United States Patent 9,328,346 (POLYCOMB-ASSOCIATED NON-CODING RNAS) - sequence listing, part 79

SEQ ID NO: 14762 - RNA, 5921 nt, Homo sapiens
aaacuacccagaacgccuuaucauggcaauaguugaaaggcauaggacuauauaaaacagauuuagaaaauaaaugggacauagaaaauucuucuaugcaugcuguugugugggguaugagacaccaugaaacaccuuguaaguauauuuucuaauuucaaauguaggugauuauguucucagagccaaaauagccagggagaaguucuuuuuuccccauggacucuucaaauuaaacucaaggggaauuuagaauuuucaaauauuaauuugaaaaaacauagccucucuguuuuggaacaucugaacaaagagucucucccaaaggaaguaauaacuaaguucuuaaagguccagaauccuuggggguuacauagauauucauauuuuaggguccucucuuccuagacuugucuuauuuacaaauuuccagugaaggaaaguuucaaauauauuuaauauauaccaacccuaauaguuucauaaaauaguguugcuauuugcagcucauauauuuccucuauuagccuuacagcaucaugaugauuauucauagaguagcuguuuucuuuucuuuuguauauguaucuugccuuuguuugcuuucguugcaugugggauauugcggggugggggagaaggcgaguuccugagccuucaguagaccagaugagaaugagguauggaauguggggaaacauucauugugcacuuucucaccuuguccuguuucugcucccaccaauucucucugacuuacucucugaugcuuaaaauucccucaacaagcaaguaggccacacugagaagaaaugauuaacugcaaauauuucaauaauuagucacauuuaauuagcacaaucuauuucaaaauaaagugcaaauaagugguucacggucuuuuauucucaggcaaaguggagaaucuagaggaaaggaaaucaggaggauaucaguuuccagagagggcagagagggagucucaaaugcuuggaaagagagaggaaggugcagaaaaacaagacugagaaccugaguuaucaucacuuauuuuacaauuuggccugagaugguccuuccccaugugcgcaucaagugguuggucagguugccuaauauuuagcccagugauuagcaauacaugcagagugaagcaaaagguauccuugacugaacuauauaaagcuuugucuccugaguagccagcauaucaaccauacugcgugacagucuccugauacacugggucccccaugccaugaaagaggaugggaguuagagaucauuaaaagaaggcuccagccccagcagggcuuggggcucuggacucugagcucaccugaagcuaaggcaaaaaugcccugauauuuguuuucauuucagguugcaucuuccauccuuggggucuucguccuaaccccaucccuggccaugauggugaguaaggauggaaagaguucaaccugucuaguccuccuuuagcagaagcauuuuaaaaggugauaauuaagggcaaccuccucaaauuuccuguggguacccguaaaaccuacaaggcaugggcaaaguaggaacucugaacuuucaacuuuucucacuguugcuugguuuucuccagaacauccguuucaaccauccuuuguauggaucuuuugggacucaaauuauccauauuggugccuuccaagguauggucagcauccgagacaacaauauuuucagugaauaggacggaauccuggacuacaagaauauaagaugagaaacacauucauuacaaugugaaagaaagccacgucugguccaaaauguagccuuaugcuuuuccagagaaagaggacauucgccuucucuagguuuagguccuugaugggcaugcacaucauuagguaagggaacagcuucccugcaguugcagugacuucuuuuugagccaaaaaauauagggggaauuccagcuggucuauagggauccuacauccccuauguuccugugagguguugacuucacacggccaccgaaggccucugaucucagaagcccccaugucuuguaacugguaugugcuguagaaguuauuuugucuugacuucugauuuuaauguuaauuuccaaagaagaagaauguuguauuuucauuuuuagaaaucugacugcaacuugcccaucacuuucaaugguaagaccuagcagaaagacacaauauugagaaggcuccaccugugugcuuggccuggcugucugauagaaaagcacuauaaccacagggacaucacucggccucugugugccucaguuuccuccucugcaaaauagcaucaauagcuaccauuccuaccuggcaggacucugaaggguuaagugaagcagaagcccacacuucuuauucuguccugcaaggcccugucccaucuggccccaccgucuuccaucuggccccacucccacccacauccaugacauucccuccagccacuccggacacuucaggaugggcaccucaggcacaggcuuucucucugcuccagucuguaucuucugugcucccuucccugaccauguuccucgcuagucaccuaacccacuccugauuuccucaaggaaauguccccugaauccugcuagagggcacacagucuacacaggcuagugauuuucaacucugcucuaugccauggagacuuuucuucaaacaaaaauauuccacgguagucuaugacguggaacagaagaagccagaacuacucuggcuggaggagggagaugcaggcgaaccuuaggcacagucagacacagcugaagaacugcugcucuacuccaggcugugagaggccagaagacaggcccagggacucauggagggggauggucaguggcagaccuagggcuagaaucugagucuagagggccuggcccaagguuccugacaaccuuguacauucagagagcacuccauaauuuucacagugcccucacaagcucucacaagcaguuaauuucucuucucaucuucacagcaacccugugggagaggggcuauuauuauuucugcuuucagaugaaaaaacagaggaucguggagcccacugaggaccaugaugguugcuaaguggcagaacaggaccugcaaucagccuuauuauuagauccaacccccuaucccucccaucccaccuguccauucauugugugcagaaugcccugagagauuccuuuccucacccacaucaggggacagugccaaaagccccgggagcaucagggcucugaacguguuaccaguccugaugcuggccuuuuuuuggugcccagaguggcacucugcuggaugcuguacaucagucagaagagcagcugugccacacugauagagaguggguguccauuaauauugugacugcaugaaugacguguuucugcuguguugcuuuaaggcccuuuugguggcuaagguauuuaacaagauggccuguguccuggccaggauggacaaggcagucuucccaaguuuggaugacauuagcaaggcccuggacaagcagguaagugaagccaguucacugugguuuccuuuuaguuugguguuuuccaccucugcauccaaccuccuaggacaaggcugugcacacagagagacuugggucacgcuuguucuucaugcccaugaaauuccaccaucauaccaaggacuccaggugcuguugauggcucauucaagucaagucauaauuuaaucaaauaaaaguucuauacagugaucucauuuugaugaauuccagaaggguuugagcuacauguuagugaauauaaauuguugaauguaaauauuagagugaaguaauagaauauucacauuccccuaccuucuuucuccucuaccuaaccccuaaacauauccacacauauucucuucaguugaaaauaagcccaggacugcugaagcucucuuccccucagcuucuuaaaugacaaaaguaguccaguaaguuaaaaaccagcgagugguccugggcaagucauugaaaucugcugucauuugcuuaaguagccugcacagcacauuuggccgacacugauauucauggcaggaguugcugacucucaggggggagaaaaagauacacuucaggucacauaaaaauaagguaacuuaccaauuuuuuaaagagaaaagcugaaaguaucccaucugauuuaacaagcaaaaacauaauauaaugcaacaaaaaaauuuaaagcauucuauauuuucauuagagaugagaaagcaucgaagaccgaaugaauuauuaaguuuaaaagguugaaaggaacggacaggaaaagucaccugaacgcacaggcagauuuuucuggaguaaugucaucaccuuguggccagacaggauauugcuguuagagacuccaagagccuguuuggguucggagcuauucuggucaauuuuaucaccccaugcacugccuccacuuacucaugggccagggucucagauccuuuuuguccugcuuccugugccacccccaaaugcugucucaucauuuugaugugccaccccuuccaggcuuuuaaguauuacccgucuacucgcggccugacuuacacuguuuuacccagcugggucaagaacuuagcacaguauggaaagcccauuaagaacaugugcagagaugaccccaccuacuuugcccagcagcaaaaagaagguguguuagcaacuuaacuagaaacccaagaccaugggugagucaaaaggcacaguaugaauuuucggucauugacaaauucuaauaacaguuguuggguuuguucuauuuauuuguuacuggauauaaaaauaauggggccuaggauguauucccccucugguuguggagaugauuuccugacagcgggacuugcugagaauggcgagcugaguuaacuuagucuuuaucaggaggcuaaguucagucaucucaucagugggauuugacaguggguagauauccucgcuugacccaaagccucaucacccccugcccaagcaacacagagcccagcaucuuaucauuagagucccauugcucugggauccccauuuuccucuucugcaagcugcccagagguuggaaggcaaaacucuaauaguuauagaccacucuggaaaaggaacaucucaguggcuggcacuccugcuaggaaugugguggcggaucaguaguaaccaccuuggaaaaccacuagacaagacuuaaagagcugcuuucuaguccagauagucaguaagcacuucccauuaggcugcugccagucacuuacaucuuaauauaaguuaacccaaugaacagggguuauucauaacaggaggauccagcaggaaaacagggagaaccugaggggcugggguucagaaggaugauuaaggaucacuuaaagaaauagaaaaaggagagaugaggccaaugauugcaggggcaggcgguaguaggaucuuucauuuuagucccagucuuuugcuagaagagcuguccugagcacuacaacuguguuaguugcaacucauaauauagccacucuauuugggggucuuaaagugcuauuuuuuaaaaauaaaaauccuucucuuucuuuuuaaagguacugcccuggcaauugacuccaauucuuguuuugaaauccaacuucuguccuuuaugggacucuucaucugcggugagacuccugggcucugaaccuccaggagggcugucuggcauguggacucaccuggccugaggccagugcuaggacccagcccucccucugccugugggaagcugcuccuuuuagucuucuaccuucugccuuuugucccaguacccagcucuguaaucugaaaaaguguguccacuuucucccucuggguuagaacaauaguuucuugccucacuggucuagcaa

SEQ ID NO: 14763 - RNA, 2933 nt, Homo sapiens
caguuuuaauuagaagaaaaugucgaaacucccaucaucuacuucaacucuaagcucuccucuuccucaccuaacggaucaagcauccaaaaauggucagaaaaacaacaagcauucccccaaaguuaucuucuuuuaaauucuuccugcuguaaggaccaugucgcaagcucuccaggugcucaggauaaaguuugcaagugaucucagccugauguagggaggguuuugauguauuuggcuuaaugaagcaacuuaagcuaggucgacccacucacauauccuaaggguucuuuggcauuguacacagggugugggcuuuagaaucagggugugugggcuguauacauggugugggcuuccauuugcuagcucuucaacuuuugaacaagcaacugaaucuuuccagaccuuaauguccucaucaguaaaaugggguugauaauaaccacaacucaaaggguuuuugcagaggaaucuagugcagagcuugacacagagugguugcaccacacacauuaauucaaccuuuauucuauucuauuuaguucaguucugugacaagcuuucauguuuaacugggucagccuaaccuagugcuuaagcauuugggcccuggaaacagaucacugguagucaaauccuggcuuuccugcugugggacuauggacaaguuucuugaccacuuugugcuucaauucuuaucuguagauggggcaaauaauagggcuuacuucauaggcuguugugaggcuuuaguagaaaagccaguacaaagugcucagaacagucacugcuagccagcaucuaagcugcacgccuugcuccauucauucuccaacucuccuagaugacucugucauacuuucuucuucaccugccacuugcuuacucuuacugacgaccuggguucccguuucauugagaaaaucaauguaacugaaagagaauguccacaagcuucccucacucuaucugcucaccuaccugcaugcaagcuguaucccugaccuuauucuugguacaaugggugaacuggcuguuaacacucucccaucccuauugcaucaucaauuucuucucucucuuugauccuuccugucagcguucaaacuuacuauuuuuuaucccauaaaaaaucucucuggaugccaccacccccuugggcuagagucccauuucucuccuucauuucugaaccaagcuuuaguaagaauugucuaacuugcaaauaucucuccucuuauucucucccgaaucccuugguugauguuuuugccccuaugacuccacaaaauauauucucaucaaggauaccuacgacuucccugucacuaaacucacaggucagggcuucaucuucaucucacgggcccaucagcagugucggacacauuugauagcucucuccaacucugagcccucuguccauggggcucccacggcccaugguuggccuggcugucugccugccuuucuggcuuuuccgugucuguuuucuugcugauuccuucucaucucucugaccucuaaauauugaaggaaaccaagacucgacuggacucuuuuuccauccacacucacaccuuggugagcucaucugucucaaggcuuuaaaugucacauauuugcagaugauuccaauguguauuuccagcccagacccccugaacuccaaaucacauggaucucugcuuagaucuauaguagccaucucaaacuaaauguauccaaacuguauauccagagaacgaggcugaaggaacaguggugaccugguguauacuccugucuucaggaaugaaaggagcacaagagagaagaaccuugcaagcgcauuuaacgccucugcgcacacccugucugcucacauuccauuggccaacacaggucacauggccaagcucaaagucagugaggccggaaguacacccaguccucagcagcaguggggagggagaagggccggagggguggaagaagggccggaguguuugcugaucaagacuccaauccaccacacucacccagucuacccagcuacccuccagccuccccagggagcuggauuccgcugaacuugacucagcuacuuggagacauugcacuacugccugccugacccaaacaccacugcucuuuuucguaucccaacuuaauuaagcgggugugagagagguagcugucuggcccggcccagcagcaucuccacgggggaauucgacaccaucuaaaauuucaguccugggaccuuuaaacugaggaauguugaaaauauuuugaaggugucauuaagaaacacgcagggaacuuccuuuacuuuucaggguagguuccugucagucuuggaaaaacucgugacccaugggggaaguuaguugugcagaugcggaaaggcaaucagauggaaagcacacuccccacaagggcccaacacagcagccuucccccaccacagagcucucucucggucagucaacuggguacugcgcucccucucucugaucuucauaaaaugaagagccaaaugccuugccuggucccaaaguuugaauuagcaucugcaguagcgcaagcaaacauuguuccaucuguuggcuuguugaaugauaagcggauuuauuaaggaccaaauuuuugcuggacauuggaagaacguucgugaacaagcagacguguuuucugcuuccccaccucaccgcccugacaccggcuguugucucuuacagucuguugggggagaagaacaauuaagugaacgauuaaauacagugugagagagcuauguuggggaaaguguagggagcuaggggggguguauaugcgaggggccuaacuggacuuggggagugaaggaaggguuccuggaagaagugucuuuuaaaguaaggcuugacaaaugaguuagggaggcaaggggguuggaaaaagga

SEQ ID NO: 14764 - RNA, 11327 nt, Homo sapiens
uuauuguauuauauucuuuuuuaaauuuaauuauauucuuuuuuaauuuguuagauacacacaaauccauguuuuuaccagucuucagagaagagucagcucuuaccauugaagccaaaucuauggugcuauuugaauccuggagacagcuuuucuuuguuaguugacaaauacauuuuccgcauucucucuauacccucugaaguggaaaugcaauguaccuuaagguaagugccugaugaaaugagaguaagaauguuauuuuuaaucuaauuccucagccaucacaaauccuucgguaggaaccaguagaaaccauuaaacuggagauagaguagguguguaauguguguguacgcaugugugugugcaugccuuugcauguguguguguuuugugcacaugcauguguguaucuguuucuagaaaacauuugacuuuggaaacuuacuaugcguugauagcaguugcucccacagguggugucuuuuaccauuguauugagaauguauuuuccaucuaacaguauucaauauaguuaauucgaaauugacuaccuuuuccucauuuuuuuagcuuuuugaauuuuauuaagguauuaacuucugacuuacacuugucuaacuccucuuucuuauaaaaauagcagaaaauauagaacagagaaacugaggaaaugagguauuagaauaaauauacugaugucuggcuuacaguuaaaauucauacacuaguuuuuuuagucagaagauuauuuggcuucauuucagcuuuuaaauuauagaauggauaaacuagacuuauagaaguagauggacagaauuaugcggaguauguucucugauagcaauaguauuaagucagaaaucauuaacaauaaaauagcuacacaaauauacaaauacuuugaaauuaaauaacacauuucuaaauuacccuugggucaaagagaagucauagggaaauuggaaaacauuuugaacagagugauacugaaaacagcauaaaaauuugugagaugcagcuaaauuagcccuuagggggaaguuuauagucgaaugccuguauuagaagagaagaaaucuguaaaaccagugaucugugcuucuacuuuaggaggauagacaaaaagcaaauuaaucccaaagaaaauagaaaaaaagaaaguaagaacuagaagucagugaaauagaaaauggccaaaauaaaaucaguaaagcuaugggcugguuuggugaaaagauuaauaaaauuggugaaacuguaguaaggcuuacugagaaaaaagugagaaaacacaaauuaucaguaucaacaguagaagaggggauaucauuacugcuacuacagaccuuagaagaauaaugaggaaauauuacguaaaacuuuaugccaauaaauuuggcaguuaaaaugaauggguacauuucuuaaaaaacaaaacugaugcaggaaaaauagaaaucugaugaauucuauauucauuuuaaaaauugaauucauaauuuaaguauuucccauaaggaucuucacuaaugaauucuauuaaacuuacaaggaagaaauaaugccaauauuauucuuuuuucucaaaaaauaaaagaagauauacuucccaacucauuuuaugaagcuucuguaauuuagaaacuaaaaucagacaagauuuuacaaaaaacccucaaaacuacagaccaauauuccucauaauaaaguauuuacaaaucaaauccagcaauauguaaaaaggauaauacucuauuaccaaguggggcuuguccaagggauacaagguuaguuuaucguauaaaaaucgaagcaauucaccauaacagacuaaagaacuaucauuuuaauagaugcucaaaaauaauuuugacaaaauucaacaccucuucaugauuuuuaaaaguuuugagaaaacaagaaaaagaaggaaacuuuuuuccuacaaaaaaccuauuagugaaauguugaaaguucuuccccuaagauugggaauacaacaaagauaaaauauaucagauuugaaaggaagaaguaaaacuguguuuauuugcagaugacaugauuuguauuuagaaaauccuuaguaaucuaccaaaaagaaaagcaagccacaaaagugucuauuauaugauuacauuuauauuaaguucuguaauaaguaaacuaaucuguuaaauagaaauguaaucaaugguuguuuccaaggggauugacuaguaagaagcuacaaaggagcuuuuuguuuggcuuuguuucagcuuuuaaacaaauauggacauauucugugucuuguuaagggugcagauuauguggguguacgcauuugucaaaacuaaucaaauuucacacuucagauaugugcauuucauauauaaauuauaucuaaaaaugcuuaaauguaaguggaaaaaaaugucaggaaguugcuuuuuaguuaaaugaaauucauuaaucauugcuuacuacuuuaaaguacaugucuuuuucucuuaucauacauguaugaagcgugcuauuuaaacuagcuguugaaaugagacauguaaagaacugauuuuuuuguuacaauaaacuuucauaauagaauuacauacuuuuuucaaaaauuaggaaaaugugcauccuuaugaaacacaauauggucauuaccugauaacuuauuuaagcuauuauaugucuauuuaaauuucauuuauauugauucaaauuagcuuauucccuuagugugaaagaccagugucuuuagggcaagugucacacuuuaaauuuaucagguuaugggauuagugaauuuugaauuuuuucguauugaugaaacugaaaauaaacccacuuucacagcacuguacuuuucucaggcuauuuaaaccuuggguucugucauuugcuagaagggcucacagaacucaggaacaguuuacuuacuagauuacggauuuauuacaagugcuauauuacaggauacaaauuaacagccagaugagaagauacauagggugaggucuggaaggauccccagcacaggagcuucuguuccaguggaguguugggguacaccacucucccagcacauggacauguucuuguucaccaaccuggaaguccucugaacuuugucuuuuuggguuuuuauggaggcuucauuacaaaggcaugauugaguaaaucauugaccaguaugauuaagucaaucuccagccccuuuucccucccugguggugaggcugggaguuccuacccucuaaucaugauugguuuuccuaacaaccagcccuucaucuuuagaggcuuuccaaaagucaccucauuaacauacauucaggugugguugaaagggguauauugugaauaacaaaagacgcuccuuucaccuguuucagagcucuagccaggaaccagaagugaagaccaaaauauguauuucuuacuauaucauaccaucacaggcacauucuugugguuucugccauuagcuagguccuguagcuucuuagugaauauuuaguuuccuauugaagcaaggacaguacuucuguagucagguaaugaugaguuaacccuaguuauuagauuagaagccaugaggggaggugggggcagaucuugaauugcaguaucaucaugagagaugucuacccgggggaggcagcugccugauuuccagagagggagaguccacugucugcuagcaaggggaaguggacuauguauuagauaggaagcauugaaauacacuucuagacguuucuugauaucguugggguuuuccuguuuuugaacuagcucuguuuugcagggucaaccacauaaaaacacugcuuacuguuguacaagcuuuacauguaugaacuuuuuauucuccauaauaaucucuaugaggacuagguauuguuaauaucccuauaugacagaugaagaaauugggacacagaagguuuaagacuugcccaaggucacagcuuaauacauggcagaggugggauccaaacucaagccagcuguuuccagaguugaugcucuuacuaacuacccucugcuguaugagaauguuuacuauagcacucauuugaauugugaaaacaccugcagaaaggcuaaauaaauuugguguaguccuauaacuauaugaaagagaaugaacuaagagagagcucagguuaaaacauggauaaaucucccuaccauaauguugagggaaaaaacccaaaaagguuauaaacauauaaaacauacauaauuucuauaaaauaauggaugcauauauacaaauaaugaaaguauaaagacaugcauaggaauaauaaauaucaaauucaggcuaauguuuacuuuuggagaaggaaugggagggaaggagcaagauugaggcugggcauggagagggcuugaauuguauuuguaauuaaucuggagcaaauaugagaaaauguuucuaucggggugguagauacacaaguauuuauauucauagauauguagauagacuacauauauucucuauauauuuuugcauguugaaauauuuaagacauuaaaaaagaauagaaaaaagcuuauaugcuuuguagaaguuguuaggacuccuuugccauaauucuuuucuuccagccaguuugaauuuaagaaagggaucugaaccacaaaccaaccauagaagagcuugucauuucuuuagguuuuccuuuuacucacauuaaaauguuuuuuauauaguauuuagauucuguauaauuaguccuacucauuaccuacuuugaaggaacauuuaagucuauagaugucaguucuaguuuguucauuuuucacucuuuucucuacauaugugucuaugaaauuauucugccaggaguaccaaaacucaugcuuuuuugagaagucaaagagaaaaccaaauaaggagaagaauacuugguuuuauauuuuaguaaauuaaauuauagcacauuucacuuagaagcacuaauauuaauucuuccuccccaauagugggugcuuaauaaguguugguuuuuugaaugcauuaaugaaauaucugaggauauuaaacugagugauaaugugauaaguauaacauuuuguuuucauagcugaauuucauugcugaugaggaaguaugacauuuucacucuagggagauuauuuauuuucagacacuuaugaggaaaguaaaguaaauccuuuguuauacugaauuacuuuuuuuucaaauuguugaaaaucuaaguauguagauuccauauaaauaacuacuaauuuuaaucauugauauugaagaaacaauaaaauggugaugaaaaugucaugauaguaugauaauaugcaaguuucaaauucauuuauaauuauuuaaaauguaguuuuagauccagcucauucauaauaguagcauauuuuauauuaaagauaugaaaauacauaacauaaacaaaauuuggaauauauuugaaagacuuaagaauaacuuaauugccaaaacaaucuuagaaaaaaagaaaagaguuggaggguucacacuucuggauuucaaaaccuacuaugaagcuacaguaaucaggacaguccugguguaaagaaagacauauagaucaaggaaauagaauugaggguccagaaguaaaccccuacauuuagggucaguugguuuuugacaaaggugucaagacaauuaaaugggggaaagaauggucuuuucaacaaaugaugcugggacaauugaauauccacaugcaaaagaaugaaguuagucuccugcugcacaccauauaaaaauuaacuuacaauggaucagaagucuaaauauaagcacuaaaacuacaaaacucuuagaaaaaaacagguguaaaucuuugugaccuugcauuaggcaauguuuauaacaccagaaacacaagcaaacaaaggaaaaguagauaaaugggacuucauuacacuuaaaaguucugugcuucuaaggacacaguuaagaaagugaaaagauuuagugccauccccaucaagcuaccaaugacuuucuucacagaauuggaaaaaacuacuuuaaaguucauauggaaacaaaaaagagcccacauugccaagacaauccuaagccaaaagaacaaagcuggaggcaucacucuaccugacuucaaacuauacuacaagccuacaguaaccaaaacagcaugguacugguaccaaaacagagguauagaccaauggaacagaacagagcccucagaaauaacaccacacaucuacaaccaucugaucuuugacaaaccugacaaaaacaagaaauggggaaaggauucccuauuuaauaaauggugcugggaaaacuggcuagccauauguagaaagcugaaacuggaucccuuccuuacaccuuauacaaaaauuaauucgagauggauuaaagacuuaaauguuagaccuaaaaccauaaaaacccuagaagaaaaccuaggcaauaccauucaggacauaggcauaagcaaggacuuaaugucuaaaacaccaaaagcaaugguaacaaaagccaaaauugacaaaugggaucucauuaaacuaaagagcuucugcacagcaaaagaaacuaccaucagagugaacaggcaaccuacagaaugggagaaaauuuuugcaaucugcucaucugacaaagggcuaauauccagaaucuacaaagaacucaaucaaauuuauaagaaaaaaacaaccccaucaaaaagugggugaaagauaugaacagacacuucucaaaacaagacauuuaugcagccaacagacacaugaaaaaaugcucaucaucacuggccaucagagaaaugcaagucaaaaccacaaugagauaccaucucacaccaguuagaauggugaucauuaaaaagucaggaaacaacaggugcuggagaggguguggagaaauaggaacacuuuuacacuguuggugggacuguaaacuaguucaaccacuguggaagacaauguggcgauuccucagggaucuagaacuagaaauaccauuugacccagccaucccauuacuggguauauacucaaaggaauauaacucaugcugcuauaaacacacaugcacacguauguuuauugcagcacuauucacaauagcaaagacuuggaaccaacccaaauguccaucaaugauagacuggguuaagaaaaugugacauguauacaccauggaauacuaugcagccauaaaaaaggaugaguucauguccuuuguagggacauggaugaagcuggaaaccaucauucucagcaaacuaucgcaaggacaaaaaaccaaacacugcauguucucacucauaggugggaauugaacaaugagaacacuuggacacaggaaggggaacaucacacaccagggccuguuguggaguggggggaggggggagggauagcauuaggagauacaccuaauguaaaugacgaguuaaugggugcagcacaccaacauggcacauguauacauauguaacaaaccugcauguugcgcacauguacccuagaacuuaaaguauaauaaaaaaauaauaauauacaaaaaaagaaagugaaaagacaaccacagaaugagaaaauauuuguaaaucacauauaacagacuuauauucagaauaucuaaagaauccucaacaaugcaaaggcaaacaacccaauuuuaaaaugcauaacugauuugaauagacauuuuuccaaagaagguguacagguggucaguagaacaugaaaaaauguucaacaucacuagucacagggaaaugcaaauuaacaccgcaaugagauaccacuuuacaucuacuaggaaagcuauaaucaaaaauauaauaacaaguguuggugagguugugaagaaacugaacuauuauacauuguggugggauuauaaaaugguauagccucuuuggaacauauucuggcaguuccucaaaaguuuaaacauggaauuacuguguggcucagcauuuccacuccuauguauauacccaaaagaauugaaaaccuauguccacaucaaaacuuguacauagauguucacagcagcauuauucauaauagccaaaaaguggaaauaacucagcuguccagcaacuguugaauagauaaacaaguauuguauagucauacaguagaauauuauuuggccauaaagaggaaugaaauauuuacauaugcuacaacacaggugaaucuugaaacauuaugcuaaguaaaaaagcuagacacgaaagaccacauacuguauuucauuuauaugaaauauguagaaaaugugaucuuuggagacagaagguagauuaaugguugcgaggagcaggaggaagaggcaauaggaagagauugcuaaugcauauggaauuucuuuuugagguguugaauauguucuaaaauuagauauuggugauaguugcacaacucuguuaacauacuaauaaccacuggauaguacacuuuaacaggaugaaucuuaugacuauauggauuauuuuucaauaaagcaguuauaaaaaaggauaacucaauuaccuuuacuagacuacauuuaacuuuccaaguuuuaauuuuuuauuuaaaauauucuguagugaugcuuuauaaauccugugauaguugauuacucauagauguauuugaagauaaaauaaaaauauauaucacagugacaguguuuuauauuuaaauaaauguguaguagaauaauuuguacuuguacuuuuugaauaaaauguuaaauagaauuuuguucugaaauuuuuuuuguuacguuuauuguggguaacuauuaauaaaaauuacauauggacuauagaguguauaugaauucaucucagacuuaugccacaauagaaaauaaacuagaaauggaauugaugauguuacuuaauuccuaauacuauaaauugugaaaaaucaucaaacuacuauugaauguuucuuaauauuuuucauguuaaauauuaagaaaacuugaaaaaaauuauaauuuggaaguacaccuguaaccugugaguaaaacaggacuggguauuguaguggagugaacuuucauagcuaggacaaucagacauuuccaagauaugucuccagcaccuggcacaguguuugacacacaguagaaguuuuaaaaauauugauugaaugaacaaaaaaugugaugcugcauaguaauuuacucuaaguaaauuuucucuuuuggcugauucuugccauugacauugaaggcugccuuugaaggagauuauucccuguauaagaaauacuaaaacgaacaaauaaaacaagcgguuaauuagacuuuucucagcuagacacacuucuaaaaucuuauaucuuuaguuuuuaaaaauucacauuuaaugaggacaauuuacacacaguagaguucaucccuuuuaaaugugcaauucaaugcacuaaaaaugauaauauagucauuuaaaauacuacuagagugagauauagaacauuuccauuuccccaaauguucucuccuggcucuuuguagucugucccuucacuccacccccaaucccuggcaaccauuaauaugauuucugucccuguaacuuuaccuuucaggaugucauauaaauggaguaauacaauauaccuuuugugucuggcuucuuucacuuagcaaaaugccuuugggauucaucuauauucuugcacacaucaguaguucauuccuuguuauuucugaguaguguuucaucuauaguuucaaauuuucgaaaagacaaauucguuggaucaugucuaugcauacauaaguauuaauaacccaacaacuuuggaugaccuuacugcauauugcagaaguaugagguaauugguucugcuggcaugucccacaugugaccauggauguuccuguuccagaacauuuagcuugcagcuauacuacaaguuuggggauauuucauaaguagcucuuuaauacuucccugaacuucaguagcaguuaugugucaacuuaaacucaggauuuuauuuauuuuuucuccaaacgucuaacuagcuuagcugaugcccuugcaguuuacauuaucucucuagaggcuggguggugaucuuaauuucuguggaccaucuggacaaauauuaaauaaagagcucuuaagccuugacagaaauggcugccacacaucucaaaaauaauugugguuucuaggcccaugauuuggaaagauugauguauuuuauggcaauacagcagguaggaaauaaagaacauauucuagucuauauauucuaguauacuauaaucugcuuuuuuugguuuugcuaagucugaguaaagggacauaacuuagauguaguucuaaggcagcagaaguguguuaaauuuaaaauuaaagaccaguuucuauuuuaucuuauagaaacagucaagugcuugaugaagauaauauauugaaugaaacaccaaaaucccccgugauuaauuuaccucaugagacuacuggugccucacaacuggaaggaagcacagaaauagccaagacccagaugacucccacaaauaguguggugagaaauuugauaucucauccauuuauaacauguucuucaaguuauuaugaaggcagaaaagacaacugaaauuaggccuauuaugacaauauugccagcauuuaucuacuuuugcugauuuuaaguuaagcucuagagaauauggcaguaauccaacaguuaaacuaauagaaauaauuucuuuguucaagaaauuuuaugaacucagucuacaguugcauauggguauuuuaaugguaguauucugcaaagcagauauuuugcaaauucauucaagaugugugauuauuuuuaguaauuuauaggugucuuuuuagucuuuccuaggugaaaauagagacugcaauaagcagcagccaauccuugccgagaggaaaagaauccuuccaacuuggauguuagcagaacauuuaagugaucaaaaccuuucaguaccagcaaucaguggagguagguuuuuguuucuacuaaugcugacuuuaaaggaaacauuaaacagaauuugaaagcuuuucugaagaaaaacuauaaacuaguucuauagagauagaguagagguuguguaaguguauagccuagccuaguuuuuuuaguugugaacaugaagucuaaaacauaggcuauuacuuuaugccauuuaucaaauaccacccuaauuuuuuuucauuuaacaagugcuauuaugugcuagaauuauauuaauaaagacuuccaaacaaaccucuuggugcuaugucuaggauaaaaggccagcacaauaagaggguuuaauu

SEQ ID NO: 14765 - RNA, 7144 nt, Homo sapiens
caugaguucuuuauucugaccaugccugccuggaggucagugggggaucucaacuauacagaugaaagccaaucagcuaggggaaguagacaaggcucagauguugagagguguucuguuccacacuaaaugugaauccuccacaccugaggguaagcccaagauccucaauguaagcucagauguacauaaaggagaacaacuguagcauccuuaccucuggggaacacuuuaugauugcugcuuaucaaggcagcuaccaacagaagggaaagccaugguuuaggcuuccagcacauauuaacuuuaggaaacggcuucucccaucaaaggggacaauaauaugucccuuacagggcuacugcacagucauuuccucucaaugcacuauuuacauugucaggaacuaugauuaugcccccagcuguuucugauuccuacuuggaaauaaauccaagauugcuauuagcccuuccaccccaaccugucugcccccauuucuaggagccaagaaagagauucacguacucacaggauuaccucucagccaugguggagccccuggacuugaaggaagaggagaagaaagcccagaagaaaucccgccaggccuggcucacagccaggggauuccaagugacaggucuucagagcgacaccgaaagcagcuuucaggaucucaagcugccacccaucaaagagcugaaugagguccacagggaagagcagggucucaggugggguguccauagggaccuuucuccuccugauuuacuuacucccccaauuuaggaguggaaggaaaacucccuguuugcuaauguacuggagccuguguuggaucgagacagguggagcugggacaggcaccacguggacuuugaucuguacaagaaaccaccaccuuuccucgagcugcucccuucgcccgcaccaaagccuguaacagguaacaggcaaggguuugccaagcugggccuccugaugccgugggcaggcaggagcucugugccacucugcaucuucagugguauccauuuuguuuacacuaucaaccaaacuuucuaugcuaagaaaagcaagaugcagaaugggucugaaaaaagagauugaaugcugggcuggaacucagaccaggauucuagccccaagugugacauuugugugacuugaggcaaaucccuucaugcccugggucugguuucuuggcuauaaaguggggaaguuggaagacaggucuaaaggcuuccugagcuucaacacuauuacccaugacugaucucuagguguccagccaagagcugggggcagaggcucugggcuucacugggaccuuccagcggcaaagauacugacaguucuuucuuugggguaaggcagagacaggaaacguaggucuugcuguaccagucccuccaaguccucuuccucuuuaucccuguuuaugaaaauugaucucaggaucaucuggagguuaacauagaacccaaacuugguuaacagagccagaaccuuuguucagggagaaagagacaugagccuaucuaaaaacaaggucugccagagaaacuucucccagaaaacuaggucaggugaacgugauggcuuccucuccuccucgacuccuaaggacaacugaucacagcuccauggaagugcuaacaaguuugcugaaaugucacuuucuccauuugccuagacuuggcucccucccuccccaguaggcccuagaucucccagguugccugaagagaccugcucucugugggcaugucccaggcccacaguuacugcuguggcucucaaggaggcuccagcuaggagagcugucuagccuaagaacacaaggcuuuuccuugguaagaaggcuuccuagugagcuccacugccagccuucccagcaaaagucuccuggggguuucacuggugaaaucacuuaagaaacacuugcuggggucuccucuucccacaacauguuuaagaaaaguuagcaacuacagaugagagggagaggcuugaacuggucgcuaggccuuuucaacccagauggaugaauggagaacuugccauucuccauuggcauguaagacugaggccuuacacgccaccagccuagagugaagcccccuuccagaaggcugcacagaaggggggugggucugacagccccuccccaaacuucuccugugcaaagaaacucuaagcagccuucuguccagagguaugcaugcuucauuuugugcaaaaugcugcccugcuaucacuaacagaacuucagguuucacugagagguuauuuacacggucacaauauuuacaaacuuuccccauuuuaaaaacuaguuaccaaaccccuggcagaaugcucaggccagccccacucagccagcucagcucuccaaguucccagucuccuccuugccuauuuccagcaucacaguaaauugggaauauacuuggaggaaaaagagucggcugccuucucugugcucaagggaguguccacaauaggcauuuuagagcuccagaccacccaaggaccacaucaaagcuuaaaguucaccacagugagcacgcugggaccugguguaaucuuucaagugccagcagaagggaggcuggagaaaugcaaaggccugcuggccuggagauaccauucauccucuccucaagaguagaagccaguucuuguaaagaaacuaaagucccuaggugggaacaucaucagcugagacagccuccccaucaucuccugagaaggauaaaaacuaagggcucauaaccccaagggauuguggccugcacugugugucugcuccuuagcauucugggcccuccuugcagggugaggacaaaggggacccgaggccaucaccaaagggugguucucaggguccugcugucacccauuaaaggcugguucuaaggaacagugugacaaguacagcaaaggcuaacaguacacagauugugacauuuuauauucuuuguuaaaugguuccugguacauguuuuaagugccucugcuucuaguuuaaaugaaugacccagacagagcuuucaagcuguuucuuagagaaugugugguugagcagaaauggcuauccacaccugacacagguccccacccaccucacacccuggaggcagcagcauaagccccaguuuccacuauggugucuccucaaugaccagaauacccgccaguuccaggggucagcaauuccauucucucucuccggcucaguucagaagcugugaugguccuguuagagagcacugccugcaggucaaaaccuggaagaggcucucccaggccaggcgacaacccuucaggugcagacggggaacaaaaggcuuaaccugugauaaucccaacaccuucugaaaaaagaguaacagucauccagcaacgggccauggguaggggcgggcgguagcaggggacacuguccccugccucagcauguccuguccagagggugggcacagauauaggcucgcuucucaaggaucugcugggacacuuucuuaaucugcucaucuagguuuucuggagcaucugggaaggaaaaggagagauggugggugaucuuucugcaccgugauaagacaaacauggcugaagugggggcauuuuuccacaaagucagcccacccaccaugaagcagcccuaagggugaaccccuccuccagacccccagcaagugauucagggcugcagggagagaaagggguacagcuucauucucaguuacaaaggacucauccugcucaucucuaacccccagaucucaugggguggagccggcacuugcuccguaaacagcccaucugugauuccagcccacuggaggagaaaccauuucagcacccuccacagcacauaaccugucagcacugggggggugucugggcuacccccagggcuaggaccugcaaaaaaucauaugccacucucagcaagugccacagugcuggcgccuacacccaucacuuggcaacacgacugggcuuuguggggacacugauccagaaccucaggucaacaggacugugagggucagagguagacugagcugggcauuccuagauauggucgaguggcuauagaagaggaagagcacugcagacagagcggggagcacgagcaaagcccucuguucucuaggccaaggccugagaccucugcagggcacugcagggucauuuuggauggaguacaguggguaaaggggcagguaaaaugcugucuccagaaucagguacaaccagaugcuccucccuucgugagccuuccccgggcagcuucaagaauacagccagggcugggcacaguggcucaugccuguaaucccagcacuuugggaggccaaggugggcggaucaccugaggucagggguuggagaccagcuuggccaacauggugaaacccuguuuguuucuacuaaaaauacaaauauuagcugggcaugguggugcgugccuauaaucccaacuacucaggaggcugaggcacaggaguugcuugaacccaggagguggagguugcagugagccaagaucaugccacugcacuccagccagccugggugacaaagugagacuaugucuccaaaaaaaagagaauacagccaggcaugcugggcagaugccagggguccugcgcaaagggcucugcacuugcucaaucuaaaauugccuuggcaggcccggugcgguggcucaugccuguaaucccagcauuuuuggaggcugaggcaggcagaucaccugaggucaggaguuggagaccagccuggcuaacauggugaaacccuguuucuacuaaaaauacaaaaaauuagccgggcgugguggcgugcgccuguaaucccagcuacucgggaggcuggggcagaagaaucgcuugaacccaagagguggaguuugcagggagccaagacugcgccauuacacuccagcuugggcaacaagagcgaaacuccaucucgaaauaaauacauacauacauacauacacacacacacauauauacauacaacugccuuggugaauggggcagguaugcaccuacagugccuggugggcacugcugcagcuaagcccaggccuacccaggcccucgcucaaggcagaggucugugaguagcuagcaggcucugggagcuugacaggguccagaaacagcucaccaucaauaggggccuagaagugggcccuuccuucccucccccaagacaugccacucacacuuguccagcugagagaggcugaagagauucugcaaguaagcuuccacgcagaagguguuggccaagagaaccugccagaaccgaggacagaaaagauaugcccaaauuccuggaaucagaccucugagcuucaaaaacccagccuaucagccaaacuggguagcauggcaggggucacaaggccuggcacaggagucaccccgucuuggguucuaauuccagcccugauccaacagccuuuccccaacagcaagugacucaacaucucugacccuguuuccucugaaaggcagaugucacaauccugguaucugcaggugcucuggaaagugcaggcagagauccugguauacaguggguccucagagacugcacccgccucccuccagcacagcgggcaaugugcagggucugucccuugcuggggguaggggcacugggaucaggaaccccugucacucacccccucuucucucagucaggaagaagaaagggaacagccccaucuccugagcagcacagacccucccacggccaccgcauggugaaccugcacagccucccccacacccgaccacacccuccucaacaaucaacuucauuaaagugcagcaggacagauggcagcagccaggcccugugugaggcugggcugggcucaccucguggucgugguugcggagcccaaugcggauggagcggcuggcccgcgacagcacggccgucaugccauacagguugaugaggauguuggccacccgcuucaguaccagcugcuccuccaugauggucugggaucacagaggcuccaaguggggacucacuaccuagaccagucccccacauggucccucccugggcugcaucuuugccugucuuagucuccuguguuccuugagaaaguggagucaauaacaccuuucucuucagguugugggagaacggcucccagccaccuucuguuuucccuucucuuugagcucuagauucagggagggguuaaggcaagaccaggucccagaagcuuggcugagaccagaagccagugcuuacugugcuacugccaccuucagcagcaagggccccaccaaucaggucccuagauucaggccccagguggagcugcccucccgauucuagggagccucucuaccugaaaggugcacagaaaaacacugcagaaaacucacccagcaaggguacccauccgaguagcuaagugggccccaggcugacaaagucagccugaccucaccaccccaucccuccagggugaucaacauuucuguucuaggccuggucccaaaggaugcuugacaaaaaguagucucaugaaugcuggccaaauuggaggaccgcuugcgacccaggccugggagggccugguuaccuugccaaagcggagcagcagugucuccacgguccggccgaagcaguagguguucuccucaaacuuguuggcacuguccuauuaaccaagacaggacucaguucagcaccucaucccuacagugcccuguccugucucacagcccggguaccaggcagagaugccccaucugggggaagcaauccagggugucauggacuagcugguguuccccaacuuccccuggagaagcccagaccccccacagugagaucuuuucugccacaaggagaucuggcaggagggcauugaaauaggggguaugccuguuaggcccacucaccgcaagacuggggugcacaacuccaugguugccugucagccccagguccacaguucggcccagggagucccgaagccuccggccaacgguauccaugacugugcucacuuuggccuguuuaagcucacugcagaaaguccaugguccugugacuggaggccucgcugcuggcgcuc

SEQ ID NO: 14766 - RNA, 1696 nt, Homo sapiens
uauaauuaaaaacaaaccuaaaagaauauguccaaaaugcuuggggagaagccucuaacuccuucccagcagauauguacucugggcaaagccuucaagaacaaguacgaauuugccaaauggacaacgugcugauucugggauacuguggcagaggagacagaaugcuaucgcuuuucaaacggcaagauuuuacauuuaaacucacagaguuauccacaaggcaagauucugucucugucauagcuaggaacagcugaagagucugccucuugcuccaacauggcuggguaccguggcuggauaaccguucccggugcagguaacagguggacaauaucacaauaucacugcaccccucucgugaaaaagaaagggaacacagucuagcacucaccagagaagcagguuuuucuucaucuuccagaaauguguucuaaaacaccagaaaaaaacaucagccaaucaucgaccuguuaaccuaaccccagcucaagagauggaacucggaucccauugccaagucagcaccggcaggcacaaagguggcagggccgggagacaccacuuucccgagaguccuauccccacccccaacagggaucgggagagagcaguuagcacagggcucgucucagaugggcuucucaccagcggggugccccuaaccuagaccccuugccucuccaagccuguuucccucucuuucccaguuacuacuuggggcucuuugcacggucuaugguggcacaagaaguggguucggaaacccaguagcugaauugaagcggaggggaggcuuuuccgcaccuacggcuacagggcggcgagagcaggcuugccaggcaacccucgaaaggccuuccgggaagagggggaagagugacgcuugggugugggggcacauccccagcaaccggacgaggccgccacccccaaggcccuccugggcuucggaucccgcgccaaccccucgcccaggucucggagcgaacucuccgcgccaggcgggcggggcggagggaggagggaguugagaguggacggccgggagugggaggaaaagcgcagacgccaggaacgccccgugagugaggagaggagagcgugggagucacgcggagaagccagacccagacgccgaccgggcacugguggcgcugccggggucccggggguuccuggacccccuaccccaggccccuccaaagcaacugggguaaaccagacgcacugugaggccagcgcagcugcuggacacgguccccggcgccgcuccaaccagaccgcgaccgcuaagccccuccuuucgagaaacucuggggccgccccuggaaguggcggggcgaagggaccggaggagggaccggaggagcgaggcgcgcggcgcagcgauggagccggucagcacgggcgcggaggccggcauggagggcgcgggaggugacccguaccggcgaccugcgcggcgcacgcaguggcugcugagcgcccuggcgcaccacuacgggcuggaccgcggcguggagaacgagaucguggugcuggccaccggccuggaccaguaccugcaggaggucuuccaccaccuggacugccgcggcgccggccgucugccccgcgccgacuuccgagcgcucugcgcugugcuggggcugcgcgcggagggggccaccacggccgggcaggcagcagg

SEQ ID NO: 14767 - RNA, 1696 nt, Homo sapiens
ccugcugccugcccggccgugguggcccccuccgcgcgcagccccagcacagcgcagagcgcucggaagucggcgcggggcagacggccggcgccgcggcaguccaggugguggaagaccuccugcagguacugguccaggccgguggccagcaccacgaucucguucuccacgccgcgguccagcccguaguggugcgccagggcgcucagcagccacugcgugcgccgcgcaggucgccgguacgggucaccucccgcgcccuccaugccggccuccgcgcccgugcugaccggcuccaucgcugcgccgcgcgccucgcuccuccggucccuccuccggucccuucgccccgccacuuccaggggcggccccagaguuucucgaaaggaggggcuuagcggucgcggucugguuggagcggcgccggggaccguguccagcagcugcgcuggccucacagugcgucugguuuaccccaguugcuuuggaggggccugggguaggggguccaggaacccccgggaccccggcagcgccaccagugcccggucggcgucugggucuggcuucuccgcgugacucccacgcucuccucuccucacucacggggcguuccuggcgucugcgcuuuuccucccacucccggccguccacucucaacucccuccucccuccgccccgcccgccuggcgcggagaguucgcuccgagaccugggcgagggguuggcgcgggauccgaagcccaggagggccuuggggguggcggccucguccgguugcuggggaugugcccccacacccaagcgucacucuucccccucuucccggaaggccuuucgaggguugccuggcaagccugcucucgccgcccuguagccguaggugcggaaaagccuccccuccgcuucaauucagcuacuggguuuccgaacccacuucuugugccaccauagaccgugcaaagagccccaaguaguaacugggaaagagagggaaacaggcuuggagaggcaaggggucuagguuaggggcaccccgcuggugagaagcccaucugagacgagcccugugcuaacugcucucucccgaucccuguuggggguggggauaggacucucgggaaaguggugucucccggcccugccaccuuugugccugccggugcugacuuggcaaugggauccgaguuccaucucuugagcugggguuagguuaacaggucgaugauuggcugauguuuuuuucugguguuuuagaacacauuucuggaagaugaagaaaaaccugcuucucuggugagugcuagacuguguucccuuucuuuuucacgagaggggugcagugauauugugauauuguccaccuguuaccugcaccgggaacgguuauccagccacgguacccagccauguuggagcaagaggcagacucuucagcuguuccuagcuaugacagagacagaaucuugccuuguggauaacucugugaguuuaaauguaaaaucuugccguuugaaaagcgauagcauucugucuccucugccacaguaucccagaaucagcacguuguccauuuggcaaauucguacuuguucuugaaggcuuugcccagaguacauaucugcugggaaggaguuagaggcuucuccccaagcauuuuggacauauucuuuuagguuuguuuuuaauuaua

SEQ ID NO: 14768 - RNA, 14624 nt, Homo sapiens
aacagauuacaaagugaauuuucuauagcuuugcaaaaguaucuaaaucccauacauccuuuuaacagcaauuuucauuauugaagacaugacuuaaguacaaaaagaaaaguccaaacugucagcuuucaguccuccacauuccccucuuuaauaugguauuuugcacuauauacauuaaugaaaauuugaaacaaacaaaaagaacuuuagucaaacuccccuuccuccuccagcuuuauuggaauaguuuaaaauuacauuucuauuuucuaggacuucaguugcucuuuccaucugacuuuuaaaaacugauuacagcaaaugaaacacaguugucuaagugauauaguauacaaaaauaacaucuugauuucugugaaaaugcauuucucugcaauuccugaauagcuccaaauuaugcuaacucugagcauugauguuuacucuggguuuuagauuuagucuuugaaaauaauguguucuaaaccuuugccaucaccaucuauguguccaacaucaacacugugaugaaguuguuccuguuuaggcuuuuauuccgauuucucucgaacagccauuaacacgcauguuuaucuuuuuguuuacucccacucaacuguauguucuauguagggccugauacagauguuacuugauguuauuuaauagcuacugaggucagacaauccaagaccaucauuauacuaaaauuaaaguuauuuauggaaguucauagacacuuccagaauugguuuuaccuccuacaugggaacauguucaaggaacccaggacgggcuuacuggucugacucaacucuucccauucaucaaucccuauucaccaguggcacggaaaggggguucuuuaacaaagcauuauacauaacaccucuaccaaacuaaacauaaacuuuuuuuguaguuaaaugcagaaagucgguuuuuuuccaccccuuuccuccuuuuacacggcaaguaaagcucacuggccugggaguugccucuaucugccaaccuuuggccagugaagaggauucagagaaaauaauacaaccaucaaucagaaaaaggaggggcgacaaaggaaaauaauuaggcuguagccucaauugugcauucccgugcaaggugcccugacucgccacagcgguaacaguugacuucacuugucuugcugcaguugauggcuacaugaccaguuucaccacaccuaaaaaagaaauuaaaaguuuucacaaugggccucagaaaaaaacugucuaccaaagcaacagucaccaugcagaacaaaacgccugaucuuuguuuucaugcaauuaaccccuaagguuucacagauauguacacaacaacauuuaucaaauuauacacuuacaugucacaaacaggcaaagauuucugguuacaugauaaaagauuuauguauauuacagagcuuucuaugaagucucuggaaguuucaaauuauaacacucuuacuuuuauauauuaaaaaaguccaguugugaaaacugcccagguaccauaagccacaggauaucagggcagaauacagaauuauauacagauagacugccaguuacauaugcugaaaauuggucuuaucuggucacagcuaaguuucacugaauuuacuaaggcccuuccauuuauagcuaauucaucucuggaagaaucucugcaaugaguuuucuucuaacaacauucugacaccuuaccuauagcacuucacuuuggugcagucuuuuugaauguguccgaauucuccacaagaauagcauuucugcucaucugcauggucgcagucacgagccagauggccugguuugccacaguuguagcagcauugcucucgcucucucuugggcuccuugcaguccuuggcaauguggccaccucuaccgcaguuauagcaggcuucaacaauaaggaaaagaaacaggccaagacuauaaaaccuuuacaaaguguuacguuuuaaauuauacaauacaaaaccucaaagguggaaaugcuauacacaguugcaugugcucaccucuccaagcucuagagggguaugaaaaggaaguguuaaauacuuaccauccuccugaagaucacaauccuuggcaagaugaccagacucaccacagcgauaacaaaugucuggaagagacgaggaaacaaacuggaaaccuguuuugagcaaaaacaaagaauucggcuagucagaccagucuugauacuaacaaauacugaaguacuucaaauuuuucuauucgacaaaauaccucuauccgagguaaaaccaccucugccacggcuucucauuccacgaccacggccuccaccaguaggacauucccgggcccaguggccagaucguccacacuugaagcacucauugcugcucauggcugcagucagaucuuugaaauauuaaaaguaacagcauuaaaccacugaaaguucuuuuaacuuuuauucucuauuaaauguauuuuuggaaaauuauucuggggaaaaaagcuagcuaauauauugguuaaaaaaauagcugggcaugguggcucacgccaguaaucccaucacuuugggaggccgagguggguggaucaugagaucgagaccaucuuggcuaacauggugaaaccccgucucuacgaaaaauacaaaaaauuagcccggugaaguggcaggcgccuguaaucccagcuacuugggaggcugaggcaggagaauggugugaacccaggaggcggagcuuacagugagcugagauggugccacuguacuccagccugggcaacauugagacucugucucaaaaaaauaaaauaaucacacaacuacaugauuggguauuauagacuuauuauaauauacaccuugauaaaagugauggaauuuacaggguuagggucaaugaaaauccauuaagagaaauaauugguaguggcugggcacgguggcucaugccuguaauccuagcacuuugggaggcugaagcggguggaccaucugaggucaggaguuugagaccagucuggccaacauggcgaaaccccgucucuacuaaaaauacaaaaaacagccgggcauggcggcaugcgccuguaaucccagcuacucaggaggcugaggcagaagaaucgcuugaacccgggggguggagguugcagugagccgagaucauaccacugcacuccagccuaggggacaaagugagacagacaggcaggcaggcaggcaggcaggcaggcagacaggcagacaggcagccaggcaggcaggcaggcaggcaggcaggcaggcagacagacagacagacagacagacagacagacagacagacacacacacacacacacacacacacacacacacacacuggcaguaauacucauucacucauuccaaguccaacuuaauggacacauuugcaugguuauaaggccuauauaagcuuuauuuugggcaaauagaagucauuuauuuacucacaucaaaaaauuggaauaacccaaaccaaugaagcuguaaaauggauucucggagugaggagucagugaaggaaaauacucucuuaaccuuagcaccugacguaguaccuaguuauacugcagcacuugccuggugacugagauauuccuuagaacagauauguuaaaacaaaugcaagauacaaaucuuaucucuagaugguacaaguacaguaggcccucuauauccauggguucugcauccauggcuucaaccaaccuuggaauaaaaauauucaguggaaaaguugcaucuguauugaacaugcagacuuuucuugccauuauucccuaaacaauacaauguuaacaacuacuuauucagcauuuacauuguguuagguauuauaaguaaucuaaagaugauuuuaaaguauaugggaagaugugcaaagguuguaaugcaaguacuacacuauuuuauauugggaacuugagcauaggaggauuuugguauuugagggaguuuguggaaccacuucacagauaccaagagaugacuguauaauaaaaauaguaggaaaacgaccaugaguuacaccaaagcgcuaauaauagcaccuacagcacuggcaacauuuguguuuuguuuucuuuuauucuccccuuuccaaauguuucuguaauguaauuuuacauuuuaaacaaugcuacuuagaauuucauaauaaacuccuuuaauugguuaucauuuuaaaauaaaaauaaaacucccacuaaagcaaauggauuuuguacuuauguaacaaucuaaaaauaaauugaggcuauucuuaaaauagaaugaaauggaauagaacauaaugaaaacaaugcaacuacauuuucacacuuccauaucuaaauauuuuuacccuuaauuccacugucaaacaauggcacacaaagucguauuuuaaauauccucucaaaccuaagcacaggcaccaucaucuagaaaaacauauuuccaacugaguaaaacuugaguggauaaucgaauuagcuaaccuaaccacagugccaaagacccaaaacgcaguccgaaaaauggcaagguucuccacuuucaguaacuguuuaaucauuaacuuguggacaaauuuagugacuuaaaauuacacugaaguugaguuucaaaaaguucccauugucaaauauacaaaagaaaauaacacaauacucacuuaccccaacucuguguaaucugauuuaggauaaauucuuagagaaaucuuucuacuaacucuugccacuugccuaugaacauauuaccaaaaaaauuauauggcuaugaguuacuggugcuuucagauauacaaaacauuucuagucagaacaaacagccagugaaggauauuaaaaacagauuuuuacagaauuugaaauaguaucugcuuuguaaucauucuuuuaacuguacuaguauuagcauccuaaauuaugugaaguauuugcugguuuccaccacagaagagucagaauuaaaaaaaaaaaaaaaaaaaaaaaaacgaauggcgggcagggcacgguggcucacaccuguaaucccagcacuuugggaggccgacgaggaugguucaccugagguugggaguucgagaccagccucaccaagaaggagaaaccccgucucuacuaaaaaugcaaaauuagccaggcuugguggcucaugccuauaaucccagcuacucaggaggcggaggcaggauaaucucuugaacccgggagguggagguuguugcaagccaagcaauugcacuccaacguggguuacaagagugaaacuccaucucaaaaaaaaaaaaaaaaaggcauauaaaauggucaaagaaaaaaggcugcuuauggcaccacuuccuccccaucuucauuuuguaucuucuccaauuuagucagaucagcuugagcucauuuaacuauugaucucaaggaauuauuugcacauaaaugauuacuuuuacaguguaauccagacaauuugcaaggccugaauaucuuauaauuuaauauuuaaacaagauacaucucuuuuagaaaauacaaaacaaggaugggcacaguggcucacaccuguaaucccagcacuuugggacgccaaggcaggaggaucaccugaggucaggaguuggacaucagccugaccaacacagugaaacuccaucucuacuaaaaacacaaaauuagggcaggcgugguggcucacgccuguaaucucagcacuuugggaggcaggcggaucaugaggucaggaaaucaagaccauccuggccaacauggugaaaccccaaaucuacuaaaauaaaaaaauuacccaggcguggugguaacgcgccuguaguccuagcuacucgagaggcugaggcaggagaaucgcuugaacccgggagguggagguugcagugagcugagacugggccaccacacuccaaccugggugacagagcaagacuccgucuucaaagaaagaaagaaagaaaaaaaacuauucuguaaaacagauaugcaucucaguggcaaaggcagaacuuuacacacuagaauauaacagaaguuuuagauguuuugcuuuuuuuuuuuuuuuuuugagacagucucgcucugucaccaggcuggagugcgguggcgccaucuuggcucacugcaaccuucaccuccuggguucaagcgauuccccugccucagccucccacauagcugggacuacaggcgugcaccaccacgcccagguaauuuuuuguauuuuaguagagacgggguuucaccauguuggccaggauggucucgaucuccugaccuagugauccacccgccuuggccucccaaaguguuaggauuacaggcgugagccacugcgcccagccuguuuugccauuuuuagucacacauaauuuuguuuacuagaguaaauuaaugcuaauaaagaaaacacuaagucuuaaaagggaagaaaaacauuaauagccuccaaaugucaucaacaugacacgugauuuuaaaagaggucuuugaguggccuuagguacuauguaugcaaucugcccucuccucccuuuggcuaacccuaucgcagugaaucagguggucuacaguuucacugguaacuggucccuugugauagacuugucucuuuaauaacauuauuaaacuaaccacuuuccacaauguuuuagacucacacuacuuauauuaggcagcagguccccauccuagcacucaucucauaugaacauuauuuaguuuaaaggucuuuacagaauuccaugauauuccuuaggaaaacuaagguaagguaagacagcugagaaucauggcuccaugagucugucucauugccugugacugcuccuggcuggaauuucacugcacuguccuggucuccccugcuccuuuuccaccugucacaacuuuuuccaaccuucacgggccaacucaaaugccaacucuauaaaagaaucugacuacaucucccagccuggaacuacccucccuauuaagucccaagacacuuuguuaauaucugucuaauggcaguaccauauugccuuguaucauauuccuugaagguagagaccaaguaauucaccuuugaaucaucgaacaccccauauaguuauccuuuuaguagccauuauguaacucaguauuuuaauucuagggggacaggugucuuuagcaauuuggugaaacuaacugacccaauccaaucuaaucaaguacuaacaacaaagcaccuaaauuauugcuaucagucacaagaguuacugcaccauuaauuuaaaguaaugauguauucucaauuuuguacucacuaaggacugacuacagucacucucugaaacucucagcuuucugaaaucauaggugagauucugcccagaugaauuuaggauccacaacuuucagcuucugacagggauuagggccaaccacucaaaggacauucccaauguaauuuuuuuuuaaauccacuaacagaaguaucuucuacuugucaauguuauuuugaggauuccaaucuauaauaaagcaaauacuagaaaauaucaaaggaagaaagcugcugaaucauaaaaccaugaaaauuagauuucagauuaucuaacacaauccccacguguggcugagaaauuuacacccaagacaacuaaaaaagccagcaaccaggccagaaccucuaauuugucauccagguucuguuaguccaagaauucauaaucaauuggauuucaguacuauuuuaugcaagcuacaaacauacaugcuaacuucaauaaaaaccaaaauacuguuuuucacuuuugucaggcagcaggaaaacacuuaaguuucuuccuuuugcuaaaaaccacuaauauaaggcaccacuuacugaagguuccuuggguuuguguuuucucuggaaaaaauuuuucgugaaaccugauguacguauacugcacugauguagccugccugacacuguaagagauuuuggaaccauacucaaccuggguuaaucacuuaacccaguuuaacuacuugcuguguuaccucaaagacaucugacuacccaucugugucuuauuuguaaaagggaaauaauaaaacugaugugugugguaagaauuguuaccuugugcuuaauagauauucaauuuaaaaaccaaaguuuuggucuucugaguacauauuccuuccacuuucgccaauuaccuuggauugcuuacagagaguagacagaacucaguccaaugucuauuacauagcagguuuagagugaggcuaacugcuuauacuuguuucccaccuuacagucuauuuccugaauggaauggagaagagauuaagaggagaaacaccggugauuuccaaaucaguucacauuuucaaccaccagacaucaagauauuuguccuaaguuuccauuuuuguguaucaaauguuuaugacacaaaccacuuuaaagggugguaggagcacagggcaugucaggcaagagaagaaaugacuaagauagucaagauaaggucugggccgggcgggguggcccacaccucuaaucccagcauuuugggaggccgaggcagaugcaucaccugaggucaggaguucgagaccagcuagccaacauggugaaacccugucucuacuaaaaauacaaaaauuagcuggacaugguggugcaugccuguaaucccagcuacucaggaggcugacgcacaagaauugcuugaacccaggaggcagagguugcagugagccaagaucgcaccacugcacuccagccugggcaacagagcaagacucugucucaaaaaaaaaaaaaaaaaaaaauaaggucugacaagacuuaagauuuacugugaggagccauguaugcuaaacuaagagguguaacuauuuuacacauuuugaacuuaucuuggaauuaaagaaaccacaaaugguuaguauacuaauuugucuuccuuaaugucaguacuuguaccauacuauugauacuaaaaacaaauauaguaaacuacuaaaaucuaacaguauguggucaagacuaacaacuaggguucuaauaaauagaauguucauaacucuguccuagaaaauacauuuaaaauaaaguagcaacaggcaaguuggagauaaaaaugacacuagcaaaguaggguaugauucuggcuaucuuuauuauuuuauaugguuuucuaacacagcuguacacauucacauuuguauauaugcuuacuuuucgcaagcucaggguuaucccugacucauucauguuguucacuuaacugcauuuagaccauacuggagcuuuugcccucugaauguauguaaguaugcacauuauuaugcuccguuaagucaguuuacugucccaacaugguacugaaacacuucagauuuuuuuuuuuuuugagacggagucuugcuucgcccaggcuggagugcaguggcacgaucucggcucacugcaagcuccaccucccagguucaccccauucuccugccucaaccucucgaguagcugggacuacaggugcccaccacgacgccuggcuacuuuuuuuuuguauuuuuaguagagacggggguuucaccguguuagccaggauggcccagauucuuuuaauaaaaacgaacuaugggggccgggugugcuggcucacaccuguaaucccagcacuuugggaggcagagguggguggaucaccaaaggucgggagcucaggaccagccugaccaacauggagaaaucccgucucuacuaaaaacacaaaauuggccgggugugguggcccgugccuguaguuccaaauacucaggaggcugaggcaggagaaucgcuugaacccgggaggcagagguugcggugagccgagaucaugccaucgcacuccagccugggcaacaagagcgaaacuccaccucaaaggaaaaaaagaagaaaaaaaaagcaaugaaaggaagcaauauacuuucuguauuaccugcauuccagccagaauaauggaaaacagaguacuuacucgggagcaauucuguauuuuuauccugguuccugaacuuacugcuugaccuugguuaauuacauccauuuccgccugcccugauuacuucuugaagaguuuuaacagcuggauaucuaugagucagucauuaguaaacauaucuauaaucuuacaaccucacgaguuauguauucuugcuccauuuuaaugacaaacuaaacaucugacacuggccaggggcaguggcucaugccuguaaucccagcacuuugggaggcugaggagggaagaucacuugaggucggcagccuggccaacauagugacaccccaucucuacuaaauauacaaaaauuaacugggcgugguggugcaugaggcaagagaaucgcuugaacccaggagguggaggcugcagugagccgagaucaugccauuugcacuccagugugggugacaaagcgagacuccgucuccaaaaaaaacuaaaaaaacaaaaauuagccgggcgugguggcacacgccuauagucccagcuacucaggaggcugaggcaggagaauggcuuaaacccaggaggcagagguugcagugagcugagauccugccauugcacucccgccugggcgacagagcaagacuuugucuccaaaaaaaaaagaaaaggaaaaaaaaaguuaagugguaaaguacacaaaaaugcuaucguaauauaugacaaaaaugcuauuguguaauauuuuuaagguagggaauuauaccaauucaaucucuacuucaaaauauuacauaaagguauuacuacuauauaucuaguaacuaagaaaaaaaaaagccacgcacauuugaauuguaaugcuguaaguauucauucuguauuucucuuuagauaaaaaucaaaguaaaacuaauacugauagcuuuuuaaaagaucuacagucauaauaauuuugaauucauucacacagcuuucuugaaucuuaaaaaauauuuucuuuaacuucauggcagaacuuaggagucucaccaaacacacaaacacuggcaacuugcuucacuaguuaacaccucauuuguauuuauggagccauuccaggugaucacuguagcacucucauauuccuaauuaacaaaauccuucuaauuacaacuuaaaauuugguggccucaaguucucacuuuauuaucucaguaguuuuaaacaugaaaaugcugcauagcuuacugcaaucacucaauggcauucccuugcugcugcagcaucugacacugccagaacaggaguucuauuaagugagacaguaaggaaagagcguucuccacauagcaggccaggaugccuuggcaucauucuucuggcucucuacuuacugucaggaggcuaggaagagaaaaaggaaccaaucuuuuuuuuuuuuuuuaauuuuucaucccugcaaggaaaaaaaagcagaaucucucuguggucaaaucuucagccaauagacaaaucauuccaauuaguccaauggugguuucacugcuuuuaggcaccaguuugguacuaucccauauacgugccacauauuuuuauugaacuuuaaaagacaaguagaauuguuggcaaggcacgguggcucaggccuguaaucccagcacuuugggaggccgaggcgggugaauuaccugaggucaggagaucaagaccagccuggccaacauggugaaaccccgucucuacaaaaaauacaaaaauuagccgggcgugguggcacacgccuguaaucccagcuacuugggaggcugaggcaggagaauugcuugagcccgggagauggaggcugcugugagccgagacugugccacugcauuccagccuggccgacagagaaagacucugucucaaaaaaaaaaaaaaaaaaaaaaaaaaagacaaguagaauugucauaaaucauguaacaaaacacauuuauacuuuaaaaaagacaucucccugccuguuccagauguucaaaugccaguuuaagaaaaaccuggccaggcgcgguggcuccugccuguaauccuagcacuuugagaggccgagggagucggaucacaaggucaggaguucgagaccagccuggccaacauggugaaaccccgucuguacuaaaauacaaaaacuagcuggguguggcggcgggcgccuguaaucccagcuacuucggaggcugaggcaggagaaucgcuuaauccgggaggcggaggucgcagugagccgagaucgcgccacugcacuccagcuugggcgacagagugagacuccgucucagaaaaaaaaaaagaaaaaccccuggucuuccacugauuugguucaaaauauuuuacagacugcaccaucugaaauacauuaccucuccuguuaccaauaugaaaaaaaagaggaccuuugguuccucagaaaaacacaaacuguuauuuuuuuaaagaaaaacuuaucaagagaugaaaucggaaaaacuuaagucuuuaauucugcccuugggaauguaauaaauuauuccuuuuauauuccaauacacaaagaacucuuguagacaagaaucaggcucaacaaacuaaaaacagcauguaccuaggauccuggcaguuuacagguguuugauuauccuuaaccagaguaacucauuagaagcauuuaaaacuauuuaggaggggggagggggaagcccaggagauaaguacuauaucucuuaucuuuuugaaacccucaaagcucuacacuccaguuauacugcuugaacaaacaaauaacauaaaauugcuaauuuaaauucgaauggaaauaguaacugguuacguuucacuccaaaauugggucaaacaauaggaaagggggaaaaaucuacuuuuaaaaauguaauuuaaaagcaagauggggauauucauuagaccuccuucacuuugagaaagacaaaaaacaaauucaguuuuggcuuaucucaccugaguccuucugaauaaugccugaaacacacuagcuaaaaucacagacgauuacugagcaauguucucuuuuuacaagacccccaagaccagaaacagucacuuccuuuggaagugcccuguggcugaggccauaugguuaacaugugggaacaagcacaagccuuacccauaauaaaaucaacaccuaaacccaaauguggaccauuaugccauucuaaaacagguucucacgauauggaaaaaucuagauggaggggagcuaguugaauuucgugucucguuuguaauuacaucuguuucauuaauccaagaaaugaugcagacuaccgcccgcugcugugguuuuggagguuugacaaauucguguuuuuucugguaauggcgcuuuuaaaggaucccagcaacuuaaauaguguuaacucuuggaaugugagccccaucagccccuuuuggaaugguaauguaacacaagcaacuuaguauuuaaaugacgauaaaaauucaagaaucggaaaacuaucaaggauagggaguauaaacucuaaaagcucccaagucuuccagcagucucgccacuccaaacacaaaggcuucuucaggaacccuuuguuguuguuuguuuguuuguuuguuuguuuuuuuaagacggagucucucucuguugcccaugcuggaguguaguggcgcgaucucggcucaccacaaccucggccuccgggguucacgcgauucuccuguccagccucccgagcugcugggacuacaugcgcccgccaccaugcccggcuaauuuuuuauuuuuaguacagaccaacuuucaccauauuggucaggcuggucucgaacuccugaccucgugauccgcccgccugggacucucaaagugcugggauuacaggcgugagccaccgcgcccggccuaagaacccuuuucuaaggcccccaaaacccuuggcacauggcccgccaggcgcacgaccccagcacauggccugcacgacuauacccaccccauccccccuucauccgcagccgggagccuuuccccaccacacggacuccuuccagugaguucccgccaaauccacccucggucccucauuccgcgacccucgaagcgucagggccucggccccaagggcgcacgggcgggccuccucugcccuaagccugcggccuggggugcggccguggcgccgaaagacccgcaugcucggcgacccagcuuuccaggacgaagaaaggacagaagugucguccgacagcggugcgccagaaacccggguccgaggcggcggcagcagccgagcuucccgccugacgcagcagaggcgcaggccaaagugcggccgccaucgccaccucgccgcucccuacccucucuguccgccacagacccgacccgcacugcggcuccgucagcgccgggccccucccccagcccucaccuuccgcgucggagcgggcccgcagcggcggagacucggacgcaggccuggggaagacggcucgcaagguagaggcuguuuauuuugaggguccuugccugcgccacacgcgggucugcacacggccccacauacgccgcugcgcacggcucuccuccgccucgcccacgcggccaaucagcgcgcgggguucggcaguccaauca

SEQ ID NO: 14769 - RNA, 706 nt, Homo sapiens
acgaaacuugggacucuuccuuuuuuuuuguuucgaauaaagccauucuagaaugagacaaaauucuaaaauauuuuauaguuaacaguuuaaauuggguuuaaucuugacaagacuaucuagggcuauauacacaaaucucuuuuggagaaaauaccacaacuaaacugaagucuauuccugaauaugacagaccaggucaaaugguuauccuugcccucccgggggaugucacucauaaacgugccaaaagucacagucuaggccccauuaccuuacaugcucaugaccuucccagggaggccccucgcccuuaccaggcacuuucaucuugggaagacacaucaguccuggcggagaaagcagcaaggccuuuccccggcucacaaaaauuaauacaaaucucagaggcugcaucccacagccgugaccaccgugacuuggcauccccuuuucugcaaacuuaaauguuaucuagaaaucgggccuggcucugaaagccaagggccuggcaggagcccgagaaaggggagaaacuuucugcggccccaagcuaauggcagucacugcaccgagacccguccccuggcaucccuuugcuccagcuggccaagacagaccaccaaggucagccagauuuccacccagucuggccgggcccggacccagcugggaaugaaccgagaagcaccgggacccggauccc

SEQ ID NO: 14770 - RNA, 28393 nt, Homo sapiens
uugccccuccgucuggcuuuccccacucccgcuccggcggagcuaagguuaacauuagacgaggcuguggcuaccggaaagagcgcaggcgcagagcgcggaaugcgccugcgcagagcgcugggcgacguggccagucggggcccggaaguggucccuguagaaccacuguggcaccgcuacuccgugccgcgcccgucgagcauugcguugcugcauugcgccccaccgacuccacuauguugaagaaauucgacaagaaggaugaggagucaggugagggggccaggccugggucugagggaggccggacccccacccgccgagcuuuccuucugguucucuguccugacccggaggcugaggcccagugaggggcaggggcuugugccaggguccacagcuagucaguggcaggccucggagagcccgagcaugcgcggcugucucacucuuguaagcucggacugcaauuuucugggugaccuugggcgcgacaaacacccccccccccaggccucaauuuacccaucugucaaaggaggggaccaugccgaauguucucuuguuacuuucuucguccaaccucuugggauucgcuggggcuacguuggugcuggccaaacugggguguaaccugcggagccagcguccugugacugggaacucugaccccaucauucauuuauucagcaaaguauauugagcaguuacuguaugccagguacuguacgguguccuggauacugcaacagagcaagugggacacucagugccugagcuaggaauauuagaaugguugcacccacgauggaggaggcagacaucaaccagauaaucacacguguaauuauuugcaaaugugucaucugcuaugaaggaacuaguuacaacgagaugguggucccuggcacauagggacuuaguuaauuacaaguuauauaaaugaacacaagacauggcaccaugagaagcacaggacuguaccagggcugcugggagauugugagugguuugggguagaguggagcccaccugcuugcaggagacuaguaggaucccuagacagauuguagaggcuugauugccauuccugaggaguuugaacuuuacuagauuuccuaggaagggacaucuucccuuuaccuaugucugggagaguuuugaaguucagagucacaaccuaccuucuccauuguccuugaccguagguggaggcuccaacccauuccagcaccuugagaagagugcgguacuccaggaggcaagugacauuugcuccccucuagcuuccaucauaaauauucaccaccaaugcaacugaaauaccaacacauucaaaguguuguuuuaaagagcaacacgggagaaaacuugugccuggaaguuuucuggaagacaggaaaacuuuguuucuggagagaguuaguuaugcuuacuucuuuuuuuuuuuuuuuuuuuuuuuuuuucugagacagagucuugcucugucgcucaggcuggagugcaguggcgugaucucggcucacugcaagcuccgccuuccagguucacgccauucuccugccucagccucccaaguagcugggacuacagacgcccgccaccacacccggcuaauuuuuuguauuuuuaguagagacgggguuucaccgcguuagccaggacggucuugaucuccugaccucgugauccacccgccucggccucccaaagugcugggauuacaggcuugagccaccgcgccuggccucucuauuuaaacauuuaaaaaauuucucuauuuaaaguuaauuccaaagcuaaggaaacugguuuaaaacuaucaccuaagcuagacuguggccauuaugcagguagagauuuugcaugacuuguuuauuuuuauuauauauauuuuuuauauauauauauauauguauuuuuuuuuagaaggcgucucacucuguugcucaggcuggagugcaguggcacgaucucggcucaacugcaaccucugccuccuggguucaagcaauuuuucugucucagccucccaaguagccgggacuacaggcgcacgccacuaugccuggcugauuuuuauauuuuuaguagagaugagguuucacgauguuggccaggcaggagaauggugugaauccugaccucuugauccucccgccucggccucccaaagugcugggauuauaagcgugagccaccgcgcccggccacuucucuuuuuuuuuuugagauggagacuugcuggugucagccugggguggagugcaauggcaugaucuuggcuugcugcaaccuccgccuccuggguuccagcaauucuccugccucggccucccgaguagcugagauuacaggugcccaccaccaugccuggcuaaguuuuguauuuuuaguacagacgggguuucaccauguuggccaggcuggucucgaacugaccucaggugauccacccgccucggccucccaaagugcuaggauuacaggugugagcuacugcguccagccgcuucuuucuuuauuguugucguucauuguuucuguuuccaguuagcagaugguugcuaaguaucugcuagucaauagguuagcacaucccuaacuaauauuuacacgagagucuaagaauaauuaguaguugauuaaagaaaaacaaacccuuuccuuaugaaaauaagcuuguugcauacccagaaagcccuguuuagacaagucaguuuacccugagacuucucagacauugaauauacuugaagggaaaugaacuaggcuagaagguaacaucuuuggucauuucuucuuaggcccguguauuuaaugaaacucccaucaacccucggaaaugugcccacauccucaccaagauucuuuaucucauaaaccagguaacagggugaagcuugcggguagggagaauggugcugggggauuggaggggaguggacaaaucaugaucacucuuaggcuauuggacagccucuguguggcuguagacaacagcucagcucuggguccccucagcauccaagucucauauguugcccuugagccucuuuagggucuggggaucuggugugggcugauccugaaagaacugcugucugacccucugucccaagcugagacuucuuucuugauuaacacagggggagcaccuggggaccacggaagcgaccgaggccuucuuugccaugaccaagcucuuucaguccaaugauguaagugccucaacccagcuuuccuugagagguggcagcuguaacaagguggugggagggccaaagagagcuggccccaccagucagugugggcugccuuuguggagacaggagguaucuucucccaacucuggcccuuggugagcccgggcugauagggcuuuucccaccuaucucccagcccacacuccgucggaugugcuacuugaccaucaaggagaugucuugcauugcagaggaugucaucauugucaccagcaggcaagucaugggguuguggguggcucuucugauggguuccauugacagaccauuuuuuucuuguguguaccagacagugagacuugguugcauauugccagcugcccaccccguggcagcuucccuguuaccacugcccaccccauggcagccuccaggugugcuguuucuauuuuaauucucugaccuugacuuggacacaaaugcuuccuuuucuugauuucucuuagucaaccaaaccagcuuagaacuuucccaaagacuuucuugaguauaaagagagaacacaagaaaaauaaacaagagaguacaagcgguauacugcuuacuaagugacuggugucugcuuuaagcuaagcaauucagggacagaugugacuaaaguguaaucacugcccuuaagaacuggggcucaguucucuuauuucuuccugccacaguuuaagguugugggggucauacauugauuuguagguucaguuagaaaauauugucugucagucccuguguguagcucuggggauauagcaacaaaaaagauagacauggccucuguagccccagaauuuacagagaaauaaccaggcaucaggccauuaagguaggguguaauauaguuuaucacggaaguauuaugggcuaugagagcagaccagaagagcauccagcuugauuagaauuacgaaaguccucccagaggaaugaucuaaguggaguccugaaggaugaguaagaaauaguaggacaggacaggcgcaguggcucaugccuguaaucccagcacuguauccacaauguaauccacagacugcgauggguggaucacuugaggucaggaguuugagaccauccuggccaacauggugaaaccccguuucuacuaaaaauacaaaaauuagccaggugugguggcgcacaccuauaaucccagcuacuggggaggcugaggcaggagaauugcuugaacuggggagguggagguugcagugagcugagaucaugccacuuacacuccagccugggugacagaacgagacugcgucucaaaaaaaaaaaaaaaaagccaggagugauggcucaugccuguaaucccagcaguuugggaggccgaggcggguggaucacaaggucgggaguucaagaccagccuggccaacauagugaaacccccucucuacuaaaaauacaaaaauuagccggguaugguggcaugugccuguagucccagcugcuggggaggcugaggcaguagagcuugagcucgggauguagagguugcaaugagccaagaucgcaccccauugcgcuccagccugggcgacaaagcgagacucugucucaaaaaaaaaaagaguaggacagaguggaggugaggggugaggaaugcuacaggcugaggaaacagcacaugcaaaggcuggagaggagugagcauagccaguuagggaaguucaaggaguuacauucaggucacuggcaguaggaagcuauggaaacuuuuuagcaaaagcagggggaugaccuguuugguuuugagucuuaugaaacucccuccagcagcuguguggaguuaggcuuggaggggcaggaauagagggagagcacugguuaggaggcucguguaguaaucugggcaagggugguguugggagcuggagaggaguaaacaggcccaggcucucugcaugcugacaaugccuucuucccugcagccuaacaaaagacaugacugggaaagaagacaacuaccggggcccggccgugcgagcccucugccagaucacugaugugagucgugccgguuccucccugcuuccuggccucuugauugaggccucggcaucaucuuuugcauucuuugggguguccccuaucacugagccaggugaugugggguggaggcagugugcaggagcacaugagaaacgcuuacuuccuccucauacucaucucugcccccauuccugcacuccugagagcugccaaggacugacuggaucuccuuccacccugcuccuuuugcccacagagcaccaugcugcaggcuauugagcgcuacaugaaacaagccauuguggacaaggugcccagugucuccagcucugcccucgugucuuccuugguguguaguugcugcuggagcccugcugggggugggguagaaaauugaagaaaauuuaagagucacauuccaguaggaaaaaagaaaguguuucuuucuuucuuuuuuuuuuuuugauugagacggagucucacucugucacccaggcuagagugcagcgccacgaucucggcucacugcaaccucugccgccgggguucaagugauuuucuugccucagccucuugaguagcugggauuacaggcgucugccacugugcccagcuaauuuuuguguuuuuaguagagacaggguuucaucaucuuggccaggcuggucuugaacuacagaccucaugaucuacccgccucggccucccaaagugcugggauugcaggcgugagccacugugccuggccucucuuucuucuuuuuuuuuuuuugagacagagucucacucuguugcccaggcuggagugcaauggcucgauuucagcucacugcaaccucugccucccuggcucaagcgauucacaugccucagccaccugaguagcugagauugcaggugugcaccaccacgcccaacugauuuuuguauuuuugguagagacguaguuucaccauguuggucaggcuggucuugagcuccugacuucaagugauccacccgccucggccucccaaagugcugggauuacaaagcgugagccaccgcaccuggccaaaauaaaguauuucuguaucuguaagccugagagucccacccuucucagugaagacagccaagaaacucuggggugauugaagagagucguggguggaugguguugacccaugccuuggggagggacauugagggugggagcauccugaguuuguccauggucucugaggaccaggacaguggcgagccccugagcugugucugagggaagaccagaacugggcccagaaugugugauggggacacuuccuaccugccccuuaauguguccuguugcccacagcaccugcugaagugcagcuuugacguggucaagcgcugggugaaugaggcucaggaggcagcauccagugauaacaucaugguccaggugagaugugagcaagggagugauauuuaaaacacucaggcaggugguaaggcacuggccaguuggcauggacacuugccaccgagauccuugugaccccuggccauagcaggcuuuaauccuuucgucauuggaucaugggaggaauuaggagguccuggguuagagaauccaggguaccacuuggggcgcuuggguuacagacugcuuaccagcuggugcugaaauauucaaguauuuugauaaccagcugaguauuguuuuggagcauaugauguggcaaacuuggccaaggcaggcagagggccgccuaaauuuaggccuuugccagccuggcuuuguuaugauguguggaauuaucuugaugaggcuuucauccacuuuacucuuccucagugaccuaggacagccguuccuuuuaucucucuggcucuugguuuccuugucuguaaaauacgaaugaagguuacugccucacaaagcagcaaggacgagcugagaucaugcauguaacaugugacccaucugggucaugagugccuaucggcgcucccuguguguuuauguauucccuuuaucucucaucugucuucucauccuuugcacgauucuugucuucagggccagcuguggccccucaaaacacuuaugagggccagauaagcuucccacauagaaggcuuccacagcugccauaucuuugcccccaaaugucgcuccuuuaggaaacaaaagagaguaucgaggacaggaaauaacuaugagaccucacaucuuuagaaagggagucucugggcuucuggcccuccaggccuagcuuugucaguaccagccaggagucuuugggcaagucagcaaagauuaaacugucuaccuucaggguuguuguggguaaugcaagauuucauggcuaaggugucccacacagugacuuacaaaacaugacaaugcucagggucuggcucccaccuucucucucucauugucugauugaaagcaccaggucucccacauugcuuucaucuuugugcuguuuguugucccuuuccauaucuguauuuaugcuaccuguuagggcucuugccgaagcaggggugggaacaagaaccacagauauacuucugugguuugugaagcauuguguggagggcuguguacacagaguaccuggggcaguugucacagccacucugugugguagcugcuacugugcccaucuuagaaaugagaaggcugaaggacccacccagggccacacagccaguauacccaaaagucauacauuuguacucuguugcugucuccuguccuauaguaccacgcacuagggcuccuguaccaugugcguaagaaugaccgccuagccgucaauaagaugaucagcaaggucacacggcauggccuuaagucucccuuugccuacugcaugaugauccggguggccagcaagcagcuggaagaggaggauggcagguaacggcucucaucucucaccagcuagaugaugccucacucauccuaccaugcugggccacccccaacguuuucuugccacccuauguucuuuuguagccgugacagcccacuguuugacuucaucgagagcugcuugcgcaacaagcacgagauggugguguaugaagccgccucggccaucgucaaucugccaggcugcagugccaaagagcuggccccggcugugucaggucacugggcauuccuucacccagccucacauguuuaugcuugcugggaacuaggccuggguucccgggcuaggagaaagaaagaaaaugcucuuaacaaguguuaaggagucuguaccuaggaagcaccugccccagacacuaugcugaguccccacuuguaucacguuuugguggugggcugcuguuaguuccaucugacugcugaagaggcugagguaaggcucggguccacucuggagccugucagguuggcuggccacaggaggaggccugguggaggaacccaggaucugugaaacuggugcaugugaaguggggcugcacuuuuccaggugaaggagagaacaguauagagggucguucugagccuccagcuccagcacuggagcagggcagccuggguuagagcccuggcucugccccuuaccaacugggcaagccuggcaaggccgcccauccucuccaugccuuccuuuucuuuucucagauguggaugauagaucaugccuauuacauaggguuauauagccagaaaaugugugaucuagacaaauugcuuagaaggcaacauguuuguuguuugccguuugcuguuuuuuguuuuugcuuuuugagacggagucucacuaugucgcccaggcuggagugcaguggugcgaucucagcucacugcaaccucugccucccagguucaagcgauucuccugccugagccucccgaguagcugggacuacaggcgcccaccaccacgccuggcuaauuuuuguauuuuuaguugagaugggguuucaccauauuggccaggcuguucucgaacuccugaccucaugauccgcccgccucggccucccaaagugcugggauuacaggcgugagccacugcgcccagccguuguuugcuguuauuaaggggaauccagcagccuugaguccuggagucuuuggugucuccucugugcagggcccugcucugggugugggaauacccugucagggaggagaaagccuaugaagaggugcaaagugguugguacuggaaaguggauauguugagaggcuagaaaaggagaggugcuuagggugagaaaccuggauucaaaguggaagagaagaggggaguguuuuagaacaggcccauggaaagcaaagauguuguggcaggagaguuagauuugcagguuuugagaaaugauugggccucuuguuuuucuauuauucucuacuauaacaguguaaacuuggucaggcaaacagauggaguucauguuuggagagagaagucuccuuuccuccuuagaaaugaagaaagaaugaacugcugggcacgguggcucacgccuguaaucccagcgcuuugggaggccgaggcagggggaucaccaggucaggaguccgaggccagccugaccaacauggugaaaccccaucucuacuaaaaauacaaaaauuagccgggcgugguggugcgcaucuguaaucgcagcuacucaugaggcugaggcaggagaaucacuugaaccugggagguggagguugcagugagccgagaucgcgccacugcccuccagccugggcgacagagggagacucuaucucaaaaaaaaaaaaaaaaaaaagaaauggaaaaagaacuaaugaauucagucacugauuuggguauucauucauucuuauuauaucccccauauuuccagaauaaugaaagauguaaauaaaguagggucuucaaaauaagcauuaagaaaaauuuuuuuugaguauuagagaauaaaagccaaguuaugaagaaaggaacauagauauuccagaaaacaguagucaucuucgcuccuaugauugagugccaaauuuagcucugagcuuccgggcagccagggcaagggagggauaugguacccgaauggcucucaucuaguuaaaggaaauaaaccauuuguuuaagagaggacuuuguucuucagcacuuggugccaagggggaaguucuguuggauccuguagacacaguaggagagaggaguggaauauuacuucacagagguuaagggcuuaggcugcaggugcaggcagucuuggaauuuaaucuugguucugccacuuacuggcugccaaccuaaaguuuguuugcuuuccccuuugugccucagucuccuuaucuguaaagugggcuagugguggcugcaagcuauagaagugaggcauguccacuguauagcacagcaccuggcacacagcagaugcccagugaauaacagcccucacuggaaccccugggugcucacagacauuauggccucuguccauggcucaggugcgcagggugaggggagcucugugucuuggguugggaugggggugucagcagggaaaugagcugagcagaggguuugagucagaacaguagcccccgguuuucccagcugcccagcagugaaggcaaccugacauguggcauccaucuccccacagugcuccagcuuuucugcagcucacccaaggcugcucuccgcuaugcugcuguucguacccucaauaagguaagaguccagcuuggggguuggaggaagcugucugauccaacuggagguguguccuagccucugaccuggcugggaaggauaauagcccuggucacaguuaguuucuucuagauggugagaugaucucauccaaaggacuucugacugggccaaaccaucaaauguagugacagcauuggguuccugcccucucugucacuguccucccaaaacagguugccaugaagcauccgucagcugugacagcuuguaaucuggaucuggagaaccuggucacagauucaaaccgcagcauugccacgcuggccaucaccacccuccuuaagacgggcagcgagagcagcaucgaccgccucaugaagcagaucuccuccuucaugucagaaaucucggaugaauucaagguaccugcuacccccaggacacccacggcccccagaggaaggagcucugucccugcucucuguggccacagccuuccugccaggacugaccugaggggcuggucagccuugaggacucagaggaggccagcaguuugcucugcagagacuuggccuuccgagaaaugugcguaguccugccuccaggccuccauccauaucguccccuuguacugaaagaacaguaguuuccaggccaguuaaggguucauugauuuguuguccaaguauuucuugagcacuugcugucugcuauguagagugacaaaaggggaacauagcagugaacaaagcaggugacugcccuccuggagcuuccuuucuagggaugggagaggaacaguaaacagguaaagaaaggaguagacgagaucaucucaggcauggguacugcagucaagaguguagaaauacagcagggaugauccuaggaagagcacagucugggaaggcccuucuggagggugacauuugagcucaaaccugaaucagugcaaagaaccaggaggaaaggcaggagcaagucaaggagagagaaggccaguggguggaagagcuguggggccagugcaggugacaaagucagaauagacagggcucaaucauguaaggcccauggucagguaaagaguuuuaauugcaaggaagacauuggaaagguguucuuuuggggcaggaggaaggaugugaauauuuuuugagcuuauauuuugaaauaauucauaggaaguuacaaagaaauauacugagaaguccuaugcaccccuccaucaacccucuccuacagugccagcauccuacacuagcacaggacaaugucaaccaggaaagugacacuggcaugacccauagagcucauucagauuucaccagcuacacaggcaacuccuguguguauauaugugaaguucuaugcaagaugucauguggagacuuucaaaauugccaccacagugaagacacucaacuauccaucuccacaagacucuuguuaccucuucauagucaggcccauuccuaccucucuauucccuaaccccuggcagccauuaauuuguucucaauuucuguaauucuguuauuucacaauuguuaauugauagaacaaugaaguaugucaccggagaguuuuaaucagagcaaacaauaauaugaauaauauauugugguaaauucuauaguguggauuaugcaaaguaggcagcagucuacucugccuguggguuacaagaaugcuuugcaggcugaaaugacacagugagauuugcauauuagauccuucugggucugggcacgguggcucaugcuuguagucucagugcuuugggaggccaaggagggaggaucacuugaggccugaauuuugagaccagucugggcaauguagcaagaccucaucucuacaaauuuuuuuuuuuuuuuuugaguuggagucucgcucuguugcucaggcuggagugcaguggugugaccucagcucacugcaagcuccgccuccuggguucacgccauucuucugccucagccuccugaguagcugagacuagaggcacccgccaccaugcccagcuaauuuuuuguauuuuuuaguagagacgguguuucaccauguuagccaggauggucucgaucuccugaccucaugaucaacccgccuuggccucccaaagugcugggauuacagacgugagccaccgcacucggccuacagaaaauuuuuuuaaaaauuagccauguguggugaugcgcaccuguagucccagcuacucuggaggcugaggugugaggaucacuugaacccaggaguucgaggcugcagugagccaugaucaugccacugcacuccagccugggugacagagugagaccuugucugaaaaaaaaaaaaauuggcugggcgcgguggcuuaugccuguaaucacagcacuugggaggcugaggucggcagaucacuugagaucagcaguuugagaucagccuggccaacauggugaaacccugucucuacuaaaaaaauuaaaaaauuagcugguguaguggcucacaccuguagucccagccacuccggaggcugagguaggagagucgcuugaccuggccuggagguggagguugcaguaagccgagaucgugccacugcacuccagacagagcgagacuccgucucaaaaaaaaaaaaaaaaaaaaagaguccuucuggagcagaguggaggggugacuggguaaagagacuguuggaguaauucagaaggagaggauggugccugaaccggcgggaguaggagaggugggacagugcaagagcuuuuugagggauaaugccuguuggcaggguuggugugaggguugagggguggaugucaacagagaugaugccauuuucuacuuugagcugacaguggugcucuugacuaguuugcaggggaggaaaagaugggguauuggaugagggagggggaaggagauggagauguuugugguugcagacauguggaguuugaagugcugugggcgccagguggaguugucugacaggcaguuggaaaaggcaggucuuaagcucagacaggagauaaauauugggagucaguggcauauaagaggcgguuaaagccaugggaggggauaagauugcugaagagacugugagaagagaagcggccaaggacagaauaccccagagacaggcuuaaccaaaaaggagccagaggagaugaugggugggaaccaucagugggagccagugguagggagagaagcaggacagguuggguggaggggacucggagacuuaagaagccugaguagaagagcagaguuuggggaacccagagucugagagucugacacuggggcuguuggcacugccuugggugggcucagggauugugcccuucaagcuucaagcguggaguugaguuccucuggucuccuugcccuugugucaugcccaaggccuggccuuaccuaaggaaggacucagugggcacucagggaacugagucaccccaucuugguggcagggccugcugcucaugcacgucuauuucauuuagguggugguuguccaggccaucagugcccugugucagaaauauccucgcaaacacgccguccuuaugaacuuccuguucaccaugcugcgggaagagguaagagucaggggcauucgggggaugccaggucuccuggugcagggagugaccugaccacuggcuccaugcucagcuuugugcgugugcuuauguuagccuguuaaccaacugguuuucauggugccugcaacccuuuaaacuccuuguggacauguaaacacguaccaauugcuaguaauuacaguaauaacuaugacucaccagccugacuuuaaaaacuggauguccugaggugaugcuugugcagaagaugggaaaaugcauguucuuuucugguggacucuagugcagaaauauucuagaccauuccaggagcucuaggagugguuucuugugaaaccggugcuaauaauacgacauugguucuauuucuguucccgacgugaauuacugauucacuuaugccaccuuucuuggacgucucaacaaaauggguuaauucuuaggagcaauagcagauguucauggaguagauuuguuccucagauacaugguaccccuuucacccagccccagaguggcccauggacuaggcaguagaggagccauugccuugagugucuuugcguuucccaagaauguuguuguagaagggcacuaauguuuagugaguugucagcuaaugggcccagcacuuuggugauuguguuuguuuuuuuuaaguagagauggggucuugcuggguugcccaggcuggucucaaacuccuggcuauaagugaucuucccaccuuagccacccaaguucugggauuacaggugugagccaucaugccuggccaggccuagcacuuuggagacacuguaugcaugauagcaguuuuuuuuuuuuucuguugaguaggagucucguucugcugcccaggcuggagugcaguggugaggucuuggcucacugcaaccuccaccuccuggguucaagugauucuccugccucagccucccgaguaccuaggacuacaggugccccccaccacgcccggcuaauuuuuuauauuuaguagagacaggguuuuaccauguuggucaggcuggucucaaacucuugaccucaggugauccacccaccuuggccucccaaagugcugggauuacagacgugagccacugcgcccggccuccaucugucacccaggcuggagugugguggugugaucacggcucacugcagccucaaccuccugggaucaagcaaucgucucaccucagacccccaagcagcuggaauuauaggcaugcaccaccaugcccaacuaauuuuucuauuuuuuguagugauggggucucuccaugaugcccaggcugauuucgaauuccugagcucaagugguccacccaccucagccucucaaagugcugggauuauaggugugagccacugcaccugaccagccuuuuguuugacaggaaagagugauagaggcccagagaaccaagugcccugucuccaaguucuguguuuggacaacuguccuugguccagcucaggucuucaacucuuuucuggagagagcaggcuccuugcuuagcucagcuucucucugcaggguggcuuugaguauaagcgcgcuaucguggacugcaucaucagcaucauugaagagaacucagagagcaaggagacagggcugucacaucugugcgaguucaucgaggacugcgaguucacagugcuggccacccguauucuacaucuccugggccaggaggggcccaagaccaccaaucccucaaaguacauccgcuucaucuauaaccgaguggucuuggagcaugaggagguccgggcagguaggucugagccagggcugaacuuggaaacuuagcuuacccuugaauaaaugucccagcaaagggaccugagccuccaguggggauuugugcacucaguguucuugcugcacaagcuguuuuucauaauauuguaggcaggaccuuacaugucaucuaguugaacaguucuuuguuuuuuguuuuguuuuuuuuuuugagauggaaucucgcucugucaccaggcuggaaugcaguggcgcaaucucagcucacugcaaccuccgccucccggguucaagcgauucuccugccucagccucccgaguaggugggacuacaggugugugccaucaugcccagcuaauuuuuguauuuuuaguagagaugggauuucaccauguaggccaggauugucucgaucucuugaccucaucaucugcccgccucggccucccaaaagugcugggauuacaggcgugagccaccgugcucggccaugguucuuaaccccuauaauuuuuuaaguauuuuuuuaauugagacggggucuugcuauguuguccaggcuggucacgaacuccugggcucaagcuauccuccugccucagucucugaaagugcugggauuacagagccacugugccuugccuuaagugauuuuuuuuuuaacuuucacuguauguugauguuuagcuaaaaaacaaaaagcuuuguugagauauaauucacaugccauaaaauucacccauuuauauaaaguuuacaauucagugagcaaccuuccuauucuuuauuuuuaauuucuuuucaugcccccacuggacagauuuucuucuuucagcaauaaaugaucuuuaaguaauuguucccuuucucauuuuuauuauucugagccuuaacugcaaauugacgccauuuggauauggaaggugaggagcuuuacauuauagccagcuucugugaccucaucaugguuaauuugaaauuagcuccuggaaccuuagaaugggagcuacuaaucccaucuggcgcccuucuccauuaaauagauaaggaaguugaggccugggauggugccaagauccacccaaagccacucacucuguugguagugacuuugggccuccuggcuugagacuucuugccucuggggcucuucugccugaagacccauucugagugcuggaagugcccaaacagugaguugucagggugcauuggguaaaucacauucgcuuccuaaacacaggugcugugagugcucuggcgaaguuuggagcccagaaugaagagauguuacccaguaucuugguguugcugaagaggugagucuaggcccaggggcccuaauggggacaguguucccuuggacccaagcagcuuuccuuugucuuuauuuuuuuuuaacugaaaagggagagaaaaguuauacagcuacugauuguagaaaaaaaagagaaagcauagaaaagcaugaaaaacaaugcugugcaaauugcaccaaccagaugugacaauugguaacuugaauuauuuuguccauuuuuuaaaaauagcucuauugaagccgggcauaguggcucccgccuguaaucccagcacuuugggaggccaaggcgggcggaucacaaggucaggagauugagaccguccuggcuaacacgcugaaaccccgucucuacuacaaauauaaaaaauuagccaggugugguggcgggugccuguagucccagcuacuugggaggcugaggcaggagaauggugugaaccugggagauggagcuugcagugagccgagaucaugccccgcauuccagccugggugacagagcgagacuccagcucaaaaaaaaaauagcucuauugagauauaauucacauaccauacaauuuacccauuuaagauguguaguuugauggguuuuagcauauucacagagugauggaaccaucaccacaaccugaguuuaaaacauuucaucaccccaaagggaacucaguguucaugaguguggccucuccucacucccuccacccuccgccuggggccaccacuagucuacuuguuaucccuauggacuuaccucuaaugaagccaugcaggaucccuccugccaucccugcugggucccagucaggaccaccuuguguccuggcugcaggugugugauggaugaugacaaugaaguaagggaccgagccaccuucuaccuaaauguccuggagcagaagcagaaggcccuuaaugcaggcuauauccuaaauggugagucauucccuggcuaucuuggacucagcaccuuacuggagcugugguucucaucacucccugggcaggggaaaucagaggcaagaugcucuuggcuggacuugccuggcaaccucauggcaucauggugaccucaggaggucccgggucauucaggucacaccugaauuggguggaaauuguccagugaauugaaacgcucaucauuaauaaaaacuuuauuuuuacaguacuuuacccuuuacaagucacuuuguauauauguuuauuccccacaccuacccuguaagggaggaugugucugagaaugcagaggcuuagagaauaaagugauuuucucagggucauacuacuuaggacuuguaacuucgggaccccagggccuccaugguggucccuggugcacauuuugcucuaucugccaggcauggugaccucucuucaccuccaggucugacuguguccaucccuggucuggagagggcucugcagcaguacacucuagaaccaucagaaaaaccuuuugaccucaagucugugccccuggccacggcgcccauggcagagcagagaacagguaacacuuauacuccucccagaggccaucaaggccaggccucuguuggagggucugcauuggcugcaaagccacuaaccuaacuaggguggguggcaguuaugcugggaggaggaaaugaucuuuuccaccucuggcuccagaaaauagagacacacauacacacagacgugggcucucucacaugucuucugcuucccacucucaggaggguuaguauuuauaaucccugaguaauagcacuggggucaccaccacacugccccgugacuccagcuguuggucaucacguguauaauuugcuccugcagaaaguacccccaucacagcagucaaacagccugagaaaguggcagcuaccaggcaggagaucuuccagggugagucacagugguugggggaugcuugggaccugggcuuaguuuccucaggggguucaagaguaagaacugucauauauuggucucuccugagugcuaggcccuugagaugcuuuagaccuacuaucacauuugacccucagguggugguuguuggguuccuucaauaucugaggaauuggaaguucagagagagaaaguaguaggaggggcuggaauuaaggucccgaucaaacuggcucagugcuguuacugggccucaauuuggagggcucgggucccuggagcccaggccaguucagaaugucugagagagcagugcugggauucaaagacacugguacuuuuugucggguuccacguguguucuguccacauugucuuguaagguuuucuucagguauccaucuguccucugguguugcauuuuuaaggggagaggcugugugucuaauugcagauuguuuuauccacugaauucaguagauaaaagcauagaccccucuuccuucaugggcccucacuuccauccuagcucuucugucuucucuuaaacagcccucugugcuaaauaguucuucacauguucugucuuuuauuuucugcgucuaucacagcacugagcccagugccuuccuuccucacaguaggcucccaauuaauguugaauuaaaugaaauccccccuuccccauuacacucagaaucaugucuuauaucaauauagcauggauccugagcuaauugggaucgcuauaacaugaaacuuuccauuuauaucaguuuucuauugcugcuguaacacguuaccacaaacuuaguggcuuaacacauuuauaaccuuauagcucugcggucagaaguccaaaguggguuucauuuguuagcagugcugaguucuuucaggaggcuccagguauugcccccuugccuuuuccagcuacuagagguggcccguauccuuggcucguggccccuuccaccgucuuuaagggcccuucuagggcagaaggucagaguagagugauuugaagaggccacacuccuggccuuuucaaaucucucuacucugaccuucugcccuagaagggcccuuaugauuacacuggcccccccuggauaauccaggauaaccccuagcucaagauccuuaauuuaaucacaucuacaaagucccuuuuaccaugcaagguaacauagcugcagguucugggaauuagcaugugggcaucuuggagucauuauucugccacaccuuccaaggaagucuccuaagccgcuuaaaggguaacaauuccauuuuuaaacaaucauccaaaagccucacauuuacuaaucacauacauguucaguuccaagaacuuuccuagaucuugaauuuauugccucauuugucuuuacaacaacgcugugaucaagauaaugauaucaguuuuauugaugaagagucugaaacccuaccaacagaaucccccagggaguaaguaucaggcccaaaacucugagucccaagaaaauaaauaucaauagaaaagcacucuagugguugauggucaugguggcccaaaaguuccuccuaauaucuagccuggauuguucugggcuuuuuauugccugcauauucauuagauucagucuucaggcugcagagggcugaaguggucacauaggcugacuuuuuguggaggaaaaaagcaaaauaauaaaaauaaggccuaccuuucucuaugucugaaacgugaauugaguaccuucuaaguaaagggaaaaauaucagauccauggccucaaagcacaaucccuguucucauggaguucaauuaauugggaagacaaguugaaaaucuuagagcaguggucuuuaaauaucaguauauauuggaauaaucugaggaaacauguuagaaaugcaaauuccuugauccugaaaccagagauucugauguaguagauuugggauggagucugaguuuuuagcaagcucugccgccaaccccuaguaauucugauacaguugauccauggucauagugcgaggaauccugccauagaauagguacaagaguggcagcuguagccauuauagguggacaccaugugcacacaucugccagaugccucauucacuuggguuauucccuuuaguuugcaaggaaugccaggaccagccaggguggggucccaugggccugugcuugaauccagugcuugaaccugggcauaggguguagggauaggucuuaccagacacaaacaauucuaaguuagguuuucugcaacacucucauucugaaauaucucuuuauuggccauuugucuuaacugauaaauauauaggaccaguuuguuauuuugucugauuuuguagcuauagcaguaucgaucuuauuuuccuaauugucaccuucuuuuaagaauccuugcugcgguagggggcggaaauccuugcuaagcuucuauagcugggggauucuccaauuaggucuaggauuuuguggucucauaucaguuuuuugcuucugaggucuuucaugguacagagauggggagaguauuugugggggguugugccacaugagcgaagucagggagaugagaaaaugcauggauauauucaggaaauaaugaguagccaguuggguaaacauaucuauccaucuaagguaggguggaacaccuugagaauggucaugggaauuuauuagaaaccaucaacaaguuggucuggggaucgagaagcugagugaauguggccuguggauuucagagcaguuggcagcagugccagaguuccgcggucuugggccccucuucaaguccucgccugagcccguggcccucaccgagucagagacggaguaugucauccgcugcaccaaacacaccuucaccaaccacaugguuuuucaggugagcaaggugggcugaggcccugcuggggcaugcgcccagggaguugucccaggucuggcagguccuguagggucauggguccccacacugcauugguugggagcccaacuugaugacagaaucuguccccaacaggucggucucucauaucucuugacucgggacauccauggcucccgauugucagcaugaagacagggaaccuggggcagggggacugggaugggaaucaccuuggucaauaggaaagaggugggaccuccuggcuuuuccucugcagcauggcucggaccuagugcaauguuuaagcuccccucucuuuccuguucaguuugacugcacaaacacacucaaugaccagaccuuggagaaugucacagugcagauggagcccacugaggccuaugaggugcucuguuacgugccugcccggagccugcccuacaaccagcccgggaccugcuacacacugguggcacugcccaaagaagaccccacagcuggugagccccucuccagauaccacccuauccuccugggagcucauggggucaggaggaggugggcggcugggcaccagcuguuugccuucuauuagagcuucagcuccuugauuucagucccaagaagaagaauagcugagucccaagugcucuucuuuaaaaauuuuuuuuuuuaaagagacaggaucucacuagaacucaugacuuuccuguccuacaagguggcacccucuguccagcuuugugggauuggauggcuuguugcugcuacuaauaacauagcaggggccuagaaagcaggcugugaccccugccugcuuguccccugcaggaggagcccauccccugcaggcuggggacauccuaacuacccagccucucuuccccacaguggccugcacauucagcugcaugaugaaguucacugucaaggacugugaucccaccacuggggagacugaugacgaaggcuaugaggaugaguaugugguaagauccuggugucaggaagcucaguuuugugcugaggcugcaaagcaacucccuucaggaacugacagugagacuggagcuguuuuuggcuuuuuagcucuuuaaaauuuuauuuuuuuauuuuuauuuuuugagaugaaguuucucuuuuguuacccaggcuggagugcaguggcgcgaucucggcucacugcaaccucugucucccugguccaagcgauucucuugccucagccucccaaguagcugggauuacaggcgcccaccaccaugccugccaaauuuuuuguauuuuugguagagauaggguuucaccauguuggcuaggcuggucgcgaucuccucaccucaggugauccaccuaccuuggccucccaaaguguugggauuacaggcgugagccaccgcgcccggccuaaaauaacuuuuuaaacuuauggaaauacauguucauguguaaaaagaaaacuugggaaauacaaaaacaaaauucaaaacaaaguaugaacaacaggaaaacauuacucauaauccuuagaguuauuuuuggggggaagugguauaauugaaaucauucuuacaguguagaccuugcuauuuuaaaaccauaguguauuuuccaguaucauuacaaauacuucauaaacacaauuuuuuuaguggauuuaaaauacuguuauauacuaugucaaaacuugauugacuuuucacuccuuuaauguugggcauuuggguuuccauauuuucacuauuuauauugcugcauuaaauaucccuuuagauacaaauuuuuaucugcauuuuagauuauuucuuuaggauagauuccuagaaggagaauaguugggucaaaggguaagcaugauuuuaagacauuuugauuccucuugucaaaugcuuucuggauaaauuugaccuguuugcugugcugggcaguccuuucaugcacuggaauagcccuucuaaauucuccuaucuuagcucgguggaacuaaguacaggauccuucugaggucugacuuuggggcaguggcucagggccaucugagugcagaccauuaugcucagccuguggauggggacuguuagaacuccuccugacuagagggacagucacaguggaauacaacugacauucgccauugugucauccuagagucacaguugaggauggauggaccuuccuugagcuggaaaugaccccgaggcaggagcugcucuaagaccaagugagcuccuugagagagcugggucuguuugagcccauccagagaugaagaaaaaaaaaaaagagagagagagcugggucuaaguuguauuuauauacacuguaaacauccacaggaguagggccucagugaaaaucugaugggagaaugaauggggaaccuucauguagacucagugggaguauuaugugucaaguucagggaagacacagcugaaauggagauagagauucaggaucugucaaauccagaggacacagcugggguaggagguuucugcuaguuucugcugaacuagaaacagcugcugguccugaagagcucaucauccccuaggagggacaggcauaggaagcagaccucugagaaugcuauguaauucccugcaugccagguccuggaagcacugacacuaggcaggcuuagaagagaugugaucucacagcaggcggcucuaggcugaauuaguagauugguacuugggauuagggcguuuucuguugaagggauaccauuugccuuugggcaccucaaggauagguaccuggucaaguugcucuauguccccagagucuagcacaguccucagugccgagcaagcaccuguggaaagaguugcaggaagggauguguggaugaguucagagcagaggcccguagguguguagaugggugccugauuucuaccuccaucucuccagcuggaagaucuggaaguuacuguagcugaucacauucaaaaggucaugaaacugaacuucgaagcagccugggaugagguaggggaugaauuugagaaggaggaaacguucaccuugucuaccaucaagacacuugaagguaaaauccugggaaugccaucucuggccuaauuacuguucaagaucuuuggcuacuauugaagugcucaucccuuuucucuccaaggauccagggccaugucuggagcacauaugucaaaugccacuucauuaaaagcccuucagaacaugggggaguggugguggcacaaagggcagauaagauggcuuaacaauauugggauuucucauuacagaggcuguggguaauauugugaaguucuugggaaugcacccuugugagaggucagacaaagugccggauaacaagaacacccacacguugcuccuggcugguaaguggcauuucuagauggggagggccuggauagcuuacagccuggaugccacuggauccugggcuaaggacuccacuguaaauauggggagucaaaauucacagcauuuaaaauucacaaaguauaaaauaaucugcagcgaaauguuuccucccuaccuuggcugccagccauucagauucccuuccgagaagcgaccaguguuacuauuacaaacaauacuuguauaaccuugcgguuauuuuauggcuauaaaagcuaauaggaacgcauuuccuuuuuuuaacucaaauguuuauguacaaaugguauauauauuguccuccgauuugcuuuucacuuuacauugcaucuuagagaucuuccccgucaauauguagagcuuccucauucuuuuucuuuuaauugugguaaaauauacauaaaauucaccauuucgaccauuuucaaguguaugguucagcggcauuaaguacauucacacuauuguaaaacuaugaccaccauccaucuccagaacuuuuuucaucccaaacugaauccucauuuuuuuuauaguugcuuaguauuccauuguguggaugcaccacauauucuauggaacagccacuacugaugaacauuuaguuugauuucaaucucuugcuauuacagauguuacaguaaauaaucguguacacacacacacacacacacacacacaguuuacuuugcauguguacacugagaauaucuguaggauaaauuuuccaaggcaucaccaguucaaagugauuuguguuucucaucuugauaaauaacuccaaguugccuuccauagaauuguauaccuuucuuccuacacuguggacaacauaauauguuaccacacuuuaugaucuuuuccagucuguguggacaaugauaucuuaguguaguuuuuguauuuucaaugaaguuaaguaucuucuuaaauguugaggcauuuguauuuccuuuucugaucauugucuucauauccuuugucuuauuuucuacaggguuggcugaguguacccacacucauucuccuucccagauuauuuacuagcaaacuccagaaauagcauuuuauauguaaauccuguaucuguauguuucucuaagagagaaugaccccuucccuuuuuuaaaggacaauacaauuaucauaccuaaaacaguuaacaaaaggaaaugggaugauuuuuuuuggcugaguguuuauaaacaggguugaaaggaggcucugcuucaguacccugccuacagcugacaguuuguagccacauugaaacaaccuaguccccugggucuugcagacaccugcccugugguuuucucgugguggggcuguccccuucauuugugcucucagauucagucaacgugcaagagccucugugacaugagauauaagccuuuuauguccaucaguucauuugaacuuagcagaagccugaaauaugguauuaucaucccugccacuuuguaguugaggauacugaaguccugagagacagugacuuucuuuuuuuuuuuuuuuuuugagacggagucuagcucugucacccaggcuggcaugcaguggcacaaucucugcucgcugcaaccuccgccucccggguucaagcgauucuccugcuucagccucccgaguagcugggauuacaggcguccaccaccaugcccagcuaauuuucguauuuuuaguagagaugggguuucacuguguuggccaggcuggucucgaauuccugaccucaugaucugcccaccucagccucccaaagugcuggaauuacaagcgugagccaccgcgccuggcugagagacagugacuuucacagugaaaucccucacucagggauuucagcccagcucuccugcccguuucacuacaccagagcugccuucauggguugcugcaaaugccauccuuagccugcccuguacagucccuucugcuguauauaucuguacuucucucuucccuucuagguguguuccgggguggucaugacauccuggugcgcucccggcugcugcuuuuggacacagugacaaugcaggugacagccagaaguuuggaggagcugccaguagacaucaucuuggcaucugugggauaagaggccagccugcauaggaccucauacccuuccccaacacuaccuggaaguugugccuuccucaugaaacuggcagaaaccccuucccaagcuucuguauugaaaaacaauuaggaaucauugcagauuuuuuuuuauucugcucccaccucccacccgggacuacuugcuggugacuuuuuuuuuuuuuuuuuuuaaauaggggaugauuuuagcuuguccuaaaucuugcuguccacccuuccaggaaagggacauuguaaaugaauaaaacauucucaacuccucuugaaucuaucccccaagaaaccaucuuaucccuguaauaaaucagcauguauuuauugaaugauugcuacuucugcagacucaugcuucagggcuccaccuuccccuucaaggccuccccuaaagaggcagaacaccugcccuguccccc

SEQ ID NO: 14771 - RNA, 13588 nt, Homo sapiens
cgccaccccgcgcccaggucccgcgagcccgccugccgcgcaccucgcccugcucccagcucuacuccaggccccguccgcccgggggcgccgcccaccgcgccucgcucggugaguuucuuccacuuccaccuucccugggcccggcccuucccgcccccggcccggcccgccuggcacccgaaucgcuugguccguuugcccuguggccccuaccuuuggggcucgccuuggcccugccagagaccggaaacccugguuauagggacuuuaaccagagggaguauuugguuaccugggcacagcaggcccgccucgggccucuugucuucccauuucucggagccacaggccacgagacccuggcauucccagagccucgcaaagcacccccgccucccggcccccgaacuggggccuuugucucggccgcccccaauccccaggccaccgcggcggaugcguccgagccgggccgccgagcggcggcugcaccugccggcuggucccgugcgccggcuuuucgcggcuuaacccagcucgcuccugcuugcgcccccgcgcgcugcgccccgcagcccuuuauccugugugacuggggugcgugugggggagagcgccgggucuggaagucuccccccgccccaagccggagucggaauccguuuagugggauuucaauaagaauggggccgccgcgggcuugaagaucugccgccgguaggcguagacggcguucuggaucugucugaaaacggggcauuuaaaauuauucuguggcggccaggcuugaacuccgcguugcuccaaccacgaggggaaaggccccgcguucagggaccccguguguggcgaacgcuccuuuaccggaaaacaaggaaggaaauucguuguuuuggaaaaagccuccucucccgaggucgggaacaucugguggugagcuccaggucuacgcaggcaccccgugcuaggauucguuuaugagcaggcaggauucgagaaccagguagggcccgugcggcagccgaggcgucuggggagcguuucccagccgggcugacaaauugcagacaaauugugccuaacgaaacggauuuaccaguugucaggccgccggccccggccgcuccaaauaaaccguggcuguucguggaggagggagaagcacggcccgauugucuccgggucucagcaggguuccgcggggagccugccaggcuugaagguaggggucagaagcgauauagaaucucggaggcgccuggguccagggugccgagacaccuaggacgugggggccacagacucuacgauucccaaagacacagaacaguaaugaggugggagagccugcacugaugccgagggagggagccuucugcuuuaaggggcuggaauugaaccucaaggagcaggaggggccguuauagcaguagucccccccuugggaacccccccggagggauggcugcuggccugagaucuaaugccccggcuuuaagggaacuucugaacccaucugcuaaggcaccccacuuccuccccguaccccucaagguuuauugccaguguggggcugggaggccgcuggguugcgaauuaaauuucucuauggaagguagucccuuagcaaauggguuuccuugacaccccacccccagccccacaccgcgggccaauuagcugcccauaaggaaaaggcgagaagaauuagguuacaaagggagggcaaacuuauggucccaaaggggccgccucggaugagcuaacuuuaaacaaagggcucagaggggggggggggcuggacggccggggagaccugggcaucucuguguccccaccuggcacccgcggcuuaguagaggccugagaagcacucuagaaccgggcaccagaucugcuaccuccccagcucccaggcagaagcacccaggucaaaugguggcgaucgccgcugugaguucucgggccaaaaggguccuucgaaaauucugcuuccuggcugaccuucuccaguccucagagaaaucuuguucccaaguaaggaaagugacagcuucuuaaugugaucaaaggcagcgccagcauuuccaacuauacucccgaacgaacaaaguacugaaaaagggaacgcgucccucuaaagguguuuuggggaccccaaaguuccagcccauaaauuggaguaaaucugcucucaccaggccuggaacagcgccucaagaccccagcagauucugggggcugcguugacccuccccgggaguuuguuuggggcccaaggugggaggaccaugucuucggccuaauggggaggggcccgguuggugucccucggucugccuggcacacacagacauugucgagcgcgggucccucuuuauuggccagcugggcgcccugcuacuuggcgucgcauuucucucucccaggcggguucguuuccgccagagaaugcagcagucccgcauccuacgcaggaccugcaaccgagguggaggcuucggucaagccggcuccugccugcguugucgaggaaggcaaccccaaggccugaaaggaccuggcagaacuccuguuuccuuuuuuuccucuacaccggauugcgggcaaggaggcugguucgggucucccgaggccccugcucaagcacuccuuaaccguccugcuaagccccucugugcggcgauuuucugagcugccgagcgggguaauuaaauccccucccucgcuccgcucugcgucaggcaggcggcagcacagggcugacguuugggcaggggacucagccaggcuggccaccuccacuaccgcaguggccgggacccugccgcggagggguuagacgccgagcucgcugcgcugaaacugggaauacacacggaacggggagggggaggguaauuuuuaccgcgccggugggagaaaaaggcgaauuaccugcuuucccgagggacgcgcguagccacuucccugagagccgcggcaccgaucgcggccgggcgggaagcuuccgcucgguccuggcguucacagcccagcggccagcugcuggucugccucccgcgcugggucccaggguucgcgcucgagcggggcagcuuugccggacacgggggauuaucccuggggacgcggugucuuucagagggucuugcuagucuccggagacgccaaauaggcucgagcuccgcggcgaucucauuuuacgaguugaugaagaaucguaagcuaaaggaugggaaaaguugagagacagacggacggagagacagugggccccggcgggaccgcacgcguugaggggaacgccaaccgggaggcacggagacugcucaccugcccggccuggccgcggaggcccggcgccaagggccucgcgcucggccucccgcccccugcgcggcuucccgggcuggcgccggccuccgcucccgcagaguggaguuccgagcagaccgggcuccgcgcgcuccagcguggaggggagcgggaggcuuagcaggcggcucgggcaggcgggucccccaagggcacgagacgcgcugguucccagcccaauggagcucugcgccccccagccccgcgcuuuaccugcgcugaggccucggacagacaaacggacgccagacgccuaggcaggaggaggccucagccugagcccgcggccccuuggcgcugcccugaacuggccugggagggggugacgggggcgcgcccgcggagcugggcccagccgggcgcccccggagccgaggggaccgagggcuuuccucccuccucggauuauuaaaaaguucauuuccuggcgaaucgggugacgucaggggcucggcgucgcgguggcggggccgcccggccggagaagccgccuccaguuacccaauuaccgacugucaaucccgccgccccucccccacucucccggggguggccgggaccccagcccuccuccugcccccgacccaccugggggcccucuggacaucuaccccgggagccucgggcccaacagggaagagggcuggaggacgcuguugaguccccccaguacucggcaccugucuaggucccccaaaaugccuuuguccuggaccucccuccucggcccggggcucccuucgagccuccgucuccccagucuguacaaugggagggaggaagacuugugcgcccggcccacacgaaccauagagccgaucuccgggcuagaagugaguggggagcacuuccaggugacuuagaagacggagaccucagaccaccgccucccccucaccagaggccaccucggggaccccccccggaggaaaaaaaaugccaccucuugcccgggggcgucucccuccagcuggcgccggcgccaguccgggucuccacggccucgccccaggcaauugggcccguuggccugcgaaggccacgcccggggaggggugcccccucccccuuucuggagccaccggccgggccaccuccacugggucaagcacagcccugagcggccgcguguccgaggcccaggugcccucuagagcccuguaguuccugccccucucugccccucucggcuccugcuguuccgccgcugucguccgaaccaucccaacccccaguccacccagacagcgcccgagcuaggggagggaacggucuggguagguaacugcgcucggacugaccacguucagcggugaaggagcguggcgggguuagggucucggggagaggccauccagagggugugcggcccgggcuccuggggagggggcaguuggugguuaguuacugcuagggaggcccagagcaucgagggaucccggaguguucgcaagaggggcugcaggggucgggccuuggggugagggucccuuagugguggggcgcguuggcagcaggggccgccaggagcgcgcagggagggggcccgccggcugaggggggccggcccgcgggucagucccggaguccagcgguucgggaauugcggacgcagccaaugggaggcggaggcugggaggcgcgcggcguugauuggcuggcuugggcuucuuaggcgugcgcggcccccgcuucaugucugugcaggagucggcagcuggcgccagggcggccggaggaugccgaggggccggagccgggagggcccgaggccgaggcgcacucuacccccagcuccuacccuguaagccccgccagccuccggacgugcugucccugggcccgucgcccucggggcucccgccggaacuccuucacucucagaggccgagucccuccccuccccacggcugcguguguaaguuugggguuugagagccggcugggggccuggggcgcuccuagcuuugaggggacucuggggggacuuagggcggggggccaggcugcgggcgacugcuuuggugugcuuuguugagagguccugauugugccgcuuaguacugcgcucagggggcugcgugugcauguuuucgggguugagaucaguauguguaucuggcgccaagugugggugugugcgugucgcugggaucaagugccacacugggugcccgggcgccugucuccaacuuuugagucuguguucauguguuugucuaccgggcgggggggcucagugugagugucugacugaagugcugcucugugcguuuguuggggucacuggugucgggacccguccccgggcgugaccccaugugcacgggugugugauucuggagccgcgggucaccacgugagugugcguggcugaacccccucccccgccuuccuuucguuuugagccuugggcuuuccucccacccgggacuggugcucuuucucgccggaucugggcuggggcuccguggcgugcgggacaccucguggugggacuuuggggggugucaggcgcuggcggcacgccucacucccccuuccucgcgcagggccguugccgucugcacccagacccugagccgccgccgccggccauggagguggcgcccgagcagccgcgcuggauggcgcacccggccgugcugaaugcgcagcaccccgacucacaccacccgggccuggcgcacaacuacauggaacccgcgcagcugcugccuccagacgagguggacgucuucuucaaucaccucgacucgcagggcaaccccuacuaugccaaccccgcucacgcgcgggcgcgcgucuccuacagccccgcgcacggugagcacugggcccguggugaugagaacccaggcgccgcgcgccaggcgagggaggggaggagggcccgucugcuugcuucccggauguaggauccgcaggaaucgagcugcugaaaaauuggggcgggagaggugggagcagcggccgauuggggagggucugggacccacaggguuucugcccacuuccagcuggccugugaggguucccuguagggucuguccggugggguuccuucuaugccacuuguccuucagcuuggacugacauuccugauuauuaccggugggguauuauguuucuggcuuucuuuggggaggggaugacugcugguucugggagucgugaucucaaugucugucaggggcgucccuagcucugccuacccugaucuuucugcccacccugauccucucucucuuugcccgcagcccgccugaccggaggccagaugugccgcccacacuuguugcacagcccggguuugcccuggcuggacgggggcaaagcagcccucucugccgcugcggcccaccaccacaaccccuggaccgugagccccuucuccaagacgccacugcaccccucagcugcuggaggcccuggaggcccacucucuguguacccaggggcugggggugggagcgggggaggcagcgggagcucaguggccucccucaccccuacagcagcccacucuggcucccaccuuuucggcuucccacccacgccacccaaagaagugucuccugacccuagcaccacgggggcugcgucuccagccucaucuuccgcgggggguagugcagcccgaggagaggacaaggacggcgucaaguaccaggugucacugacggagagcaugaagauggaaaguggcaguccccugcgcccaggccuagcuacuaugggcacccagccugcuacacaccaccccauccccaccuaccccuccuaugugccggcggcugcccacgacuacagcagcggacucuuccaccccggaggcuuccuggggggaccggccuccagcuucaccccuaagcagcgcagcaaggcucguuccuguucagguaaaggcaggugcuggggacuucguggaagaggggagcauuugcguuuuugugguggggagcugugacuugggagagguggcaguguugguuucccagaucuggggaugggugaugucucgcucuaauagcccccagcagauguuugagacccccgggucagggagaggagacucuaaaacuuuugccauuuucuuaagugcuuccaguguacccccaaaguucaguuccuugccccaggguuggucacugccugaccagaacauagaacaggaauucccccuuucccucccugaaucuuaagugaaaauucaagccaccucaggacuuaguaugugaagcgagggaagugacucuguaugugcauguguuugggagcgugugugcauguguauacgugugucugugugcauguugugugugcauguuucaggcacuccggagguuccagaccauuaaggaaucugggucucuaacucaaucagucugaucuugggauuucgauggcucccugaucuccucgggagauuuuccccagagcaaaauucccaggaccugcuccugcucccugcccucgccaggcccuucccucucccucccugagggcuggagugaggggaugaagcugcagugcccccgccccuuuucccgcagcuggcuggggccaaacuggguuuguccaagaaucuggccacagagcauaaacccagaaacucguggcuaguguggaguucuugcuguccaugucucuuucccgaaucccuuugagccacagagggggaagguuuuuaaaacaguuacuccugagugcaggaaccaccuucucuugccaggcuguacuccucauuuaguuuaaacuaaaucaagaauaacuuccuggggaacacgaugccagccagugauccugcucaacuugguccccagccccagcccccgcuggccccagcacccgcugagccccggcucaggguccuaguucugcucagacccgucagcuugccuuuucuugguccuuucuccuguuuguuuugcauuuuauuugaauuccagauggucuuuuaauugaaaaaaaaaauacaaacaaaaaaaacccaggccacuuaucuaaaaaagaaagagcuuauuauuuauuuuauuuuaaagaacaacaacuucgauccauuauuuccaggacucagaaaaauucuagagcuuugguggaagaggagaaaaguuggggagaaagagggaaaugcuucuggacuuagagcagaaagacgggguggggcagacacaguuggguagaaaggagagggacaaaagaggagagggggagagacgcgccagagcgggaaggagagagccuccugggcccagccagguugagcugggugacuccugccaccacccuacccucggcaaaguuugcaguaaauacccuccugguugcuccagaacgccuggggcccugggccccuccuccccuccuccuucguuuccaucccuccuggugaggauuggaagcaggggauuuggcuuuaaacgacucuggaccugugcccccucccaugugggagacccucucgucccucuuccugcccaggcuguugcagccaggcccaggccaaccgugugccugagaggcaccggcacugcucggcuggcugcuuuccugcccuggacucccucccgagaacuugccgguuaagcaggcccccgugucucucccuguuccccugcagaaggccgggagugugucaacuguggggccacagccaccccucucuggcggcgggacggcaccggccacuaccugugcaaugccuguggccucuaccacaagaugaaugggcagaaccgaccacucaucaagcccaagcgaagacugguaggagcgggcacagguggcugggagggggcugcugggcaggagcuggcgguuaauuacaggggaaaaaaacuccuucaaaugcagacgcuuugccgcuugaaauccucuuuuaucaugaaaagcacugggaugucaguuggggucgucucucuuucuggccagauucuuucgggccagauuuccuccucggguauagggagcccaccgggcacccuugcgccaccccacucugcuccgggauccccgaaguugaguguccacgggccggacuccuguccucuggccucugcuuagcucuuuuuuaaaaauagggccaugaaguacuuuuccuuguggcucagcccuccccgacagccccgcucacaagcuccucgugcuuauuuaaauaaaacacaaacucacaccggccacuaaaaaaaccugcccuuuauuauuuuuccauggagucaccuauacuguguauuuucauuugagugauuuuaaaaaaaugcccuuucggaucuccugccggaguuuccuauccggacaucugcagccugaagauaaggaaacuucguguaucuguuuccggacucugcgaguuuuuagagucuccucagcucaguccugccucucgcugggcuguuuugaaauuucuaauacccuccacucugcaaauaaugcguaaaaugcuaagaauaauaaauauauuuuuucagggcgaagugauuuaugaggcuuaaaucguucccugcuuugggggccuuuuuuuccccuggagcgagggcggggugaggcccggguggggguagagguggaggacgcggcguuggccccugagucagaauuccagcuucaggcugcuuacucaccccucccugcccccgcggcugcagucccucugucccuucugugaccaggcuugggccuggggcuguuccaggcucugcaggccucagcccccagccccccacacucaccaccuggugcacucccgccugcaguucucugggaaguguugggggacccccucugucacuguggggcuggcguugguggaaccgggagaggggaucuguuuucuuggguaaagccucccucuagcuucucucugcaaggaccaggcgcucauuuccagacccuaccucugccaggcauuuccugagggacuaggacucagaggggcugcggggugguuaaagcucuaaggguugggguauggggggcuggaugggggggaucagcacucacaucagcuggagagauggaaaaguucugugucugcacugcccacugugguagccccuggccacaugugaauauugaucacuugaaauguggcucgugcaauugagggaacuggguuuuuaauuuuguuaauuuguaguuagaucuuauuuaaauggcugccuguggccagcugcuacaguguuggacggugcagcucugcacucuguaaaccugcgcuggccucagcgacacugacucacccaggauuauggauuuugagcggagucgugcuagaggagacacagaaucggccccagauccaggggcucgagggggaccaagccggcucagccucaggaugccugugcuacuagagagcccuucucagggccucaguuuccccauuuauggaguuagagcgcaggguaguugggggagguagcuaauucuccucuguagcucuugcaaucccguugauucuaacaucaggcuucugagaguucuuuauuccaaaguucugugagucuugacuuauuucguucucaaauucuaaaauuccaugguucugagaugcuuugauucccaugugagauuuagcccuccuugacugagcugguggggacuggggguggagcgagggucagggaggggggucgaggugggcgugggaguccagccugcugacgcugccuugcccucccagucggccgccagaagagccggcaccuguugugcaaauugucagacgacaaccaccaccuuauggcgccgaaacgccaacggggacccugucugcaacgccuguggccucuacuacaagcugcacaaugugagugcgccccgccccggccaccccgccccucccaggggaccucugcgcuuugugcugccaggcaagaggccccagccacaauauccagcuuggcuuggcuugggaagcugcugcccugagugagcgccagaagggcuucccguaagaggggugccuugccucugcucaggagguggagcuggcuaggacagggucucggacuagggaagugguuucucugcuuaaaaagggucagggugggggggaggacuucaguuggcugggcagugcuggcaugcggugggcagagccagggagggugugggucagccccauaugccagaacccgcccuuccuggaaugguagccaucuggugaugggacuaugaaggucgggcacaauuccuggcuuccugggacccucagcuugaccugccucugguccacgcuguggcggggugggaggaauguugcuggaggaaggaacuggcccucugaaaacuggugguugccucuagguuaacaggccacugaccaugaagaaggaagggauccagacucggaaccggaagauguccaacaaguccaagaagagcaagaaaggggcggagugcuucgaggagcugucaaagugcaugcaggagaagucaucccccuucagugcagcugcccuggcuggacacauggcaccugugggccaccucccgcccuucagccacuccggacacauccugcccacuccgacgcccauccaccccuccuccagccucuccuucggccacccccacccguccagcauggugaccgccaugggcuagggaacagauggacgucgaggaccgggcacucccgggauggguggaccaaacccuuagcagcccagcauuucccgaaggccgacaccacuccugccagcccggcucggcccagcacccccucuccuggagggcgcccagcagccugccagcaguuacugugaauguuccccaccgcugagaggcugccuccgcaccugaccgcugcccaggugggguuuccugcauggacaguuguuuggagaacaacaaggacaacuuuauguagagaaaaggaggggacgggacagacgaaggcaaccauuuuuagaaggaaaaaggauuaggcaaaaauaauuuauuuugcucuuguuucuaacaaggacuuggagacuugguggucugagcugucccaaguccuccgguucuuccucgggauuggcggguccacuugccagggcucugggggcagauuuguggggaccucagccugcacccucuucuccucuggcuucccucucugaaauagccgaacuccaggcugggcugagccaaagccagaguggccacggcccagggagggugagcuggugccugcuuugacgggccaggcccuggagggcagagacaaucacgggcgguccugcacagauucccaggccagggcugggucacaggaaggaaacaacauuuucuugaaaggggaaacgucucccagaucgcucccuuggcuuugaggccgaagcugcugugacuguguccccuuacugagcgcaagccacagccugucuugucagguggacccuguaaauacauccuuuuucugcuaacccuucaacccccucgccuccuacucugagacaaaagaaaaaauauuaaaaaaaugcauaggcuuaacucgcugaugaguuaauuguuuuauuuuuaaacucuuuuuggguccaguugauuguacguagccacaggagcccugcuaugaaaggaauaaaaccuacacacaagguuggagcuuugcaauucuuuuuggaaaagagcugggaucccacagcccuaguaugaaagcuggggguggggaggggccuuugcugcccuugguuucugggggcugguuggcauuugcuggccuggcagggggugaaggcaggaguugggggcaggucaggaccaggacccagggagaggcugugucccugcuggggucucagguccagcuuuacuguggcugucuggauccuucccaagguacagcuguauauaaacgugucccgagcuuagauucuguaugcggugacggcggggugugguggccugugaggggccccuggcccaggaggaggauugugcugauguagugaccaagugcaauaugggcgggcagucgcugcagggagcaccacggccagaaguaacuuauuuuguacuaguguccgcauaagaaaaagaaucggcaguauuuucuguuuuuauguuuuauuuggcuuguuuuauuuuggauuagugaacuaaguuauuguuaauuauguacaacauuuauauauugucuguaaaaaauguaugcuauccucuuauuccuuuaaagugaguacuguuaagaauaauaaaauacuuuuugugaaugccc

SEQ ID NO: 14772 - RNA, 13588 nt, Homo sapiens
gggcauucacaaaaaguauuuuauuauucuuaacaguacucacuuuaaaggaauaagaggauagcauacauuuuuuacagacaauauauaaauguuguacauaauuaacaauaacuuaguucacuaauccaaaauaaaacaagccaaauaaaacauaaaaacagaaaauacugccgauucuuuuucuuaugcggacacuaguacaaaauaaguuacuucuggccguggugcucccugcagcgacugcccgcccauauugcacuuggucacuacaucagcacaauccuccuccugggccaggggccccucacaggccaccacaccccgccgucaccgcauacagaaucuaagcucgggacacguuuauauacagcuguaccuugggaaggauccagacagccacaguaaagcuggaccugagaccccagcagggacacagccucucccuggguccugguccugaccugcccccaacuccugccuucacccccugccaggccagcaaaugccaaccagcccccagaaaccaagggcagcaaaggccccuccccacccccagcuuucauacuagggcugugggaucccagcucuuuuccaaaaagaauugcaaagcuccaaccuuguguguagguuuuauuccuuucauagcagggcuccuguggcuacguacaaucaacuggacccaaaaagaguuuaaaaauaaaacaauuaacucaucagcgaguuaagccuaugcauuuuuuuaauauuuuuucuuuugucucagaguaggaggcgaggggguugaaggguuagcagaaaaaggauguauuuacaggguccaccugacaagacaggcuguggcuugcgcucaguaaggggacacagucacagcagcuucggccucaaagccaagggagcgaucugggagacguuuccccuuucaagaaaauguuguuuccuuccugugacccagcccuggccugggaaucugugcaggaccgcccgugauugucucugcccuccagggccuggcccgucaaagcaggcaccagcucacccucccugggccguggccacucuggcuuuggcucagcccagccuggaguucggcuauuucagagagggaagccagaggagaagagggugcaggcugagguccccacaaaucugcccccagagcccuggcaaguggacccgccaaucccgaggaagaaccggaggacuugggacagcucagaccaccaagucuccaaguccuuguuagaaacaagagcaaaauaaauuauuuuugccuaauccuuuuuccuucuaaaaaugguugccuucgucugucccguccccuccuuuucucuacauaaaguuguccuuguuguucuccaaacaacuguccaugcaggaaaccccaccugggcagcggucaggugcggaggcagccucucagcgguggggaacauucacaguaacugcuggcaggcugcugggcgcccuccaggagagggggugcugggccgagccgggcuggcaggaguggugucggccuucgggaaaugcugggcugcuaaggguuugguccacccaucccgggagugcccgguccucgacguccaucuguucccuagcccauggcggucaccaugcuggacggguggggguggccgaaggagaggcuggaggagggguggaugggcgucggagugggcaggauguguccggaguggcugaagggcgggagguggcccacaggugccauguguccagccagggcagcugcacugaagggggaugacuucuccugcaugcacuuugacagcuccucgaagcacuccgccccuuucuugcucuucuuggacuuguuggacaucuuccgguuccgagucuggaucccuuccuucuucauggucaguggccuguuaaccuagaggcaaccaccaguuuucagagggccaguuccuuccuccagcaacauuccucccaccccgccacagcguggaccagaggcaggucaagcugagggucccaggaagccaggaauugugcccgaccuucauagucccaucaccagauggcuaccauuccaggaagggcggguucuggcauauggggcugacccacacccucccuggcucugcccaccgcaugccagcacugcccagccaacugaaguccucccccccacccugacccuuuuuaagcagagaaaccacuucccuaguccgagacccuguccuagccagcuccaccuccugagcagaggcaaggcaccccucuuacgggaagcccuucuggcgcucacucagggcagcagcuucccaagccaagccaagcuggauauuguggcuggggccucuugccuggcagcacaaagcgcagagguccccugggaggggcgggguggccggggcggggcgcacucacauugugcagcuuguaguagaggccacaggcguugcagacaggguccccguuggcguuucggcgccauaagguggugguugucgucugacaauuugcacaacaggugccggcucuucuggcggccgacugggagggcaaggcagcgucagcaggcuggacucccacgcccaccucgaccccccucccugacccucgcuccacccccaguccccaccagcucagucaaggagggcuaaaucucacaugggaaucaaagcaucucagaaccauggaauuuuagaauuugagaacgaaauaagucaagacucacagaacuuuggaauaaagaacucucagaagccugauguuagaaucaacgggauugcaagagcuacagaggagaauuagcuaccucccccaacuacccugcgcucuaacuccauaaauggggaaacugaggcccugagaagggcucucuaguagcacaggcauccugaggcugagccggcuuggucccccucgagccccuggaucuggggccgauucugugucuccucuagcacgacuccgcucaaaauccauaauccugggugagucagugucgcugaggccagcgcagguuuacagagugcagagcugcaccguccaacacuguagcagcuggccacaggcagccauuuaaauaagaucuaacuacaaauuaacaaaauuaaaaacccaguucccucaauugcacgagccacauuucaagugaucaauauucacauguggccaggggcuaccacagugggcagugcagacacagaacuuuuccaucucuccagcugaugugagugcugaucccccccauccagccccccauaccccaacccuuagagcuuuaaccaccccgcagccccucugaguccuagucccucaggaaaugccuggcagagguagggucuggaaaugagcgccugguccuugcagagagaagcuagagggaggcuuuacccaagaaaacagauccccucucccgguuccaccaacgccagccccacagugacagagggggucccccaacacuucccagagaacugcaggcgggagugcaccagguggugaguguggggggcugggggcugaggccugcagagccuggaacagccccaggcccaagccuggucacagaagggacagagggacugcagccgcgggggcagggaggggugaguaagcagccugaagcuggaauucugacucaggggccaacgccgcguccuccaccucuacccccacccgggccucaccccgcccucgcuccaggggaaaaaaaggcccccaaagcagggaacgauuuaagccucauaaaucacuucgcccugaaaaaauauauuuauuauucuuagcauuuuacgcauuauuugcagaguggaggguauuagaaauuucaaaacagcccagcgagaggcaggacugagcugaggagacucuaaaaacucgcagaguccggaaacagauacacgaaguuuccuuaucuucaggcugcagauguccggauaggaaacuccggcaggagauccgaaagggcauuuuuuuaaaaucacucaaaugaaaauacacaguauaggugacuccauggaaaaauaauaaagggcagguuuuuuuaguggccggugugaguuuguguuuuauuuaaauaagcacgaggagcuugugagcggggcugucggggagggcugagccacaaggaaaaguacuucauggcccuauuuuuaaaaaagagcuaagcagaggccagaggacaggaguccggcccguggacacucaacuucggggaucccggagcagagugggguggcgcaagggugcccggugggcucccuauacccgaggaggaaaucuggcccgaaagaaucuggccagaaagagagacgaccccaacugacaucccagugcuuuucaugauaaaagaggauuucaagcggcaaagcgucugcauuugaaggaguuuuuuuccccuguaauuaaccgccagcuccugcccagcagcccccucccagccaccugugcccgcuccuaccagucuucgcuugggcuugaugaguggucgguucugcccauucaucuugugguagaggccacaggcauugcacagguaguggccggugccgucccgccgccagagagggguggcuguggccccacaguugacacacucccggccuucugcaggggaacagggagagacacgggggccugcuuaaccggcaaguucucgggagggaguccagggcaggaaagcagccagccgagcagugccggugccucucaggcacacgguuggccugggccuggcugcaacagccugggcaggaagagggacgagagggucucccacaugggagggggcacagguccagagucguuuaaagccaaauccccugcuuccaauccucaccaggagggauggaaacgaaggaggaggggaggaggggcccagggccccaggcguucuggagcaaccaggaggguauuuacugcaaacuuugccgaggguagggugguggcaggagucacccagcucaaccuggcugggcccaggaggcucucuccuucccgcucuggcgcgucucucccccucuccucuuuugucccucuccuuucuacccaacugugucugccccaccccgucuuucugcucuaaguccagaagcauuucccucuuucuccccaacuuuucuccucuuccaccaaagcucuagaauuuuucugaguccuggaaauaauggaucgaaguuguuguucuuuaaaauaaaauaaauaauaagcucuuucuuuuuuagauaaguggccuggguuuuuuuuguuuguauuuuuuuuuucaauuaaaagaccaucuggaauucaaauaaaaugcaaaacaaacaggagaaaggaccaagaaaaggcaagcugacgggucugagcagaacuaggacccugagccggggcucagcgggugcuggggccagcgggggcuggggcuggggaccaaguugagcaggaucacuggcuggcaucguguuccccaggaaguuauucuugauuuaguuuaaacuaaaugaggaguacagccuggcaagagaaggugguuccugcacucaggaguaacuguuuuaaaaaccuucccccucuguggcucaaagggauucgggaaagagacauggacagcaagaacuccacacuagccacgaguuucuggguuuaugcucuguggccagauucuuggacaaacccaguuuggccccagccagcugcgggaaaaggggcgggggcacugcagcuucauccccucacuccagcccucagggagggagagggaagggccuggcgagggcagggagcaggagcagguccugggaauuuugcucuggggaaaaucucccgaggagaucagggagccaucgaaaucccaagaucagacugauugaguuagagacccagauuccuuaauggucuggaaccuccggagugccugaaacaugcacacacaacaugcacacagacacacguauacacaugcacacacgcucccaaacacaugcacauacagagucacuucccucgcuucacauacuaaguccugagguggcuugaauuuucacuuaagauucagggagggaaagggggaauuccuguucuauguucuggucaggcagugaccaacccuggggcaaggaacugaacuuuggggguacacuggaagcacuuaagaaaauggcaaaaguuuuagagucuccucucccugacccgggggucucaaacaucugcugggggcuauuagagcgagacaucacccauccccagaucugggaaaccaacacugccaccucucccaagucacagcuccccaccacaaaaacgcaaaugcuccccucuuccacgaaguccccagcaccugccuuuaccugaacaggaacgagccuugcugcgcugcuuaggggugaagcuggaggccgguccccccaggaagccuccgggguggaagaguccgcugcuguagucgugggcagccgccggcacauaggagggguagguggggauggggugguguguagcaggcugggugcccauaguagcuaggccugggcgcaggggacugccacuuuccaucuucaugcucuccgucagugacaccugguacuugacgccguccuuguccucuccucgggcugcacuaccccccgcggaagaugaggcuggagacgcagcccccguggugcuagggucaggagacacuucuuuggguggcgugggugggaagccgaaaaggugggagccagagugggcugcuguaggggugagggaggccacugagcucccgcugccucccccgcucccacccccagccccuggguacacagagagugggccuccagggccuccagcagcugaggggugcaguggcgucuuggagaaggggcucacgguccagggguugugguggugggccgcagcggcagagagggcugcuuugcccccguccagccagggcaaacccgggcugugcaacaagugugggcggcacaucuggccuccggucaggcgggcugcgggcaaagagagagaggaucagggugggcagaaagaucaggguaggcagagcuagggacgccccugacagacauugagaucacgacucccagaaccagcagucauccccuccccaaagaaagccagaaacauaauaccccaccgguaauaaucaggaaugucaguccaagcugaaggacaaguggcauagaaggaaccccaccggacagacccuacagggaacccucacaggccagcuggaagugggcagaaacccugugggucccagacccuccccaaucggccgcugcucccaccucucccgccccaauuuuucagcagcucgauuccugcggauccuacauccgggaagcaagcagacgggcccuccuccccucccucgccuggcgcgcggcgccuggguucucaucaccacgggcccagugcucaccgugcgcggggcuguaggagacgcgcgcccgcgcgugagcgggguuggcauaguagggguugcccugcgagucgaggugauugaagaagacguccaccucgucuggaggcagcagcugcgcggguuccauguaguugugcgccaggcccggguggugugagucggggugcugcgcauucagcacggccgggugcgccauccagcgcggcugcucgggcgccaccuccauggccggcggcggcggcucagggucugggugcagacggcaacggcccugcgcgaggaagggggagugaggcgugccgccagcgccugacaccccccaaagucccaccacgaggugucccgcacgccacggagccccagcccagauccggcgagaaagagcaccagucccgggugggaggaaagcccaaggcucaaaacgaaaggaaggcgggggaggggguucagccacgcacacucacguggugacccgcggcuccagaaucacacacccgugcacauggggucacgcccggggacgggucccgacaccagugaccccaacaaacgcacagagcagcacuucagucagacacucacacugagcccccccgcccgguagacaaacacaugaacacagacucaaaaguuggagacaggcgcccgggcacccaguguggcacuugaucccagcgacacgcacacacccacacuuggcgccagauacacauacugaucucaaccccgaaaacaugcacacgcagcccccugagcgcaguacuaagcggcacaaucaggaccucucaacaaagcacaccaaagcagucgcccgcagccuggccccccgcccuaaguccccccagaguccccucaaagcuaggagcgccccaggcccccagccggcucucaaaccccaaacuuacacacgcagccguggggaggggagggacucggccucugagagugaaggaguuccggcgggagccccgagggcgacgggcccagggacagcacguccggaggcuggcggggcuuacaggguaggagcuggggguagagugcgccucggccucgggcccucccggcuccggccccucggcauccuccggccgcccuggcgccagcugccgacuccugcacagacaugaagcgggggccgcgcacgccuaagaagcccaagccagccaaucaacgccgcgcgccucccagccuccgccucccauuggcugcguccgcaauucccgaaccgcuggacuccgggacugacccgcgggccggccccccucagccggcgggcccccucccugcgcgcuccuggcggccccugcugccaacgcgccccaccacuaagggacccucaccccaaggcccgaccccugcagccccucuugcgaacacuccgggaucccucgaugcucugggccucccuagcaguaacuaaccaccaacugcccccuccccaggagcccgggccgcacacccucuggauggccucuccccgagacccuaaccccgccacgcuccuucaccgcugaacguggucaguccgagcgcaguuaccuacccagaccguucccuccccuagcucgggcgcugucuggguggacuggggguugggaugguucggacgacagcggcggaacagcaggagccgagaggggcagagaggggcaggaacuacagggcucuagagggcaccugggccucggacacgcggccgcucagggcugugcuugacccaguggagguggcccggccgguggcuccagaaagggggagggggcaccccuccccgggcguggccuucgcaggccaacgggcccaauugccuggggcgaggccguggagacccggacuggcgccggcgccagcuggagggagacgcccccgggcaagagguggcauuuuuuuuccuccgggggggguccccgagguggccucuggugagggggaggcgguggucugaggucuccgucuucuaagucaccuggaagugcuccccacucacuucuagcccggagaucggcucuaugguucgugugggccgggcgcacaagucuuccucccucccauuguacagacuggggagacggaggcucgaagggagccccgggccgaggagggagguccaggacaaaggcauuuugggggaccuagacaggugccgaguacuggggggacucaacagcguccuccagcccucuucccuguugggcccgaggcucccgggguagauguccagagggcccccaggugggucgggggcaggaggagggcuggggucccggccacccccgggagagugggggaggggcggcgggauugacagucgguaauuggguaacuggaggcggcuucuccggccgggcggccccgccaccgcgacgccgagccccugacgucacccgauucgccaggaaaugaacuuuuuaauaauccgaggagggaggaaagcccucgguccccucggcuccgggggcgcccggcugggcccagcuccgcgggcgcgcccccgucacccccucccaggccaguucagggcagcgccaaggggccgcgggcucaggcugaggccuccuccugccuaggcgucuggcguccguuugucuguccgaggccucagcgcagguaaagcgcggggcuggggggcgcagagcuccauugggcugggaaccagcgcgucucgugcccuugggggacccgccugcccgagccgccugcuaagccucccgcuccccuccacgcuggagcgcgcggagcccggucugcucggaacuccacucugcgggagcggaggccggcgccagcccgggaagccgcgcagggggcgggaggccgagcgcgaggcccuuggcgccgggccuccgcggccaggccgggcaggugagcagucuccgugccucccgguuggcguuccccucaacgcgugcggucccgccggggcccacugucucuccguccgucugucucucaacuuuucccauccuuuagcuuacgauucuucaucaacucguaaaaugagaucgccgcggagcucgagccuauuuggcgucuccggagacuagcaagacccucugaaagacaccgcguccccagggauaaucccccguguccggcaaagcugccccgcucgagcgcgaacccugggacccagcgcgggaggcagaccagcagcuggccgcugggcugugaacgccaggaccgagcggaagcuucccgcccggccgcgaucggugccgcggcucucagggaaguggcuacgcgcgucccucgggaaagcagguaauucgccuuuuucucccaccggcgcgguaaaaauuacccucccccuccccguuccguguguauucccaguuucagcgcagcgagcucggcgucuaaccccuccgcggcagggucccggccacugcgguaguggagguggccagccuggcugaguccccugcccaaacgucagcccugugcugccgccugccugacgcagagcggagcgagggaggggauuuaauuaccccgcucggcagcucagaaaaucgccgcacagaggggcuuagcaggacgguuaaggagugcuugagcaggggccucgggagacccgaaccagccuccuugcccgcaauccgguguagaggaaaaaaaggaaacaggaguucugccagguccuuucaggccuugggguugccuuccucgacaacgcaggcaggagccggcuugaccgaagccuccaccucgguugcagguccugcguaggaugcgggacugcugcauucucuggcggaaacgaacccgccugggagagagaaaugcgacgccaaguagcagggcgcccagcuggccaauaaagagggacccgcgcucgacaaugucugugugugccaggcagaccgagggacaccaaccgggccccuccccauuaggccgaagacaugguccucccaccuugggccccaaacaaacucccggggagggucaacgcagcccccagaaucugcuggggucuugaggcgcuguuccaggccuggugagagcagauuuacuccaauuuaugggcuggaacuuugggguccccaaaacaccuuuagagggacgcguucccuuuuucaguacuuuguucguucgggaguauaguuggaaaugcuggcgcugccuuugaucacauuaagaagcugucacuuuccuuacuugggaacaagauuucucugaggacuggagaaggucagccaggaagcagaauuuucgaaggacccuuuuggcccgagaacucacagcggcgaucgccaccauuugaccugggugcuucugccugggagcuggggagguagcagaucuggugcccgguucuagagugcuucucaggccucuacuaagccgcgggugccagguggggacacagagaugcccaggucuccccggccguccagccccccccccccucugagcccuuuguuuaaaguuagcucauccgaggcggccccuuugggaccauaaguuugcccucccuuuguaaccuaauucuucucgccuuuuccuuaugggcagcuaauuggcccgcgguguggggcuggggguggggugucaaggaaacccauuugcuaagggacuaccuuccauagagaaauuuaauucgcaacccagcggccucccagccccacacuggcaauaaaccuugagggguacggggaggaaguggggugccuuagcagauggguucagaaguucccuuaaagccggggcauuagaucucaggccagcagccaucccuccggggggguucccaagggggggacuacugcuauaacggccccuccugcuccuugagguucaauuccagccccuuaaagcagaaggcucccucccucggcaucagugcaggcucucccaccucauuacuguucugugucuuugggaaucguagagucuguggcccccacguccuaggugucucggcacccuggacccaggcgccuccgagauucuauaucgcuucugaccccuaccuucaagccuggcaggcuccccgcggaacccugcugagacccggagacaaucgggccgugcuucucccuccuccacgaacagccacgguuuauuuggagcggccggggccggcggccugacaacugguaaauccguuucguuaggcacaauuugucugcaauuugucagcccggcugggaaacgcuccccagacgccucggcugccgcacgggcccuaccugguucucgaauccugccugcucauaaacgaauccuagcacggggugccugcguagaccuggagcucaccaccagauguucccgaccucgggagaggaggcuuuuuccaaaacaacgaauuuccuuccuuguuuuccgguaaaggagcguucgccacacacggggucccugaacgcggggccuuuccccucgugguuggagcaacgcggaguucaagccuggccgccacagaauaauuuuaaaugccccguuuucagacagauccagaacgccgucuacgccuaccggcggcagaucuucaagcccgcggcggccccauucuuauugaaaucccacuaaacggauuccgacuccggcuuggggcggggggagacuuccagacccggcgcucucccccacacgcaccccagucacacaggauaaagggcugcggggcgcagcgcgcgggggcgcaagcaggagcgagcuggguuaagccgcgaaaagccggcgcacgggaccagccggcaggugcagccgccgcucggcggcccggcucggacgcauccgccgcgguggccuggggauugggggcggccgagacaaaggccccaguucgggggccgggaggcgggggugcuuugcgaggcucugggaaugccagggucucguggccuguggcuccgagaaaugggaagacaagaggcccgaggcgggccugcugugcccagguaaccaaauacucccucugguuaaagucccuauaaccaggguuuccggucucuggcagggccaaggcgagccccaaagguaggggccacagggcaaacggaccaagcgauucgggugccaggcgggccgggccgggggcgggaagggccgggcccagggaagguggaaguggaagaaacucaccgagcgaggcgcggugggcggcgcccccgggcggacggggccuggaguagagcugggagcagggcgaggugcgcggcaggcgggcucgcgggaccugggcgcgggguggcg

SEQ ID NO: 14773 - RNA, 255894 nt, Homo sapiens
caacuuaacgggccggaccgcggcgacuaccgagggaggugaggggcgggccgggcggguguccgaggcggcggcggcggcauggcagggcggcgggugaacgugaacgugggcgugcugggccacaucgacagcggcaagacggcgcuggcgcgggcgcuaagcaccacagccuccaccgccgccuuugacaagcagccgcagagccgcgagcgcggcaucacgcucgaucugggcuucucgugcuucucggugccgcugcccgcgcgccugcggucgucuuugcccgaguuccaggcagcgcccgaggccgagcccgagcccggcgagccacugcuucaggucacgcuggucgacugccccgggcacgccucccucauccggaccaucaucggcggugagcgcgggccggggcgggagccgggcucagggacgcgggcggagcgaccgggccccguguccgaauucgcucgagccuuugccgggacgggaaaucgccccaccucauugguggggcuccugacgccccaagaggcggacgugacuugccuagggcuccgcagcaagugagcggaggcuuugagauucagcuuuucccauccagcagaaccgagcugcaaggcgccuuccuuaaaaaaaaaaaaaaaaaaaaaucaaaaaaucccuaccaaauguguuuauaauacauggucaaguaaagaaaacucaaaauaagaaaacucacaagcuacaaaaaggguauacauacaaaggcugucuucauucaccugucauuuggucugauucccguuccuagagccaaccgcugcuaccaguuuuuguauaucauuucagaaaggcuccacgucaauacaagcauaucuguguguauguauaaaucccucuuucccucauccuuuuagacacgauuucacucaacauugugucuggagagugccccauaucuguacacaaagcuacaucauucuuuuuaaagcucacauagaauucaacugcacccuuguaccaacauuuucuuuuucuuuuuuuuuuuuucuuuuugagacagagucuuguucugucgcccagccuggagugcaguggcacgaucucggcucacugcaacuuccgccuccuggguucaagcgauuguccugccucagucuccugaguagcugggauuacaggcgcgcgccaccacgcccggcuaauuuuuuuguauuuucaguagagacggguuucaccauguuggucaggcuggucucaaacuccugacuucaugacccgcccgcccuggccucccaaaguccugggauuacaggcgugagccaccacguccggccuguaccaacauuuucugaacaaaucuuuuaaugauggacguuuaugcuguuuccaguauuuacaaaccauuuugcagugaauauucuagaacagaacucuuugguauguucgcauauauguaggauaauagauaauaacuggcuggggcaaggggcauguguguuuucggucgugguggguacugccaaaaugccccacaaagagguaccauuaauuuuuaauuauacauguaauacaugaauacaugcuacuugugaagaaauagaacaucacaaauaagacaaacauucccuuacccacuccucuguccuaaauucuguaccccuccuaucucugcaaaugaaaagacccguuuuuuguuuuuuuguuuuuuuguuuuuuucugagauggagucucgcucuguuaccaggcuggagugcaguggugcaaucuuggcucacugcaaccucuuucuccccgguucaagcgauucuccugccucagccucccaaguagcugggacuacaggugcacaucaccacaccuggcuaauuuuuauauuuuuaguagacaugggguuucaccauauuggccaggauggucuugaucucgaccucgugauccccaugccucggccucccaaagugcugggauuacaggugugagccacugugccuggcugaaaagaccauuauuauaccuuuguggauuacuuuuccagacccauuuaacuccacuuaaauauauggauagaguuuuaaaacauguuuuguuuuuagaaaaaaugauacaauaauauaaacacaugguauaaaaggguauauagcuaaagaaguauacuucucacugcugaccccaguaccugauuaccuuucuguucccauuuucuuguguuuccuuccagcaauauucuguaugccacacaugggaauauauauugggcagaugauaauuggcuugguggcagauggccucauuggucacugggcauucugggucccagcuauaauggugagcuuguuaaguacaguacuucaucuuuguuaccucccaacuguuucauguuacaggcagucugagaucauuuccccauuuuacaguagaggaaauagaaguuugaagaagugaagggacuugcucagggucacacuaucuaaagucuucuccucaauccauguuucagucaggugaauuucaaggggcacacaauucucuacccauuccucccugcccccuuauaacugaauucuguuuggucacaucaaaguacauuuuagaacauggacucugagccaguccagacuggagguggaaggcagagguuaaaaaaugagauggcgaguuuuuaguguugucuaguaaauaggguagaugaguggugaaggacauacuuuuggagucagacaaaacugggcuugaagccuagcuugcuuucuuccuuagcuguaugacguuugaaccuaauucuggaccuugcuccaacuggaagauagugguaaccacacaacuauuuauuggcuugacuuuucuuguguauuugcugcuuaccaggcaaacccugcaaggagcguggugguuaccauuuaauaguugagaaaauugggacuuagggaggcagguaguuagugaaacaguccaggucugccugacuccaaagcuggaguccuuugcaugcuuccccagguuacccuauaguucccucauccgcuuccaacauacgugcauaccucauguuauugugcuucacuugauuguacuuugcagauagugguuuuuacaaaucgaagguucaaggcaacccauccaacagcauugcuuacuuugugucucuaugccacauuuggguuauucuuaacaauauuucaaacuuuucaucaaauauuaagcaucaaacauuucacuucauuucaaacacaugucaucuguuaauggugaucugggaucagugaucuuugauguuacuauuguaauuuugaaaugucacaaacaaugcuuauguaaggcagcaaacuuaauaaauguuguguguuuucugacuguucuaccuacuggcuuuuucccugucugucucccucuccucaggccucccuauucccugagacacaacaauauuaaaauucauccagcuaauagccuuuaugcguucaagggaaaggaagaguugcaagucucucacuuuaaaucaaaaguuagaaaugauuaagcuuagugaugaaggcaauguugaagacugagauaggcugaaagcaaggccucuuacaccacaccaaacagcaaaguuuuggacgcaaaggaaaaguuccugaaggaaauuaaaagugcuacuguagugaacacacagaugauaagaaagcaagacagcuuuauugcuuuauagagaaaguuuuaguggucuggauagaaaaucaaaccagcuaccacauucccuuaaguggaagccuaauccagagcaaggcccuaacucuucaauucuaugaaggcugagagagguaaggaagcugcagaagaaaaguuugaagcuagcagaaguugguucaugagguuugaggaaagaggccaucuccagaacauaaauguacaagaugaaacaacaaauggugauagagaagcugcagcaaguuauccaggagaucuagcuaagaucauugaugaaggugaguacacuaaacagauuuucacuguagauggaacagccuuauauggagaagaugcuauguaggacuuucauagcuacagagaagucaaugacuggguacaaagcuucaaaggacaggcugacucuuguuaggggcuaaugcagcugaagccauugcucauugaccauuccaaaaauccuagggcccuuaagaauuaugcuaaaucuauucagccugugcucuugaaauggcacaacgcagccuggaugacagcacaucuguuuauagcaugguuuacugaauauuuuaagcccacuguugagaccuacugcuuagaaaaaauacuccuuucaaaauauuacugauuguugauaaugcaccuggucaccuaauggcucugauggagauguacaaagagauuaauuuguuaucaugcuugcuaacacagcauccauucugcaguguaugggucaaggaguaauuuugacuuucaggucuuauuauuuaagaaauauauuucauaaggccauagcugcccaagauaauaauuccucugauggaucuggacaaaguaaauugaaaaccuucuggaaaggauuuaucauucuagaugccauaaagaacauuugugauucaugggaggagguaaaaauaucaacaguaacaauaauuuggaagagguugauuccaacccucauggaugacugagggguucaagacuucaguggagcaagucacugcagaugugguagaaauagcaagagaguuagaaugagaaguggugccugaggauaugacugaauugcuacaaucucaugaucaaucuugaguggaugaggaguugcuucuugugcaugagcaaagaaaguaguuucuugagauggaaccuacuccuggugaagaugcuguaaacauuguugaaaugacaacaaaggauuuagaauauuacauaaacuuaguugauaaagcaguggcaagauuugagaggacugacuccaguuuugaaagcaauucugugaguaaaaugccaucaaacagcuucacaugcuacagauaaauuuuuguaaaaggaagagucaccugauguggcaaacuucauugucuuauuucauuagauugccacagucaccccaaccuucaucaaccaccacccugaucagucggcaaccaucaccauugaggcaagacccuccaccagcaaaaagauuaugacuugcugaagguucaguaaucauuagcauuuuuuagcaaugaauuauuuuaaaauuaaggaauguuuauuguuuuuugagacauacuacuauugcacacuuaauugacgacaugucauguaaacauaacuuuuauacacauugggaaaccaaaaaauuugacuugcuuuauugugauauucacugugcugcaguggucuggaacugaaugcacaauaucuuugagguaagccucauuuguagagaagcucuucauauugcaaaaaaguuucagcacuugccugguccuauauaaccaauuguaaugcccugaagaauuuggcaaguuuuuuauuuagacuaaaacuguagaagaacuuauuuuuguauguacauuguugcuuaucuuuugucucaucucuggaguagggagauuuaucuucuuaaaauauggccugaguggaauggaaugcugagaccaaggcugcuaccauucuuccuugaauacaucagagacccaccuuccuuuucagggaauugagaaaaaacaauguuuuucuuguaaagagaagguguuccccauugagugccugcucgggcccaggccuguugccaggaacuugcaucuaugcaauaccacccuguguggugggaguguuaguuagccuuauuucucagaugaggaaacccaagcaaagugccuugggcuaguguuggaaccuaacuccgccaccccuaaccuggaucugguuaauaccuucauuucaccucaugguccacaaacuugugggcaucuuugccuucuugaaauggcccccaaggccauccuggcuuauggcaccuggacuucuacaguucugcccccugccugcuuauucuccuccucccucugauucauucucugcacagugggcauugcucuccuuuuacaaguguucaucagaucaugucagcccuacacuugacaagacuuuccagugaguucucauugugcuuggaguaaaauccagccacuuuguggcccauaggacaauggucuggcucugcuuuccucugaucccaucaacgaucccaucaacgacugcuccccacucugaccuucagucacgguggccucauuucucuuccuccagugggcccaccagcugcuucccucaggacauuugcaccuguuguugccucuguuugguacaucuggcuccuuaagucucugcuuuaauggcaccuccucagcagccucuccugccccaccuaucuaaaguugucucuucaacccucacccccucauacuuucucaugucccuguuucauugccccagcagcccuuuucacuaccugacguucuucauguguuuacuuguugaguaucuguccucugcuagaaugugagcuccaugagaccagagcaggaaccuuguuugucucauucaccaguguucucagcacuugggccagagccuggcauaggauagauauuuaguaaguucuggaugaaugaagccuguguaccagcuccugggcuagccaguuuuagugagcagagaaccuucuuuguggguuaguggacagaaggcaacuagcuuagggccuggccuguagugaauuaugcagguugguucuuuguccuccccuuuaggagcuuacaucagaacccggaagacacugcuguguacaaagugaucuucuggaguucuuugcacaagggcaaaagcaggaguaacucacuuuuucuuuccuaggcaagggcaaggcucugagccuuaaacaugccauugugucucaacaucagagaugacugccagcauuuaggcauggcuggaaaucggcguggugugugggaggugugcuaaagaugaagcuagaaggguuggcagggccagacccuagagaauggcccuuaguguagauuuuuccuaaggguccuggagcuccuuggaaggcuguuaaagcaggugugugauaugauugggcugagcuuuugauagaaaguugcaggauugcugggcagggauucccacuggcagcaggugugguuuucucuagcugcaccugcaccuggcaucccugggagaucgggcucuuguuagaguuccuugcuacugugaaagauuuagacccccuguggaauauguuauucccaggagaaggaaauuauaacaguugucugaguucugugaugauaucucugaaguuuaauauaucuuaaauuaaagcuggcucuaauuccacugugugcgcacacacacgcgcgcacacacacacacacacacgaauccuaucuuaacuuagagaaaauuggguuuuaucucccuugaugcauguggccacagauaaaacuaaguggugcugugggguuaacagugauaauuguacuuaccauuauuuagugcuugucuguaugcuguuuuuuugauuuguuuguuuaaucuucacacuauuccuaggagguaagaguugcuauucccauuuuacagauaaaaaaccauggcucagaggucagggaacccaguuaguaagugucagaacuagguuugaacccauauugaucugacugcacagcccauacgcuggcauucucagugugaaugaaaaaguguacccguccauuccagcccccuguagugguucagagcaguauuuuucuugaauccauuuuagaguauaaaucuuucaggguuacaacuucaaaaagauucaguaauguauguuuuaaagacuugggugggugugagggacuuagacucauccucaaucuaacucuggcaggaaagaggagggcugaaaaaugcugguaucuuggcuuggcaauuuauaguccucugguggcugugaggauuaacaguguauugucucccagucuuuuguuucgguuguuaaugaacagcacugcuacuugucgccuggaccucuugccuucuguacacacuauuuuagcggugccuccugcgugggucugacccucucugagcccucccugccaagagcugaggagggcugcaaaagacuucuaagucugacucagguuacucuccuugaaggagagaaacauccaagagccuacaagauuuuugucucugcagccuggagagaacauucuuuguaaaacuuaagcgacuuugccuuuuccuuuuuuccagccuucuguguucuuggcgcccauguggagaaggcucuuccccuuucaucuguuuuauugaggugugugcccuucauucuuucugcagaugcccucucuugacucguaaaugaaacaagggguucuugugugugaaugaauuucaaccagauuuuuuugugauacccguuaggcaucugcacauauccccggaaagcagccugcuccaggcagaaauaacauacugggggcuugaccagguaggccuugguguccuugaggaauuuggguguuacucuaaugcaaaagcaaacaaaccaaacaccacuuuugguuuucuuuaccccuagucuuuucaggagaaucuguguaggaauauauuaugugaaauugugguaauuauguauguuuguccuaaaauacugaggcauauuugaaggaguucuaaguggaaaugcuuucuucagcuuuacuucuuuaguuccuaguauccaucaggccuuaguucccuguuucuuugugcccauccagugagagcuguuucuuucucuucuucacugaaagguacacaccauaacuagaagauucuacucuccaguacugcuucuucgacguccucuaccaccaacuaaagcugaggcugacacuggaguugcuugccuucacuugcuucaaagacucuuauguucaauagagucugccucacucagcacuaaaguguaccacuauucaaguacaaguuuucuuguuuugccugguaccuuauugcucucugaccccaccugaucuccccauacacuggagugccuuuaacucucuccaggagacucaaguugagcuuugucugcggcaccuucucuuggcgcuggacagcgggugauuuugcuuuagcuugggugacagugugggaguagcgcaacaucagagacacagccuugaguuuaaauuaaugcagaauauuugagcaggaaccaacaggaaagaaaaauggaagcagguagucauauuucauucuguugggguacauuuuucuucucauggggcuugcccuugagaacaaaacauaucaaaaguuaaaucaaagaauauuuuuguagucgugcuaggaauagaaaauaaugcaaagacucuggcuucuugaggcaaauauuuugcuggaagguuauaaucaaagucagaaggaaaucauagccacagcuuucgguaaagcuguaaucauuuaaaauuaauugcuuuuaaacuuuucacugagcauccccuuuguuuucuaucagcaugucucuuggguuuuucuucggaaucauuccauccagguuggaauaggauucgggcaggcaucccaggaaacaacccauaaauuaagcccuaagacauauuccccuuucugucauucuuuuguuugauggagccucaaccaggcuggggaugagauacucuuaccuuaagagcucaauucuguguccccuuuaccaguaaaggcuuugaugugcggaaaaugaugguaucuauagcucugguacucuggguaucuuggaggcccagucuugguggggguagagccuggcacuucugaggcagccucaugguaggauagggagcuggagugaguccucguucuucuaggcucuggacuugguugcacagcaugcaucccucuuggugugaacacuucacuccaauggcugguuuccaugucuccucuuuccauuagccuggaagcuugaugggguagagacaauaucugaaucaucucuguaggucuagggccaacccagagccuggcauacagcagauaauaauuuuaaaaacauuuuuaauuuuauauaguguuuauauaauuuuuuaaaauaauuuuaugguauguaaauuacauaccauaaaauucacccauuucacugaguguacacuaagugaacacucagugguuuucacuguacucauacaguuguguagcugucaucacacaaucucaguuuagaccauuuucgucaccccauaaagaaaccacaucccuaccaggagucauuccccauucgccccucucccaggccuaggcaaccacgaaucuacuuaaugucucuggauugaccgguccuggacauuucauauaaguagaucacacaauauguggccuuuuugucuggcgacuuuugcuuggccuccuauguugcccaggcuggucuugaacuccugaaguuaagcaguccucuugccucagccucccaaagcgagcauaugcuuugggaaccaguauugcauuuuuuugugaaaaaaaaaaaaaacaaaacuauuucuauugauuucuacuugugguaaaguauaaauaauguacaauuugccaucuuagccaucuuaaguguacaguguguggcaugugcuccucaggcugccuccucuuucugugaugugccuggcccauggagacauuugggcugguaggccuuguuuuaagggcuuucggcagcuuguguggugggaaaggaccacauggagcugcauuugguguuuuucuccacucacucagagauucuacacauacacguugcauggcuuuguuuuggacgugagggcagauacacagucgugccuguguucaaggggcucacagucccgaguagggaggaggaagccaggcagugccagcagccaguuuaagauguggagugguaagggcuuugaucgagaugggcauagaaaugugaguaccugccugggguggcagauagggaauccugcuggaggagacacacggcugggccuggaaggaugaccuguggauuuccaggcugagagauccaggaaacagccuuagcagaguccagaggcauggaagcagcccuggcuaaagaaggggaguggucaggguggcuggcacuugcacacaggggggugugaaaggaggugcggccagguuggcugggucacaggccaguccaacuggcuugugggaauugugaaggaugguugagauauuacauuuuagaagaugggaggcauuccagcuagaggacucagaguaaacaaggaccuagagacaaagggagggcuggagugugacugggguaucaggccaagcuuccagaggguagcccggaccagaucucaggagccgggagagucucuucugggaggaaggcugguagguuuuaagcuucugguggcuuuuagugagcucccugagucugaggagaggacugugacaagugguccuagggccugucauuccucucaucauuccagcuucagcuuucugacccagcuggaugaaggagaagaggaaggacaccucaggcaggcaaggcggaugccaucagcagggaaaguggggcucugggguugcagacauggcagugcugagcaguggccaagggauaguucugccucuuggagggagaugaaagaauggacuuuuggagaacgcuugcugucugcuggacacuguucuagacccguggcucuugcugcauccucccagccagucuccuagggaggcguuuccaucuacauugcucagcuacuagaaaugaggcucugagcaguaggcaguuugcugcagggcgcacaaguagccagugccaggcucuguuucagaggcccuggcuuugcccagaagcugcucucagaccuuagcacaugccugcuuccauagaaaauuguggcuccugaggaacacuuuauauauaaaucaaauugucaaaaauagagauuucugcuucuauucuccccucgauuauuugaguuuuugucuuuuguuaauugggucuuuuauuuucuugugcugugugauuaggcuccugcugcuuugaaguggccuuuguuggguggguagggaggacuuaguuaaugugggugauccucucuuggcaggagaaaaaacaacuuuugcuguugagagagaaguugacuuucccucuuuccauaucucuuguguugugaugauuccucucuugucuugaggccuucaggaagacuaaaauaauuuccuuugucucuaaccuacuuccugaggauauuuauuuggugccaugcacaggugcugcuuaaagauaaaccugacuuuuuucuuucaaaauuagugcuugaaauuugcuagcauugcccugucuggcagcaggaacuugccuugcuuggccugguggcuacaucccuuaccauagauuuauuuggguugcuuagagcuccagagggucaguggcuuguccuuggucauuugacauuggcacuagagcucagucuucccagauacaugacgguguggcacuugaggaaaaaauggcccuguuuguggucauuuccaggugaguuucaggaucuuucgccaugaacaguaaaggcccucggguuuguguucucagcauucucuauuuucuaaaaagaugauccaggggacauucagagaugaucuucagaacuuacgcucuagagaggaaagacuuuacauaagaaggacuccauuucuucggcacuugcugucugaccucacagacaaguagaccacaggaagacuggaagggagcccugaggugcuuacagcacagccguguuucccaucagcacccagcccuugcagagagggcugacagacacuuuggcuggaaaaaacaguguuuuaaaaaaucucugcaguggcuugaucaguacuuuccagcagaacuuucugugaugauaggaauguucuacaguggcacgguccaacauggcagccacgagccucauggcuguuggagcacuugcacuguggcuaguguaacuaaagacugaaauuuuaguuuuauuuaauuuuaauuaauuuaaauuuauauaggcacagguggcuaguggcugcuguauuugacagcgcagggcuggauggacugaggaaugacuagguucugugucccuauuguagaguuggguuugagcuguccccuacaugugauuugguuauaagaacugucaucuuccugagauguccuggccuggggugacuaccacaggcccuuagauuccacccucucagcuucuucaccuuccuagugaaggacaccuccacucucccaaggugcggcccuugaacugcuccucaguguguccuccuccuucaccugccucuggauccaucaccacgccuucucccuccugcuugcucucugucuuugcauuucccaucaccacagcugcgaccugaagacaggcuucugcuaguuccuggccggaugaguacagcauucccucacauagucuccuugauuccaaccccccgcagaagguauagggauagaagagaguuuaaaaacuacuucccuguguagaagucuuuguuugcucucugcuggcauaaaggcuuaacuaagucuuagcuggcugacgaggccccuccugagggguugagaucucaggacuccaggccgaaugaaccacaugcaggucuguggacagacagacugugcucucucaugcugcauauucuggcuacgugcacuuuucugggaagggucauuguccacccuccucaggcuagauuaggucacccucauuugagggccuguaacauccuacacauuccccuaugaucucauuuucuccccaucuuaugccuuuucuguuuacuggauuauguuuuccacuggacuugaucucuuugaggguaggggccuguuagcauucaacuguauguccgagggcccaggacaggccuugguacagaguaaauauuuggugcaugcauaucggaaugaaugaaugaaugaagaggucauuucccacugccugcaccaauuacccaugcucuuauggugcuuuaaacaacuggccaaauagaguucaacaguggaggaagcuugccuugagguuagacaaguuaaucuuucaauggaaauucaauccucauauuucauuuucaggccacuuugcguagcaaaguaguuuaacucauagcagauuucugccaugcugaugguuaauuucguggcccacagagggucagcacacuaaugccgggaacacggcgaccucagugcagcucaccgcacacagugagggcccagcggcccuguuguuuuagagaagcaguucucaaacauccuucugauuuugaguuaacaggggugacccuuucaagaacauuuuuaaaagcuauaacauagaucccucccagaucguauauuuuccuuucuccaugcaguucaaaggggcugaguugucucauagguuuuugccggcaaucuucagcuugacccugguuguuuaaaucugccggaggaaauuugaacaaaguuguacuuugguaauucuucugccucugugaaccuuuaaccuugggguuucuuuucgagccagggcugcauugucaccagucgucccugcuggggcuuucaaagagcauugucuagggcgucuguuuucacuuugcuacuggaguucuuuugaggaaggguauuaauucagaccugacucugagacaggacgagcacuuuuaaacuugccccagagcuuggggauggggaaaugagcguaaugcaagccuguggcugaugccaguaauuguucugcaaauagucugugagggugaagggagaagaggcccuccagaggcagaggaaugugccagcuguccagugggaggccacagcuuugcccaggguuuguugacuacaugacaaaaagaggucacugucucugaucacuaguucuggguccagaguuccuccugaauguaaaauuccuggagugccagguugcuaagaaccugggaggccagaggugaaccuggggcuccauauaccauuaccaagugcuugcaugguaaaaaaaacuuucuggggagagagaggaaggcucccugaggcaagaggguagagauuugcucugcugcuguccuggugcuggccugagccuuucugagugaguaucccucuguagaccaggucacucaccuccaucagcuagccaguuucacccuuuaguucuucuugugucuuuucacaggaagcccaagacacccauaaaugugaaaugucacagucauaggcccccuggggcuucgaggcuguugucaugggugugcaguguuugaaacuggacccuaagaggggaggcccucugguaccuccccaggcaucuccuugcugguucugucacuuacucuuugcgacagguugagaguuguuugaacaucuggcuuguuccguggcuuucuuugauuuauuuucccaggauucuuaguguccugaagauuugguuaggcgaccuuauuccuuaagcucagaugguauagaaggaaagguggaucaugacauuaauucauucaacaaacuccgagcaacuacugcuugccagggguugaguuucuaguggucaacaaagcagaaguggcuucugcuuucauguagcuuccugucuaguuggggaggcagaugguacagaaguaaauaaaacaugcggaauuauaaauuauguaagugcuaagcaggacaagacaggaugcccagauagggacuaauggauguggggcaucuacuuuaguuuggaggccagggaaggccuuucugaagcaauaaagcugaagcuaaacuguggcacaaaagcccgucccuggaauguugggagguguuccagaccaaagguguagcacacaugaggguccugaggcuggacaucuccuggggcuagcuacgagugagaggguaucagcugguuuucacacagcagaccugguguugcagguauauuuggacagaugcauauaucuggacucucuggaagucccaguuuugcugaaagauaagcguggcacauccuaucauucugaaauaggacacggugagacagaagaaggcaggccagccuucuggauaugccuggucucacuauggcuauccuauuggccuuuauccauccuuagucuuauuucugguacuguaaccccuuauuuccaugguagagggaugggcugauguggaaucagcguuggcaggcaauccuggcagaaagugaauuagacauuuuucacaacucugugauuguguuuggucauuaaacauuggcccacuggcugcuuaugacuugaaugccacauggagguuaaggacacauuccugaaccacuaacucaagaauuagacaucagagauacuaaguaucuaacaucauagaauuguaaauaaaauuccccugacaccuagaccucgucucacuccuggucagugcuccuuucccugcauagccucacagagcacaggcccuucaugcuucccuccauccccuuuccugcggggcugccucuugggcugaaggcaaugcauggcgguggggcaggcggcauauuuugccuuuucuuuuuccuccagaaacaaguuuggcaugggacuuggucagucuugaucugugccuggaagugugaaggcgugggugcagauguugggauaauuuuuguaccucagaaccagaacuggacacucacuguagggaagaccagcuccucaccccccgccccgccucccccgccuggcccgagguuccuguugagcaggcauggccuagccucagacuugcaugcauauuuuucugcuguugauuuucucaaauucuuucacaagggaacaguaguuuacauccuuuaaagcuuucuugaggcugggcacgguggcucacgccuguaaucccagcacuuugggaggcggagguggguggaucaccugaagcaggaguucgagaccagccuagccaacaugacgaaaccccgucucuacuaaaacuacaaaaauuagccaugcguguguaaucccagcuacuugagaggcugaggcaugagacugcacuccagccuggguggcagagugagaccacgucuaaaaaaaaaaaaagcuuucuugggauaccaguuuggucuucuggugacagaaccuugcccauagguuagaggaaauaauacuuucagcaacacccccagcuugggggaucucagaaagaagggcauguugccaacuuuugaggauuugucugagaaacagcaaccuggcaucccccuaacucccugcuuuuuuucccucuagaaucaaauagaaucucuuuuccuggcaaagauuuccuagauaaaaagagguacuacuuagucauuuuuguagguucguuaauaguuucuaaaaguuuuuaaaaguacauaauaagaaaacuuguuauggcaaccaauaaaguuucuuuucgaggaaugaauauuuucuaggaaagauaagagucaguuauguuuggucugauuucuucagcugaaucuuucccucuuccucuuaucuugaaaucuaucucauaaggcaaucuggggacacuuuagcaagcacucugguaacagauguguguccuccucuuccugacacaucucccagcccuggagacccagcuguacaaucgcaaacuguccacagggcggugggguggaaaucaucuccaugccgacuccgaacuauuuggugcacaagagggcaguauuugcuuacagucuuggaucgggaugaucaauguguaguuucacaggucagcauaguuaaaaugaccucugacuuuuucaagacaaaauaaacuguaggccacagccaugauggcuucccauagaugccuuuaagugucugaucccuucagaaaaauugcugcuugcuaucuuuuuuccuuaaaaagaaaaauauuguuucuuucaagguuuauuuuuaauuuuuuuuuaaucaaugaaaauaugguuugcaggcuuguaccuacaauggcagagguuaaaaaguguugcaaaagcaaaacaacugcuuucuaauuaaaaaccagaugggaagauuuuuguuugaagcaaggggucaaauguauuuucucccccuuucauaucaguguaaagauuaucugacuuaacuuuuaaagcauuugaagaugugggcuucagucaucaacccuucuauacucaguuuuguuuuucugcaaguucacaguauuaaccaaagcaaggacuuuccaggagaaaaaaaggagaucucccugccuuccagaggcacaauguucuaucugaaccauaggccaugucugcuuuuguauaaugauuugccuuuuuaaguucuuccaugguguuuuucuauagagacuuuuaagccagaaagacauagcuggcccuccaaaucuguggauucaaccaauugaagauugaaaauauuaaaaaaaaaaaaaaugaaaacaacaaaaauaacaauucaacaacaaaaaaaugauauguuuaaaaacacaauaaaguauagcaacuauuuacauagcauuuuuauuuuauuaguuacaagugaucuagagaugauuuaaauauaugggaggauaugcauaaguuauaugaaaauacucugucauuuuauaucagggccuuaagcauccucagauuuugguccuucagggguccucaaaucaaucccccacagauaacaaaggacaguggcauugguuuacaacuccugucccaccagauuccagccuaugcaagaauugggaucucauaucuuucugcucucucuuccucaaaccuggaacuucugauuugaggugccuccauaacuuuagcacccaagagaguuuaacugaaaacagcagugguagcaaggcccagcacauuaaggacauagugauggucaggccgaaggaacccaugcauagggguggccugggucuagcggaaaugccaccuggccucucugagccugucugugcaccucaaaugcagaugauuaucucacagggugguugcaucaaagauguccauaaauaaagcuucaggcacauaguagggagcaguuauuguuuuguuuguuuauuuuuuguagagccaagcgcuugcuguguugcgcagguuggucucaaacuccugggcucaagugauccuccugcuuugacugcccaaagugcugggauuacaggugugaaccacugugacuggcugggagcaguuacugugccaaugaucucucugaccccugacgaauuauaagcauauggaggugguggggcacuguuggacaugaggauggagacacagacacugauucuugauugcagacaaaccaguucuuucuggauuauucauuuauuugauucauugagcauguccauugcuuggucccuuggagcaucugcagcaaagugaaaugcaaucuagaugggaggugccaugcugccgccucgauccucugauagcaaucgaggagaaaagcuggguuccgaggcuuagcccuguaugaaaucagaugucuucuuuuacucuuuuguaaucgcaacauaaaucuuccaaagggaguaugucuauaagauagaugccacauaagcuguggaauguauuaguaugugugacaucccuguggucuuuuaauugaucaguggcauuuaaugcaaaauuugaaucugaccacacaaaguagggagaacccuggguggccuucauguuugcuuccccgugaagcuccuguccuggcuuuuauuagaagggucuggguaggaaaagaaggguuuugagcugaaggcuuucaaaagaggcccaugccauguuuuuccgggaacauaguuucuaaaaaaaugcuggaaccaucaguuuccaaaggagccugguuugugaggggaaugaaaaguuguuccugcguguggauucuggguuguuuuccaucuucacucccuaaggcagggcuggcaagcggggaaugggacagauguuuugugguaguaauuuccagucagauucuugaaugccuuguauacucugggucaccgucagcucauaauggagcaaaauugagugagaauuccugcaaugaacgacgugaauggcgcaccggagagauaugaugguggagauagagugcauucugcaagaaaauauuuccagugcuaucuguaaaauucagauugaauaaccauucugaagugcuccccuuuuaaaagaguuuccuuccacaagcauugcaggcugaguaaauaccaauaauuuuuauuucccuucuccuuaucgguuccccuacugaaauguuccugcacagccuaucuggucuuuucaagugaacaucaaaugauuagugucagcuuccaguuugaauuaugaucauauuucaaaacacaaacuucuucacuuuugcguuuggagguaauuaucaauauuuaccaauacuggggaagaguugaaaauggaggaaauacugcugagagaauggugccccaagugaagauagcagggagggguuguguguggccuuguguguacaguggcagagugcuucaggggcuuggccugccacguggauggccugcucucuuccagcccuauccgcauucucgcacagauaagugagaggaaugguggggacccaacugcaaggcgaucucuuaggguugggcacuaugacaaggcuagaaaagcuauuucugccaccuggaggaggaaacauugcucuggccgcugcucucagaggcccuccccucuguuuccacagauccugcucucugacugccauggccugguacgaaugcccuuuggugaaaaaggccagugaaacccagggcugguuuaaggccugcgcugcagccuggaaagcagacuaacacaaauagacugugcugccaucacacagaaaauacaguuuacaauaccuacaucagaguugaaucccaguguacuagguggcguucucuugcauuguaguaggcauuuaauugaacuuugaguaauuucaguuuuugcaguuuucuuuuuguauuuuggagccaguaaguuuuuuuauguuugcaaacacucuguaagcuuuggugcuuugcuuauugugccuaauuaauaguugccucuggaaaacgcagaggagguuucagacugccucaaagaacuucccagagaguggagaagcugcagcacaacaggccugggcucuggagucaggaagauugaaauuggaaucuuggcccuucugcuggcuuuuuguauuacuguggacguguagcuuuucugagccuucauuucuucaccuguuuaaaacaggagagaaagggaauaaugccuaccuucggguuugcuguuagaguuagcaguaacugugauacaguuagcaucauucugggugcaagguagacacuugguaaauggaagcaggccuuacuguaggguuagugcacugcaggcuuggcaccagaauguagccacuucugaaguccuuggggcagucaaaaguccucuucccucagcauugcagacagcaggaaagagcauugcaauuaugcaagagcuauguuucaaagaaggaaaugaaauucuugaauuuuuuuaaggcaaagaagagggaaaaauagauuuauuguuuuaguuggcuauucaauaggaugcaggauaaagcuggccucucuccugucuaaugucaucaucggcauucucucuuuuucucuccuucucuuccucccucuccucccccucugcucuacuccuccucccuucucuucccacgccuccccccgcuccuccuuccccuccucuucuuacuaguacugcugcaaacccccccuuuucuccaagucaaccccagguccugagccugggauuaaaucucaugcucuggagauacucuaaugcuaggaauuauuuccucuuuuguggucuuuggucuuuccuucagguuuccuguugcuuucuaagggaggugccaggugcuggcccuguggcuaguuuuggcuagugaggaaugcuguaaagcagcugugacaccagcgugcagcaguccuacugcugugcagccugggcaguggguggugacaggguggcauuggagugaacaagguguggggaagacgagcguagguggaaaaaauguagaccgaccuucucgguaaaacuggccugggaucccaggcaacaugaaggcuggcagaugcugagggaguucucuaggggaggcugauaaaauucgacaucaccuuaccauuuaaugagucccagauacaugggcuaugccagcccaacagagugcaggcuuuggaaagcccaaaugaaaacgacauggucccugcuguugggggaacucauagugcugggagaagccugcugggccucuuuuucagaaggagggagaacauggguuuaguagugagcccucuaauuaggccugcagguaggccucagcguggggccuggauuugcacccuguccuucgguuagagguuugugacacccauagcugugcucaguuaaguggagcaguggaaagagcugaggcucagcaugcugguccacguuugaauccugauggaccagcuugugagaaugcacagcucugagccucaguuuucucaucuucaaaauggggagaauaaacuuacaaguguuuucgugugugugagaauccaaugagauaagcuaaauguaguauuuaucucaguguauggaaccuauacucuguaagugguguuagcuauugugaucauaauuuaauaugacuuaaguuuuaaucuuuauacgacuucauauaaaaauaaaccauuugucagaaaucuuauuuuccuuuuuuuuuugguugggaaggcaggcuagauggauggucucugauaccacguguaacauaugauuuuugucucuguuuuuaaauuggugauaauccgauuggagagaaacuaaauuaauauacuugaaguaaucagaguaugggagcuuaacugcguugaucggcuguaaaauugugagugcaguuagaguuaagacaaagaaggccacgaagggaaaagacccaaccagaagacacacaccagaagagaaauguggguggaguguuagcaagccacacgccuugucugccgggagagaccagucugcuggaagcaguggcuuguuuuauguuugcacacugauagguaccaaucacugcuacaugcaaauguacccaaaaauaugugaugacaggaacuucucuugaaauaauuuaugcauuaauacuaaaggaaaaaaaugcauagaacagcauaaauugcaaacaugguauaauugaaaaagcuugagguuuagagucugagaaacugaauuugaauccuggcuucaacauuuguuagcuauauggucuuggguagauuaccuucucugggccucaacuuccuuguuugcaagaucagaaagaacuauuuuaaggauuagaauauauaucuaguacaugauaagcuuuuaauaaacaucauuacuauuaugaccacuauuuuacuacugauaauaaagacucccggccucacaugacacuccauugccagcuauaaauguggucuucccugagaugcuguaauuuuuuucuguaguuuaaaugaacauacuggauuauuauuauuauuauuauuauuauuauuuuugagacagagucucgcucugucacccaggcuggagugcgguagcaugaucucagcucacugcaaccuccgcuucccagguucaagugauucuccugccucagccuccuagguagcugggauuacaggccguacuggauuauugauucaauguuguggggaggcuuauaagugaauuuauaugauuaaguuuuggaaagcuuuuuuuuguugauuccuuaucuuaaaaccaagauaaaaaaagccuuaauagcuuaauauuuuuagggucugagccaggccuauguguuggccuggggaagaaagggaaacauucagaaagcuuuagauuuuuuaaagacuuguuggggguguccuccuuucaauuggagaaauagugacaccacccccacccccacccgcaucucuggauuuuacuguuuauuuuuuggcacacguuuccaaauacaucaaauauaaaugaugcauuuugaaguuuuuaaacuaucaauaaagcauuagaccuucacagggguuuuaaaaaggucuugcugacuuuucguuuccccagauuuguaggucucugaaauuucuggaagcuuucucugcaucucuagcugagccaaaacgcaccucuguuuagagaugguaaagaacuccauuugaggaguucauuaaacuccaaagaaucuccccccguucauucuuuuuguguuuuguugcggcauagauugcuuaaaccaagugagaaauagcugugaguuuuuuugaaacuuggagauacucauuuuugucaaauuugucuugaaggagcaggcucaaguuugcuuuuauaaauaggaaaauugauuugcaaagagaugaaggcagaguaucagacaggagaugacguguggcacauuuagaauuuggagaaaccauagccauaaagaaugaguagacacacauucuuuauauaaauggguaggccaucugguucucaaaaaaaugcuuguugacaaacaugauagaccucaaggugaauuucagacuuuuggauuaguuuaugugcauguugguacaugugcagaagcucauggcaaaauaauguaccauaauaaaugcaaguucagcaaauaaaacauaguucagagucgaguuaugugguaaaaaugcaugaacuaaguaauuuucagugaagguuuuauuauuuuauaaaugaggucuuuuuaauugccuuaaaagacucucuuuuaggaaaauuugaaauaugaaagucaucuuauuuucauguaaaaugaaacauuuaaauaccuuuuuucucaugaaaauuucuagcauauaaagugaaacuggaaguaguuuuguuaaguaacuuguauuuugggggcugaggaaaagcacuagaaaauucagcuccuaaagaucauucuucaugagaugucaauagccuccagacaaauuaucaugugaauauuuucuaaaccauaaacaaauuuugcuaccauuguguuuagacucaaaguuaguuuaaaagagaaauuucuaaaugaaacuuccuaacggucauucuuucgggggcaggcagauugguagaaguaauauauaaaacccaaggacaaaauggcacuuuguuuuuuuucuauuaaacucuuuugcuguuugcuguuucaaaaauucauacugaaucuuuacaaugaaacauuugugaguccaggagcccagaacccuaaaugaauucagauugacuucuuuuucuguacggucuaucaaaaccuuuucacuuuaccacagaccagaaauuauuucucacuguuuucugugccuuacuccuuuaaucuccaaauaccuguuacuacuauuguaauuguuauuuuauuguaacaguuauuguuguuacugcuauugaacaagcuuuggauguuugguuugaaaagauucaaucaaguauuuugauuaugaugacuagugccuguguauagcuaagcagugaagcaaugcagagauuuuauaaauauuuuuagggcauuuuuuuacugugauuguagggaguaagauauuuguuuuuacaggcuggaaagauugcugugaauuuuaacacuugggagucacagcuuuaauucugauuuagucuacuaaaauaaauaaaaauuagccguugauacucuuuuaaaugaauggaaccuauuucugauucugauuuuucugaagcagucucuacauuucccaaagugccacuucccaagguggacaaaacauguucugugcaggcgaaaugugagaugcuggcugcauaggggaggaagggggagaggaagcuguuugcaaaacuacuuaaaauaaauuugaagggucaaacauggaacacaguugcaaaagagaaaggaaaaaaugccuuaggucaguucagcuagaaucguguaggcauucgcauuggcuagaggguuaguuguguauuucuugcuaaucagauacaauuggagcagauaauauuugaguaucugaggcuagaucucauugccucuauaucagggaaaugaaccaaaaggggcaaguuuuaaaaguuugauuuggggaaacagauaccauuuaggagagagaugguaggcuguguuuaccucguuguccgaaggcugcucagacuuuagucagcucuccaacuugcagcuugucccucagagaugcaguaguggcuugggccggcagacgggcuugcguuagcauuucauuuaaaagcgaucgguacuuuuaaauuaaacaugcaaaguuaucuuggugagguauugaaugggagguugcuggauuauugaauuuggcccaaaauuuagccaguucagcagggauuuuggggucugaagcaauuaauaugcaaguacauuugagucagcaagguaggagauuacugucuuaucagaguaaaaaaaaaaauucuuuuuccaagauccauacuuuuuuggagguagauaaaaacuccauuguuugagauucauguuugugagugaccaccucaaauugccagguuuuaaccacuaaaacacagaggagggaauaauugcauuuaaaaucucugaucuguuauuugcauuaugcuuagcauagaggagaccccaauuuccuuccucauguuuuugguuuuuuuuugccauuuuguuaacauagauugagaggaaacuuaauuuucuuucuugaaaaaaucauucacugaacugcucaaaacacaugaaguuguuuuugucucaucagaucgaguacuuaagacaaaacuacgaaggacuucaauauaugguuaaccucucaugugcucugugaaucuagacacacuccauccgaguugcuguaugauuuccugaccauaaugaccuggccaggggaacagcuauuccuuugacaacaccguuuuucuucuucuacacagccagaacccuuacaccuguuuucccaccuggcaggcagcauucagaggcaugagguguauuuuuauuguguggcacucagccacacaaguggcugugcagucuuggggagaagagguuacuuaacacaauuuccuugacuuuaaaauggggaaaguaagaauguaagaccuuaaagaguugugaggaugguguggaacaacagcuggagggagccaaaggcagugaauuacagaugugcagugccauugaguugcagcuuccucugcccuugacucagugcaagagacuccaggcccugcaucgaugggaccaggcaggccugugaaaggagcagagcagcagguccagagccagcagaaccugcgagcuagugugccauugaggccugggaauugcugcuuuacuccagaagacagggaaccuggugguacagcaggaaggcauagucuuugaaaaucagaugugacuuaaaaaugaauuuaaaaaaagggggcuaaugaaguccugaaggccuuuauuucuguauuuauuguggagaucuuuuucuucugaaagcuuugauuugaccaucugccucauuucaggaguuuggagaccucggaaauuugagagaucacuccuggguagcaaguugcccuuuugccagggccuccuugucccuuagaagcaucuagccuuggcugcuucagggggcacuucaggacauggauggggacugaccauguccuuuggcaggugacgcagggagucagccugggcgugaguggguguguggcuggcucccuggcaaagagcugccacaguuuccuaaggggccccaucuuuuccauccagugggacagccuuucuauuucagaugaaggauaaaauacuugguagaauaacuuucauuguucccauucccaaauccuuuucuguguguggagagcauucugaguuugucuguuuguuuacuguccucccaucaagaccuacagccuaugccgacauucuucuaagcagaucacaugugcuuggcccacaagugggcauucugaacacuuuuuuguguuuucagccaugguccucuuuucucaagggauacugccagucuccauccugauccagauuuagaaacacaacaaaaacaaaagagaagcggugauauaaaauggaaguagaacuuggcguuggcuaguggagacggcgauaaggaguuuugaagugucucuccuuugaaaggucuuucuuguuggaucacugcucccccaguaugucugauccuuaugcacagcccaccugggcugguggggggcgguccucaucacacugaggcuggguuucuuuaacuucagaaauguccugaggaauaagaaaugaaacaugagcaauacaggguuaauguugucaagccauguuuguuuuuguuuuuguuuuucuuuguuucuuuuuguuuguuuguuuuuugauacgaagucucgcucuauugcucaggcuggagugcaauggcacgaucucagcucacuggaaccuccgccucccggguucaagcgauucucccaccucaggcuccugaguagcugggauuacaggcaugugccaccaugcccggcuaauuuuuguauuuuuaguagagacgggguuucaccauguuggccaggcuggucuuggcuccugcccucaagugauccgccugccuugggcucccaaagugccgggauuacaggcaugagccacugugccuggccuauuuuuguuuucuuugauggggcaagguacccagauuaaguuuauagacgacagcuaaugauaaucaaguuccauguuugagugccuauuaaauuaucuuguguaaugcccccgcacaucugggagaagaguuuuguuuugguuuuaguuuuuuaaauaaaugaagaaaaggugacucagacagguuaaguaacuauccaaaaaaaaaaaaaaaauucuguaguaagaagguggucaauccaggauuuuaaaaaaguauuacauuuuggauuagguuauauauguacaugauagaaaacuuaaauaauguuaaaggauaugcagagaaaaguaugccuuccuucugucucuguguuucagucuccuuacacuccccgcacugccaacacacaucaucaguuuucauuugugagcguguuuuggagauggguccauauuacuuuauaauaguuuccccucauucuuuguauugacaacauacuguuccacucucaggaugacuugugcuaucucgaacaguagugucuggaaggccuugguuauucugucuuuuaugguuguguguacaugucacagggucaguuccuagagacagugccugcuggaaccuggguguccucacacccagaccugugcaguagggguuaggguugcugcucuugccuagaaggagccagagggcucccaccagcccugcugcuagcagagaccuggcgaccacuguggcuuuggcacuuggccugcuucccaccagccacagagaucggggcggggggguggggugguuggucuaguagugggggugggcggguugccagagagaaggagcgggaagaggccuuucuuuucaauuuacccucuuuuuguaugccauaaucuuguuuuucuuuggaaucccgcugauccaggccugaauucuaguuuuaccauuuuacuagcugaaugaucuuugucaacuuauuuaaccuuucugaacuuaaggcuuaccaugaguauuaaggcuuaccaugaguaaaaauggugcucagaauaccuaccuguuagaguugcuucgagaacauagaauaaauauuacugcuaguacuuuauugagcuuugacuaugucagguacuuccuaaacccuuuaaccugugguaaucugauuuaauccugauaaaccucuaaugaguuagacacuguuccuauccucuuauaugugacuugaaaucuaaaaauguuaguaaacauuugaccccaaccuguugggcucccaagcccaugaucuugaccacuaggcuaugcugccucccauaaaugcagccagaguugauuguguauacucuaugucugucuaaucauugaauucuacuucuggugacacuuaagcucuuuuccugcacuuuaauguuagagaucaucauucuuccuaaggaaggcuuuuggagcguugcuucuuacggugcuuauuggaaaugugaccuggaacaagaugcaucauuucuuugcaccucaguuuccaucuuuguaaaacauugauagcaauacuuaccuucucaugguauugugagaaccgaugcgugcagggcacccuacauacuaacugccugguggauagcggguccucaguugauguguuguugucuuuuucuuccucauuugggucauucauagacuacuggagagauauucgagaauucuucaaguguuuguagaauggcuugacauaaguugcuuuccauuccuuaucuguguaaggagugauguucuggaguauuaaauugggugagugugggcacaguuuguguucugagguuuagugugacugugaaaacaugcuuuuugcauugccugagaggauacaauagaccaccagcaggaacagcagugcagaccacugagcagcuuuuuguagcccuggacccaguguucaguguuccagagagaugguaagaauaaagggagaggcaucgaagccaaacaauuccuagauuugauugaucuggccuuccagauacccucaaauuccaccaacaacuacuuuuaguguuuuuuccuauuuucuuccaaguuaaaaaaaauugugauaacauauucauaauauaagauuuaccuuuuugacuauauuuaaguauacaguucaguggcauuaaguacaugcauauuguagugcaaccaucacugcuauccaucuccagaaccuuuucaucuucucaaacugcaacucuguauccauuacacacuuacuccuuauuucccccucccaccagcuccuggccaccgccauucuauucucucugugacuuggacuacuaaguggaaucauacaguauuugcccuucugugacugguuuauuucacucggcauaauguucucagaguucauacauguuguagcaugugucagaauuuccuuuuuuaaggcugaauaauauuccuuuguauauauauuuucccauguuuuaaaaguauaggguaaguauguaaguaucuaucaguauauuuauuuauagccaucucuguaguucuguauuuugcuuuggcuuaacguguauuuuucaaguuauuacuuaaauuuugugaguauuguuagugauaccauacuguucugauucuguuuaaaaugaaggacauuuuuuuuccuuaucucuuauagaaugaacuagcuguauuacacuguuugcauauuucuagaauugacauuuccaagggacaguuuagaaauucucaauuguaucacaaacucugcagugauuguauuuugcaccuuacccagacaugguaagaaauacaggucuggcauggcaugauggcucauggcuguaaucccagcauuuugggaggcugaagcuagagauuguuugagcccaggaguuugaggcuacagugugcuaugauugugucacugcacuccagcuuggguaacggagcgagauccugaaagaaggaaaaaaacaaauacaagucugccauaccuuauccauaaauuugaaaauucaaauagcucuguaaacugaaagcaguuuuuuggaguuuggaugcaaaaccccaucugaacugacugaaucuuuuauuuuucccauuuagugugaauauuuaauguuugauuauagggaauggccccaucgcugcugggguauuauauaauguaugauauauuuauguauguacagaauuaucuuuuggggggauaauuauuuuaauuuauucaucauuuuauaacuuaauauuaugaagcacuucauauauaccuucuuuuuacuaagcaauaaaacagacuuuuucugugacauuaauuuauaauagaauauucuuuugugugcaaccauaucauauuuuuuuagaaacuuuuuuuuuuucuuuuuugagacagaguuucacucuuaucacccaggcuggagugcaaugacgugaauuaaauggaauuauauauacuuuaugaccuuucgugucuggcuucuuucacuuaguguaauauuuucuuuuuuugaaauaaggucuugcucuguugcucaggcuggagugcagugguaugaucauagcucacugcagccuugaacucuugggcucaagcaauccuccugcuucagcaucccaaagugcuacgauuacagguguuagcuaccacgccuggccaguguaauauuucuagauucacccauauuguagccugagucucuacuucauuccuuuuuaagacugaauaauauuccaugccuggauauaccacauuuaaagaauccauucauuaguugauaggcauuuggauuguuuucacuuuuugauuauuaugaauaaugcuaccaugaggagucauguacauguuuuuguguaaacauacauuucuguucuccuggguauaaauauacccaggaauugcuggaucauaugguaacucuauguuaccuuuaugaggaacugccaaacuuuuucacagcugguacaccauuuuucacucucacagcaauguaugaagguucugguuucuccacauccucaccaacacuugcuauugucugucugucugaucauauccauccuagugggugugaagugcuaucucauugugauuuugauuugcauuucccugauggugagugauauuuagcaucuuuucaugugguuguuaauauaucuucuuuggagaaaugccuauucagcucuuuguucguuuaaaaauugaguuggcuuuuuauuguugacucauaagaguuuuuaauauauucuagauaguuccuuaucagauauaugauuugcaaauauuuucucccauucuguggguugucuuuucacuuucuugauaguguccuuugaagcacagaagcuuuuaauuuuugaaacauucaaguuuauuuauuuacuuuuguugcuugugcuuuuggugucauaucuaagaaauaagugcuuaauccaagguuacauagaugcauaccuauguuuucuucucaguuuuauaguuuuagcucuuccauuuaagucuuucaucuauuuggaguugauuuuuguauauggcaugaaguagagguccaacuuaauucuuuagcuuguggauaucugguugucccaguuuuuguuaaaaaaacuguucccucuauugauuuguguuggcacucuuaacaaaaaucaguugacuguaaaugugaaagucucuuucuagauucucaauauuucauugauuuauaugucuagccuuauucugaacuauuuuuuuuuuaaaguucuaaauucugaaacauuuucccccagcggcuuagggauuagguaauaauaguagauugcuacugagccauggggagggcuguuucuccaacuccucagauaucccugugcuuaccuucccagccugucuuccugugugagcuccauggcacacccuagggacagugucugaggacagugcugaggcucauggccacaggagugguagaagcagguuuucagacugauaaugccauuacauuucaaacuuugaacauuucaaaccuugaacaugaauaugagauguuggagaucccaacugggaagguguagcuacccagcaagucucccaucucugaauacucugcuauacaggaguggguacccagggaccacauuugaacccgggcacccugacugccuccagccccauugauauuuaauugguucagggauagauaccugagccaagauguacuaaacaaguucuucugugggaauuugaaacuagggaaagagaggcagggacacuaggaguucuggaaaucagcauguugauagaaauagugugcuagaccagagagaaggcugggagcuguucugcuucugggcuuucccagagcuucugugagguaccuggaauccuucuuguaaacccuccuuuuuguuuacaauucuucagccaguugguuacuuguaagaaaaaaaaauucuucaucaaugaauguguucacuuggugaagaguggaugucauuuuuguuauuuuuuucuuuugcaaauguacauuuagcaccugcugagagcaggacauucugaauguuaggcacugagaacaucuggcagauaaaagguggcccugccccuugggacucacuguucaaugaguuggaggguaggggauagaccauaaagcagauguacugaauaugagauaggugcaucaaagaccauacaauacaccagaggguuucagaggugcgagucagggaagacuucacagaaaaagugacauuuguguggaguccucauggaugauuaaagucugccugguagcaaugagagauucaguuucagaaaaugggcauugacugcagggagccuagaaguaugaaggauuuggaggguuuggacaauccagagaaggcuugugugauuggucacaaguguaagcagccaauggugagcuggugaagcagguuggaagcagauuaugaagggcuuuguaucuuggaccaaaacauuuacacuuuguucugggggcagcagacaggucugugguuuacagaguuuacccuggcauugauggguuggaggggagagaggccaggagaccauuuuggagggcagugccagugguuagggugaugagggagggauggaaaggaaggaaggccgaaacccaaguuaggaaauagacucuccagacugggagacuagcucuagguagaggguacagugcaguuucaaggagacagggaacgaaagagguacuuggaacagaauggguaugagguaugggugugggaugaggaugcugcugcgaucaugaugagggcuggcaggcaggcaggcugaggggguggcaggcaugcagcagccccagggcuucuuuuuugugggguagaugaaaggggguccauuugccuuuguuuuaugccaaucaggugcagcuuuuggauuccuggcuagcugccauguugcccucaggcaaaaguuuggcggccuugguauuguugacccuuuguacuagauggugaaaguaucugccuugcagaccaggcccuggaaucagguauuuggaaugcauagcuaauguguuccacuccaguccguugguauuauuguuccacaguaucgcaucuaauugacuauuucuaaauguucuuguauauuuugacuguacaagcaaaguagguuuccagcagccccucuuugccggggcugccucaucugcaaaguuugcuggcaccacccuccuuucccaggguuccugguuccuuucugccugggagcccugugccugagggggcauggugaucuuacuggauuccccucccagccuugcccaccuguuguccuccagccccgcucaccugggaguuugauagaggggcuauugugugcaaaggaugguucagcauggacugccuuuccucccuugugagucuguaggggaguuggacagguagggguagacccccaggcacugauggagcccagccucggugcccaguaccuuuacauggggggggcucccaaaguuggauacuuccagcacagcaagacaggcacugcuauuaggggcugcccagaucaagugacacugaaucaucugcugagcaaguccuuccuuucucaguccgugggcagccccucuggccauguggaggaggaggccugugagcacugguucucuggacauugcucaucucccuccuugacaagcgccucgcagaagacaaaacuccauucacacaaugcauaaugacagcuuaggucaaugauggaagguauauaugaugguggucccauaagauuauaguggggccaaaaaauuccuauagccuagugcugucauagcugugguaacaucauagagcagguuacucagguguuuguggugaugcugguguaaccaaaccuacugugcucagucuuauagcacauauaguuacuuauaguaccuauuaugauaauacaugacugguuuaugucuuuacuauacuagacuuguuauuauuuuaguguguacuccuucgacuucuuuucuuuuuuuuuuuuuuuuuccgagccagggucuggcugucuuccaggcugcagugcaguggcaccaucucagcucacugcaaccucugccgccuugccucaagcgauccucccaccucagccuccugaguagcugggacuaagguccucaccaccaugcccagcuaguuuuuguauuuauuuuguagagacgggggucucaccauguugcccaggcugaucucgaacuucugggcucaagugauccaccugccaaggcauugcaaagugcuaggaugagccacugugcccagccuccuucuacuuccuuuugugucuuuuuuuggagauggagucucgcucuguugcccaggcuggagugcaguggcacgaucuuggcucacugcaaccuccaccucccggauucaagcaguucuccugccucagccuccugaguagcugggacuacaggugcaugcugccaugccuggcaaauuuucuguauuuuaguagagacgggguuucaccaugucccccaggcuggucucgaacuccugagcucaggcaaugcacccgccucagccucucaaagugcuaggauuacaggcaugagccaccaugcccagccgcuccuucuacuucuaacaacaaaaauuaacuguaaaacagccucaggcagguccuucaggauguauccaggagaaggcauugucaucacaggaggugacagcuccaugcauguuacugccucugaagaccuuccaguggaacaagauguaugagguggaagacagugauguugaugauccugacccuguguaggccuaggcuaaugugcauguuuguguuuuaguuuuuaacaaaaaaguuuaaaaaguaaaagaaaaaaguuuuuaauggaaaaaggcuuauagaauaaggauauaaagaaagaaaauauuuuuauacagcuguacaguguguuuguguuuuaagcuaaguguuauuacaagagucaaaaaguuaaaaaauuuuaaaguuuauaaaguaaaaaaguuauagugaacuaagauuaauuuauuauuaaagaaaaauguuuuuauuauaaauuuaguguugucuaaguguccauuguuuguagagccuacaggagugcagagucaugcccuaggccuucacauucacucaaccacucacucacugacucgcccagaacaccuuccaguccuguaagcuccauuuaugcuaaguacucuauacagggguacccuuuuuaaucuuuuauguuguauuuuuacugucccuuuuuuauguuuagauacaguucaaguacacagauaccacuggguuacaauugccugcaguauuuaguacagucaccugcuucagcucacugugccucgccuggggguauuuuuuuuauuaugguaaaaaauauauaacauuuaccauucccauuuuuaaauguacagguuuguagccuaggagcaauaggcuauuucacacaaccuaggugugugguaggcucugccaucuagguuuguguaagugcucucuaugauguuugcacaaagaugaaauugccuaaugacacauuucucagaauguaucuucaucauuaagcaaugcaugguuguauaccaacauagcuugauauguauauuuuuaaugguugccuucuaauauugccaugucgugguuucaucuauggcugccauauaaaguuuccuuuuuuggggggcuauuuuuuauuuuuaaauuuauuuguuuacaaaauuaaaaaaauuauuuuauuuuauagaugggucacauucucuugcccaggcuggagugugguggcaugaucauuuagcucacugcaacaugggcucaagcaauccucccaccuuagccucuugaguagcuuagacuucagcucacugugccuggccuggggguauuuuuuuuauuaugguaaaaaauauauaacauuuaccauucccauuuuuaaauguacaauucaguggcauuaaguagauucacauuguugugcaacugucaccacuauuauuucuaacuuuccaucaccccaaacugaaacucuguacccauuaaacacuaccuccccauucucccuacucccagccccuggcauccaccauucuacuuuuuguuuauaaauuugacuacucuagggaacucauauaagcagaaucauacaggcuugguggcugguuuauuucauuuagcauaauguccucaagguucauccacguuguaucauggaucagaauuucuuucccuuuuaagggaaagauaauauuccagcauaucgauagaccacauuuuguuuuucccuccaucuauuaaugggcacuuggguuguuuccaccuuuugccuguugugaauagugcuucuugaauauuggugucuagguaucuguuugauucuuguuuucaaguccuucgagaauuccuauaccuaggagaggaauuacuggauaaagugguaucaauguuccuuuaagggaaaaaaguggguuuuauaaaacagggcagggcaaaauuaguuauuuaaagaaaaauauuaaguaauauuguguguggcauugugauggaguagaaaugauggagcugacccuggagugguggcuggugcagugugcaaaugucuuaccagccuggcagaauucuguguggccuuggcugugacuucacuccgggucucaaccuauccaucuguaaaacagggcugaugccucguuucucuccaggcugccaugugaaccugacacgguugggugugagaagccugcugguucucaggugugccccuuucccgauuuuucucugcgugcuuagagaccaugguggcugcagcaggcccuggacccgcucuucuccugcagauucauucaaggcugugccugugggguuccgagcugggcucuugagcuucagcuggcuguuuccuaaucacuuucuuuccugucacccuggcugccugcuacugugacaccuagaacauuaccccagaagaucaggacucuuccuggacuucacaaacguauuuuuauagugcuuacacucuucugccaauuuuaucuguagcuugucuuuuucuuccccucuccuauuuaacuucuuugucuuuugaccccuuucauucaguuaauugauugauuaacucuuuccacaguauuuguuggacaccugugauacuggaaggaggagcauauauuuguugggggaggagguacagaaaagauacagaagacaccucccacccccaauacuuuuagucuacuuggguagaaaaggaagacauucuugaaauugguggguaguaguaauaauguguaaagcauccuaacagguauuuuucuuucuggagacuauccaagcuucagggcaggggggcaucugcuugcuuuaaacagggacuguacagcacugguagaaaagagccuggguuuuagagccuggguucaaauguuggcacugucccuuaccagcuacaugaucuuacgugacaacaugggaauuccaucaugucccuucaggguuaaaugggacggcuugcaugaauccucugcaggguggccacacucagggaccuugcuguuagugacuguguccuccucccaaggagugggacuccccagacuucacuuaugcuguccuuauguaucacugaaguuccccucucaggacuugggggaaucaggggaugcucuaaaccagugggcucagacacagguccuauuguauagccacauaccccagaaagaaagugcccuccagaccagccuccaagggaggcagaggaggcaagggcucaccauuguuuuccagcagggugcaucugagaggguguugcucucugcagagcaggcuccuguggcugugacagagcuaaccuacuggcacuucgggggaggggcugcccucugccuguagccugacuauuggcaagggcccauuuuucugcauucauucauuuauccaguuacguaauuuuuucccuucagaugaucauuugccuggucauuugggugguaauaaugauucuaaaauauuauuuaaaaaugaauugacuuauuugcuuuguagcagccaccauaccuauguguuuuacaaaugucaccuucugugauccuuaccaugacccuguaaggaccacaucaucaguucccauuacugagccucagcaauggcaagugacuugccuaggaucacacacuaauccgcaggccaggauuuggacauaacuuguacaacuccaaagccauuucuccuaguugcucggcugucccucucuuugccuuccucccuccagaggaggagggacucugauaucagcagauguguuuuuccucuggcaugggaggacagaagggaagagaaacaguauaguuaucuaagugagaaugagccaugaaggcugaguagcgguuuucugugcaaguaaaaucuuaucuugggggauagagggaagaccaucuucccccaucccccaacuugaaugaagaagaaaaaacccaaccaaaaaugacauaaagcuaagcugccacaaaggcugcacuuacccaauauuccugguguggagguaaguuuugcaccccaauuucuccucucuuccgucuugggacgugaaaucuuuucagcucauaaaaaagacagggugcccacaugguguuuuuaauggagaaaauaaggcugggaggugucugagccucuugggacuuccggagagcuuggacaccacagccuucccagcuggagggugcugagcucccaccuggauugaggaucugugcuguccugaggccauuguucuuuuucccagcacaggauggaaaaggcuccucugggaggcaucugcaggucagaugcuuuugggguggcagggugcagcaguggcuggaugggacugggaugguuguuuuaacaauaaguuauuagagaacuucagcuuggcccugccuuucagggaacuaauucugggaaaucuaucuggauccugaaauaaguucugcuuugugauuucauaauuccucuuucagggaauaaucugaaaugagccagagcuuuaugcacaaaaauguucuucacagcauuauuuauaagagcaaaaaauugggagccacccaaaugaagcaaaauaagguacuuugugcacccuucuuuaaaaugauauuuaugaagaaaauuuaaaaaugugaaaagucauccuacauauguuaagugaaaaaaagcagggcaaggaauucuuuuugaguucaguaauauacaaaauacauaugugcaagaaaaagacuagaaagaaagacauuaaauguuaacaguagcuaacauuaggggcuaagaucuaggugacuuuuaauuuccuuuuauaaagaauuuuuuuuccccaaggcuuuuucuuucccaauguuauuuucuaaaauuucuacaaugaacauuauuaguugaauaguuacccuccucccuccucgcuccuccuucuuggagcuggucagccagugcugcuuuucuccuccucccaccccuccccuucucccacccgagcacuguggcugguuuccaguagcagcaguacaauuaauauuuuacacgaucuucgccuaaagucuggugguaguuugagauacuucuuuuagucugaacucauuuucaaauuuagggcccaggcuguucuauggcuuuaggaguugaggaaacaugaaagaaaucugccuucuauuuguuuaaauauuaaagcauuuaaaauauuuuuuccuucuuucagauaaucaaaacacagcugacuugccauugcugcacagugcugaaagguagcucucaaugugggugauuaacaccauggcaauggagggggcaaguuuuaaagaaauaauuaaauagaucuuggaaaaucauuauucuuuugucucauaauagaaaaccaggccugugucugcagcugagcacaguauuuggugaucagcagauaaaaggacacuccaaagccaaacuuggagccacugucgucuaccagaugcauuuuaucuggcggaaugugugggaccugacagacacaggggaauccaggcucugcgaaccucugcugagccucgucuccucucuccauaauggagaugaaggcgccucccauucacaaguguaguuauugcauaaguguuucccucugucaguuuucaguggcuaaaccuuccuauauaauauccuuggaagauagguuggggcuugggcuugaggucaagaugguagagacaagggauuugucccagacuucauggcaagagugagacuggcaugucuagauuagugauuagagagcucuuugagaaacuggggagagcucuggcccuucucccaaacagaacgcauauaacuauuucaggaaguguuuggacccaagaugaagaacugcucuucaagaagcaaccguggccuggcuagacuugggcaauggcaugacccuguggguauugcccccaccgccuuucugcgagggccugcaaaacggggcccuuguccacgugugugggucagugcuguagccaggaggaaggccugagacagugugucugugacucucugcuguuugauugugugagagucuguaugugaagaggaaaauaaaaaggaaaugaaaccaauuuauaauaauugucuucugacauauauaacuccaaaaaacugcaaagacaagguucugagccaaaugaaauuauucguuuaugaucaauuaaaugaugaacauaaacacaagaaacacacgauuuuccuugcucaagauuuggcauguguauuuucugauucuacuauauauguaagauuuuuauuuaaaacaaaagugaguuguugugcguaucaugggaugugugcugugauacaaauacaguggcccuuuauauauauuuaaauacaaagucacuuuuuucugauuauaaaacuaauacagaccuauuuuagaaacuuuggguaauaacaguauaaggaagaaaauaauaaucaucugguuuacuugauggaaauuaaacauuucauguaauuuuuuuuggcugcuuuuaaauuuaacauuauauccuaaacauuuuucccaugccauuaaucacuuucuguaaacaucauuuuuucaugccugcaggaguuccauuguaugaauacacaauuuaaguguuugguuguguggaaagcauauaagcucugacuugaagaaaugugacccaaaccugugucugucacuuacuggcacucgauggccucuggaaccucagucuccuugucugcagaagggagacugaaugacaguaccuuggguuacugagagaccucaaagagccucgcacaguguggggcaugcacucagcaaauaguugccauuauuauuauuggugacagcaguggcagcuuugucuuguggcuccucuagggagaguuuggaugcucgcaguauguuaagaauuugcagcccagcucuggccucguuuuuuaaaugaauacuuucuuuuucucuuauugcugugauuucuucuuuugcauuuuuccucuuuguucuguguacuuuuguaaguugcuuuacaucguuuuugcaguaaggcagauuauaaauaaauaaacacugacuauucccucuaguguugguuguuuagguuguuucugauuucuugcuauugugaaucauucugcauagaauaucuuagugcaucagggucuguccuagguuggauuauuugcuggggcuagaauccuggaggcggaaauacgcauuuuguuuuucuuuuuuuugagacggagucucgcucuguugccacgcuguagugcaguggugcgaucucggcucacugcaaccucugcuuuccggguuccagcaauucuucugccucagccucccaaguagcugggauuacaggcacaugccaucacgcccagcuaauuuuuuuguauuuuuaguagagacaggguuucaccauauuggccaggcugauuucgaacuccugaccucaagugaccuggccaucuuggccaccuaaagugcuaggauuacaggugugagccacugcgcccggccggaaauacgcauuuuuacaucucugauccaauuucuucucagaaggcuguaccaaucuacacucccaccauuaacgguacgagaagaccagugccacugacuccaugacugacuggccucuuucuuucaagccccguuucuugucauggcccaggguagcaacaaucugauucucaccuggaugcuguguucugcaucaucaucaguaaauggagcucaggguugaggucugccccaggucccccgguuuugguaaaucuuauuucugaugggaaggcaguccugucgccagccaguccugccugcauagauugcccucucugcuaaacaauggacacauucagacccgacucguguuuucaguuauuaaaaaacugagccgucugucucugccugugacuuuaaucuuuaagccuuuauucccuuuaccccaucccccuucccuuaaccuuuuguuugugcaguuccgagcucagggauacguggguccaagacuuucugaauguacuguggcuuccccugacagcuacagaugguuguagcccugagugauguuguuucaggguaggcaagggggggaugaaagggaaggagaagagaggucagcucuucuugccuccagcaaucauuugaacuuugccaaaacuauuuuuacauagcucuggaguggagugccuccguuccauucucuccccauuuucaaauuugguagacuuguaccguuucugaguugcuuaggcuuaauaaguuuacaucuuacagugccucuuagcauuucuuccugagaaguaguucuugugguugaauuauguauaugugugucuaaaagcaaaagucccaagaaaggaucuucaccccaacccccuuaaaacacaaccagaaagcucagaacacaacaacaucuuccauuucagaaagggcacucuuccggcagcacaugugguucucagugucuucuugcacaaggccagccagagaaugcuggauguaaaaaccagugacagggccaugagcuuggcugacagggagcauuaggaaaccauccucucuuuugcagagacacuggggacauuccuuucugaagaaggcuccuugcauacaaaaagaauggucuuuaagaguguugcuggcaccuuucugugaagagccacacaaugcagagggagggaaccuaucacuuggauguggaggugcaggucugaaggccaggaaggagacauuuuuucauauguguguuuuuuuuuucuuaaagacuuucuguuuuuuuuucuuuuuuugagguggagucucacccugucgcccaugcuggagugcgguggcacuaucuuggcucacugcaaccuccaccucccagguucaagcgauuuucuugccucagccuucugaguaccugggacuauaggcaugcgccaccgcacccagcuaauuuuuguauuuuuaguagagacaggguuucacuguguugaccaggcuggucuccaucuccugaccucaggugauccgccugccucggucucccaaagugcugggauuacaggcuugagcuaccacaccuggccuguguguauguuuuuucaagugugugcauuuuuugugcauuuuuacaugucaacacacccuguuuguuuuuaaaccuuuuuucucacuacaaagcuucuaugacuccagcauuuuauaaaugccuucagagaaugcaagagccuccucaccccuuuacggugauguuaacagaggguuggugccuauucaucugacuuuguccacauauauguauauuuaugcuuauguuagucuauuaguauugucacuuuaaaauuuguuuuuaaaguuaaguguggggcuauacuacaucugcuauuuugcauuuuguuuucccucugcuuagcaaugucuuggagcaugaguucagagaguucaaauucacucuguuuaguggcuguaggauauucccuugugucuauuuaccauuuaaccagucuuuuaauggauguuuuuggugucuccagucuuuugcuaggugaacguaaucucuuugcaccuuguagaaguguuucugcaaguuucugucuuagaauuggaaauuguuggggcaguugcauuuuaaaaaguauugccaaauugccccucccugcaaaaaagucauacugguugucuguuuuauaaaaauaauuuuuuuuuugagauggggucucacucuguugcccaggcuggagugcaguggcaagaucuuggcucacugcaaccucugccucccagguucaagugauucuccugccucagccucccgaguagcugggauuacaggcgcacgccaccacgcccugcuaauuuuuauauuuuuaguagagacagcguuuuggcacuuuggccaggcuggccuugaacuccugaccucaggugauccacccaucucggccucccaaagugcugggauuacaggcgugagccaccgugcccagccuaaaaauauuauuuuaagugaguuaccaccgaggaaaaguaaagcuuugucuaaaaucucagggcuacguuuaucuuacgacuuucugugccugacaccaucauacacaccugggcuuauaaacuugaauuugaaaagucuagcuucaagaucagucagcuuucacucuggauauauuuauuguccgucugcuaugagccagaccuccaguucuguggcgguaacacaaggaaaucuuucuccaaacucuaacaugaaucucuuuuuuuuuugagauggaguuuugcucuuguugcccaggcuggagugcaauggcgcgaucuuggcucaccgcaaccuccgccucucagguucaagugauucucaugccucagccuccccaguagcugggauuacaggcaugugccaccaugcccggcuaauuucguauuuuuaguagagaugggguuucuccauguuggucaggcuggucucgagcuccccaccucaggugauccgcccaccucggccucccaaagugcugggauuacaggcaugagccaccgcgcccagccuucuaacaugaaucucuuuauggccauguuuuuacagauccccagccaugccuugggcagguaaggaaagaaugcuagcugaaacgauggggagaauuaugucuggcaguauggaauugggcaaaaaugaauuggaugcagguuucccgcagaacaaucgugagacuguuauggaauaagccuuuguucuuugcaaucagaguccugguuuuacaccacccagauugucucauuaggaugucuuuuuuucaggacaucuguggucacuugugugaaugugacacuguagggucaaguggagggcucaaugaagagagaaguuaaaguuccccacagcccuagaaugggacaguuugcuguugauuauguaguuaacugcuggugaucugugcugcuggugauccuggacuugaguuggucacaguccccaccuuugcaauuuucaucuuauccaugcaccaccuuuauuaguauuauuauuauguuuacuuuaaacagacuauuuauuuaaccuucuccuaaguaauauuagccuugaaauaaugaguuuaaaauacuaauuccauuuuccuucagugcauauuaaaauaaauaccuaacuaccauaauaaaaaaagugugugucaccuaaaaucuggcaggguauguccuauacuuugggcaacaccaugcucucuaauugcucuacacucacuuuccugccaggguacuagguaaugaguacacauacaggauggggcagagauaggagaugggaagugaggcaucucugacccagaguucugggugugcuuaagaaaaaaaaaaaagaaucucauagcagagauccuguggugguaucuaauugugguuuuauuuugcauuucucugaugacuaauaacauugaauacuuuuuaauguguuuauuggcuaucuguagaucuucuuuugugaagcagcuuucaaaucuuuugccuauuuuuuauuagauuuuaaaaaauuauuuuguuguugaguuauaggaguucuuuaaccuacuuaucaguccuuugucagauauaugugucgugaauaccuucugacaauuuauggcuuaccuauuuguuuucuuaauggugucuuuugauaaccaaaaguuuugaugaagucuaauuuaucacuuuuuucuguuguaguuacugcuuucuauguucuaaguaacuuugcuuaccaccaaguuaugaagacauucuacucaguuuccuucuaaaaagcuuaaugacauuagcguuugcauuuaguccuguaaucuaucuugaauuaguuuuuguauguggugugagaugggggucaaaguagauuuuuuuccguauggcuauucauuuauuccagugcaucauuucuugaaaaguuuuuuagauuguuuuguugccuuugugaaaaaucacauaaccauuuaaguguaggucuauuucuggacucuauuguacuuugauuuguuugucugucuucacaccaauaucgcacugucuuuauuaguagcuuuauaaaguaaguuuugaagucaaguaguguaaguccuccaacuuuguucuuuuccaguauugcuuugaauauucuugauccuuuguaguuccauauaaauuuuagaagcagcuuuucaauuucuacaaaaaaaauaaauccugggauuaugauugggauuacauugaaucuauacuauagcucaaucgagggaaaacugacucuuaacaauauugaguuuuccaaucuaugaacuuagcacaucucuucacuuauguauuuuuaaguuuuuaguauagaggucuuguacauauguuguuaaauuuauuucuaaguauuuuauguauuuugaugcuaucauaaaugauauuuuuaauuuguugcuaauauauuaacauaauuaguuuauguauauucaucuuguaucuugcaaccuugcuaaaccuucuuauuaguccuagugguuguuuuauagacuccuuaggauuuccuacauaaaaaaucaugucagcuaagaauaaagauaguuuuacuucuuuguuucuacucuuuauaccuuuuucuaaccuuuauguucuuuuucuuaacuuauuacacuggcuacaacuuccaguaaaauguugaguagaaguggugagaguggacauccuugccucguucugaucauggugacaaaucauuucauauuucucuaguaaguaugguguuagcuguggguuuuuccauacacauccuuuacuguguugaggaaauuccuccuguuccuaguguggugaaugguuuuaucaggagugguuguuaaauuuugucaagugcuuuuucugcauccacugaaaugauuuuauaguuuuucuucuucauuccguuaguguggggaauuauacugauugauuuuuuugaauauuaaacauaaaaagcuauaaauuucccucuaaacauuaccucagccucacccaauauauuuuuuaacaugguuuuaacauguucauguagauuuuuauuuuccaggaauggauuauuuggcccauggaucaaucaguugguagaauacagauuguagauaguauaaaugaaugguuacacccaaauguuggcaauuugagacaauuugugaaacagcaggaauggcaaagucuuuguuucaucagcaacuuccuaauggaauuuguugacggaagugauuugauuuuuauccauuuagugaugcuuauaucauggcaaaguccaagccauucacauuucccuucagguguguucuaauucaugaucuuaaaucaugauaggcuauuuccuuaaagugaugucauuguuuccaccugggcagaggaagaugaugaguguuggcgauggcagaggaaggggauggacacaaguccaggaauaaggaaggcaaaugucagccagcacugucagccaccucccuugugugcgggcacugggcuagaucaccugcauguguuaggugugaguccacagcacugaggagauggaggucuguaggaaguaaaucaucugcugcaggugacaugaguaggggcagaaacgaggcuggagccaggucugcuagcccucaaagcugguggacuuuucccaggcaguaucuaccuuuuuuuaucaugcaacaugaggauaucuacauuuuggagugagugugagcuuugaggauaaaguuguaacagaaguuuccaggauaauccauuaauugauaccaccuaucuuauugauuuaauaauugagccacuguuauacuuggccaguugaauaucaagcuuggcauuccauuagauaggaaaccugguuuuggaauaaaucaauaaucccaggaauucuuaacaggaaacaugguuaccaaauguaaaugaaacacuagaguuauuuauaggaguauuguauuagauaguucucuaagugggcugcaaagcagcucugugaagugaguccuauuuucucagugacuugcauauucuaagauuaagugauguauucccaaggaacaaguccuuuguaaacagugguuaacuuuuguaaggaaggaauauagaagauucuggacagugucacggaauaaaacuauuaagagcacagauucuagcaccauacuacuugaauccuggcuccaucacuugcuuguuuugggaucuuaagcuggugacuuacccacuuuuuaccucagcuucuuaucuguaaaauaaggauaauaauauuguauguacuuaugacagucauuguaaggauuaaugaauuaguauguaaaguacuuaacacaaagccuguugcauagucaacucucaauaaauauuaacuguuauuauugcuaugguuacugauauuuguauugcuuuaauuaugacauuuauuucuuaauuuuuggcagaauuuccuugcuuguuuuagcuugccguaagauuagguauuucccucucucuccuugugucugagguaggguucuuucagaguuuugcuguuugucacagugucuaacuacucuguguucagcuggccucccuaggguugcucuuaagaaucaauaucucuuauuaacaaauacgaugcucccagccacuccuuuccugggagcaucuccacguucaaagccagguugcacagugccuggacagcagcaggauguguguugguucccuccugggaugccgccuuccccagggcaugguaagugugcugagcagucugugcgucagugagacccucccgagcucagugagacccucccaaguuggugcuucacugagacccacccagccauuuuugccugaucaagugacagaaugguucaaaacugaauuauaaaagacuuauuuaccuggaugauaauacaaaagaaaggagcccaauuguuacacuuccccauuagguacuuuugucugcugcgugacgggcuucccuagaagaguuguucaaacugaaguugugaaguuguagguuauaaggcagauuugauucacuguuuacuaauucugugugacuugauauaagguuggugcucaaaaaguugaaggaauuuuaacuaguugaaggaacuaguuaaaauuaauuaaagugaggauaggcacccuuccuucauucaguuauccccuuguuuaaucauuuauugauugguucauuuguaugcucacucaucuggucaccugaacauuauuggaccccuccucugggccauguaggcccuguguggagcucagggacucagauguaucugggaagaccccugcccagucuacugaggagacaaacacagaagcccccuuuucagugccucugagcagugcagagauggagggagggaaagagggugccaaguugagccuaaugaggggaagagcaaggcuggacuccugcugcgggggugcccuugaggaagagucccagggugaugagggugaggguguguucccucccacaauuaaugccaucacagugagaucugccuaauaauaggaucuccagaccccagcaaauugucugcugaucucaggcaauguuugucuguaagaauccuucgcccuguguaaacauuuuauuagaccauuaaguugccgucagccucucccacauuuacuaaugccugagcaggcugagcauaggcuuccauuuuuaugaaaacucuugcuuuuccagaggcuuauucuuugaccuaauuuaucuugaauccucaucccacagaucuggcuugcuuugugugacugggauaguugucugaaagggagggcuuuccuggagcugagagaugggcuagauaacuucaggaggcccuggccugcuaaggaauucuuuagugcauuacaauuauaugccuuuaaaaaacuauucuuguaaagaauuauugacaguacagcauuuugggaguggggugugccaaguguagcaacccauuuggaacaugucuguguccuccuuuuucaaguuaaaauaacgacucuuuaaguauuuuacaaugcaauguaauguugauuucagaaucugcuaagauguaggggauaaaugcaguccacaaaucaugcugguauuucauuuuauauccuauguucuuguaagggacauggaacugagaaugaugguggguguguggagcaggauugugugaggcacaaucuggaacaccuuucugggaagagacuguccagagagcuuagauccaucugcccugggcaaaaucugguaauauuuauaaacaacccuguguuagaauucuccuaggccuccaggaagaggcaggagcuccucuuugugcuuggcuugcuuggaggcauuugaccaaucauuaaccucccaaaauuacccuuguuuuuaucaggcgcguuuugaacuugaaucuaggcauuagaggaagggguguugggaaagguuccaucucugcugugggauuaacuuggcuuggagcaagccagucacuucugucugugugagcacagaacacaaaucuguuuugaaaacuggaccuaccugaaggaaagaugaugagaauaggacauauaaacagcuguauaaaacacagcugcuggcaguaguuucucuuaguggccauggaucugugugaagaggugaaaaccuuuugauaugagagaaagaggguagauauaauaaucaccuuuaugauuugcuuauuaacguugguugcucaacauauuauuucgauccucauagugaccuguaagguaggugggcuccucucugucuaacagaugaggaugcugagacacagacagugcagagcuggguuggggacuucacuuuacuucugcugcccugccgacuucucacggcuggcccggagacagaauaagcccagguguagaagggagcagcuggaguuguaggaagagcaguggguggacagccaggaguccgcaccaaacacaggcucacucuccagacccagacuggcccgugcagcacuucugccugcagcugagggggccccuuaagagcccuaguucaagaaaauugcaucuuuggauaucagagugaagaagaguacuucuacugcuauaauucagggcuucuugcuuaauucugaaccaucuaaccuagcucaauuugaguaagagucuuauaaaacaguauuuaaagauggccagcccucccuuccugcuccccucucucccucuauuucccuucuuccuucucucucuuccucccuccaucucucucuuucccuccccccucccuccauuuucuucccuccaucuuccugacuccuugcuuucaauugucuggcuucaguuucccuuggcucugugagagcaggucucuggaguguguugcccaucuuguggcuccccuaggagguuauguuaacugugaacuaugaagaggagccacauuguuuguuuuuuaacacccacucgauuauaaauugccagggaggcuuggacucuugggucgcuaaggugaggauccaauuuugagaucugcaaaauugggucaaaaucucauugcaucuuuaagccuuuccccucucccacagacacauugcauacacacacacacacacacacacacacacacacacacacgcuuaacaagauaaggauaacguaaacuagaccuuucuuuugacuuaauguuuuuguuccauguuggcauucaaagcaggaacacagggugcuaucugacaaagcuuuucuucuuugcuguucagaauuuccauuuggaguuuacuaagccaggacugauaauggguagacagcucaguaaaauucuagaugagaagaucucuguuaauaaucacggaccccugagaauuucugaaagguucuagagagaguuucgacauucaucuggcugccaaaugaacuucuggucugacuucagggcuuauugucuguggcacccccagauuucaguucugacagggggugcuaggcuguugguagcaucagaauuaccugggaagguugccuaccugccuguuucuuuuuuuccuuugguaaaugccagauuucuuguccccacuguugggaaauuuucugucccgggagucuggaucaguacugcuacggaaacuacaggaaguuggauuuuggcucaauccagauaaggaagugauuuaaaauggagcagcccacauaguguggggcugccucaaguuuccagcacaggcuggucucugccucuaaguggcggaugguuggacgggaagccucuuugguccuguuagcacacuaagaguuuuuuguugcggauuucacucuaacaggcacccaaguuacuugaccucuauugaccugcgcuucuuuuucucccuucuguccgugaugucauagauauuggaugaugacuguaaguuaggcucaggaaaaaugaccaaauuguucugcuuuuauggggcucauagucuagagggagagacuugaaacuguagacaaacucuaucuagugagugcuggagggagucacaccuucaaccugaagaauguucagguguaguguuagugcccaaggcaaucuguugccagaauugaccuugaaaauuccuugggaaggggcuguguugaagaugaaugccuugcuccucagugagcuccacauagggccaguguuuccucuggcauugaguggauugcuaugucugagguggggccuagcugaagcaguugguugauguuuaggagcuauguuuuaugaaaaaucucuaucagauguuagagucacagcucacccagugagauggccacauugggaggggccugugagaacugcgacaauucaggggucacuuuggcacaucggcuuauuaaauggaguuuugggcaaaagcuccugcacuacuucucacugaaugcuuaccuuugaauucccaugaauuaaaccauacguugugaauucacagucuuauaggagcauagaugagagagaacaacugauucuauguggggagggaggaaagacuucucaaagaaaugacauuugagugaguucuugaaggauaaguucagaguagaauuugaucagaucaggggaaaggagaacauucuaggccagcguuucccaaagcauacuuuguagaacauguguuccauggcauguuaauguggggaaagaagagaacccauuaguugagagaugcugguuaaacucaguucagcaauugcucucaccccuuaaagaacuucucagagccuuucauccuuaauacacuucgguguaucgugaaucuuaaagagugagguacaguguuuguacuaggugagacuuuucuuggaaaccugguuuaggcaagguagacagcuccugcagaggcaugaagcuuugaaagaccauggcuaauucaggaaaugguggguuugugugucugaguagagggggaguguaggaggggaagacagugaagagauguggggaacuuggaugguaugggccagcuucugggagaacuccuuugggugcuagguaaggcuaggcgccagucuuacucaaacuacagucauuuuagaaccaucuucacaucucucuuacaggcucaaugccauauauauucugauuuaauauauuuuuauaauccaauuuuuaaauuguagauaaucauaaggaaauuuugcaucacuaaggcaagugaaaaaccaguagccuuugcaaaaguagaauaaacacacguauguacacaaguacacauauauacacgcacacaugcugaaaaccaaacaguugucaaauucuagcuacaaacuaugaacuugagcuaugauucgcuuuuguuauaaagggagauuuggguauuuuagagagguaauaaguagauuauguccccaguugagacuugcucaucguucaaucaaagaaauggacagauaaccaaaauguuaauaauuuucuuacaauauaaugccagaucugugugccaucaaaaauaucucccacuuugggaaacuuugcucugggcaguggggaaccacugaaggcuuguaaacaggagcaccuuucuuugcuuuagaaagccaguuuguguacuuuuauggaugguggugguuccgaauggguaagacuggaggcaggaaauccauuguuuaagaaaaaaagaagcccaggggagaaaugcagaggucugggcuuuggggcuaugcccauagaaugguaggagaaacuguuucguuauuuaguagagagaauggcaggacugggggacaaacagagaagggggucccagaaaugacuuggcuuggucuccuggagaggucauagcagcucagacugagguugguaguuggcagagaggcagauugaguaguuggcagagaggcacgcugacuugaggcuucugcaggaagucaguauguagguguccaggggaguaagggauuauguguauguaacuccagaucucugguggguggaaagagaacugauuuuagagccagguaaaucugugcaugacccauggcuucaccccucacaucuaggaucuugguuuccuuuuucgacggugaaaaauuguaaaccccaaccuuaaggaugauugggaagguuacuagugguagagugcuugggauaacuguggcacagggcagagcccagagucagcaauguuuauuuuaaguuccuucuagcuucccaauuacaucucugaauuuuuuggagaaagcuagccucagauucagccaauuccuacggauuuccccuggaaugaaagaagccuugauucacacgugucaugacauugagcauucuuguguuuggugggaauuuugguauagaaaaugcugauugcugaccuuuuaucuucugcagaagagcuccuucugucaggguucagagacuuaggcaucaggccagcugggcaucacuggcauuuuuuccugcccauuucugucugcuuucuaggcagcagaaaugaaaauguccugccaaucuguuagacugacuucgccaacugccaaauggccuugaaaggaguagugggaaagccagagcuugguggucagacauccucugucgcuuacuggcuguuuaagccuggacaguggcauguccuuaagucucuauguugucauuugcaaaacaggguuaauaauauccauuuugcagaguguuuuggaggacuagagaucauagagagcugucuuagcccaagguauacuauaugcuuaaaauaugggugcuauugcccuuaguuguuguguguuaaccuccucucaccucuacagaaauguaggaaggcuauuuauuauuauuuuauuuauuuuagagacagggucuugcucuguuguccaggcuggaguguaguggcaugaucacagcuccuugaagccuugaacuccuggguucaaggaauccucccaacucagccucuugaguggcugggacuacaggugugagccacaccaccaagcucuaggaaggcuguuaugaauaugagguaucuagagauaacauacuguuacuugacaauacaacauguaaaaauuuagacugaccaaaagagaaauacauauacuucuuuuuuuuuuuucuggagacagagucuugcucugugaucucaguacaguggugugaucucggcucacugcaaccucugccucccugguucaagugauucccaugccucagccccccaaguagcugggacuacaggugcaugccacugugcccagcuaauuuuuguauuuuuuguagagacuggguuucaccauauugccuaggauggucucaaacuccugaguucaggcaauuugccugccucagccucccaacaugcuaggauuacaggcgugagccaccacaccuggcaagaaauacauauacuucuuuucuuuuucuuuucuuuuuuuuuuuuuuuuuuuuuuuuuuuuugagacagagucuugcuguguugcacaggcuggagugcaguggcaugaucuuggcucacuguaagcuccgccucccggguucaugccauucuccugccucagccuccucaguggcugggacuacaggugcccgccaccaagcccgacuacuuuuuuuuguauuuuuaguagagacaagguuucaccauguuagccaggauagucucgaucuccugaccucaugaucugccugccucggccucccaaagugcuggcauuacaggcgugagccacugcgcccagccagaaauacauacacuucuuaacacucacagaauguuggugugaaaugggaguuuggaaacgucuaugauuucuuuggaggcugugggagccccugggaggcuggggagcugccccagcucauaucuggacaggggcugacccucaucagagguguuccugccacuaccuuuaguaccagagugaacuucauguguugcuccuuagagaccagccaccaugcuucugcuggccuguaagccucugggccucugcuucacagaagugcucuggucuggaagggccccagagggcucuuguuggacucagagcccugcuuuugaucuucaccucaggaaggcugcugguaccucucccugauauugagugcauaaaguaauggagugagggccacccaggaaaaggauuuaaaaccgaaugagcagucacauccuaagaacauuuguuaaaagcccuaugucgacauggagaagaucugguuuagaaacagggcuuuugcuuuggccuucuguucaauguuuuuaaaaauggcauucgagaggaguaaaagcauguuuggagguauaguuucuacccucuuugagacagcagaaucaaaauucagauagucucugugggcuuggacagugagccaaagccaacaugaugaaaugaagcaagcauaaacaggacgaguguugcgaguucaagccggccaccagccuccccaggcagugaugggcuggcgcugccacaucagccagcuccuuccagggcugccuuccugggagcauggcagccacaucccggggagcagcaguccucugcuagcacacaucugcagcgccagcuuccauccuuggucucauguuuuaauagcaaaucugacaaauucucauugacccucaguggggguuggcugcccaccacaccuucugcauugccucaugggugguauuucucccaaggaaagccuuggcuagggugagugggagggagagcaaggacgcuagguccgagaccuggguuguggcaguugcugcauuacuuauaggcuguguggccugggcaaaccuuucgucuuccggaucuuaggcuccucaccuggaacaugggauugaugauaccccugguuggugauaccaggugaagggucuggggagccuuagcugugacgggaagaaagugcuuggcauguccuuggcauguaguuggcguaguagaaaaugcagucuagcugauuuggaggguguggguaagcugcuuaaucucuaugagccuguuuucuugucuguaccugaagaauugacacuucagauaccuggcccagugccauucaagacaugguagaggucacaggcauguagguccugaacgauccagaggaagaaggggcucuguagcccaggaacugccuuacacagugccagggcccuuggggaugcugagcuccugcuugugggggagucaggugaagcugggcaggacccagcaggguugaggucaugucucacggggagugccgggccacgugagggaagaccaguggacaggcacauuaaguuuuaaacucacauacuuacuuuaauguacguuagaaaaaaaucaaauaaguaguacaucaaaucuguacuuuuuauggaaguuuuugcuuucuuuuugguuuuauaguuuuaguauuuaaaaaaagucaauuuaaaggaaaauauuaaguaaguaauaaaccaggcaagacucuccaagaaugucaaagucacaaaagaacuaaccucccugccccaaccucagccaaguaaagagcaggugaugcuucuagauuaaaggaaacuaaagacaacaaaucuggaagauauaaagaacaccucugaaagacauaauggggacaauugggagaaauuugaauauaggcaauagauuaaguaauauuaugguauaagucaguguuaaauuucuuggguaggggaaucuccuaauucuuagaagacagaugguaagggcuccagugucauuguaacuguaaccugcuuuaaaaugguuugggaauccuuuuuauauaucagcauuauauauauucacauauauguauauggaaagagaacgagaacaugcaggaaugcacacaaauguagcauacugcuaacagcuggcagcagugaggcgagggcugugcuguguucaguauucuguucuuucagcuaauuuuguaaugguggcccaggaaugaugaacauuugagaaccauugugcugugggacuuuccuucagguccuuuugaaguccuugcugacuuuucauuucuggaacauaucuuuaauuuuguauuauaauuugauaagaaaaauuuuugaccuaagaaaaaucauucagugacacauacuaauauaauguaacuugguuagaaaauaugauaugagaucaaaaaauucaguuuucuuaguuauauaaaaugagguggcuaaauugaaauuuuugucucaaugaggcagaaaucauugaguaaccauuuguggccaccaguuaagauauguauucaauagaaaaugaccuaguacaggcccagaggccaucaguuaacacuagaauauuaaugauguaugauaggauuauagaauuaccugggaucucuucauuucccggagggaaacuggaaauuaucuugcucugugccaccugaaagcuauaaggaaggcucuuugaagaugguggugggcagcacuuacagcugcgaucugguguuccucugggugcacugauaccagugaaugauuuuccugaggaggaggagguaacagcaaaaucauguaacaucagaaaccuuuguugaagauggaugugggaaaguugagguggcuggugaggaguugaauuagaagacauaguauuucauuauugugguuguaauaauguuggugagauuauacaccaauauccagcccugaaguguagucucuucaccuccuugccuuucugccauguuaauaguaccuggaccacacauuugggaucucaauuauauuauggcucucagcaacccuaauugguucauggauauaugucuuauuugaaggugauugcaugcacuugaauguuagggggugaagcuccuuuugugucucucugccugcauuuaagaugagauugagcacacagaggcaacauggccuucccugggggaaggaaccugggucugaauucagaggacuuggguuaggauccuggcuccacucccuagugucuaugugacuuuggauaaaaugaugaugauuaugacggugauggcagaaguuaacuacuucauaggauccugucugugaaguaaggguagucauagugcaccuuggacagcguugauggaucagaugagaugaugcacaugaguagucaguucacuggcauggaacaugcuauaaagcuauuaaaauaaugaugcuugaguugaacugcauuguuaaaacaugggcuaauacacuguauuagucuauaaucugugguuauaaaggacaaaaauccaccccaaacugauucuuaaaaccaggaaguuugugaggacuagcuuuaagcacagcuggauccagggccucaaauaauguuguuaggacacugccccauuuuccagauugcuuaccucaugcuggcuuaauucuuaggccacccggcuccugugagauugcagagcugccauccauucugcuugcuuucugccaaguuugccccucucacagaaagagauauuuccuaguucagcaaaaagcacaggagagacugaguggccagcucuaggucccacgccuaucccuggagcugggaccagaguuccuacugucuaaacauuagggacugagaaggggagagaggcgauccuaaagggaaagagacccugugccaguggagugcuaggucuccauaacaauggggaugcauaguucuugcauggguuuccaaaucucucagaggaggagaauuucucauacaucacacagcccagcagauccaccagucuucauuucaaaccaagcauucugcuauuuuucuugcucaggaaacuguugauaaaaacugucccauuuaguugaaacacugcaaaaguuauacagaaaaauaaacaaauugagacucgggccaguugugggauggaggaacaucaaagcuuggccagucaccaagcucauuuuccacugcggggugguuucauguccacuaaccagucugcagaucuggagcugcaguuuaggcuugauugguuguagaagccgaaacuagcucaagguggcucuaguaaaaggauuuguugggagcagcagagcugugccugggcugggcaugcuaagcccaaguuggagcagguggcucuccauaccagacagccacagugaugucccugcuaggccuuccaccugccucagccacguuaccugcccacccaccugccccucugccccucgaccagcccacucacgccuguacuguccucugauggcuggccguacauggggucucugucacacccuuagccucagugcccagcucacuggcccuguuucccagugaauugcuugcaagagccucaggggagcccuguuggcccugcucacagaggucacaugacauuggucaguuucugacuagagcacucuugggacagaucuccgugugguccccauaguugugacugauugaaggcagugggcuauagguaggacagaauacuuugggaagggaugcaggcagggacagucuuuguucccuggcuuuggcagugauccugaaaacuuuucagauacuugaccucauagauggagacucuggcugccugggcuggacacguacauauguagcucaaguauucauauguuaguauuauaguagauaauaauuuuuauuauaaguauuuauauuuaucaugaaguacauuuucuuaucccaauuuuggaaaauaacauagaaagaagaaaauaaaaguuacccuuuaaucucaccucuguagaugcuagugaugagagcugauagcuuuugcuuugugugucaccauucuaagggccuucuaugcauacuuguugauccuuacagcaauagggcgagauaggauggagaguaauguaauccucaucccucacugugggacagagguaaggucuguggugguagugguggggagggaugaagggacaccuagccuacauggggcugccauaaagcccugguucagugucacccaaggguccaccaugugcucacugguggacaucccagggugaaaugggguuggguaguagugguguccuguucauucaccuuaggcugccauagcagaaccaaagacaggaaagacaggauccugccucccucaaucucccagcagaagggcuuaaggacccgugacccuuuaauguguucacgugcaccuuggccauugguuuggcucucaggacccuaggccuagacccucugggccugcucccuuccccagggccugccugaacauguucaaauuaauuugacauguuugaauuaaaggaauacacgagcaccuggggcauagcaccagcccccccuggucccccacugcccauguauauaacuugccuuggcuguggucuucuuuuccacacuugcugugauuauuguccuggggacaguccucaggggaaaccucagcaucauggggaguagggaggugugagucaugagaaagagucaaauauuaauuagggaacaucuucuauauuucaggguuugugccuggaacuaugcgaacauuuuuccacuuggcugcacaacucuuucagguacauuucaucauccuagcuuuauagaagaggaaacaggcucaggggguuaagggguuugcucaaggccacacagcaggucaguggagaguguguguuggaauccaaguaaauggguaaagaccaagagaccacaguggauacauguuucuuuucuugguuuuucaaguccccuuuuaaggggcuuuuuaacuagcagugagaguacacagaggugcucuccaaaggguuauacucuuugugauuuaaguaagugaagugaauaaggggaaaaaugaaagaaaaaagagacaaaccacaacaaguuucauguauaggccucuucaguuggcucuggccccuucacagacauagacuguaagaacuacuccggaaacagcugguaacaggacaccguacuuucagccuuucuuucuucauuguugccagaaaauaaucagcucuauaucuuaagugcuugauagaguggccagacaccagcuguaacuuaaaacaauuuuugucuuaguugcuuuaagcaaacagaugcggcuagcuuucugggccaagcgcaguguccaugucuuagaguggacuacucaagcugcucaaccgucuugauuuauguuuaauucuugcuuuagauguguccauucagacauuccuuugguauguuuccagaggcuuggguuugggguuugaaggagugauuccggacuggccguugguuugcuuguucauuguuucggcacuuaagugugcugcgugugucaggagcagggacucagcccuccuggagcugacgggcuaguaaagaagcuggacaagcaagugaauaagaacagagccuccccuaccccaaaggcaaccauuugcaacucuuagcuuauuauuuuuauauaaucuuuacaccauguuuauugugcuacuuuuuguuuggcuuuagacauuaucuguagacuuccugcuaaggaacauaagaauucuucucuuucuuauguccuccuucaguuaggcauucccucagaacuuucagcacaugguggggcacugugcucuguacauaauguccagcgccugccgucaggaagcucacggugcaguggggagauggaccuuggaagagaccacgagaggaggcuaugccgaggccugagcagaggaguggacguucugugcuggaugccucugcucggacuuugccucccucuauggcugagcggacucauucaggcagugugcuuuggugcagugguaccauuuccccagugcuauccuggccccagccaccucaucucccauuggagugauggcagcaacugcccucuggccucccuguugccauucuguccuuugauauacauuguccacacagcacagagugaccuuuugaaacauccaucaggguuauaucacucccccacuugaaaaacugcccuuggccuucuguuaacaguaaaauacaauccugacuccauacugcagccuucaaggcuccuggugacccagcccacuccugucacccccauuuggcuugcugucugcagccacuugggucuuccuucucccccucagaccugcuccucacuugggccuucuccuugcuguuuccccaucccuuuuaucuuccaagggaaccuucuugacuacccuuuuuagaauaauauccucaucaccucccaccacuuuaucccauaauccuguuuuauuuucugugcagcuuuuaucucucuguacaagcuaugcagaaaauauuuauucauuauuuguaucucacacuagaauguaaacuccaugaggacagggaccuuauuuguuuuguuaaauggcugcauucccuuagcauagugcuuggcauguaauagacacuagaaaaaaaaaaaagaaaaaaacucuuggcuaaaugaauaucgaaagagugcccaucuagugugucccugggacccagugcuacccuacuguuugaagucauuagugaaaaaaauuaucccuuuuauacuuagagcuguguccaaggaauacaguauuguuccuaaauaucaugcaugagcagaaagaaugaauagcaguaauaaaaaugguaaacucuuugcauuugcgguggcagcucuguucucugcacuuuaauacaguaacagauauuucugaccacaacuccaugugguagcacuacaaaucuaguccuaguuauaggauuacaacuccuggagaugagggaacugaaggacagagagagugaguaacuuaacaaagucauuagcuuuauaagugguggagcagagacuugaacccagucauucuggcuccagagucugugcucccaagcaaaggugccugaguuccuuucaggaaauaucuuuggaguuaaaugaauugaacacuuugcuucucuagagguggaaccaggaauaaucucaauuacucccacucuugagugcuccgucaugguguuuauguggcuguucauuguggacagugccaucacugauaccaaagccccagcacacguagagaccauaaggugucuuuacugucaaaugauggggcuucacagagagagucacaggaaacaagagacaacaacaacauacucucagaggugcggcuggccugcuuccccccauucccuggugaaguauggcuauggaugcuacccgccaugcagucugaggauuccuccacaugcaagaagccuccugugccagucccauagagauguuaugcccuucugcuccccacuucuaacucacuguucuaaggcccugacuaugugccugccugagggaaccaguacagaaugaugccagccugucccugaaugugugcugucagaucaggcgagaaagggccaaccucccgggaguauccugcaacagacccggcuucaagccuguguuuccucuucagugcuguaugugcauugcugccaguucuuaugcuaucccuguggcugggcggugggacagaugaguagccccagauggcacagcuggcagugccaggguucaaguccaagucuuuuugauauggagucuacaacacaacucuguuuauauuucucuguucaccaaagugaauucucguuacucucaguacauuugguuuccaucaguguuuugagugcugaaaauaacaugauagugcaugucccucacaggagaacuucagaaacaucacaggugugccacacuugcaccuugcaauuuaccauguuuuuucagacuuccaguuaacauggugggccaugcugcugcuggaagccuugugucccaaacacauugaaaugcuggauaaagugaggaaacacuaagagaagaaaaaauaugcagccagguggagaagcaagaaaggagcaucuucaagagcuagacuagaaaaggaggucaaauucucagcagggaauaugaauggaagccaguuaguuccagggguauacagauuggagaugugagguucaccugguaaauuaagaaaaaagacaagaaguugccuguaacugguggagauuaaauugcuugcuuugcgaggugagcugagaaaguuuccuucacccaggagaggacagaauuccugagauugcauggauucagaugcaggccucauaucuucaucacuggugcuaauggaaauccucagccaagaaauuaacauagaaacuggugacuccuuauggcccugggcugccguagccccugaucucccuaugggggugccuuuacaguugcacacaugugcaagcccccacagaaaacaacguuugcugaagaggaguuuacagacaaaauuacauggcauacaggaaaaauuaccaccaugagaaagagaaucuauggauucucaagugggaaaacucagauccuggaaacuagaaaccauaaaacaaucugaaagagaauuuaaaauaagaauauuugaaauguaaauaaaggaauagaaauuauagcaagauuaggacauuaugaaaaaaggguagauaaauuugaaaacaaaccaaaaagaaauucuaaguauuaaaaauguauuaaaaaugcagucauugccaugugcuuucagauuaauuaucuuauuaaugcuucauggaaguuaggguagguaguuuuauucuucguguguuuuuucaaaguuuuuuuuuuuuuuuuuuuuuuuuuugagacagaaucucacucugucacccaggcuggagugcaguggcacgaucucagcucacugcaaccucccccuccgggguucaagcgauucucaugccccagccuccccaguagcugggauuacaggugcacaccacuccagccagcuaauuuuuguauauuaguagagaugggguuucgccauguuggccaggcuggccucgaacuccugaccucagaugaucugccugccucggcuucccaaagggcugggauuacagaugugagccacugcgcccagcuuaaaguauuuuuuuuuacuauagaaguacucauguauguugaaaaucuggaaaauagagcaaauuauaggaaagaaauaagaauaauuuguuaaccuguuacucggguuaacuauuuuggcauuuuuuuccuaguagggauucuacuggguauaaaauuuuagauccuuauuuaagcaaaguuuugaaccaugagccuucuucuauaccauaauuaaauuuucucugaaaacauguuuaauggcucuguauuauuuuauugucuugcucuaccauacuuuaucugucuacucuugaugaauguaugcacuguguacaauauuacgcacuuuaaccacaacauguugaacauuuguuugcauuucagauuauucuuuagagcagauuaccaaaaaugagauggcuugauuuauggguggggccuuauauucuguaaaggaaggaagggacaggaauauaugaacauuuuuuagcuguauuauauaucauaaagaauuugucuggucuuugucccagguuccuggagcuucuaaaacccuuggaauuuccagagugauaacugugucucuguuacucauggugggcccuuggggcacagcugaguuuaugcuaaggagaugacucaagauggggacuggucaugccugaaagaccaaccaugucauuagaggguuaggccuaugggccauaugauaucaggcugaccuccugaccucuggggagcuggaaauuuaguuuagucucauggcuaguaauucaaucagucauaccuauguaaugaaaccccaguaaaaacucuggacacugagguucagggagcuuccugauugguaaacacauugauaugcccagagggugauuuucccugacugcacagggagagggcaccaaagcucugaaucuagggcccucccaggcuucaccccaugugucucuucauuuggcugguccugauucuuacccuuauaauaaaacuguaauccuaagaauagugcuuucaugaauucugugaguuguucuaguuaauuaucuaaccugaggaggucaugggaacccccuggauuugcagccagcuggucagaaguguggguggccuagggaccccugaacugguagcugguagcugaagugaaagcagucuugcuggggacuguacccuuaagcuauggagucugaccauugacuuuaggugguuugugucacuauugaauuaugguauacaacuugugauacauauuuccaauuguguuauaaaguuuauguacaaaauuacaaaagaguguaccuuuaaguaacguugacaccacugggcuucaguauccuuauguaugaaaugggaaauuuagugacaacaacacagaaauguuguaugauugucuucguaaagugccuuggaccagcaccuggugcauaaaaagcagucauaggauguccaugagcaugugcccaugugcgugcauguugugugagcacugcaggaaaaccagaaaacaagcgaagaaaacaggaaaagaagaaaucauuugaaaugacaucaaagauauaaaaacgggauauuuuguauuuugaaaaccucauuguuuaaauagguuggcuuaucccuuuuacauuuauuauuauauauuuggucuuuugucaucauguuccauuuaaaaaaaaaacauuuucuauucuuuccugcucuuuuuguuauuuucuaugugaucuucuguuucucauucucuuuucauuugugcaggucuacaguuuuuuuguuuuuaccuuagagcuaaaaaugguucuacaaaggguuacuuuuaaaucuucaaugaaccugcuuaagccuggauuucccaagcuaucaccuugagaaaugaagcaccacucugugacaccucuccuccuguuuuugguaguucugcuucaggauuuuuuuuaguuggcguuagugaaauaauuuucauagaauguauuucuucuuucaagaaugauaguaaaugcaauugguguauaagaggcccaucauuuuaauggaagaauaaacgucacaguucuccagacuuaauucuguauucaaaugguuccuguggucacccuugggucuuuucaugcaugcauccuuauccccagguucucacuuaacauuuaucauguuccuauuagaucugccuucaaggagguuuuaugugaaaagugaaagguuucaaacauacucaggacaaagagaacaaacauucauguacccaucaggcagacugaacaguuacuaagauuucaccgugcuuguuucaucucucucuccccugcuuuucuugcugaaguauuuuuaaacaaauuuaugagaucuugagucauuuuaccccugaauacuuauguauauaucuuuaaaaaauauagacauuuucuugcguaaaucaaugucauuagcacagcuaauaauaacuauucuuugguauccaguacccuaucuauauuuagaauuuucuugaaaaauguucuucaaauaugguucccuaccuccucccuccacaaaaggauauaagaacauauacauccccaaguccuucaugucgaugaggagcccgaggcucagagagguagauuggcuuccucaggucagacccuaguauugggauuugaauccacaccccucuuagugagcuuuauauuuuauguacuacaccuggcugcccaggcaugguuaccccgaguagggcgaagcauguaaccucaaccucaaguuucgcccaagauguaggggcugaagcagacaggaagaugagcacugcuccaggaagccucccaccagugcagaagagcucuuuucuggaagacagggcuggaugccacagugaggcaaguccagccccagcccuaggucagugucuuuuuuugguuuugugucuauucuuaaggagguguaaagagcucuuuucuggaagacagggcuggaugccacagugaggcaaguccagccccagcccugggucagugucuuuuuuugguuuugugucuauucuuaaggaggugcuucugguacacaggcagugccaaggcccccuacaaugaagcuacauggcuacagggaguucugaagguuauagaagacuauacagccuuugggaucuuagcucugccaugcacucgcuguguguuuugagccugugacuugaccucucugacugaguuuccaccuuuggaagauggaauuagagugcuuacuuugcaggguuguugugaagauaaugugaaugcagauguaagcauccccagcaccgugccuggcacauaguagcuguuuauaaaugcaaauauaauguugucuuuaucugccagggaggaggacagagcaccagccaccucuccaucucuacugcacuguccccuggccccaagaccucuucugcauccccuuccucucuccucuggucuggaugguuaggcacccaggcuuuauggggcagggcauuggagcugagaggacaccagcucugagcaccugcagguuuuggagagaaggaaaggacacugccaagcacuugcucaguguccugucacuccucagguggucugguuucaugcugcuuuacagaccaaagugcugggcacagaggcagaugugucuuauugucuucucagaguguuaccaauuauuucuaguuucaguugaagagacucaguucauugaugcaagagauugacucucaggauaugccggagaacagagccccaauaagaaucggggcaggagcucaggggcuguggaaacacucguugccagcaagugugcugagaacacaaaggaaaugcuugugauccuuuuagagugacugggaguaaacauuuauuucaccuugaaggaaaugaauguuucaggaagaggcccaggagcuugacgaagcuagacagcccaugccguaagccacauaaaggaggacaucagaaccaauuggguuagagagggccuaauaaauugugucccucacaaggacccagcauuuucuguuccuugggugggccacaugugcucuugagaagauugggaacagcuguacugaguuguugccauugagucauaucugguccaggggccagcgguuggugccucuggucauuccguccuuuucuaacaaagcucgaggugaucuggccaucuccccaaagauccuggggaagugcaugcucagcauccuccgugcagcacuggcagcuggggcuuccguagcccccugcuguguccugugcccugaauggccccuucccuuagcuuuccggccugcucccucccuccaguugcuaaauuccccucuucuaugcuugcuuagcagaaacuucucauuuaacuuuuacauacuucacuguguugauguugucuguauguguguguguguuucccccagaagacucugaagcuucucgagggcagggacuggguuggauuaauuucugaaguucagaacccagccuagggacagccauacagaauguaacagaagcaaacuuuuauuucugugcccagauaugguggugcacagaggguuguguggugcacagaggguagcugguuuugcagguacaguaucaggcaucuugagaaauuaauaguggggaaggagagcccacuaaggugggaaugcuugccugggacaccagccuggccugccugucgccuccaccagggggccccccugccccggccccucucgggccauugcauccugucccucugguugcuugcuuggggcuugcaggacaugguggacucugcaggcugcuucacagugcaguguguuccugcugcuccuucugaaaugugaccuaccaugccuucuucagucccucugucuccauccagaaaaaugucuaauuguaucuugaauucauuuacauugcuugcuucaauggccucacuuggcagcugagcccauaugcuaauuccacccuuuucaugaaggaauucugcugauuuuacuuacuuuuugugacagauuccucccccuacccccccacuccguucuuuuuuuggucuccugcucucccaguaaacaauuucuuagguccacucucgcaggcucugugacccagugcccucaggacacuucauggggugaagcuccugauggguuugagucagggcccugagcacuggcccaagcccuuccagcaccuucagcuuaggguuagucaagaauguccugccuugguuucuuugcuucagaggaggggcucucuguggcuuggggacccauuucuacaagggucuaagacaacuguuguuuuuuggaacccauaguguaagaguuggugagagcggcauuaacucaggggccuugugaggacagacccugcuuccaugauaggggaggaggagucuggguccgggggugaauugagcccgagcucagucccagugcuugccuuugcugccaguggggccuuggaugagaguuccuugaccucucugagucuuacucucuuaaucuguaaagcggauaucugagggcccauccuccccucauucagauuacuggggucuucuccaaguggaugcaguccuugcagccccugaguccucucucuauuggcccugggccacuggaucuucacagcauuugauuuucucuuggcacagccgcuucaguuguucaacuuuucuccccuuuuuucuguuucuaaacaagcauacauaaccuuuuuaaguguuacuaggaugccaccacugaggacuagagaagaguugauuaauuguugcuggaggggguguucuaaguaauugaacaggcccggucaucucugaccucucagugcuuuucauucacuucauacauauuuguugagcaccuauucucugcugccaugugcaagggauucugugggauaagguggcccaggucccugucccagugggugaagcugcagaggagcuugggagucacaaacagcacuauccuagggcaacagggauuguggggcucugaggaggggcugucaccuccagaugagagggagccuggaaaauaccugggaggugacaucuagccaaaauuugaaggcuggguugccagagaaaggacaaggugggaagaaugcuccaggcacaugugcaugggccacgguccuggggugauagagagcauggcugagugaggagcugaagcauggaguaugaggagauggggguggugggugugaggcugucagguggugcagguaggggcccaaccacacuggccuucuuguuccuugcccagggaggagggucaggguuggggagucggucucugaccuugaccuccugugacccucacucucuucuccacagagggcaacauagcacuacuagauaccagguccgcggccugaguggggucugauccuguccuugcacuuaccugacaauuuggccuugggcaagcaggcaaugcaaacucucugugccuugaugugaucaucugcaaaauggggguguugguaauaguaccuguauccuaggacugaguucaaugagcugauguaugcaaugcacuuagaacggagccuaguuauagugaacacuacauuaaaugucaccuauaaaaacagugcucauuucuuguggaaagggcuugguaagaauaacuucugucccagaggaaauuccagccuggugucucugagguuuuccugcuucaugauccagggaaauaauugucuuagguuauuccugggcuuucuaccuccuggggcuauauugagacucaguaugaaaaccuauguuugaaauucuagggaaaauccccacuagagagaaaauaaugucagagacuguuuggagcuuucacaugcauuaacuccuucaguccuccuaacagucuaugaaguaggcccuguuuuuacacagcauauguauacuguggcuaugauacuagguguggggccucgguccagaguguuggggagcgaguguuuggcagccucugcacggccuuuucaucagcuuuggaagaagccaaggcuagagagcgaagugcucuccccacguggccccacuggaggggcaagggcugagugagauucgucugcucucauuuggaccccagagagcccauuguccuuuccuccaggaugacccuccuggcauccaccuuccccacccccaccaugggcaaaacaugucucaugggagaaagaaggagugggcugucaaaucugcccuaccccaggcauagcggacugauuccugagugcuuuucugacuccaauaguuacaggccuaaaaggcuagauguuuauucuguuucuucgaacuuuccuuucuagcgaaaacuccagaguucucacacuagggagcuacaggccagucuuggcccauggacauguuuuguuugggccaugcuguuuaaacauuuuuuucaauugguugucaacauuuaaacauuggcgaauuucauauaauauuccagauuuuuggcaucucuuaaaaaaucagaggaucuggcaacuugaggccuacauuccugucuggccaugguguacuggagcugaggagaaacgguccccuccaaauggggugcgggaguuucuguucccuuuggucucacaccuugacuuaugccuagcccauguugcucaugugaggugcccaccagcccuggaggguuuccuuuccuuuccuuuuccuuuccuuuuccuuucauucucuuucuuuuauuuuuucuuucuuuaucucucuuuuucuuuucuuuucuuuuuucuuuuccuuucuuuccuuuccuuuucuuucucgcccgcuuucugucauucuuucguuuuuucauucauucauucuuucucucccucccucccucccuuccuuccuuuucuuuauuuucuuucgagacaagaucgugcucuguggcccaggcuggaauacaguggcacgaucauagcucacugcaaccuugaacuccugggcugaagccauccucuccuucaaccuucagaguagccaggacuacaggcaugugccacugcaccuggcuaauuuuuguuuuuuaaauuuguuuauaaaguuggaggucucacuauguugcccagacuggucucaaacucuuggccucaagccauccucccuccucagccucccaaauugcugagauuacaggugugagccacuguacuuggccacuggaggcuuuuauauuugggacaacugcucuccacuuucuuuacuuuaggacaggccuuugugaaugauagcauuuguuagggagaaugggaacucaggcucaagagcacucauaaugaucacuuucaugaugaagcaccugcugucuuccagacccaagugagguugguuagcaaguauccaugagccucacacugcucuguuuauaguauaugauccccauuuuacagguaggagagacugaggcucaaauagguaagggccuuuagacaggucucgcuuagcaugcagauugggaaaguugaaguagaauccagaauguucccucaaagucugucugucuccccacacaccuugcccucacucucaagguggcccaugcaucaguaggcaugcccugaaaucuagagauggaggacuccaggaaguuuccuucacaguuucccuuggagaucacugggugcucuccaagagaaauccucuuuggugaccuucagguagguggccgguggaacuaauuuauguugccucagaucaggcagagccagcauuggcuccuggcuccaccacauucuagcuauaggacugcacugucccccuacuccucuccuccccuccauccccucucuccugucuucccucgccuccucccccucacucauuuuagugagcccucauuguggacugggcucugugucuaacuuuccaagccucagauuucucauaccuggauggguuguugcuuggcacuguggccagcccaaucgagaccuugauaauugguagccauuguuaugaaugaugaggcuuuccacucauuuucacaauggaaaucacauugacaggaccccagaguuacagaauuuuugugaaaaauauugacuuuaaaaaauagccuuuucccuaaggcaccuugugggaagagcugagaugacacugaauugcacagaucuuuguaacucuggcucucccgucucauggaucagguaccuucuuuguucuaagcagucugcuaggcacaucacauaccuuucuaaaagguuaguaaugguuucaucuccauaugauagaugaagaaacaggccuggaaagcccaggcauuuugugaaagaucauacugcugguauguggagcaggggcuccaacucaggcuggcccuccccagggauugugcccugagcccuuuccuguggggccugauucccaacccugccccaggauccaagguggacucaguguccaugucauguaacaaaagagucagggguucucggugcccuguuagggccuguuguuccugguugguuggcaagucugaguguuuauucagcacugcugggaaggcucccuggcuuaauucugagauuccaagccauccugucguaucucccccgacucccccagcugagagaacugggagagacacgaggacacacagggcaggggcucuucccugggugagguuuguguuuggauuucaggcgucgcugauggugaagugugcuuaggguuuucuuuguaauucacauuccugugucuaccucuuacuguuuuguccaaaaauucuuguauccauauuuggugauuugucucucuguucccacccccacccccaagccccucaaggugucugccaaaauccuguauaacucguaucaucucccaagcuguuauaguauaugagggcaaaggauaauuuaguuauuuuugaauaaagauucggaggaaaaguaaaaaaguugggcaggggguggggggaaguuuucauacucacugcaugaaauagacaauauuuccugaaacaggagauacgaaccucaaagaauuuaaaauaaaacauucauuuuauuauuuuuuuaaagaaggaaaacgaggggaaaaaaguagaauagucagucuuuuuauccuaaguacagaugaaauugauuaaaccuuaaagacuggccuccgcacacccgguuuauuaauugaagaauuuccucuuacccggaaugggaaguucacauuaaaaucgagcuugcccugagugguagugacacuugagaacugaacauuuuccacaauccuauuuucucuucagugcuagaggaaauccuaaaaugguuaaaauggggggaaggggacugaggcgggagagaacagaaacuguacauuuuaaggaagccuaaagcaugaaaucaaauuauagcuuaugggccacaauuauuuuauuucuacauuucaaauuccauuuucugcucuuuuucacugcucuugaacgggaguuguacuguugugcaaagucagcuaaaaagauuacccuagauagacuaugacacgguagcuuaaagaagcaaaaaggcaaaacucccugguuagguugggagcccuguggcccuacagagcccucaugucugcuuccaucuggaaaggcgacauaagcagccaucaccccccggacuccuuggcccugacaggagcuuggaaaccuccacucuucgugugucuuccuguaugaggcugacucugccucuuguccucccagugaucagugucuacuucauugccucccuaggggugggccgcuccuggcugacgauaagcugaugccuggcgcaucauuaaugcucuggcuuagcaggacugaaggucaugcauuuuccaguuuucuuccagucccuggauuuagugccagcacaccuuuccccuaccucucacugaccccuuuucggcagagugaguuccaggcucagugcuucagcaggccauguuauccaguuaacaucuaauaauguuuuauuuaucuuuacaguuaauuucuccuuaacgcaaauuuaagaguguuguacuuauggucauguaaaguuguuuuuaauauaagugcauuugaauuuuaaaaaaugauaugauuuaaacauacaugugaguaaauaauaguagagguaguauccaugggucuggcagaaaucaugaagguggcucauggauggagaacccuggcuuaauucauacuucuucccugauguggaucagcuguuuugaaaacuucuagccaaagagcucuuuaaucaugucuccaguuauccauccacaucuuuaccagcccuugcucucaggaaguucucuuacagaucuaccugagcucccucaugcuucuguugaagaucacuuuauuuuguauuuucauuagauagggaacauccuacauuagauaggucccuaccucugaccuugagcaucuccuuaacuuccucuucccucagccucauggugggcaugcaggcucuuagacucuggcagacaggcgauauugcuuaguaucaugguacaaguucuccuguugaguuggagguuuggguucuaauccaguccuccaguuuguuagcugugugacugagggcaagucacuucagauccuucaaaucucuucaagucucagcuucugcaccugugugugugaauaauaauaaauguuuccuuccugggcuauuaagauuaauugaaauaaugugccuggugcauucuuaagcaugcaauauguguucauucucuuucuuccuuuccccgauucccugaccuguagucaucuuuuuauuuauuuauuuauuuauuuauuuauuuaauuuauuuauuuugagacagagucuugcucugucgcccaggcuggagugcaguggugugaucuuggcucacugcaaccucugccucccggguucaagcaauucucgugccucagccuccugaguagcugggauuacaggcacacaccaccaugccuggcuaauuauuguauuuuuaguagagauggcauuucaucauguuggccaggcugguguugaacuccugaccucaagugacccucccaccucggccucccaaaauguugggauuacaggcaugagccaccgcucccagcccauuuuuuucauuuuuaagcuuuuuauuucaaagucauuucaaacuuagagaaaggcucuaagaauaguacauaggacucccguaugcccaucacccuugagucaucuuugugaccauccuugcauacgacagcaugguuuggguacagccagacagagacuuaggaguugcucucuagcaaggcugacuguggugcgaggacauuuccauggauuccuccacuggucuugcagaaggcugaaaccucauuaacagaaaaucuuuaugaccacuaagcagacauaacugggugucuucucucugcuacccucccacccugccuuagguggauugucuaacuuguagaucaaagcuagccucuugacaaguuuccuaauaggacagguacauaccuagaguugugucugagaugacuugaugugugcacagauaugguguuaagggacgucgaucccagugagaaaguuauucccauuucaagauucuuuaaguccuucugaugacuuuaaggagaucucagguuggugcugggagcucuuauacuucucuuaacauuguaagcucagugccuguuacuguaaccaugucuggcuagaacuuaauaacaguguuuuacuuuuauuguacuucuuuuuuuaaacuuuucacuuaugguaaauuaugcugguuuuccagugauaugaagcuuuacuuuuacuuacuuacuuauuuauuuuauuuuauuuuuuugaggcagggucucauucuguugcccagguuggagugcaguggcgugaucuuggcucacugcaaccucugccuccuugguucaagugauucuccugccucagccucccauaugucugggaccacaggugcacaccaccacacccagcuaauuuuuguauuuuuuuuuuguagagauggggucucuccauguugcccaggcuggucuugaacuccugggcucaagcaauccccccaccucggccucccaaagugcugggauuauaggccugagccaccgcgcccagccugaagcuuuacuuuuaaaaauaaauugcucuugagucaguaacguauguauguacauaguucaaaaucuuaaagguacaaaaagguacacaguaaaaaguaaaucuuccuuuucccccugcuuaccuaguuuacuuccuggaagcaaauugcuauaaccauuuucuucuaaagauuccaaagacacuucaugauuuuuaagcauguucuuucucccacggauccucuagaaguggcaauauacugugcacacagugaacacaccagcuccgcuagagcucuauucagugaauaguuaccgugguguuuuuaaauagcugggucauguucuguuuuauguacaugucaugguuuaguuaacuacuucccuuccaacaggcagucaggcugguucugaccuuuugcucuuccagacacguagcaaugaguguccacauaugugccccaugugcacgugggucacugcuaguccccagggguguuugacggccauuugccguugugcugcuccuacccccaaccccaccccagugacaggcaggacuaucugucuccccuguguggaugggcaaagguuuguuuguuuguuuguuuguuuguuuguuuguuuguuuucagacggagucucacuuuuucgcccaggcuggaguucaguggcgcaaucucgccuuacugcaaccuccgccucccggguucaaguguuucuccugucucaggcucccgaguagcugggauuacgcagcaacaccaggcacgcaacaccccauccggcuaauuuuguauuuuuaguagaaaugggguuucaccacaucggccaggcuggccucaaacuccugacuucaaguaaucugccugccuuggccucccaaauuguugggauuauaggcgugagccacugugcccagccaagaguguuaccaaauguuugaggugacucggccuccuguauaaaacuuggguucuggagccacauagccugacuuugaauucuagcucccuaucuuucuaguucugcgacccgugacuuaauuuccucaucuguaaauggcggggggcggggguggcggugacacagagugucagcaggcucccagaaugucagggcuaggcaggccgaacacucaacauguuagcucuuuguauuaucaucaguauuauuuugucaguacaguaggugaaaaacagaauuucaguguacagugguuuuaauuugcauuuuuuuguuacuaguaaggugugaugucuuaucauguuugagcuauuuuuauuucuuuaugccccugcuuauuucucugacuucaucuccuuccucuuccucaaacgcauguggaggcuuugcacuuguuccucccucuguugccuaccaacuccuucuccgcugagucugugcccagauagcuccuucucaaugaggccucuccugacagccugauuuaaaauugcaggccaccugcuucgcagacagcucggagccuacuucuccugcucuuucuccccaggaugcuuagccucucugacccuacugugaaauucacuuacuguguuuuaauguuugcuuuugcucuacccuacuggacugugaguucucgauugcaagggguagggacuguugucugucuggccucucaagugugccagccaccaacucuacgucuggcaugagggaguguucaguaaacgugcugcgugugaacuagcuguugauaccauuuacauuuuugauuggacugucgcucuuuuuaaaaaauccauuucuauauuuccaauuugaaauauuaaggaaaacaguccuuuguauguaguaugcauuuuaagcuucucucccuugucacuggacuuuaucguauuuuccuauacagagauauuugguuauuauauuguugaauuugucaguguuuccuuuuuauuuucuucuguguuuauucuguggguuuuguaucuuaccuagguauuuuuuuacuuuuaagauuauaaaaaauuuuuuucucacccuuucuuucaguacuuuuuugguuuucuguuuuuauguuugaaaccuugauccauuuggaauuuauucugaugucauguguaugguagacauccaauuuuauuuuuaucuagauggcuacccauugucccuuuaucacaauuaugugauugucccuguuuccagauguggaccuuggggucagagagggaaagauccuuacccaagauugugcagccagcaaauggacuugcauccugcccugcuccccucucccagcucugcggguguuuugccaugagucucuagcauuucuuguuuuuuuggcuuucuuuccuuuuggcggggguccaacaccucuauuugucugcuaucuuguccagggccauuuauuuuuugccuugaugucuuacauggaccuucuuuguuguuccuccuguuccuccacugcugacaugcucucauuguucacccuggccuuucuucagguggugaugaaugucuccuuuggcucccuccugcaggacugugccucagguugugcacuuuguucuccuuccucucuauccucagggccuugcccaccugcucuuugggaugccuuaggguucccagagcacucaggaaugcaugauucuggccaagaggcagcugauaauagaaaaagcagaaauuuugaagucagacagcccuugguacuagcgcugccucugcuguugacuguugggcaauuagaccucagauuucucuuuauggaaaugggaggucuccucuuccaggggauaguggugaggauuagaacuaaugcagaagucacaagcucaggugccuguugggagccaggcuaguaguacaaaugcuggggugugaggcaauagggaauugcaggaaccaggguaaaguugggaaugcaugccuguucuccaggagacagcugcuccucagccacaucagacaaaggcccagucuaaccacaugugcuaauucauggagauuuuuaugugacauuucucaaguuguaaauguuggcaguguaugcauauucuaacagguacugcacaggcuagacaaugcccauuccagauccucaggcaucuuuaaguugucaguuugcaaccagugaugugaaguccuuggcuccaauucagcucucaauccacaguggcuguuauucgggguuuuuugggguuuucuuugagcuugcucugucgcccaggccagagugcaguggcauagucucggcucacugcagccuccaccuccuggguucaaguaauucucgugucucagccuccaugcauaccaccaugcccggcuaauuuuuuguauuuuaguagagacgggguuucaucauguuagcccaagcuguucucaaaguccugagcucaggcaaucugcccacuucagccucccaaaguguguaauggcuguuauuugaauuguggcugcugcuuuuggguuucuugucagucaggcagcacccugcagugucccugcuggacgcugggucaacucuguucccacuaguuacuuccgguucuuggaguucuuaaacuucuucugguccacgugguauggcauauccuuuaccuggagaccaagaagccaggguuugacucuuaaugcaucaugggaccaggacagcaaugucuaguucugccgggucagcuucuccugcucaggggucucccugcaagucuggugagauuuggccaggauguuuguggaggagccugccuuugcagggcaguucaaacaaaaaggauguccugcccagugguggauacagugauccaggcuguuggcuggcacuuaccaagaaaccccgugaggggccagcuccuggguccacaggaguugggggaggcacuguuuguauucgcuccaugcugccguuaauacucuuccucuuccuccucuggagggcacaaggccuuuggguauaugugaguccuaaaggaaggaggaggccaguucuugagcucuuacugugcuggcauagugauacuugcagcagcuugcauuuagugagucuggggcauguggcaggugcugggugaggugcccuccuccaacuuacuguguugucucuggcaucagcaucuuccaaggaggaaucccaggcuccaggaggucaagagguguacuugccugaggcugugcagcuggcagagcgagaugcuuacccucugcccccgccugccucagaacuugaggugggcuuccaagcugccaccccguuccuccugcccacaggcagcaccccucucuaugaauuccuugaucacaugccucagaucaaaacaugcccucccucugggcugucuccucuacaggaaccugaguuuccaacuagagugguagacaccacugucaguagaaaacagaaaugcaauuauuguuucuguuuuacagauguggagauggagcacagagagggugaauagcuuuauaaaacuccccuccaucugaaacuguucaugaaaauggugauaacaaggaccagggucccuggagccuucuccugugacuggggccuccuuuggccaccugguccccacuggagggucugggccuggccaggagccucuagccuguuaaacuccuagcaccuccugcagucgauggaguaaccuggugguuguuagcagcaugggcagcaugaauguuuggcuucagugagagggcuaagcagaaaggcugagagagagugcaugaguguggcaugcugcccugugcccaggugggugcuaggucacaggcacugugcagggccuggucgugaccgcccuccuucucuccuccccuuuccccuuccccaacuccaucagcaggcuuuguccacuuguguuugccuggggucugccuggacuaguggggacagcaggccuuguuacaguucgaccaagagugauggggcccagguucagugcucacagcuguuaguaccagcuccugcuuacugagggugcuuagggcugagucucuccuaaucuucugcaggagacaucuuuguuuagguccugauuguggaugaggaaauugaagcuccugguaagguugugauuugaacauauccaagcuuggggaccuccaagcccugcucuugccacuuccucuuauuugugguccuuguuuccuuggucuuuaaaaugacccucuuguuuaagccccuuccauuuccaaauccucugagccugugcugaggaggacaggcuggacacugcugguuagucccacaccuuccugguaccaguaggaauuugagagggaaaguccaggcuuacccuguuucaggaaaacugcagaaggaggaaaacuaauucuccuuaaaacugauuuucuccuugcucucucugcagaaugggcugcaaugugacugaagucuugcugccuucccauccccugcccuuggcagagagucaggguugggacagcugcaaccuguguuggauggagccugaucaguccuggguucuugccccuaguuggguggcuuugggcaaguuauuuaaccugucucagccucagucuucuuaccuguauaaugaggagauaggcaauacauugaauaaaugaauaaaaacagcugcaaauaauaauauaaggcucucgcccuggagucugagaagcuguguucugaguuggggaccucugaaaccugcccguuuuguccuggaacacccgcagggggcuuguacagagcaauuguuuuauucuggacauaagaucuugcugcucagaguuucaggguacuguuguagagcaaaaucaguagacugaguucaaaucccucugaauccuugcuccuugaccugacuugguuacuucaccucucuaagccuuuguccucucucucucucucuuuuuuuuuuuuuuuuuuuuuuugagacagggucucacucugucacccaggcuggaguacagugguguaaucaggccuugaccugcagccuugaccucucugggcuuaggugauuauccuaccuuagccucccaaguaggugggauuacaggcaugcaccacuaugccuagcuaauuuuuguauuuuguauagagacaggguuucaccauguugccccaugcuggucucaaacuccugagcucaagugauucacacaccucagccucccaaagugcugggauuacaaacgugugccaccacgcugaaccaauuuuuguauuuuuguagagacgggguuucacuauguugccuaggcuggucuugaacuccugagcucaagugaucugcccacuuuagccucccaaagugcugggguuacagacccagccuguuuucccauuuguaauacccacauugcagaguugguguugagauguagguaagaggagaugaagacauguagaccaccacugugcaugucauaauagcagauguagaagugaaaaccgugguaacagcuaauauaauugaggauuucauaugucuaggcacuguucuaaauuguuuacauaucugaucucauugaaucuucagugcaauccaauaacauaggcaguaucaucguccuuguauaagaugaggagccugaggcacagagagaguuaauguauuuggcaaauggucauaauaauaguaggauauuaauugccacugcaguuuuauauuguugauaaaauguauuuacauuguucaaugaauauuuaaaaagucaccagucaaaaacaaauuuuggccaggcacaguggcucacgcccguaauccuaguagcacuuugggagcugaggugggaggaucuauugaggccaggaguucgagaccagccugggcaacauagcaagacuccaccucuacaaaaaaauuuuaaaaauaagcuggguaugguggcaugcaccuguagucccagcuacuugggaggcuaggacaggaggaucguuugagcccaggaauucaaggcugcagugagcuaugauugcaccacugcacuccagccugggcaacaguaagacccugccucuaaaauuaaaaaaauaaauaaauaaauaacaaauaauggcacacauuuaccuacauaacaaaccuggucauccugcacauguaccccugaacuuaaaauauaaguuggaaauaaauuuuuuuuucuuuauuuuaaauguaacauuuuuucuccuucuuauaaugcccauagcuuugacuuuuuuaaaaaaaaaucugauuuugagguugcuaaaauauguucaaaguauaauguuaaguuucuccagcugaaauauuuuuuucugaacauauuuuauuccuucagucccaaaaggaaaauuacaccucacagauaacuuaugcuuuguuaaaugcugacccuuguaaguuuuucauuauuuuugaaaugauuaagauauauaauuuacagaauuggaaauuguaauuuuuaaauguacugagaaacuuuaacccuauuauaauuauucugcaaaucuuuuaaggauacuauagucaguacaacuagaugaaaaacucugauagauugggaaauauagaggaucauuuauaagccuugauuuuuuugucuuguguuucccacccacucacucgcuaugucccucuagucucagagcgauuuucuacccuggguucaugggaauugggaaggacacuguuugauucauucuaugaaacuacuagggauuuugaaaaaggcaagacgggccaguugugucacuuccugucgucugaucaaaaguuugaugaagaaaagaaaguaacugagagcugcugccaggcagcaggcaguugccuggugaugaccccggguuuccagugcuagucugguucccaguguggccagucaagucccucugaccucugggcuccuuagaagucccuggugcuggcugcgcugcacgggguccgcucaagagccuggccuuuuggaacaaagacggcuuuuggaugcuggaucaggcugcagaugaaaucccaacuggcuccugaguguuuggguccuaucuaugcuuaguuuucugggucugucaaucaguuucauuucccauccacaggaucucaauaggcgugagaagcaagagggccugaugcguggagcacaugagucauuccccuacuggauaguugacuggauaguuguguauaccaauaggaaaucgacuguugaagaagaggaacagauuccuggugaauaaaguagaagaggcagggauauggacauuugcugcauuaguccagcaacgauguauuaagcugugcccaagcugggucuugugcugugaauacagauugaaaacccaggccuugguuaugaacccucagcauggagccggguggggcaucaaggaucaggggcaagugaaccuggggcagguguucugggcaaagcaggagcaggggcaaaggcaaggaagggaaaggggcgagaguccaccuggguccuaccuugaucuuuagaugggaagugggagaguugauggggggagggggagaaauugugggcuggguccccacugggcagggcgggcuguguggcgugggaguuaagaaccugggcaccaggguucagaucucuucucugccaccuaccugcuguauaaccaugagcagucaacggacuucccuaaagccucgacuuccucaucuguaaauuaggggcuagguaguggcagguguuuaaguucuagagggaacuuggauagucagaauuacucuggagaaguccuuaaggaacgcaugagguugaguggccuugguucugugggcacagcuucacccaccggagagggaggccuguggggccagugcaggauccauucugcugugaagguggagacuggaaaauaggcugggcccccaacguguuccucccuccuuguucccugcugggcuuuaucucauccugccucaagacccagucucacagcccuguggccaguucccagauuuacugaugguuaggacccggaagacaguuggguguaucuucuggguagggaaggcuugggcucagcuugugugagggaggcaugagugucauggggccauggagagagggcgaaaagcccaggaaaggguuuguggagcacacagcauggugcuuggcacaaggugagugggaagcaacugguaguuaaaaaacagggagccucccacagccacauuggggagucuuuuuuuuuuuuuuuuccaguggacaguggggcucuuagcaugagaagggcauggucaggucuguguuuuauuguauuauuuauuuauuuaugcacuuaaaauuauaauuuuauuuuagaacagauacuacacaucccuguuuaaaaugaaaaggaaccgaagaauguacagagaauuuccuuccuacucaucuuuggucucccagcagacaaccaagucauuaguuucuuuugcauucccucagagauauuuuaugugugucgaagcaaauacuuaugcaguaugugacacccacacacgugcacacacauacacacacacguauaccuuauccccuuuucaacacaaaucacacucugcacauugugccuugcccuucucacucacuccgccucggauaucauuccauagugguagauaaagagcuucuucauucuuuuaaauggguguauaguauucugucauggcauuauagcauuauauucuuauuuucaaccuguccccugcugauggacauuuaccuaguuuccagcauuagcuguaacaaacaugcugcuuggcugggucaaagauuaugugccucugcagagguuauaccaguuaacccccgacccccgcuccugcccagcaguauaugaaucagugauauauuuuuagaaagugccuuugggaaggcuguuuggaggauggaguuuggagggccacaucugagcugcagcagcccauuagggacuagccaacaugagccugccaugggcuaugggaacuggagcuggaacagagaaagaguccagaggagaguugguaauucaguagcuaugagagggagucuaucagaugagucgagccuguuuuuaauagucuguucuguucacgguagaugauagagucaguguccauccccucuguggcuguagcagagaccugggcccuccugccccuugaccuggcagaggagaugcugcugcugcugcugcgugcaccugagccuagcccuguggccccagcuggcaggaugaggagaggaggcuggacagggagaagcagagugggagacaggaggguuggggcaugccuaggucuaccugaagucagagagacacaccguucugugggaggccagaggagugucacaggacaggggugaccaagaggccucuuggaacagugggaagaauucuucagcaguggugucaggagcccugauuucuagugucuucgauacuaguuggcugugugaucuagagcacaugaccuagacccaugucugugagucuccguuucuucaucugaaacauaaguuuacuggagauuaaguaagcugaccuagugugcguagucagagugcccgaaaaaagaaaggcccucccuccuccaugccuucccucuauccccagcagugggauagaaucagcaucaucagagucauucacagagcagucuccucugcauugccaaugaccauaauccgaucccgagaaaugcuucaugggcauucuuauaagcucaaaauguaauuauucuucauuuuaauagggaaaauguuuguauauuccugcaguacgaaguuacacgcuucuuguugaaaugacuccaaaucccguuaaaaaggaaacagucacuucacuggcuaacauuauguuccugacaugauuuauagcaguuucccuucauucacuuucuguaacuugucugucuaccugcuguuguucagcucaggugugcuguacaguaggaugaugcucacaagcgugcacgcacacacacacacacacacacgcacacaaauguucaguacuuagcgauuaugacacagaaccuuagaugcuccuaacaccccagaaggaauaggacugagccguagcacugugaggaaaagaugcuguccacucccuaauccucccccuucugccuccucuacuuucucagucuucucucauuucuuagcaagggcaaguaucuagccauuugccaagccuaguacgaaacuuuuuuuuuucccccugcugagacauuucuuccucugucaaauggaaugaaagugauaggauuggugcaauagaaaggcacggguuuuggaguuagaugagccuauaccuaaacccagcccuauugcguguuagcagugcgauccugggcaagcucucuguguuuuguggaccucaguuuccucaucugccauggcaguucugaagcuucagguccaagugccuagcacagggccuguagccagaagcuguguagucaccauuuauuccacuuugcucacuuuuacugcagugcuuugaccuggggcauugggcaacuuucuguggggcucaccaccccuuuucccuuucuaaccuucucuucucuuauuccaggggcccagaucauugaucugaugaugcuggucaucgaugugaccaaggggaugcagacccagucagcggaaugccuugugaucggccagauugccugccagaagcuggucguggugcugaacaaaauagaccucuuaccugaaggaaagagacaggcagcaauugauaaaaugaccaagaaaaugcagaagacccuagagaacaccaaguaggucugcuaaugagagcaauguucacugcauaagaaggcuucuggggccucccauguucauuucacaaacaugaauuggacaggcaggugucagccucccguccuaguaagugagaucucaaccuggcauuugcucacauaagggcugcauuaaaugagguaaaggcuaacguguuuuuaaaagaggccaaaaaccacaggagcauaaagaaacuagaauuugaugaggcacaagcccuucugugucucagcucacaggaaggagaaggagcacagggacucugugcccagugugcaaggccuggacuggcaaggguucagauccuuucuacuuagcuugucuugauaaaaacuuagucccgccuacauauauuggccauacuuuggugcaagagaggcuaggacuguguucucuugcuaucugcuucucuacaacucgauuaucaaaaggggaagaucaauuuugguagaugacugguuguuucuguuacagaagcuuguaagauuggguggacagaccgacagaugguuguugcugcuggaagccagacuaggaaacaccaaaucacaaaggaccuuuuuagcaucuucugccaaggaguuuacaguuuuaucuuguggaaaguaggaaguuauuaaggaauuuuaugcaagggguggcuagaugagguuuuucauuaggagaucacuggcugcagguggaaggcuggcauggugaggaggacccaggaggcagcagagaggagaaggaggagaaggagaaggagcagcagaggcuacugaacuguagugguuuuaccagggagagaagguguugcucugaguugaggcagagcauggagggaggagguggcuuggggagauaucuagcgggagaauccacagcccuggugaagcaauucgccuggaucacaguaaguguggaagaaagcuggcagugcuaccuagaagggcaggggugcgggaggcacagggggacugugagacagaaagccaccugguugcucaggcggccacaggaaugacuaauucugauguggucaagaaaaugagaaaauguccuuguugagcacaguguugacagaccucauuguuuuaucaauuucucucuuccucucuaggccagucccuuuugaucaauacuaaauagcggucacugggagacagggaugcuuccucuuugcuaugcagccugagacaauauccugccacuuccaccucuccuucuucugcccauggagggcaagcaaguagagagcguuuuuguuucccugucauaaagauugauaugccuucccauuuaugauguuuuuuucagauccaacaccugcagcucucccucagaauucucaaguugguuaaauuaaagcuccagcucugugaaugggccaaauaugucauaaaagauuuucuagcgcugccuuuuguuagcaaaauucaucaauccgauaaaaucgacacauuuagauaaguguugcauaagaauucagacuuuguuauucccagcggaaguggauaugagacuguaaaaaggaagauaaaaaauuauaucuucuuuuuagugaguuauuugaucucccugucguuuuauuuacuugucagaaaaggaagaacaggucuuuuggacucccgcaaaaaaacccaguacaaccucaguacucagauacaaccucaguaucauuuacuauagaaaugggaccuucagggaagggcuuaggguacguuuaaggguuaauuaauaguaauaguuuugauuaaauuuaaggaaaauucucauuugcuugugaaaauuacuauuucuauuuuaguguauugauugaagaucaaauuauggacuuuaucacacauccagaggaaauuguccaucugaggguccuuggaagccccuccugcccucauccagcaccagcaggcugguagggaaaggagaggacugucacccugagggguuguaaucagugggcaugugaccugcugaacauuagcuuuuaccuccaugaagcaaagaacuucuuuaaaugauuuuaagugacuauuucauuuucuuauguucccuuguuaaguaaacccuucauaaaugccaguccagaugcaaagaaacuuucugucuauaaagggaaaauguggacuggugaaccauguaccuaucaaaaccaaaaaaguguucaaaacauuaaauguauuuuuuucuguccaaagaguaacugaaagaaaacuuggaaaauagagaaaaguaguuaaaagaaagaagagcccacccaaagauuucuuuucucaaauggcagcugcuggcacuuuuggauuuuuucauuucuuuuuucuuuuuaacuauguguaguauugcccccacuuuuucuuccacauuuuuuuuauugugguaaaauacauauaacauaauguuuaucauuuuagccacauguaaguguauaauucagagcuaucaaguacauucacagugcuguguaccuguccccacuauauauaccccaaacuuuuucaugacccccaacauaaacucuguagccauuaagcaauaacuccccuuucucccuuccucccacccuggcaaccucuauucugcuucucaucucuaugaauuugccuguucuagauaccuuuuaucaguggaauaauauacuauuuggccuuuugugucuggauuauuucacuuagcauaauguuuuuaagguccauccuuauuguaacaugugucagaauuucacuccuuuuugugguugcauaguguuuuauuaugucuauauaccacauuuuauuuauccauucuucuguugguagacacuuggguugcuuccuggcuacugugaauaaugcugcuaugaacauggauguauagcuauuuauucaauuuucugcuuucaauuccucucaguacauccuaggagguaugaagugguauaucaucauaguuuucauuugcauuucccuaguuacuaaugauauugagcaucuuuucaugguuuaauggccauuuguguaucuuuuuuugagaaauaucuauucaaguccuuuguacauuuuuagguuggguuguuuucuguuguuguuguuguugaauuguaauaguuauuuauguauucuggacauuaaucccuugucagagauaugauuugcaaauaucuucuccuguuuuguagauugucuuuucacuucguugauaguguccuuugauacacaaaacuuccuaauuuggaugaagucuaguuuaucauuuuuuuuaauugccugugcuuuuggagucauauccaugaaacuguugccgaauccugugucaugaagauuuuuauccaguguuuuuuucuaagaauuuuguagcuuuagcucuuaaguuuaggucuuugaucauuuugaguuaauuuuuguauaugauguaaguuaaggguucaccuucauuauuuugcauguggauauccaguuuuccaggcacuuuuguugaaaagauugucuuuuccccuuuuaacuuuguaaaaaaucgauugaccauauauguguggguuuauuucuaggcuuucuguucuauuccauuggucuauaugucuguccuuaggcuagugccacacugcuuugaugucuguaguuuuguauuaaguuucaaagucagaaaguaugacucuucucucuuuguucuuuuucaagauuguuuuggcuaucuggugcuccuugcaguuccacaugaauuugagaaucugcuuuuccauuucuguggaaagguuguuggaauuuugauagguauugcauugaaucuguagaucucuuuggguaguauugacaucuuaacagcauuaaaucuucuaauccaugaaccauaggauauguuuuuguuuaagucaucuuuaguuuuuuuugguuuuuuuuuuuuuuuuuuagcaauguuuuguaguuuuuagcguacaaggcuuuugucucuucgauuuauuccuaaguauuggauucuuuuagaggccauuguaaaggaauuauuuucuuaauuuauuuuggauuguucauugcugguggauagaaacacaccugauuuuugaacuuguacccugcaacuuugcugaguccuccccccaucuuuucuuuacauauaguuguagucaugaggcauguacauuuuuauuucugcuuuuauuacuuaacauuuuacauaucauuugcucauguaaccaccacucuguugaccuacuagacuggcuuaaguuucuguucuuaaaaauaaagccuuaaggugaacaucucuguacaucauuaaacuguauuuucaccuuuuuccucaugauagauuugcagguaugagauuauuagaucaaggggucugaacauuucuaaacuuuuugcugugcauugccauauuauuuuccagaaguguucuaccauuuuacacaggugucagcagauuacuuugguuuauaauuuuaaacuauacuugaaacuuaguagaaaauaguguuuuaguagaaaugguaacuuaguagaaaugguauuuuguucuuguuuuaauuugugguucuuuauuuccugaaguguuuugaacaguugugcuuuuguaugugugaauuaugcccauguaaaaauuuugucuguuugccucuugcaauuuuaauuuuuuuuuaauuuuugggaguguuuaauauuaguaaagauauugcuguuaacccuucuaucauauuugcuacaaauaagucuuuggcauuuguugucuuuccauuuuaguugcuuuuuuugacaugcagaaguuucuaauuuuuauguagucaaacucuuuguucuucuuugugauuucuuuaucucugaaagcauuuaaaauuacucuugcauaagcauuuaucaauguuaacagaaaucaaaacagaagauaaaaauguacccacaaucuucucaaugcaucaaauuaaaguguuuuucccccaggaucccugucagucuuuccugcguguacauaauuugagguaguuguuaucacagcauugacacuguucuguguucuaggcuuuucuguuuauuuuuccacuaaauguuaucaucugacagcauccuugauacaucauucccccagacucccuuuguguuucuuccugcuuuuuaaacacuuucuauuuccuucugucuguuuuagccagagcccucugucuggagcccaccagggacuccauugauccugccucccucccugugaauggguugaaugccaaucucaaggaauuucucugcuacugaguggacuuugacuagguguauuuuccauacuagcuuuguggcugacuaacugugugugcuugggcgacucacuccaucucucugagcugcuauuucuuccuuuguaaaaggggagcugaaaaguucagucucauagcguuuaauaugagggagcauuucacguggagccuggcacaccauggauauguaggaauaauagcuguaacauguggagaaccugcuguguacuuggcacuguacuagggguuucgcaugcauaguucguggaaucagucggauccuuacaguuuccuaagagguagguuuugugucuggcuugacuauugagaaaagugaggcuuaauaaauguuggcuguuuugaaucuacuaucccaaagguaaaauuuauuuauacucuauuuguuuauauaucuuuauauggauuauaaauucauauauauauguauauacacacacauacacauauauauuuaucugaaacuuuuuuugugugcuaacgaacgucagcuugcauacacagucagcacgucuaggcccagcaagcaccgcaacauacuguagcugccagggaagucuggaggagacagugggauggcagggacagcaguccuugaaugagcucuuggucagcuccugcccgcacuacagagcugugcagcugccgucucuggcuggagccccuuguacuccuagaccccagacaccaauccaguggcugcuaaacucuacuccccagggcuccauggagcugggucucccuuguacagccagaagccagggugcccuaauguguagcauguucagcguguugggaaggcuagcuucucuugagucugggaaagggccagacaccuggcccaacacacuguuauguucuauuacuauauauugcccaaaaggguuuggauaaagauaguugaauuuccaaaagcuuuauagguaaucucuggaauuccccaugcacguuccuacaacucugugucccucugagccucaggcucagggcguggaagcagagccaguguacauggcuuggucuuggcuccgucagcucugcggauggagccuucgugcuaagaauagauuuuucuccuacccaucucuuucuccuaugggagaggccuggacucuggacuccugcagaccagccacuuacucccuggcucccugggcgagucauagcuucucugaauaugguaccugaaccccugcccauggacuauugagaugguauggacaccaccaagcuuggugccugguacagagcaggucgcagagaagucugaguucuuuuccugccuuucccauuuucucuccuguguuucuuuucuucuuuucugucucucuuccucaguguuauuuuuuccuuuuccucuuuccuucccucuccucacuguuccuuccuuugugaauuauuuuucccucccucguucccucuccaagcucucuuuuguccuucuggguauugccuuucucaaggcaaagaccuaagccccgcuacuucugugggggcagugugucaugucugagcuacucuagaacugauugacaggugggucuguggcccucuuuggaaucuccuuacugaacugaaaucaucgugucacacugaccuuuggagcaaugaguggccccugagauuguuuaaguugcucuuuagggaacuucagcuuccucagaguuacgucucuugucuuuaaaaaagaaaaaaaucugauuuucuucaaggguuugcucccaaccaggccagggcagugggaugagguuuuaaaggccaguugaauuaagcuccucccaacugaggagcuuccugugcaguuggacaggagagccugaguaccuggaugauggcgaaggugagcuagggaauuugcuuugugucggaguuaaaggccagagcugaaguggcuccucagaguagcaaggggauucugaggaaggcaaguuugcuucuggcuggggagucaggaaugaggacuaacucuagaagggcaugugaugacuaagcaggggugagguucaaaauauggagcacaggccaggaacuggccacugggaaggggugccaucaucuguggcuguugugcugguauagacgacuggugguugcagcaguucccagggcuccucgugaguuccacacggcacuuuuacacauguuaaccgauucagucugggagacaacccugugaucuaggucaugccaucucauguuggacagggaaaugggggcugagugaggugaaaucgcauaaaccagcuguggaauggaaauuaguccuagguuucuagcuggaauccugccucaggcugccauugccugggugagguuugccuaggagaggaggggaaggaggugagggcaacagugugagcuuggguuuuaaaaaugcagauacccagggcuuuugcugagaugaaucaguguggggagacuggagcagaucccagagggccuuguguaccacccugggccaggacuucaucccaggacagucacagaguccugagaguggggaggggagagggccagcaccucagaguggugcugcuggaagguucucacagcuguggucugugcaugcacuuuggagagcaguugggaggccuggggugagaagagccugacccagaguggaagccauuaagaaugaaaaucaggauggauuggagcaagauccuaagaggagaaccaauuggaugcagugacugaugagagacaucagugaccaugcagucagagaggacuaauucagaggccagggcaaugccaucccauaucagaggccaggaauuagaggccaggaggcagccugauggcagauggcaggguagaacuagagugcugggaauggggcuuggcuggggaugcgguuugggagcggcccacaagggggcuguggcccucauggucaguaugcaggggaagaguuggccucucuggccacucuuuggggaggccugcagugggcgcaugagugaugaagaagggccucucggggacgugaaggauagucaagggccauggaaauaaagguaugggguugucagggaggagggaaggaugccacugcuggacagucaccuggucagaugccacagaggaaagcgauugcaagggaagagcacugaguugaccacugggagcugcucuugaccuucaggaacuucuuucucugccaugcuuccccgaacccuggcccccguuccucuuagugucacauggaauuggcacccuggucuggugccccagccccucacccccauugcucuugggagcccuuuguguauucauugugcacguuccguggagacuggcgcagaggaaguacuuaguaaauguccugcacuuaaaagggaaggagacagaagugaccuuguaagaaaaucagccauaagcucugauggguaaacagaagugggauuuguuuugaaauaugagaagaaggagaaauuggauguugauugaaaguggcagggugggggugucaagcaagagggcuuuugucccaagaggagagaaaucuggggcuguaggagucucuggaugugaguccagggaagagcuuggaggggcuggggagcggggccggggcugggguaucagcauggguuccuggaaggcccccauagaccuggcagcaagcuugggcucuucccuucaggugccucuucuugggcuggauccuucgccuggcuucuguuuggggcuauagugggggaaugugaggggauggccuagggucugaggaagauggaggcaguauuauucagagugagggacgugcaccacaugucacacaagauccaucugggacugugcuuggauguggcaaaauugcaaugaaaguuaaccuucuucaguuaucuuuaaaucucuuuuauuaagucagaaaaaaugucucaaauugguacuguugugucuuaaagauuucccuaacuuuuuaaccaggcucagugccuucagcagguaauaguaucuagcuagaauuuaauagcucuauuuuguuuucuuuguguuuauuuuuguagcuacaguaguagaagauuucuuguccccugagauuggacugugguugguuaaucaaaaaagucccuugaagcagagaaucauaaaaaaugacacauucaugccuuaaacauaauauuuuaacuuaaaacauauacgugcauauuuauuuaauaaaaucaacaauaaaagcuguuacagaagaaauacaacauucgcagcaucaugccucccuuuccucaucagcaccaagacacuggcagccgggccaggcuggucuggggcuucuuggcugcauguggauuugaguucugaauucgggccugacuccacuucuucaggcugugcuuuugaagaauguuugguuuuugugucauuuauaauuucaguuuuccaugcaugaucacuuauaaucuauauguuaucuuuaauucauuuggucugaauacaguuaaguaagcuauauucuguauguucuucuuggucaguauguauguauguauuuuugagacagagucucacuuuguugcccagucuggaucucacuauaaccuugaacuccugggcucaagcaauccuucugcuucagccucuuaagaagcugggacuacaggcaugugcuaccacaucuggcuaauuuuuaacacuuguuuuauagauggguucucucuguguugcccaggcugguauagaacuccuggccucaagugauccuccugccucugccucccaaagugcugguauuacaggugugagccaccaugccuggcccagaauuuauguuuuugaaagcucuagaguuugcugauuuggcaauaaggaaaaguuguagcguguaggcuccaguugcaucacugugggcagcaacugugaucauucuggcuuuuucuauccaaguguggcauacuuuucuuugcauaugauuguuucucuuggucacaucuucuaaguuuuugcgguuuucucaguguuguggaggugcucucuaguaagauuucccagagaaagccucagugacugacuuuaauucuguugugaguauuugaacagcaguuucuuucucuuugcucagaugcucuccagaggggcuccacggcuuuguuccaccugccacuugcugggauauguucugcccagcucgucuuuucuuccaggaugagcccacuaacuagagcuccaagucaccuuucaucuauaaaccacucccgaaugcagugcacugcccacaauuucagugaagcaagucugaguacaggauuuuucuguuuucacacaaccucccugcaggucuuuuaugguuuucuuauccacaccuaguuuaacaccagauuuuaaggagauuugucuuuaucacaccuuuccagagcauucaauuuaguuuucauagaaacagcuauuuucacacuguuguuucauaauacuaaauuaaauuauguuguuacagugaagcuuauaacgggcauuaccaacuuuacagcauaaccagguucagcauaaaggucaggaggcaaaagugcaggaaguacucaccucuugagcguggccugugcgcgucaagcuguccccccccagcauggagguuuggcaugcuaggagccaggagcagguuuugcagagggagugcagagcguugccucauggauguccuuaaagugaccaguggugggagggcuucuacucuaccuuuuauuuguggaauguggugguuuuccauuuagauaguggcaugaaauugcguuuuaaaauaaauauauuuaaguaagaacauuaauucuuuuaaggaaaauaaaugagcaaauagcuuagauggcacacaaauuugacaaagcuugugaagaggaugugggacaauuggucuaugugcaggucaacccugagagaggaggaggaagggagggagcagagcgaccuugauguuuugucauccccucuuugugcccaggcuggcacugggcucaaucuucugcuuuuguguuuugaaagaccauugaugccaucuuccaggucagugucccuggggaguggaugcuggaggucauucuggggaucccagcaccgugggaaggacagggcucuggaauagggcuuuugggaccagagugcugagcucuggauuccuccuugcuucugcuauuugcuucaccugcgacccuuuagcaaucauuugaccucucugugccucaguuuccucaucucuaaaaugauaauauaauaccugacaucauugcugugaggauuaaauggagucaugugaaagcaucuagccaggugcugugugcauggugggugcuucaccaauauuuggagaaugaaugugugacucugaauaugggaaugaugacagaaguucuuccuaccuuagaggguuguuaagaauucaauaaauuuaugucugcaauuugaaagugauagcaaacugucauaguauuggguacuauaauuauagcuaucauaucguuuuuucguugguuugagaacuaaaauuacauauauuuaauguauguaauuaagggcaaggguuuuauuaaucuggcuacaggacuuaaauauauguucccugauccuugaagaucagcugcuuuccaaauucucauauggauuugagaagggacacaugccccugccuccaaccuaggcugauggaggauuguucucaugauagucucagguuuaaaguaaacucagaguuggcuuuaaaucacagccccaccacucauuagccuguggccuggaacaagcuaccaaagcuagccaaacuuuuaggacccucuucuaugaaauagggggaggaagaauaauacccaccuuucaggauugugaugagaagauggggauuggaaagcuucuagcacaauugcuuguaccauuggugcucgguaaaagguccugucucuuucugccacucccacuguguugcaugcuagacuauauacagagaagcacuuagagcaagccucagugucaggaagguaaggguggcucuuccuggcggaaacaaacuccagaacuagaagugcuacagaaaugucuccugaaaauacauuggguauacaaacaauuggaagugguucaauauuguauggcuuacuuauuaaggcaaugcaauacaaauuaaaaugaaguauauauuaaaaauaauuuuuaaaagacuauuuuguuaugugugcagugaaauaggcaucuuagauguccauugugguaguggaaaagguagcauaccuuucaaucuauuuucucuguaauugagauagaauucacauacuaugaaauucauacuuucaauguggaaagaauuguacagccaucaccacuaucuaauuccagaacauuuucauuaccccaacaggaaauuguauucauuaagcccuuugcuccucauucucugugcgccaccagccugggaacuacuaaucuccuuucuguuuuauggacuuaccuauucugguauuucauauaaauggaauugcacaauaugcaaccuuuugugucugacuucuuucaccuagcacaguguuuuugugguucauccacacugaaguauguauugaugcuucaugucuuuuuaugucaugucuuuuuaugucacaacagaauaauauucuguuguguauauauacacaacauaguuuguguauccauucaucuauugauagacauuugagauguuucuacuuuuuggcuauugugaauagugcuacucuggacauguauggauauguacuucuuugaguauuuguuuucuguucuuuuuggauauauaucuaggaguggaauagcuggaucauguggugaucccauguuucccuucauuuuuguaacauuuuuuacugcauauaaaauucuugguugguagauuuuuuuuauuuuuauuuuuaacuuucacuucuuugaauauauuauccugauaccuucuggccuccacgauuucuccugagaaaccagcugcaaaucuuauuauggauuccuuguacaugaguucagucgcuucuuucuugauggcuucaagauucucuuugucuuuggccuucaacaguuagauuguaaugugccaggugugggugucuuugaguuuauccuauuuagaguuuauugagauucuugaaaguguagauauuuuccaugaaauuugagaaguuuuuggcuauuaaauaucacagcuucccucaggcagcugugauguuaaacaauugccucugauuauuuucaacaaacucccccagggaaaaggcuauuugcacuaagcaagcuccaaggcaggucaaauaaauauagcauugugaguagggccuuccagggagccaccagacuggaaaaucaugaucguucucuggaagaagggcuuugaaggagcucaaacccauucugccccuuucagugccuggcaugcuacugguuuucaccaugauugguuuucaggacagcugcagaguuagcauaggaagagggcaaguuaaaacaucaaaagcucacuugguuuuacugagacucuucuugaauaaacacuccacagauugcucaagccuuugguuaauuuccagaguucugaacaaguugauucugaucauuuuugccaguguucuuuguuuccauggaagagggcuuuucagauguccuugcuguaucauuuugcugaucuauuagugaguauucacucuuagauguguaccccacgaauucaucccacagccaaggcaaaaaaaaaaaaaaaacauucaugcccgcugacauguuuaucacaguguaauuuauaauagugaaaaauuugaaauaucacaaauaaguaauggaggaaagcauguacaagcauguaaauucugggucguaccauuguccaggugucaacaaugaaagaacaggcccagguggagagaagugugacaaagagacugagagcccuggcuucagacucagaugggcuggguucaaauguggcucuaagguuuauagccaacaacuuggagcaaaucaguuagacucccuaagccucauuuucucaucuauaagauggcaacaacuccaucauguguuguagaugcuuucauuuaaaccucacauuauaggcuuggcucagccauguaaguuguuauuguuguugcugucauucaacagaaaguucuuugugauauaaugguaaauaaauuagcaggauaugaaaucguauacauacuauaaccaaaaucugaaaaaaagaaucccuuggcaaagcaugggaaaaccaugguuggaagaaaauacaccaaaugaugggauuauggguuauuuauuuucucuuucccucuuuuuuuuuuuuuuuuuuuugcccuaacaauguuccuuuuuuuaaaugggaaagauaaauguccacacagaauaaguaugucuucuuaaagaugcgggggcuuugcuaguagaguuuaggcaagaaugcucugcauuagaaacugagauuguagaggcgugcuuccagguacaucugcagauacuuuuuggucacuauuauuucuugcaucucuucagaaggcugagauguauuuauuggucuucuucaaggaggucuuuuauucagaagccuaggggccaggaucacugcugccuccuuagggagugcucugaaaguggagguuaauaucuaagagagcccuuuaaaauucugauguccaaugcagggacauuucccccagacggggaaauuuggggccuccauugcaucaugugccaugugcuaguacaguggugcugucuucuaggcuugguugauguggggagagaagaggaugcucacugcacuugguacugugccaggugcuucauggacgugcuuuguguccauguugcugaucucuguaacugugaugggacuuauuuuccauuucagguuccgaggugcaccgauuauacccguggcggccaagccggggggaccagaggcccccgaaacugaagcuccacagggcauuccagagcucauugagguacugucaucuugaauccagguugcccuuuagccccagcgcugcucaggccagccccuuugugucccucucuccccugagagagaaagagaggcagcccuagcaagaggacucaguugguuccauuaaccucccuguuaacaccuuagcacaacucccccaccucccucaaaaagguagacccaaacuaggacuccuaagguucacugaagcccaugauucacccuccagccauaaacucugcagagcucgucacaccuugcugugccucacuuucuccuuucucuugucauaccuacacucagacaaagcagcucccacccaucuggaacccugggaccgugacauccauuccaguccuucagacuguaucagcuccuccaguaccccaccugggcugggggccagugaggcaggggugaaagacaugagcccaacagcaggggcaaugcagcuuccauccugggcaccuccaccaaagaugggaggcuuaucuucggaagcuguggggcugaggcccagguuguucuuccuaacuugugcugguagucagggagggagcccagucauccaucaggaagggugugugugggugcugauggugcugguacuaaggaagguagcagugagaauggagccacagaguuccuccacagagugcucaggacaguucagccggguggaguagcaacgugcauggcucuggggcuggacugugguucaggggcuagcuccaccaccacucucucugaccucaggcaaaugaucuacucuuucuugccucaguuccuucacuuggaagauaauagcacauaccucguggaguugugaggguuaaaugaguuaauguguauaaugugcucgguacagugccaugucagugcuuacuguuacagugauguugauguuuacaggccaggcacuguacuaaguucuuuacauacaggaucauugacauucacaaaaacucagggaggcugaaauuauuuauccccauauaccaacgaagagucugagauucaaagauguuaaauaacuugacccaugucuggcagcgaguuacacgguggagcugggauucagacccagguugaucgcuggggucagcuucacggccccccugcaccuggcuccgcagagccaagaugagaugugaccacguacaugcacugccaccauuucugugauuuacacgugcugaucuugucagcuuagcaaaacaaauguuuucugggugaggcuuuuguuacuuuuucaucaggcuccugagagcacuugucugggagccugggauaguuguuuuuguuaaagcgaaauccucaaaaaugcugcuuugaaagauguuuguauauuccuuuaagaagccccuacauaaaucucagaccaagccuguuuuguuugaaucucuaguguuuuuccaaaagaauuguuaucacaagacuaagacuuuggaacauucaccacugaauacuuuuuugacagccuguucccuuacgaagugaaaaaguagcaaacacaaggaauccuagucuuuguuuucauuuguuuauuggugaugagcccugacagcaucucccggcacacagguggcaugaggagaaucggcuggugaggcugaggcguguggaguccgcagagaaggaaggacccugggaacaauccuuuccuccucccucuccccacauccccuuguuucuucuucuuucacuugucauucucucaggcaugaugccagcuacuggagauaccuggcucucacagcccuaugggggagauaauaaagagaugaucacaggagaguguuagcuauagugaugggggcaggggaaacguggccauacagagaagccuguccagaggagguauugcugcaguacaggcgaggcucagccagcugguaaaacucuaggccugcuggcggcuggcuucuggcauacgucagggaguggcggaagaugaggccuaaaagguaccuaggggcuagaugaugaggaguuuuaaauucugaaggcaucaggaggcuggggaaaugcaugaggccagggagcaaugcgacaggguguccuuuaguggcuacucuccugcagcauggagggccuggcaggacagaccauuguagcagucccacgggagaagacagacgaggcuucuccaggugcccuuuccuucagacugagcggaaagagcugagagcauggcagaagcuuggaaugcagucagggaguuaggugguuuugaucuccuguccaccuugccagggcauggaccucugagcugaguucaccuuggcagccuugaugaacugcuggucagccacauucucugccuuccucugcccugccccaucuggcuccucuccccacggacuguggcaccaguuucucuuuucuagcuccugacgucccagauuuccaucccaacgagagaucccucgggaccguuccucaugucuguggaccacuguuucuccaucaaaggccaaggcacugugaugacagggaccauccuuucaggcuccaucagccucggugacaguguggagaucccugcccucaaggucagucuuaccuugucuucccuucuggccuccucgcuggcagcaagggagggggacugucccuuugucuguucagcugcugagccugcugcugugccugcccugggacucccacugccugcuccgccccaccuccccucuggcugccuggccccgcccggcuccaagucuuucaacucagauucuaggacugcugcucucccuaauucucauagcgccuguuuauuggaggccuaugaugugccucaaggagguguucccaaguaggucuucuguguagauaaagaaacugaggcuccagaaggugaggugggcuugagaucacaugguuaacaaguggggcugcuggaggggaaaccucccuuucuggacgcuguacgucaggguggcaaguauguguggaguuauuucuggguaccuuuuucuuaaccacaguaauuucaaauuaaacaugacgugaaucuuaugaugcucagaaucacagaaucuggaagaaauccagguugguuuugcacuccugguggccaucgacagaugccgcauuauucuucugaagaccugugagaaggaugagugguuggugccuucccaucaccccuccuucuacuaugauggccuggcucugauuuaaaagauagugccuugauauuccccuuauuuagaaggcauuuuuaauaguuuuacuuuaugcgacaagagaaacuuacagccucauugacugcccuccccuucaacaagaauaaaagguagggaacacaugcuacuuagaauucaugugagaccuugccuggaaugcugggguccagggcaguucucuaauccuugaaggagccuacagugcagggaaguggaggugcucagcccuguggacucagcuagcugcuagagaggcuuggaugugcaugauuucaauuugcauguuaauugggaauggcuaccuggaggcuguauugaggcauuuuaagguugucuggcucacuagguguguugguuaagguucuccggagaaacagaaccaaugggagauacagauaucuagguaucuauagauacauagguaaagauacauagauguaaauauguagauaucuguaucuccuauuaguuuuguuuugcuggagaacaccaacuaaugcaccuaguauuagaugcagauagauaaauagauacguuuuuuaaggaauuugcuuauacuauuauaaaaccuggcaaguccaaaaucuacaggguaggcuggcaggauugaggccuagggaggagcugcagcuugaaggccauuugcuggcagaauccccucuucucugaggagguuaauccuuuuguucuuaaggccuucaacugauuggaugaagcccaccuacauuauaggggucaucugcuuuacucaacauccaccaauuuaaauguuaaucucaucugaaaacaccuucacagaaacacucagaauaaaguuggagcacuguggcccagcuaaguugacacauaaaaugaaccacaucacccgcugggugagagggccaugauagcagcaccuggccugagugagggaaguggagagggucccuacuggcacccaugucuugcgugugccaucccucaucuagagcagcaugguuggauauagggaaggggcauuucauggagggcaggcaugaacaggguucccccaaaugaaggcaaccugagguuucaaccccccagcucauuuuacagcagugugucuauuacuuccuucugcaggggccagggguauuagggaagagucuccugaccagaaaggacaaaacaaaagaaaggacuuggcucuggccagguuccagagcuccuuggaucuagugggaggagucgaauggcagggccccaccauauccaaggagcccuggaaccuggccagagcuggguguuaggaugucccccagacacugugagucacaguccccuccuuuaccugcugucauguccuccucugaagaccauuggucccagaaaaagaccacuugaauaaaaucuaguuuaagccagggacuaaaagugcaaaucuucaaaaauaaagcacaaaaguguaaaaguagauucaguuuauauuuaacaaaauuaagauuacuuuggugacuguuugcagauucuuugcuagaacagaaaaugaaucaguacuaaauuucuuuccagucucugugcuuccuaagucagaccucugggggccacucugaccuggcaucccuuccacucugggagaagacaugcuugcagcuugggagaggaccugggaguaugaaagaggugucaaaagagggcucucuggggggugggguagacuuugaauuggggguaccugagguucuagagggagaaaaagguuuuugauaagagucaguggcugcaauguuagggcugagggcauggagaagggcugaggcagagaagucaguagugguaaggaggcagggauguucgagugggguccuguucugagcuuuuuggccacccucuuuguccuuauaaagguggaacuugccuaucaggaugccaguuacugaucuuuaguacuugggcacauggcaggugcuuggcagauacaaauuuaauucuccuuuuacuuuugugcaccuguuuuuccccagccuacuuuuuaacacuuuuggugucuacugccugaugaucuaauuuacuagucaggaaaagcagaacuuguaagcaauguacugagacauuugguuaaggagauuucuaagcaaacugugaaagaugcugccuuguuucuccauugaugcuuauaguaaaacaugagggaaaaggaaugaauugaggaaggaacuguuagcaaacagaaaucagcgcuugaugauuucggagguucucagucccucuagauugcaaaggauguuaagauuaggaaauucacugcugagaaagcauaccuuggagagaaggccaaaggugagccuggacaaccuucuguugaagagaggaggugugugacucacagauccaagcaacuuagcagcaaccagaaauagagauggacuucuauagcaaaguuaugcggagagccgucuuggcuaauggcauggaccccuugauguauauaagagacccucaaggguuuugagaauguuauaccagcaagaacacuggacugaaagggagagagacuugacaaaugaauaaaaagcugucagacuucugggauucuacagacaagaaacaggcugauagaacaacucagcuacaaacacauguuauccuucaaaaacuaaaaaaggaagaaugacucugagagcagggcucuggaaacagaagugaggcuaggggaguagccacagaggucagucucagguauugaaaccucauggaauuugcccugcuguguuuuaaacuugcuugggaccaaugaaccuuguauuuuuuccaccgucucccuuuuggaauguuagaaguagguaaauuguuuucuagguccacagauggagaggcauuuugccccaggauagaccauaucuagagucucaccccuaccugauuaggugacuuacaugaugacauuaggaacuuuuugagcugaugauaauuuagaugagauuuuggacuuagaguuaauggccuaauggacugagaguuugggggauguuugaagaggugaauguauuuugcaugugggauggauguaaauuuuggguaccagaggguagacuauaguagguuaaauuauggucccccaaaauaugucuaccagaaccucagaauaugaccauuuuggaauaagggucuugcagauguaauuaagguaaggaucuuaagaagaaaucauccuggauuagggugggccuuagguccaaugaccaguguccuuauaagagacagacaaggagaagacacggagagucacagagagaaguccauauaaagacuaaggcagagauuggagcucuguuguuccaagccaaggggugcccaugguugccggaagcccccagaagccaggagagaggcauggagaugagucugccucggugccuccaugggaaccaucccugcugacacgucgauuuggacuucuggcuccagaacugugagagaagaaauauuuuguuguuuuaagauaucaaauuugugguaauuuguuauggcagcccuaagaaacuuaugaauuuugcauggaaaggacugaaaucagaaaaagccuuaaguucuuucugauccugucaggucccuuaacucugagcuuuggcuuccucgcagggagucgcugccccugcucaccaucuugggcuucugggggcaacaugucagaaccauugcauacugauggccagcacugcccguuccuuucuuuccuggcaugcccaucccacaagugagagaaccuagacccgggaaacuuaagcaacuggacagcagagcugggacuugaagucauucauccagcuccaaagacccagcccuggccaugugcccugcugucacgggagccccagaggagaugccugggcugguaguggugccucuacuccagggcagggccugcaggccccauggcaguucuguggccaugcugcugugcuuugcugaggccuugccugggcugcggcauguacgagagcccauugcagcagagccugagguucagaacuccugaccuccucucaccccugcccucuuccagccaugauugguggccagugccuauugggcaccgggacauggggggccauggcccucuuuccaaacacagugacaucccugucagauuucacuaauagacuuggacacaucugaccgcuugaacucccuuggaggcagggcacagccauuccaaauaaacagucacauuccccucccagucugggcuggccugcggagccugccauacccuggcccccguuucuguugcccaggucuguucccagcuggggccaauuagcugagcaagaaaauguuggggaacagggagugaaggagaaaaaaauuccauuuagucccuagaacaguuuaaaggccacuuauccuaagaaucaccagcuuucugcugaggcauuuugacucucucgaucuucagccugagaaaucccucugauaagauuugaucuucgggguucaggcuagugauguuucuggugaugauuggcuaucaggguuguaacaucagaaacuguugaagccacagaccauggggaaagagagcaggggcugggagugcagagggacucaaggcaggcauguaccagcucuguguccacaggcaagucagucaaccucuucguguuucacugguucagcucaaacuugggaugaccacugugugcuuggcucuguccaggaccucuggaagaugggucaggguggugugguguggacuagggauaauguauauaagguuccuggcaucuaggagauacaagcuuuagcugauacucuugucauguuuauuguugccauuugauauuauucucauguagaauuuuuguuguggguuccggaaguaguaagugucagggcaccuuccuggguguaagguccuguucagggcuacuaagugaguuauugaaaugcaaauaugcuuugcggaccccacuauguggaccccacuaugguccacuaugaauccaaucaauguucugauaaugaugacaaacauuauuagauauauuuggauaccuauuuaguugauaaagcuuuuagggaagaguucagaauuugauaacauaguccucccaaaucaagucuauauucagauugauuuucuucuucauugaaaaccccccagaaagggaaaagaaaaccuuaaauacugguagguguuuuuacuuuuaccuuugccucugcucuuugaagcuaaucacaagggugagauaagauuaugacaucuggaaagaauccauuuucuugcccaaacaagccugcagucuugacucuuccagaucugcccuucccccaccuccagcaacgcugugcacuccccuucccagaggaaugcugcauugcuucucuccuuggagcccuuccgggcuuuccccuaccugcaguaugcucacuuuccagcacagcucagggcucacauccuuuggguagaggugugccccguccucugugcugccugcugcuuguauuugucuuugugccugcaucuccuguggacccuggucucccugggggcagaagcugagucuccuccaucuuuguauucucggcauccauccugggcucggcccagaaaauauuuggugaaaggaauaauaggaaaaagccaauaaaggaaauaaacaaguuguuuuucaguaggauuuugauuggaaauagguaaugagugaccugagagggcuguguuuggagucacugccacccuggggccauuuacagaaacccagagcugggcagccccccacuuccugcuggggcugugccccugucuucaaggcugcauccugaugcuccaucaguaagcagcaguggagaugcucccugugucccugugcugccucauucugggagcagugacugugaaucaggugcccgaggcugcagagcuggcuuuccaacaccuguggauaucggcucucaaggcugagcucccucugcugccauguguuuuuaucuagaaaauauugagugaccuucauccugaacuauuuucuguuccagaagauacauaaaggaaggcaguuucugugcauuugauguuucaugguugucuggcuuuuggcaguggaagcuuacgggauucugcucucugugcccauguguggugcaccagaugcacaggguuggagcucccugggaaggagagaaggcagagaaggaaaccaggaagguuuugggaaagccagaggaagccaugcuaggcccuuugagcagaucagcccacccuugguugucgcccucaggagggaccucgcagaucaggcccuuccucugcagcaccauggccacugcucagguucaaacucccgggcccugcagggccgcuucuguggcaugcugcuccuccccuugccucccaggucuucuucuugaguccagcccagcccugcugacagaaaagccuuauugcuguccugcucaucugucuguggguccucauugucuccaggauaaaaucuaaagugcauggcacggaaggcagagcauagcucuucauuaucaccucuccagccucaguuucuugucuuaaagccucauaagaccucccacugcucucuguguaucaggcaguacucugguuucaaaggacagaaacccaacuucaauugccuuaagcaggauaggaaacagauaggcucagggcuggagacgucuggaugucaucaggagugcuggcuggcuccagaacuggcucugcccugucgugugugggccacacacucagguggcaccuucccuggcauaauccccacagcucuggcuuuccauuuucuccuucaaauccaagaugcagugcuacuugugguugacuccugaacaucacgcuaucgaaggauccguccugacaguggaacaccccuccccuggcagcggcuuguuaccugacucuggccaaugauaugugaagggacauguccuagggguuuggggaaaagcuuuucugcuuuuuggaacucaacaggaaaagacagcuuuucuccuucacuggacauugaagggaggaaggaugugacgccuggacucaggggcugaacggccaccuuacucccaggcuggagguuugcagaggcugggaggcaggagaguugcccagaagcagagccugcaccugagggcugcugugugucugccccgccucagaacuucguguauugugagagcucugucuccacacgguuccagucagggcuaucuguuacuuuuggaccaaaguaucauuuaugauaugagagcaaaauggcaucucuuuccuagcuguuaggaacacaauuaaggaacaggcugcuccuggccugguuggacgggagcucaucccuguggaugaguacagugcucuaauugggcuggcuggguuacauguccaccccuggagcuggaagggacaaggugggagggaugguucacuaagaaauuuggguuacuccuaggaaaugcagaauagacaucaggcaggcaaaacugagagguauccacuggcuuggugcuucccaguguccacaccaucacagcucaggugcuggacacagauggacuauguuugaguccugccccaucacucacggggcaguuaccuccccuggcuuccuccagagguugucaugaggauuugacaagagccacguagcgugcuugcagcagggcuugacguaagccucacugucuuuaucaccacccuguacaacucugcaucuugucuuuucuuuaaugggccuuuuuacuuggcccauggagugcagagacuuggggugggguggucugagcucugcauuuccugccugcacccaggaccccaagagccucugugaggucuugccuuucuccuggcuugaggauuugaaucacaccugcagccaaguuguaauauccuguugucucccuaaggaggcacagcugaggaaggacagucgccaggcaaagauggaagguugaccucacaggaggcagggaacucaggaagacuucucucugcaggugcuguugucagagaucaaugcucaguguccuaaagcucuggcagguuggaggaugcugccccugcaggccuuuuuccuguggaagcuuggagcuuguucuuaacccccaaaccccaagugaauggcaugcccuuuuccaucaggccccugagaaucuguugcagcuagacgaacugcuaccagcaugugcuuccagaagcggaugacuggcuggaguccugaccugcagucagcuguccaggcagaggguacagccagguucuugugcugagagcggccuggaccugugacagugggucugucugcgcuccugauaggccuaagcauuucacacagucuucugcaaggauggcacuggguggcccaggcaugguuggagcaggggagaaaugguggcuuuaacccaaguggugucuuccuaaggaaggggacaggcaggaguggugcugccccacugcugaggugggcccccuuuauagagaugccagcucagucuggucgugcuugguguguuucaagccugguguaagcaucuagagucccacuugggcccagguugaccugcagccucccaacccuuugauggggcucuagugcccaagaccacaaaucaagcccugccccagcccaaccaggcuccucaacugcagcuuccugcucuuaggccagguggaugucuuaggauucagccucuccccugcucaccccaaagccugagugcagccaccacucaagcauacccugcccuuuccagcugaggggcaguguuacaaagaagugacagcagggcuucgagagcaacugggcuuggguuuguaccuaugugcuggcccugugagcucaagugaguucccugaguacacugagcuucagcguccuugucuaucagugggguugaccaugcugccuuccuccgagucgcagcaaagaggaggaggaaaggggcaagcugcucuagagcacgcacgcaugugggcgcagucaccacaggaagccucagccccugcacccucuacauggagcccuggcagucaggcagcacucagugguugcugggggagcagauguggaggugccaaauguggcgcggguagggaguguggcuggccucuggacauccccuguagaagccacauguugagggagccuaggucggugugggcccuggcccaggguggccuugggacacucccagggcagcuguagcacccuacaaguugucguaugaaaaccacucuaacuuauacgugcuuuuggguggaauuaaaugaguuuuauuguuucuaggacaagauagggauuugauuagaaacaacauuuauggaaugccagggcugguucccauccacugugcccugcaggaacacagagucuugggucccaggcauaaacggccagcugugugacuggggcaagacacgccccucuguauggccaggccaccuucuuaaauaaguaagaacagccuucaggugggaaugguucuucccaagggccauuugcuuucacaaucuuguuuaccuucaguggucaguuaaguuucaaggggaaacugugacucaggccaguggaauugucagaugcagaagcaaggggugagauggaugcgggcuugcugggcuuaccgaaacuuguaugccuguaggccucugggggugcagucauuuccucccucuagcugugggcugcggugccuuuggaauaggaugcgcaugucaucgaggggucuagcagugaccugaggacuggcaggaccucgauacuggggcccaaagcgguuuccucuccugggaaaugggugcccagccagugucagagccccagcugggaguggccuuggugcagaaaaugcuguguaaauggcaauugacagugccagguugugcccaaugcaagcaugggugcugccugguccacaaaggaguaucugaucuuugacugucugaagaccacugccuuucuagguuggaagcaagcucugauucagaugaaaguguggccaugcagggcugugugaccucagcuugcacacccaugaagccagcccugcccacaaccuuuccagauacuguugaugcgugucaugucggggacuggagucccugacagguaucagagcccaagcuggcccugggggagcccucaguggggcugggguggucaggcaggcagcuguuucuucauauggggaaggcacugagugaacauggcuuccagaguguggugggggcacuggaagggcuccaacccugcuucccaggcaaggcgacugaagcugagucucagagaaggcagagggcuuugcccaggcauucugagcagaaggaacaguaugugcuaaagcccagaggcgagagagugucuggcaugacugagguaaacauggagcuccuugcagagagucugagaaguggggugguucguaggugguuguggucaucucugaaagggcaguagggaggauguuuggaaggccgagucuagaagauguuccagcuggagucggguccuguaggccacgccuugugauggggaagcacagcugcacccuggaaucaggcaagagagccccuccaggggcccacagggucucgaggcuccugggugccgcugcuccccacuccgcccccucaugcccugccagccuguaagucccaggacccugugcuuucacuccagcuuuuccccaggccccuucuuggcccuccucacccuccugggcucagucccaggaucagccuccugcacagggugggaauaaauccuguaggcagccucugcccuugacaguggaagucagggcugccuagcagggucuaauucauuauuucucacacucagcuggggguuagggcggguugcuugagauucuuguuaaacauucuugguccaccccgggucccugaauuccagucagcaggaaccaaggaauuaacauuugugaccaucaaaucauccaaagggacucccuuuauuggcaguuugaggaaaccaugggccagagguuggacucugaaguuagacaaaccuggcucacguccugccccugauuugucacauacugugcagccugggugacuuaaccucucugagccucagcuuccuuauccgcaaaacauggaaauguuaauaacagagccugcuuuguagaguuacugugggaaggaaaagaaaauaaugauuuuacaucaguguccaacauauucauucagcgcauagucuugagcaccuacuaugagccagaugcuaggcuaggucauaggaguagagggugaguaaggcaggucccauuucuguucuuacaguucaccuucuaccaguagggguaugaguugguaaaucaccuuauuuaccuuacagugaggcgauugagaaugggagggguucuguaggccaagagagcucucuuggagguggagauaugaauaucuugagcaaugaagggguacagccauucagaggccugggagaagagugugggaaugcugggcacauucugccaccaggagggaaggggagacgcugugggacaggcaggaggucagcagggcuggaggccagggcaugcauccaggcuaagcacagcaaguacuggggagccuggccucccaaccucuucuugaggaagcagacccuucugggcagagcggcucugccugcccccucucacccucuggccuggcaccucagggagggcagaccacaccugcagucugugucgggccccucacugcccuggcaucacucuggggcucugcugggacuuucuuguuuguuuuaaaggaaaguugaguguuuccugagugugcguaaagccaauguacuacuuaaacugaguauuuauaauucuuucuuuuaagaaauaaaacaauaauaaaauaccauaaaccuugcuuuaauuauucacaggugucaacuuguaaucaucauggggaaagggccaaugagaugccuuauuuaaaaaaggcacuugccugcuuuucuuugaaguuuugcuaaaaugcuucauuauaacauguucuuguuuauaaauaaauuccagccuuucaaaguuuggguguuuuuuguuuuuguuuuuguuuuugugugcguguuuuaaaaguauuuaaaugagaugauucuagaugagggugauugauucacagagugagccagccagagcugucugugagugacagcuguggcuccccugcccuccuggggcagcauagcuaccuuagcuugcugucagcugugguguuugugaagcuauccauuguggauguguagauuagggugaaucccgauuugugugcucgcauuugccuaccugcuggacuuacugccuggcagacagcucugcacgugagcacaugugcacauauggccugagauggggccuucccaggacaggggagaguucucugagggcagauagcaagggaaccaaccugggcugaagucaggggaggcuucucagguccgaaggaggaggaagacuuacuaggagaagaugagcaagguguggguagagaggauucugggcaaaugcaaaggccccauggugggagagagccuaauguguuugaaaaccuaaaaggaaggcauuuggcaucuggacuggagcccagagacaaauguggggugagaggugcuguagagguaaguggcaccagaccaugcaaggccaguucaaguucugucuauucuuaugacgcagcugguuuugcagggugggugauguagugugugugcaauuuauuuguguguuugagggaaagacagaugguuuggagaacagauuugaggggagccaggaccuuucuggggacuaguggggaggcuguugccauaguccaggcagauugagguggcuuggaucaagcuggcagcaauccaaugggcauuaaaggcauucaggagauggaauuaacaaggcuuugugauggacuagauauagggacagugaaggggagaggcauauuaccgauggaccccagaucucuggcuucagugacaggccagguggaggagccguuggugagagagaauccagaacaaucuggaggggagagugaacagagccaggaguauggcuugggcuucacuaaguuggggacguuuggggaacccacuuggaaaggucuaggaagcaagcugacauaagugucugaagcucagagaaguuugggauaggacauauauuuaugugcuguugguggcuccaaccuugguaguuggggccucuggcuagaaaagaaaaguuaaaaagcaagcuucagcuguuucaucuaaaguuauaauuccgaugcuuuaaaggcucccaacccucuucuuguucauggugggggagccuuccuaguugugaaagggucugaguggcuccagcuuuggcauauuagggugcaggggaggguauuucuagggacacucugggagaagcugcccagccugcauggugcuagugccagucugcaaaaucuccagguaauagagagggcaggccccugcccacccccuugcagccuccaaugcugcugcuguggcagcugcugcugcgaaacaaaccagggugacugggcggaaggucaggaguuuaagagcuuguuugauucaaaacuaggcuaaaagacaggaggggagugagcugguuuucuguguggauccugguauuuuccuuugaguuggggaggagaaugguggggcagggagggaaggccggccgccagagggaacgcugccaagcagagcgcagcuaaugugaaccauacggcggcggcguugggcaguggcggccaucucccgcccagcuuaguacagcccuuacugcgggcaggggugcagacaggcaggaaggcagcucgggcugugcggccacuuaacccuuccagugcugaacuacaagcagggcuccuucaccucagcacauugauguuucagccaauaauccucuguccugggcacuguagaugucuagcagcaucccuggccucuacccacuagaugccaauagcacccucucccagcugugaugaccacaagugucugcagacauucuaaaugccuccuggggggaaauuaucccuggcggagaaccaguggccuagaacaggcggcccccucagcugcugggccugccuggacucugaugggccugcacccuucaggggcccugccccagacacaccacauccauguuuggagugcugccuggggcugagcaugugggggucguuuucccaugaagcaggcagccauagggucagaggggagacgagaccuacccagaguuguaugccaguaggagccaggguccaggauugguguugcuccacacauucccugucccccugcucccaggcauggcccccauucaguuucugugguuuuaagugggaggugugcagccugccccugacuggcuuccuggggggacuaauuccuaugccagccuucucugccuauucaacaugcaguugcccaagggaacauggcacggguguuuaccacacuguucuuauaccaagagucagugcacacgagcucaguguccagcggugggucugguucucuaaaccgugcgauaccacgugcccaucgaacacgauggugcagaucuauguggaaagaccaccauuagaaucaucagauccgcgaggacagagacuuuugucagucauguuccugggcccuuaauaaauguccugugaauaaauaaaaugcuaauugcaaaaccaaaucucaauauguaugauuuggucccauuauguaggaaaacugucugcauauguuuguauacaaaugcaucaaaaaaucuggaaggagacagcaaacugagaacaguggcugcaucuuggaggagugagggaaaguggaauuuagagggcugaaagagagcuuucauguuucagucuauuuaauugguguuuaaaucuuuuacaacgagcugguauucaucuguuucuuguguggcuuuuaugaaagaaaaaauauaaagaacuggaaaaagagcaacuuuuguucuguccuucccuguucucucucaccucccuugugcccucacucggcuuuggccuggaaaguccguucucugcuggggaggccucuguguagggagcccaggggucuggccuggcacuguucugcugagggccaccuccuuuucagaaagcuggaaugggccccuccuccuggccccugugcauggaugccacuacugggcuucccuguccucccugagcccuccaggagcucccuggcaccaguuggcauuugcccuccacauggcagugcccuccuugccucuguacggucuucccucugggcccucaagcuggggcucgcacagcaagcggcagccucuacuuuauuggggaagcucugggcaccaacccucacccccuucuccuucacuagccgcccugcaugauuccccucccagcuguuucugcucauuucucugaaguuuucagcccuuuuucuccuacucacuguuuuuuuuccccuccacacuccccuccucggagaugcagccugaggcugaggccgcauuguuuggugaccuucccugcugucccaggcugccugcacauuaucauauacaaauacuuucgucccuuucacagcagcugccaucuuugcugacucuuucauuacccccuccgcuucagccuaggcaaacaggucucugcagguggugacagugauaauuuccuguccauggaaagccugcucuccccgcagcaccauagcaggagcuucuucccuuuaacaggugaggggaauccaagguccagagaaguuaagucacauauuuuaaauguggaucggacccuccuucugagcauacuucugugccuguccugugagcagcaaugguuuauaacaucccuggagcuggccccuaauuuggcuccuccauggcccagcuuucugcaugcagcugcucuggggucccuaggagugauugcagccccuccagggucacuuccauuuuagcugagauuuggggucuugagagagaaggggccugaugugguguggcagccuccagcccacuucuaguaagaguauguuccagaaacuugacuuuguaugcagagguagcauggguaaguuggggaugggguggaugaggaugugagacaugaagauaccagccucuuggagguucuagaaucccaaaacgccaggcaguaagggguuugggccuggcuccaggaaguuccuggagaguuucaccaggaugggguuuggcugggucucacugucuuccuggauggaccagggaggacagaaccagcaugccaccucugggauccacuccagggccuggcugguucaagcauguccuaaggacagauaggggaggaaccucugaggcaggcacucagggguccuccucugggcccugugcggggguuuugagccuuauggcugaugggggccuggcgacuugcacucuccgguucucagcuguuuuguaguugacagugugugggaagcuggggcguuccccugaguuagugguggucgugggaucugagcaggcaguugcagaccugauccugcuuuggcucuggagccugaauggauuucugacaggagaagcugaggcuguccagccugccuugggaacuuggcugcuucaccaagugggagcucugagacucucccacaggucccgugcuccccacgugcccuuacaguuaccugcccaccagggcccagaggaggggcuaccuggagcaagggugccuggacugggccucugucuuccccugcugugagcagaguucucaccuccugaccccgacuuggucuaacccugugacccacaugaaaugccagccacugguggugggaaguggguggcuggucucuuccaagccaggagugcaucagcuccagccuccuucccugcugccggccucgguucacagggagcccuuugaggggcuuuuugaugugcaccauggauguuuggcuugaccaaauuuguuugcuuaagcauugcucuugccaguucauucggaccuucucuuucuuuuaaaaauaugcugcuugccaaagguuauuuuggaucuguuuuuguuuaucagguagaauuguuccagcgcaauugaaagcagacccacauguugacacgcacuggagcugcuugccaggacacgugcacaugugcacacgcgcacaugcagaauauguggcaggcaucucaucgugagcccuagaguguacacagcuuaggaagggggacuggggaagcugcccauuucaccggggacuugguaugugaagauuuucaucaucuaggugccagcacugacagacuucagguggggaaaaucuagggacuguuaccuccugggagaggcaaccuggugagucugaguaccuugggguuaggcuggcucugccgcugguugccugucauccuucccugcucuggccuggcuuccuucucugugacugaucucccgacuucacaggcuuugugccaggcuguggcugacggccuucgggaagcaagcagggcuggccggaagucagccagagugagggacuagagcgcugggcucccuacaacugugccucccuuuuaagugaguagccuuuucuugggaacacgguugggugcuuccugccaggaggccugcaguggauuucuucugaaaacacagcucuuucuccccaucaggaccugcuguguauaagcaggcugcucagaggagcccuuucaggcacuggcuuugggccuugcucccuugccccuuuggggcccuguggcaccuggaaacacacagagggacuaggcgguuaaggcucguccucuuucccaucccaggacagcccagcagaaagcuugaggauacugauucagcuccaggucucauugaagggaggacacuguguccagagggguggcuauguucguucguuugauuauuauuagugauaguaaccaacucagaugagcauaaggaaggaaaggaaauuuacuugcuuccacaagugaaaagucaggguacuugugcuccaaguaugguaguguggggcuuggaagcugucaguacugucuccuuccaugcacuuacuuuguucuguguggcucuacccuccaggcagcccacgucuuguggaacccuaggcagcuccagacuggccucugugcuuccuuccaguuccuccugcccagcaaugcugcacaagugcugagaucuagccuuguccuggggccgaauugguauagacacucaagcacugucuccccuaggagucaagugucaccguuaauguccugucaggugcaagccccagcucugcuggcucauagagcaguccacaccuuggcagaacuggguguccuuguggcuggugacauuugugugaggcugcccucaccccuggccugcaggaagaaccccuguuuuguuuccagucuuagaccaacaaaggcauccacacuggggaacugggggaagcuaaaucagcacccgcccaaaugggagagggagauccaacaucuuaacauuaucuucagauuuuaaaaaugauacauacuucuccuuaaaacuucaacacuacuaagaaggagguacauguacccuuccccauuugcuggagagcacgggugcugccauguaucagccucccuccagcaguuccugugaguaacauacacggcuacaccauggcaugagccuuggcagagucauaccaccgugcugcuguggcaccuccagcccuccaccccccacacaaccugaaugucucuccucuuucaauaaugaagauccuauagucaugaagcugacuguaaagcccaaaguaauuauguuuuaucugaguuugggaaucuuucuaaaacguauuucauacucccgccuuuccuugaacuacacaauucuuccuagaauacugcauauaauuccaucuuuucuugacgacuaaagcuugucuugaugaaccaguugauuuuauaggauuggagcuauagaaaugcaugaucuguuugcuucuccacuaaaugacuucaugcaagcuggagggccuugggggccugcccagugcuggggguugggggugggggauggggcuucuggcacugugcaggccaccaaggcuccuuccucaguuacuggagccucagagaggcuaagaugcaagcagagggucggagcaggcuuuugggcacucaggguuaccugaugaggggaaagccucugcccacuugccuuuccccugagagacacuaaacaaaugaccaggguaugugcaaaagccacaaagggaaggguacaaaauccucugggaauguccaucauggacuauagucgagucauuugauaggaccccauauagcuguacaaauucaugaacuaagacuguacaugucauaggggaggcuccuggagccgccaccacccugccacucccccaugucuacacggcuguucccaugucugcacugcacuccugugcuuuaccugagcuaugugugcuuaaccuuaagcguuuaaccagcaugcuuuaacguuuuuuuuuuuuuaaugcaauauguaaggagaagccacugaaggauuuuaagcaggggaagaggguagggaauaaggaccccuggccaggugggagucugguuggagggguccagaguggguguggaaagcuggcuggguccaggugaggguugaugacggcuuggucuagggagguguugggagagugggagagaacaggcugggcuuaagagguaccuagggugccucaagucuucaugaugccuugagcacggggcaagaugaagagguggggucauggguacuucuggguuucuggcucacaugaugagaugggugauggugcuguggaugcagaaaaccauguguggggaagaaggugccucuggcgugggagcuauggugcugcagagccugggaggcaugggguggaaagcccagugcugucagagccagagucgagagugucccccugggugcucacacuguggggcuggagaaaucagcuugggagaaggccuugcuuuuggagaacuguagcacauaauggcugggcagcagggacaggccugugaaagagauggcugggccugagagguagaggggagugaggagggccagggcuggagcacugccguguccccuccuccucaccaccuguagcauguccacuuccucuguccagccugcaggauccucuguguuugggucuacccucuugugcuucccuacugauccccaaucuguaguuguuuucaaaaauuuagccaugguuuccucccucgcacagccaucauggacaccaacccagcuccccucgcccacgcucccuuagcccauuccuguccagcgucaggccagucccacguuccuggagccgccagcacccugccacucccugccccuucacagccauccccaugucuacgcugcauucuugugcuuuaccugugcugugugugcuucaccuuaggcguuuaaccaucauucuuuaaaacauuuucaaauuuaugugaaaagagaacuugauaauaucugugaacucaugaguuugcucugcuaguuauauuuuuucuaucuggaauuugauauaaguacaucucccacauggguuuguagucaugcauguguguacagcauuguuugcucugucuuguagauaaauggugacgcucuguguguacccuaugccaagcuugcucuucgcauucagcacuaugauuuucagguuucucuuugcugauauguacagucucaguucaugaauuuuuacugcuguaugggguccuauuacaugacuugacuauaguucaugagggacauucccagagcauuuugcacccuucccuuuguggcucuggcacacauacuggucaucuauucagugucugucuccacuaccccucccucacuggagucuccuugcacacagagcuugauccaggcgggaagcaggagggaguuaaacucuaccuccuugagaaaggaguaucuauguaauuauuuggaauucuuccuuacaggagacuugucucuucucccaguuuauuaacucaguuauguauuuuuaucaggcuagacuuuggauauguauuuuauacuuuggguuauaauccaaugcuacauuauuuugcugcucaaaugguuccagccuugaccauggagcucuaugaggccagcuccuguguccucuugacauggcccauccuuuuguuuucugagcacuuucuggcacuauaagguguuccaggcucauccuguuuccugccccagaccuggaaucagcuacuucuccaaggagccugacaccuucuauaggagaaugguauuagagacagggugugugcuccuugcugcuggggcaucauugcuucuagguccuuuuagcagauagagcuaggaaagaaauguauauauagcaacccauaugugcauaucuaccauuauagauacagaggcaucuaccuaucugcauuuacaucaagcugaacaugagcucaugcucugucucugacucuaaucaaguacacauggcucauucuaggcuugccuccuugcuugucugugaccucccuccaacaguaugauguuuggcuccugucaccagcauucacucacuuauuuguuccaucacaguucacccuuaccacugacacaagauugugaagccugugaacaagggugguuuuuuacugugguuguccacaggucccugagccccugaucuauggaagcaagaauguugguguucagacagauuauuuggaagagugaacccugagggccaauuuggcaaauaaaguggugaaaugucccccuuugucuugaagcgugaagcccuuccugcugucaggcugagguggagaugagcucagagagaacucacagugaugcagcuccaagggggcaggcgggcuugugcagccauggggggaggaaggaaugagaucaagaauggaaucugggggcccugggaaguggagucccagcaugacaaacuguacuaaaugggagagagugaggaggcuggggaggggauggaaaucauuuaacagcuacacuuuucuuccuacuagccuuggcuuccuuaaggccucaacaugcacuggauucuaaauaugcaaagcaaggcuagcuguagacaaaaggaggaaagaaugagguggugaugugaugagcuguaguuugagaaaaccccagagacugagucuccuggaguuagacugggagacuugcucuuugggaaagcccauaggccagagacaucaaagugccgguaagaauaggguuccccuuggguuaccaucaguuggggaugcaauaacuacagcauuuaucuuuaacuuaaauuuuuaauuguuaaaaaaauagguaauggauucucaagauaggggaaaaaaaauucaaacuauguaaaagauguauaguuccuacccuauuaccauuucugguuucuuucuagaaauagucuaugugcauucaagcauauucauguauaucguuaucuccuuuuuuccuguauauuaaugauaacauaguauacacauuguuuuguaccuuguuuccccccgccccccccaaaaaacucugucuuugaagauacucugguaugagaacagauagaccugccuuucuuucuuuuucacugcugcauuagugauaauacagguacgccaucauucauuuguacuggucuuccagugacgaacacuucugcugcaucuagucucuugcuugacuucuguauuucuucuuuuaaaguguaaauguuuggcacaggugcuuuuuucaguuauuucaaguaagcgauuuugguuuucacaggaucccuaggagauggcuuuggcagacaaaacucggcucugagggaugauguguuuuggucaaggucauagaguugacaaaugggaacuugaguuuaggucuccuuacuccacuuccaguguccuuuucacuguauucuagaccagaagaauaaagaauauauaaauccacauauaagucguaugugccacagcaaaagccugaguuccugccuuucuuuaccagugaucugcaaaucagggucuguugagugggguuuuccuuguugugacuugucucugggaccccaagauagggccaggcccagagcaggagucaggaaucccuuguugaacaaaugugcacccugggcccugagauuuggggcucacuguggccauugacuucagggaguucuccuaggauacagcaagcugccaguacauugguuggaguagaggaccuauacuuuauacuuugcaggugaacauguugacuuaaccaucagaagucuccagauggaaaugucuugccccaucacuguaguuuaagugguauuccuuuaagaagaauaacuuggaugccagaaccaaaggccugugcuauuggacugggccagugaagacagcacaggcauuuuccaguuucagugaaguuauuuuuggucaaggcauuuccuauuugaaaacauuugcagcuccucauggguccguuggugccuggagguauagggcuuuucagagguuauugugauuguccuugaaaugguggccuuugcaguuggaguaauguucugcagaaguuagaguaucgcuaucucugaucagagucuggcacugcuaaggagcuacagggauauguaccagcuuccucgcccagcauagggaacacgcuuuucaauucaugucugcacauuuucccaccugaggcagcugugccuuagccaguugggccccucugagaaauacugcuaauacagagcgacaccaccacucagcucuguggaacuucuccccaguggccuaaaugcugauuccugggacaguuccaaauauagguuccccacucccgcuuuauaggaaccaguuuaccaagaccuggaggccaccacuaugucucaugccuuucuuucugcauccugcacauucucaguaccuuccagacucuugccaagaugcaggcucuagagccauaucacaaauucaggugccuuuuagggccuggcaggaggcagauggagggaagcagcacaugggaagaacuguacuucuuuacacugugugaguagaccugggcacacugaagacccaccacucaucucaacugugcaugggaaugcaaaacuggaauaccuagauuuugucauuuuuaaggagaagcuggaaaucuggauuuucaagugaaaugucccauuuuaaaauauaggcuugaguuuuuuugucacacaguaugggucaaacaaaacaugucugcagccuggauccugccuuugugcuaccuuugggaccuuugcucacuucucugcaccgcccuuccagccaucuuucugcagaggcuugcugucauguuugaggguuuuccuuuaggcagaguggcagacaucugucucauugcugugggggccaccaauaugguagaauggaaauauguugcucaccuuuuaauguguggauuggccaucccauaaucuucuuuugugaaaugacugcuaaauucuuuuacacauuuuuauauuagguuguuugucuuauuguugauuuguaagaguucuuauauauuuagggcacauguccuuugucagauaacacauacuuagaugauuucucccggucuauaaauugccuuuucauuuuguuaauggugucuuuugaaggcuuuuaauuuuggugaacuucaauuuauuauuuuuucuuuuauggcuuaugccuuuuguguccucucuaggagaucuuugccuuugccuaucccagaauugugaagauagucucuaauguuuucuucuggaagcuuuaaaguuuuagcuuuuauguuuaggucuguguucaauuccaaauuaauuuuuuuguauggugugaagaaaggauugaagguuuuuuuuuuccucauauauguaugcauuguuucagcacuacuuauugaaaaaaauuugucuuuccccuuugaauugccuuggcaucucuuaaaaaaaaucaagugacugaauaugugugggucuacuucugugccagugcucuguuuacguuuauugucuucucaugcuaucuugauugcuguaguuuuauaauuuugaaaugagguaauaugaaucuuucaacuuuguucuuuuguuucagcucuucuagguccuuugcaucuauauagauuuccaagucaacuuuuuuuuuuuuuuaaguauuggaauuugguuggcauugcauggaaucuguagaucacaacugggaacaauugauaucaguauugaguauuucaauccaugaacaugguauaucuuccuauugauauaggucuuuaguuuuucucaguaauguuuuaucguuuuuugggguuguuuuguuuguuuguuuguuuuuugacagaguugcacucuguugcccaggcuggagugcaauggugcaaccucggcucacugcaaccuguaccucccagguuuaagcaauucucuugccucagccucccaagaagcgggauuacaggugcccaccaccauaccuggcuuuuuuuuauuuuuauuuuuaguagagaugggguuucgccauauuggccauggcuggucucgaacucccgaccucaagugauccacccaccucagccucccaaagugcugggauuacaggcaugaaccaccgugcccggccuguuuuauaauuuuaagugcaguuuuauacuucuuuuauaaaccuauuucuagguauuucuaaguauuuuuuuuuuacuuuuuugagacaggcuugcucugucauccaggcuauauauuuuauuauuugacacuguugaaaauauuuuuuauuuuccaauuauuuacugcuaguauauagaaauacaauugauuuauauauuuugagcacauguugcugucuaugguuugaauguuugucccuuucaaaacucauguuuaaauuuaguugccauuguaacaauauuaagagguacaaccuuuaagagauguuuaggucuugagggcuccacccucaugaauagacuaauacuguuaucccuuucuugcucuuucucucaccuuuucuuugcccuuaugccacuugaagccuucugcuagguucugacacagcaagaaggcccuugcaagaugccagcaccuugauauuggaauucucagccuccagaguugugaggcaauaaauuucugcucauuauaaauuacccagucucaaguauucuguuauagcagcacaaaguggacuuaagacauauaugcugcaaaaucuuuuccugcuaaauugcucacuagauccuugcuaaaauuucucacuagauuuaguaguuauuuugugaauuucugaguacuuucuuugcaaacaguuaugauaucuggaaauaauuccuuucuacacuuuuugccuuuuuucccccuagcuuuaauucacuugccaggaaguacaguacaauguucaacauaaguggugagaacagauaucuuuaccuuguugcugauguuaggggcaaaauguuuauacuauuucacuauuaaauauguuagcuguggauuuuuugugcauaucguuuaucagauucaagaaguuccuuucuguuucugauuugcugaaagcuuuuaucauaaauggguguugaauuuuuuugaaaugcuuguucugcuucuauuaaauuauuauauaguuuuucuccuuuauucuguuaauuaaguuacacuuauugcuaaguagguuacauauauuguuaaguaaguuacauauauugauuuuugaaugucagacccacuuuacauuccuaggguuaauccuauuuuguuaugaaauauuauucuuuuuauauauugcuggauuuugauuuuacauuuuagcauuuuuuaauucauuuugaauuuaugagguauauugcucuuaauuguccuuucuuauaaugucuaugucauguuuuaauaucaacauuauucuggccucauaaaaagagaagaaguuuuugcucuuuuuuuauuaucugaaauaauauguuuaaaguugguaucacuucuugcuuuaaaguuuggaauaauucgccaaugaagcuaugagggcauauaguuuucuuuaagaggagucuuuuaauuauguauuuaaauauauauaugauguauauuauauaugauucagauuuuuauucuuguguguguuuuguuguguuucuauaaggaauuagccuauuuuugucuauuuauuggcauaaaguuaauuguaauauacucuuauuaucuuuuaauguuuuuugaaucuguagugauaucuucauuuuauuucuaauauuuuuaauuuguaauuucucucuuuauuuugaucagucuugcuagauguuuguuuauuuuauuaaucuuuccaaauaaccagcuuuuggcuuuguugauuuuuuuucuuuuguuucuuguuuucuauuccauugauuucuccucuuuauuauuuccuuuuuucuacuuucuuuggguuuacucugcugaucuuuagcuucuaagaugaaagcugagauccuuaauuaucaaccuucuuuucuaauauaauauuuagaacuauaaauuuuccuauaaguacugcuuuagcuuuauuucaaugaugugccauuuuuuaaucauuugguuaaaaguauuucaaaaauuuuuacagaauuucuccuuugacccauggguuauuuauaaguguucuucuuacuuugcaaauguuugaggauuuuccaguuaacuuguuguuaauuuauacucuuauuccacuguggucagagaauacacauuucauguuuucuguccucugaaguuuguugauaauuauuuuauggucuagccuauggauuuuggcaaaaauacagaccuauaugaugacucugaaaauguguauaggcagaugauagcagguguuggccuaggugaaggcaguuguggaugcauagagaaucaguucagaguagaaaagcuuccuauaaggacauccucuccuucuuuugcuaauuuucugucugucucuccuaguagauauuuauauuugcuaaugccuuuaaaaacuucccuugggaggccaaggcggguagaucacaaguucaggagaucgagaccauccucgcuaacacagugaaaccccaucucuacuaaaaauacaaaaaauuagccaggcgugguggcaugugccuguagucccagcuacucgggaggcugaggcaggagaaucacuugaacccaggaggcggaggaugcagugagcugagaucacgccacugcacuccagccugggcgacaaagcaagacucuaucucaaaaaaaaaaaaaaaaaaaaaaaaaaacuucccuuauaggaucacauuaauaacccgagccacagagucagaaagugcugccuuagaaugcccuuugucacuuucuggcuugugaccuugggugaaugacuucaccuuucugagccuuaguuaauuuuucuaaaaggguaaugggaguaucuucccuguggaguuguugggagaauuaaaugaaauuuuacaaaaugccuuucacaguucuuggcuuuguaaaugguaaauauuuuuagugguagcaguacucaaagaaguuagggaagcucacacacaaagguggcugcuucuccccuuuggacgguagucagaggcacuuguucuauucuuggugagaagucugcucccuaccuucugcugugcccuuggccccucagagauccagaggagagagccagcucagagccagcacuucuguagacuggcaugcuggugcucuugcagggguauugugguugggagccauuagggguccucacuggggugccuuagaccagauaccuggugaggcccagauaucccuccuucccauaggguccccuagggcuaggguggaggacuaucuguccuuccuagcccugaagauugccaggaauagaguuugcugacccuguuaggggcugacaguugaaguacauacaggaagaccugccucuuccugaaaguuuguucugggaaggggaauuuagaggggaaaagugaauuaaguucuaucauaucugaguguucuuaaaaugucagcuauugagccucuagaaaugacacauaaauucucugcuaggcacaacagguaaaggagaguuucagaaguugugccaagugcccccucuggacugagcagcagggccccagaccuaagucagacacuggcuccaccaucagaacucaugaccuugugggacagagagagccaaggaaguagagcaccuguacacugggggcacuugagauagggagggaccccaagggagggucugguuggcuuucuuggagacauggagggcucugagaagaaagaaauagguuuacuaaguggaaaagguaaggggaggguauucccaucagaggaaacagcauaugcaaggauuggaagaugccauuccagacaguuggaauggcagacuguucugauauuugacauuuuuguucgaauuagaauugucaugaaacaaaaacagaaacacaucauaccuccaauguguguugcugccauuuugaugaacuaucaaucucuugcauguaccuccaggccucugcugugccugucagggagggcuguccccaugaugccugggaaaauggcuaugucucugccagccacagaccagcaugggacauuucgcuggcugcaccaugugugguguuuguccguugcuggaaugugcucaguugaggggaauuguuucauuuggucauccaggcucaggugaaacaaaaagaggccaaugcaaaaagcugcagcugauuccaggcacccccaaaauguuuucuacucaacacuggcagcagugcgauguccccucagcccugccuuuggugguguccaacuacaggagcuggauggcccucuggcugccucuuggggccugggaagcaaaggaagcaaguucaaaucugucaccuguuuguaguuuucauaauuuuugauuuggcauuuugaucagucuguuuuuggucaaggaaaugcauccguaucucauaacaggaaaccccuuuugugaucuuuacuucaaggcauuuuucuguacuucccccuacuuuuuuuuuuuuuuuuuuuuuuugcuggcaaauauacagaccuaguaugauaugugugucuuauuaaaaguucaacauaauucauugccauugguuuguuuacaaaauaaacaauuccagggccuuccaacaauugaggcuccuuuuuuuuuuuuuuuuuuaaaucuuccuuggggcuggaacuguggugagaagauggagaaggacccaaguuugggagaagucacgugguuccaugccugcuuccugccagagucccaagcaggugacccagcagucagcuggggaggcagacaccccagcauggccuggacccugcucuccucauuuaugugagggucucagugggguggugggaacccaggaaauucuugaaccuuccucagcccauucauccuccugcccagaguccccaugggaaguaugugcauaggcacuagcagaaaagcaaaaaaggaaugcuuuccagcgugaugugguggguuugguccccagccccagccucagcucuugugacugagugaccuauagggcagcuuuaaccuuuccccugagaaagcacauguuaccaugguccagaaaucacccgcucaucccagaagagauggaaggauagagagugagagauuauccaggcccugguacugggagcugagcuugccuggcugccuuuggugggagagggcccuggcagagcaugagauuucaucauccugagcccacacuaggaugucccgauguuggaauacccuaaaagcucuucucuuggaaaacguaauccacguaggaucuugaaauaugaccagcaggauggggcuuccugucccugguaugcagaaagggugaguggaggcaggaggaaggauggugucugagcuggccaccccauguagcuaacacaguccaaugccacucuguccucauccuggccacccauaagccuuucuugucuccucuuucccuuccuaccaaguccagcauuugcaagccauccugaugcuggcccuugcuuuucucuguagccucagcuuuucucauucuucuacugauaaagcaaacuguaguucuccuguuuucucagcauacucaccuucauggccaugcacagaccugcagggccugugucuccucgucauccgcacagggguauauccaugugggcaccucaggaggcagcucgaagguuaccuccucacugaccuuccugcccuccacgcuacacacauaugccccuccgucugucucucuggcaugugacuaccacugugaccuugcugcaguuauccauuggccuuugugccccugagauggccugaaagacacgauuuggauuugucccaguuggcauagguguggcuuacagucaguacucugcguguguuggccagaaggcccccaguggcagucaggugguugugaucuuggagugggguagaggaauuguagccaaugcuauuccaaugcuagccaauaccaaagcugcaccucaugcucuacaucacacagggagggaccucuggagucccagagguuuggcaaagcucccugcagucuuucuguuaagaguaaauaaagaagcaugauaucugagguggugaguacccacugaugaguuaguagcauagagcuggccuccguccucuugggagaccauaggcacauaccagggaugaacagcauguaagaaucaggggugccaacuugggccugagagggagggguggucagggagauguguacagggaacaccaacugaaggccccggucccccaagggaggacagcuugugagggcucaccgaaggaacacaggagaagucuagccgaggauuuaugcuuacccuucucuugauuaccaucaagugugaugauaacuuucggagaacuggcucuaccagugccccuuucuuuauuuguggauugagccccugaaccucacugcuguaguuuccuuuguggaaggagagauuaaagaaccuuccaaacuuccugugggucaagaugccaucaggaggaaaggagcuggugugggaaagcccagcccaaucccagcuaugagagcagugucugguuguggaacucuggcacacacccuucuguggaccccacggucaugcugaguucugcauuacuccacaugucccagagcuuccugccucauucucaugucucggauagccucaugggagggcuccagcagagcuuugagucuugugcagccugcccuugauucugggcuccaguugcaugccuuguucccacuggcucucccaugcuaaaaauuagauauuuuuugaaaaauugaaaauaucaacauguuguuauaaaauuaggcacuuuuuugccuaagcuacucucaccacacuccuaaaucuuagguucaaacuagguaguugucucaauuuugcugaaauaguccauuggcuccuggccaauccugcugacuucuccaaguacuuccuggaugccucuggggcacacauugcugcaguccaggagcugaagccagucaguaggcccugggacagccaaggagggugcaucacaugugcccucaggcagggagugggaauccucccaguuuacagcaauauuuugccagauaagcugacacaggcuucaagaaaucaccuuuuccccuuggaacaaaugggggcauaugccuggaucaucuucucuuacucccuugugccagucuaugacaccacuguuuuuuguuuuuugcuuuucugagacagggucucugucacucaugcuggaauacaguggcgccaucagccucaaccuccccagcucaagcgaucuuccuaccucagccuccugaguagguggaaccacaggcaugcaccaccaugcccagcugauuuuaaaguuuuuuauagagauggggucugcauguguugcccaggcuggucucaaacucuugggcucaagcaauccuucugccucagccucccaaagugcuaggauuacaggcaugagccaccacaccuggccauuuuuuaaaauagauacauaauaguuguacauauuugggggcacauaugauauuuugauacauucaugcaguguguaaugaucaaauuaagguaauugggguaucuaucaccucaaacauuugucuuuucuuuauauuaggagcauuccaguucuucuagcuacuuugaacuauacaauacauuauuguuaacuauauagucagccuacuguacguuagaacacuagaucuuauuccuucugucuaacucuguaacaauuaaccaaccucucuuuaucccaucccccugcccaccagccuuugguaaccaccaauccacucucuaccuccaugagacccacuuccccacauuugagugagaacauaugguauuugucuucuggugcuuggcuaauuucacuuaacauaauggccucuaguuccauccaugaugcugcagaugacaagauuucauucuuuuuuauggcugaauaguauuccauugaguacauauagcacauuuucuuuauucauuuaucucucaguggguacuuagguugauuccauaucuuggcuguugugaauagugcugcaguaaacauggaagugcagauaucuguuugauauacugauuuccuuucuuuuggguauauacccagcagugggauugcugggucauauaguacuucuauuuuuacuuuuuugaggaaccuccauacuguuuuccauaggagccguaucaaucuaaauucccaccaacaguguacuagcauuccccuuucuccacauccucaccaguauccauuacuuuuugucuuuuugauuaaagccauuuuaacuagggugaggugguaacucauugucguuuggauuugcauuucccugaugauucguaaaguugagcauuuuuucauauaccugauggccauuugugugcuuccuuuagagaaauuuauucaggucuuuugcccauuauucaucagauuauuuauguguuuuuguuuguuuguuuguuuuuugcuauuaaguugaguuccuuauacagucugguuauuaaucccuugucagauggauagccugcaaauauuuucuagucaccacuguuuucuggcuuguagcaugugcucaggaacuacuuguugagugcucugugaagacaaaaauauuuugauguccaugaccaccugacacauggggaaggccuggaggaaggcaugggaaacccagagcacagaccuggguucagguccaggccaacagcugacucccuuguguguucuugguccuguucagcucuaugagcuuuacuucccucagcccuaacaugaggauuauaaguaauaccugcuccucagagaugaccacguauuucauaaaccuuagccuucuucuucguugcuuucauagaguuacugugaggauuaaaucagaaaaggcaaaaaugucaggagcaccucgugcacucuugaggugugauccaaguccuggggugguuccuguguguccugauuguggcccugacuuuggcucugccccuuucccagcauguaagcccuguggcuuucuuugguuuggggucugggccugggcagggguuuucuuccccaggugauguucacuggugguagucagcuccccggcagagcagacccccagcuuggaaaaggagcauguguucuucccaagucugggugugcuagaacuggccuagagauucuggaacagcuguucuggccaccuccccagcugccuuucucuuugucccagaauuucccccaucuuaacuucuuucuuucaucucccauucuugacuccagcacuguaagcaggaaucuggccuuuuaucucauucuuggaucuugauaggcuggaaugaugguaaaaagccaaugcgggccaggcgagguggcucacgccuguaaucgcagcacuuagggaggcugagguggguggaucacgaggucaagagaucgaggccaacauggugaaacccugucucuacuaaaaauacaaaaauuagcuaggcgugguggcacgcaccuguagucccagcuacucaggaggcugaggcaggagaaucacuccagcuuggugacagagcaagacucugucugaaaaaaaaaaaaaaaaaaaaaggccagugugaugaaauauacuauuaauauauuauuaauggcaaucauguuaguuuucuauuuuuauuucuguucccauggcuucuacaauaaauuaccacuaaguuuuugguaccacuaauuuaguagcuuaaaacaacacauacauauguauagacuaugugcauugaagaaauaauccuaaugcaauaugaaaaauaaaacuuucauaccuuucaguaccuuuuucccagaaguuugacaauuugaaaauuuacucuuccagauaauuccugugcauguauaagcauaaauagauacuuaguguuuuuuaaacaaguaggacuauacugugcuuauuguucuaugcuuggguauuuuuuuuugcauguuucuugcauaugccuaaauuauuuuaucuuauugucuauuuaagcugauuucagguuuuuguacuugaucauuauaguuaaauagggauaaauguaaaauucuuuauccucaaacaagcuccaucgauggagaagaaccuaucagcacaagugguaaugugguuauuugcacucuccagcuccaggcuagagcaugugauaugugcaauguuccguccugggggggucaugcuuuaaaggggucuuugcugaguugaagcagccagugaagccguggagacuugccagugguggugaaagguuacauaacugggaggccccgcagcugcacccaugcagcuccuccggugugcacgcuuguuccagcucuuccuuuuaccugggcagcuccuacccauauguaaaaaggcuugguguacaucucacuuccccugugaagccugaucaugccuaggcugugaaccucuccugggccuggggcucugcacaugggcgggacacagggugggcugcagaacugaaauguggugaaccggucagggacuuuacuggugcaagucacagaaagucuaacuggcccucaguaagugguucccaggaggccaucaggaugucaaggggaggcagguguuggacuccaggccugcuaaacguacucucagagacucagaacuguucacccccuaccuguccaguguccuccuuaggcaccucuuccuucuguccuuuucccuaguggcaacuuuguuucucuccuggagcuguggaguuacucuugacagacuggaggggagaaguccugaggggugagccugggaauggggcaggaggaaagagacuggugugcagaagggacuuacacaugucgcaacauuuaaugaggagggguagagcagcaguuccugggagaaagaacucccauggggggcaggaaaugaggcucaguggaagaccccacugggaagcuggcaggcagaccaguguggucaggccaugcagaagggaccuggggggcuacucaaaguuaccuaauggagugaagaugaauuuuucucauugaaguggaaaaacugcugauuuuuaucagggcaaguugguuagaguguuaguuaaaccaucugucaaagcucauuuaguugucaaaauuaaaucauuuuccuccacuuccuaguggauugguuauaaugauaacuuucuuggcaugacauuuaucaucuugguccaaaggcagucggggguauggggcugggaagagggcaggaauguaaugcauagagugauacgccuguuccuuuugugguagaaagaugcuauuuuaauacuguuuaauuuuuauuaucacuuauaauauuagugugcauuuugcuguaacugcaccugguuucaaagcaggacaaaacccauggccauauuaauaaaggagggugaagggaagagcuggguuagugccccuugucuggugcuucagaugguaggagagguugauccugcaggccgacugauuuaaugcccugauuuccagcuuagguuucauaugccagucauaaaguguaagaaauaaauauccuaaaacaauuauuuuuuuaaaaaaguuuggcuuauaagcaaaauaucuaaaaacauuucuaauuuuuauacagaagaggaaaaaauaaucagauaaucauugauuuuguuuuuuguuuuuuuuugggggagguaaguuauauauaugguugggaaauucuaacagcacgaaaguuacaaaaugaagaguaggagccucuccuccucuaucccaaacccauucuuuauaaccauuauuaacaauuuuucugaauuuucccagaaacaauuuuaugcauauacucacguauauaaguguauaaagcuauuuuaaaaauuauacucacaagaaaugguuguuuuauuauugugaucuuacaaauauuucucagcauguauauuuacaucugucucacuucaguguuucauaaauacccuguuauauggcuguaccauauuauuuaaccaguauuuuagugccauugauggacuguugccuuuuaaaaaaaauuacaguugaugcugcauaaacaucccauuguauguaacuugauggacuuguaugaguauauccauggguaaauccuuaaaaauugugauuacugcaucaaaugauauauugcuuugcauuuuuuuaaacauuauuauuauuauuacuauuauuauuuuguagagacggaggucucacuuuuuuguccaggcuagucucaaacuccuggacaacaggagcaauccucccgucuaccaaaguguugggauuauaggcaugacccacugcaccugaccgcuuugcauuuauaauguugauaaauauugccuaauuucccuccagaaaggugguaucaaguuacauuccuacaacaguaugugagauggcccacguccccagacuucuucccaaauuaaggaucaucagucauuucaauuuuuaccugaccugauaggugaaacaagguaguauuuccuugcuacuccauuugcauuuaauuuuugaaugagguuaucuuugcauauguuuauuguccauuugcauuucauugucuauaaauuaccuguuuauggucuuugcccauuuuuauacuaggcuguuucuuucuuauuaauuaauauaaauucugugagugaggaaaugagcucugugucaguugugugguaaauaacuacuguaccuucucucauuaaacuuuugacuugguuuuuuuuauccauuuagaaguuuuacauacuuacagagacuaauuugucauucuuuuaugaccucuguguuuucuguccugcuuaaacuggccuccaagauuauaaauucacccauacguucuucugaaauuguuuucauucuuucauucuuuugcauguagccuaccuuuauuuugacacaaggagaaagcacaguaucuaacuuuauuuucccauguuaacuaguagcaccagcaccacuuguugguaauccuucuuuuacucccgauuuaaaaugcuaccuuuguuaagaauuuaaguccaucucugagcuuuuuuuauuguugucuuauugaucuguucacauuuuuucuuccaugccaguguuucuuuucuuuuugauucuuacaguuucauaauagguuuuuuuuuuuuuucuggaaaggcuagucccugccucucaacccucccuauuucuccuuuuguuuuuucugagugucuguagcuacuggugcauuuuucagaugaacuuuaauauuacuuuuaauugccaaaaaauaauuuuugguauuauaauuugaauugaguugaauauagauguaauauaaagagaguuuacaucauuauaauaucuaauuuuccugagagcauugucuuucuuuccacuuacuuagaguuucugaguuuuuuucaaauagauccuguacauuucuuaaguuuauauuuaggcauuuugguugcuauuauuaaugugauuuuuauuuucguuauaauuuaaaauuuuucuuuguuuagaauagcuguugauuuuaaaauauaauccuguaacccgccaccuucccaaaacagacuucgguauuguuuuuauugucuuuuccguugauucucuugaguuuucuagguauauaauuauaucauuggcaaacagugacaauuuccauucuuccuuuuaaauguuuagaccuucaauuuuauuugcuuaucuuauuacauugcuuaguaguucuagaacaauguuaaauggcaggcaucuuuucguuguuuguaauuuuuuuuuuuuuucccucaagacagggucucacucugucacccagacuggaaugcaauggugcguucagggcucacugaagccuugaccucccaggcucagaugauccucccaccucagcuucucaaguagcuggggccacaggcguguaccaccacaccuggcuaauuuuuguauuuuuuguagaaacaagguuucaccauguugcccaagcuggucucgaacuccugagcucaagugacccaccuggcuugaccuccaaaagugcuggaauugcaggcaugagccaccaugccagccuguuguuuguaauuuuaaugagaauguggugaguguuuuaucauuaaguaaggugauggcuuuucgaucucauuuaucuuuucucucaucauaaggaaauacucauuuauuuuuauuuuuuuaaaucaaggauuauuuuuaauuuuggaaaaaucuucauggcguauuuuggagugauuuaugguuuuugucuuuugaccuuuuacuaugcuguuauauuaauauguuuucuaguauugcauucuggaagguauccuacuuaguuguauucuggucuuucaauaauauuuauauuauucuuucaguaauauuuaugucauaauugaaaugucugguuggcaauuuuugucaugucaagucuugguauuaguaugcuagccucacaaaaaggauuuggaagguuuucuccuuuauucuuuuuaaacaguuaaaauaguuaucuauuccuuagaagauugaagaaauuugucucucaaaccaucugaauuugauacuuuuuggggguagcacuuuaauaacuuaaacuguuuuccuuuguauuauuagucuuuuguuucagucucugccagggauaauuuugacauaacauuuuccuagaaaauuaucuauuaaguuauaucuucaaauucauuuguaucuaguuuugcaaaguaaacuuucuuauauguaguaauuuucuuuuuuaaaauuucuaacuuuguguauuugggcuuuacugguuuuuaagaacuugcaauugcauuuaucuaucaauucuauuauuccauauuuucuaauagaauaauuugugcuuuuaucuuugcuauguauuucuuucauuggguaauuugucuuuuugcuaguuucuugacuuaaagacuaaauacauugaucauauaauaguuaccuagguguuuaagguugugaauguccuuugagcuugugaauguccuuugagcaccguuuuaguugcauuccacuguauguuacuuucuagauauccugcaacuucucuuuugcauccuucuuuaacucgaguuauuuaaugagaaaaucgucucauuuccaaguuguuugguuuuuuuccccucuuuguuuugucaugcauuuaaaguuuuuauugcacugugaagggagaauauggucugugucaugucagcuguuuggaguuuauugaguuuuccuuguggccuaauauaugauuuuguaaaugauccaacggcuuuuaaaaagaagaguuauucuguuauaagaauauaaaguuugagauaaaccccccaccuuauaauauaggucuuaguucaaacuaaucacuuauuuuauaaauuguuuguuuuugcauugccuacaauuugugcuuuacaaauuuuguugcucugccuuuugauauauaaauauuuacuauucauauccucacuguaaauuaagcccuucauuaaccauuaguggccccuuugacucauuuaaccuccucugccuagaauucaggcuuguuagauuuaaauuuggcaauccaguuuucuauuuguuaacguaaucuaucuuuuuuuuacuuuucaccuuucugagucauuuuguuuuagaugugauucuuguuuacaauauauaguagcuuuuuaaaaucaaaaucauuuuuaaaaguucuaaaaaaacuuuuugaaccucaguuuccccaucuguaaaauggguaguugaaaguaccuauuggauaagauaagauuugugcuacucacuuuacauauaucuucucauuuaauucacguaaagcuauccuuucaagguacuucuuauauuuuuugucagaugagaaaacugacuuaggaaggugacuuuuccaaggucacucaauugcuaauugguugagcugugauucauccccaauccaaggcuuucuaaauucuaaaaucuuucuacuuagcccauacggcagcaucgcaccaugggugaaaccccaggucacccugcgugaaaugguuccuagcuuuuaagacaaguuguagcaagcaggguaaccugguaacuaggcucacuuuuggacuuaauuggaaccagacugcagggggcucaagggucaggcuagcagucuucucaccaguacguccuaccugccccaccuucccagaaugagagcagcucugcugcuggguguggggccuggccacacauggggccuugccugccccugcccucuccaagcuuuucccaaggcuggcaggcacccucugagcacuguuucuagccucagcuccaugugacagucagagacagcagauggagccaaagacuuggagaaaaaugacacccaguucagaguccauguucccuggggcccagaccccaguguugaauguggaggaaagggcuugguuuauuguuggggguggagauuagcaggggcuuuucuuguacccucucccuguggugauuaugucuagguaucagugaggaagagggacccagcggggcccagcuagcaugaaaacuuccuggaaguuaaggccuggcucccacagggugccugaugagccuuuauaaaauaucuagaggcauacccuauguccacuuggucucuauuccuccaggccugugguuccaguagggguucagcgaauauuggcuggaugaacugggcaaaguauugacugagcugcuuuauucgcaacaagaacagacaggaaaguguauuuagacugacuccugcagcaucuggcacugggcauuaagagaaauagugcucagccugugcacacauugggcaggguaucaguccagcugcaauacuuucaccugugugaguggggccaucacuaagucuccuagggucuucucuguaaaguggagaugaugcugacuguggaguuggcccugaccuugugccauuuucaaggaugaugaagaugcuuuugauugugcgcucucccuguaggccucuccugggcuuuguggcaggcgagagcacaugcuuguuggagcucugugaggcccaggcagugccugguucccuggggucaccugggcauaacagugcccaucuugucaguugaacuguguggcuaagggugaaagacuaaguaguuggaacucacggcaacuugcacacaugcucugcgcccacaguuaaguauaguuggaaaaguggugcucucagcagugaccucagucucugucauucagacccaggagugggucucagaagaggcuggaggccaagcuuggccguagcucugcucuuauuauaugaugcccaguggcccagguuccugaccacucagacuggaagagccaagucauccuggcaggggccaaggcucugaccucaguccuucuuggugccagcuuagugugugugccaggcuggauuggaugugucaggggagggggaauugggagaagacauagcuuuccuugaguaccuacugugugccacgugcugagcuaggcucuccaaguacuaauuucugauccucucaggaaucuuccaaagcugggacucuuauccccucuuugcagcuggaaaaacugaagccaaaugccauuuaaucgcacagcuauugagugagaaccaguaagccagucccccaaaaccuaagcuuuaccccucaugccaauagcuuuuaaacauuuuuagcuaaagaacuugaauaucaaauuuuaugaagaauccccacaaauacaaccuauagaaagggagccagucuggcugaaaugcaaaugggugacuugggcccuucuguuccugccccuccucacaccuauggcagccccaggacucccugggaacacaaggcuccuuggaauccaguuuggaaauggguccugugcccuagaaccauggaugggagagcucaagacaccgccccugcugucugcaggugcauagagccggagcuuuagcuuccccgucugugaaauggagcugcugaucccugucuugcagccugcuaaagagaguccgugagguguguuuguuuuguuuuguguuuuguucuuuugaacugaaaauugagguguuucaacuaugguugagaaccuacuggcugccagauagucaacuagguguuuguacgcaugaucucauucggaaagacugccuucgcccaugagcaagagugugaaagugaagguuuauuuguucacgagagggugauggaacagcuugucacaaacuguaaguguaguccuggcacauggcuuggagaggaccugaauuccgguggguggcuguggaaguggagaggaagagcugacagagacucugcccugaacagcugucagcaccugguggagacugagcaggugcaaagagggcagaggggaggcgauagcugagagagggccagcuggcguuuggaguuagaggaagaaaugggaaaggaggaagccuagagcaggaaaaucaaggauaauguccuuucuggaugagaggggucagcgcacagaggcuagagagaagagagaggccccugcugcugucugcugaacgcuuacuggggccauguacauaaccaguguacccaaugaguaggaccuaagccuuuauuuucagauggggaaacugagguucaaaggagaaacuuuuaccaguaaguaaaagaccaucgguucuggccauaagucauggugacuuuagcugugaagauucaaauuagaggaugcuggcagagggugaaagcaagcugagaaaggcuaaugccuagggagugaggcauaagucagaaucacuugggaguuuugugcccagccagagaaaccccuacuccuucagguguggagcuucuggaaacucuucucuacucaagaagggcagaggugcuuugcaggaagggccuggacacaccgauucuuggcgcccacucuggggccucagaguuccccacucuccugaccuagccuggcuuggccugcugaggugcuggaugccacacucugugaucuuauucaaaugucagcuuuuccuagcauuaacauccauugacccauuuaaaauagacacacuuggagaaggaaaucaaaaagcaaaacaaaggagcaguugcuuuuccaaucacauacaccuugugcagcuuaaugaagucauaacagaaccaaaggcaggugcgguaucugugcuuuucagggagaaaagcaggugucaccauuaucaucuggaugcccuuuggccacagcauuuuuagaccaucugaggcacugccaagaauauuccuguggcuuagugaugagccuuuuggcaagguuaggaaauuagaacucaccuuaguuguguauuuaauuaaggguagggagaaagucacaggauuuccuuuuucucuccuuucccucuggaagcaaggggccacauacaaccaucuccgcaucuuucagcuuugacugcuccugccccguaaucuugacuccuggagguuguggcuuuuacucacucucuuaguuuggcuucuugagaguuucuaaaauuguacaaggucauagccaagagauugccucuuagcaaccucgugccaguggccuugcgccuauccccuggucucccacacuuacaggaggcccacagagagagucaugcugcuguuuucuuuguaggcacacaacagaacaguguuuuccaaccuuuuccucauaaucacuguacagauagacuguaucaugacccaaugcacaugcagguggagaaagugaaaggcuuuacaaaauaguauccuuaccuccugacuuccauugcauugcauucuacuccaauuuuuuauuuuccuuuucacuugaaaaccacuggucuuaaugcacugcauugccaccucaguuuggaaaccugcaguagugcucaggcucuggaggucaggccccugugcucugcugccccacccugcccaccuggcaagcaggucuggaggccucugucccucagcuggucucagcaguacuggcugcaggugacuauuacaguggcaguggcuggggaggccuucuauugaugcaacauucuguguggggaaaggcccacuugauaaaacuguuugguuuuacuuaaaaggaguguaggugaggaaacaaacuacacaacaaugugaaugaacuggaaaaguaagaaaagauaaugcaggugauauccuucuaagaaaauuuuuaaaauuaaaauucagauuuagaccaauguguuuuagaaaaggacuaaccaugagauucccucuaauugcauggucuccucauucauugaaaauguaguuauuuuuacagaaaucugaccuuucugcaauuuucaacuguggacccaugugaaguguaacuaauucuccuuucacagcauucaccuuccucuucgguaaugcugagccccauucugggucugccauuuuacuacagaggagagaauuugaaagguggucagaagaagcauggacauguuaaauguuuggaaaccagauuccuguagggaaggagggaaggauuuuagcuccacaguuguguucugagugccagcuaauggggcuagcccucuacgucccacuaaaagccugcauggucccgugaccuucagggcacagcuccaaacuugaaguguguggcuggcagccugucuuccucugcagccaugcauggggagcuucaggcccacggagcuaguuugguucccuguccagcagcugccuuguccuuucaggcuucgguagcacucuuucuuuugugaccuggggccaaggacuucaccuuucugugccuccaucucuuuucagaguguuucugagcauacauugauuauucaugugcuuggagugggcacucaggaguguuccuuguuguuuugcaagggacgcccuuuccagcccugaccauuugaaacacucuuagaaauauuucaaaauccagcucuuacgucccaccucuuccugggagcugcaucuguccugaggauggaguugagcucugcuccuuaucauagcccagucaccccucuucccgcuugacucugugcugcuuaagagaaggcucccaaccucucuauguuggaauccccagcaccuaguaccgugccuggcccacagucagugcucaucaaugcugauuugucccugaauucacaugagggauaagaaaagcuucaucccauuuccaccucugauggauuggcuguaccgucaagaguuccauguugagaagauucugagacagaacuugagaaagggaaagaccccacuauguggcagauacaaagccaagcauuuuacaugccuuuucuucugauuuaacccuagacaacccugugaaguagggacuguuaucaucucucucugagaugagagaaccagagcuccugaguuacacagaagugggcagugcugggucucagacaggcaggguccccgcugcugccccaagcaccuggaccuaggccagcucucucuccuggaguuuugguccuguccaacugcuggcuacuuccaugcgcagaggauggaguagcgggaucccaccgccuuugugucaccagacugcgcuggaauaggggagccuuuguuuggugugggcacccaccgggguucagaauaccaguguuuagaagaggcuccgccuucacccuccaaggaaggacagaggcguccaugguuguugaaaagcggaauguucccgcuaaugagaaacaguugagagaugggugggccaccauccuuguggcaggcccuguguccugaccugcuugucaagguacagaugacaggcagggcuacagcagguguggcuuccucuagcuggauuggcaaagggaccugggccaggcuguggggaggagggagaaggcccucugcaauuuuucuuuucucuucccuuuucuuuuccuuaaccauuuagcuguaucuuuuaguaaaagaauacccagaagacaguuuuucugcauuaccauauauagaaaauucuaaacuucuagaaagagauaguucccugggaagauggucugguuugagggugagcauuaacuuuggacucauacagcccuugguuaaagucuaggguuaccauuucuuggcggugugaacuuggucaagucaaguagccuccguaggucucagcccccuugucuguaaguuauuuccaugccauagcauugugaugaggaugaccaugggaagcaccugggauguuguagaaucuggguagaaacugguuuuuccuauuccugccagcucuuggaaaaggcuacauccuggcucucccagccaguugauagugugccucucccugaaagagaaauugaugucuccugccaacauccaauugggggaguccaggaaaagggcaguugucuggguaaccauuugugaaagccaaggacagggcaaaauggagaugcaaggaaggguuuauccuccuggcaacaggguugcacucauguuucuggucgaugcagcuuugugcuucuugccuuuccaugccaugugggagccacggguggcauguugcauucaguuagugaccaggcugcaucuucagagcccaggcaucccugucaccaucuaagcuaguuggucagccagccaggucuggcagguaggccucccacucccagagucuauggaugccacacccaggacucaggcaugaggagguccacuuugggaaccugacuucaccgcugccugguaacggggcuuuggcaagucaggcucuuggcaucuccauuuuuaacagggcacuuguaaccaggacauccucaugagcacagcagagaacuguucccgggcucucaugagaugugugagaaggccccucauguggacauauaugaauguagcacauuuuuguuaguuuacuuugaaaagguaauacuggcagaugguuaaaaaggcaaaagaugccaagguuaugcagugauuagaguuaagucucccugacaacccccugucuugggucccuggucucucccuccuaggcagccacugcugcugccauucuggugauaaccucugcauguggaagcuuauguaucucccccuguuucuuacaccaggcccuacccagugugcuaccccuugcuuuuaucuccuccacucuagaugcaagaugguucuacaucuguacauguggaugucuguuuagccucugccuaggaaucuaccguaaggacaugcugcucucucucucccucucauugaggcauagaguaguuguuuggagagcacguuaaccaacuguugguaagaacagcuguguguauccugucugcuuugagguuucaguggcucaauguccuugagagcaguuuuuagggaguuauccagaaaauguuuagcaaauaaggaacucuuucuuuuuucucucuggugcaggauuucugaagcucaacauuguugacauuuuauuuuauuauuuuauuuauauuuauuuuauuuuuugagacagagucuuacuccaucacccaggcuggagugccaugguggaaucucugcucacugcaaccuccgccucccagguucaagcuauucuugugccuaagccuccugauuaguugggauuacaggugugcaccaccacaccuggcucauuuuugucguuuuuguagagauaggguuuugccauguuggccaggcuggucuugaacuccuggccucaagugauccuuccaccugugccucccaaaguguugguauuacaggcaucagccauugcucccagccuguugacauuuuucuaccugauaauuuuuugcuaugaaggcuguccugggcauuguaggauguuuagaaacaucccugucuguacccaguagauaucuauaacacccccacccaccaugugacgaccaaaaauguauccagguccagacauugccaacuuucccagaggugggggagucaccccagguugagaaccacugcuccagugggauuuggaagagcugagcagugcugugcacaaauguguagcucuggaguuuaguccuggggcagaccuguagcugagaaggcagggaugggggucgccuggagccaucaacauccacaccaccugcucuucagggcugcuuccuaaugugccuuugggaagccaaugucucucccuaacacacacacaggagcccacacuuacaucaaagaggcaauagagugugguguauuauggcuggguugugaagccagacuuaucaaugcuaccacuuccuugcuaugugacuugggauaagauauuuaugucugcuggaacuuaauuuucucagcaguaaagugggggauaauaagaguaccugccucauugguaguggagauuaauggguuaaugcauguaaagcacuuaggcccagggugagguaugugauaugugcuccaugcaugucagauaucacuauuauuaucagcagaaaaauaaaaugacugcugagcccucucugugagccaggaucuuugaauugaugaccacaguugaguuugcuuguaaucaugggcaguaggacccuccaugccuuuauacucaggaaauggaggcugagagagaguaaggcccuugcucaaggccacacggccaauaagauguauugagcagagccugugcccgagggccaugcugaggcugcuauggccucugccagaagccagggccugagcuccuggggaggcccaggagggagggagggagucuaccauugguaccuuguguuguagccaauuaguuauuugucagaagccauccuugggcuugaagucccugcacacugucagugguauggaguguaaagcuccauuucuugaaaacugcauacucgucagggccaguggugucaccuuggcaggguuuauaaggaaagaaauuggccauaauucuagugauaacuuuuauaugaauuuccuuuauuucaccuuccuaugcuauauguuauacauuuguauaguggagaucacuauguuuaauuguuacuaaauauaaugucacuauuucugaugcauucugguaccacuguuucauauguccucauaucuuugaaaguucuuagcuuguugccauuuuauugguugcauaauauuaaauguuuucuuaauuauuaugcaaguaguacgugaaauauauuuuuauugugauauuuuaugcauugccagaaaagaccaaguccuuuugaucacccuucuaauucuagucuguggcgcagagguauugcugcuuguuuguggauuuauuuuucaaagagcgugguauuuauucaguuauaauagaaauacaugcuuguugugaauaauuaauucacuaucagguaaaguuaaaguuuccuaaaauucuacuucccagagaaagccaguguuaagagcaugcucuguguucuuucacccuuuuuuaaugcacacaaaugcaccacacccuaauauacacacuuaggaauaaaaagcacaacaggcuucugucauaggcauuguuuguuaugucaguguuuucacuuagcauguagcagaaccaucucauaccgaugccuaccgcucucccccucucuucacucacugcauccugguccacagaagagcgcuccugcacucuugccccauccccuuaugaucgacaggcacgugguuuccaguguuuuuggcuaugggaaagugugcugcacagcaucucagcaugugugaagugguuuagggcuguuucugaauuuccggaggacugucacgugggcugaagaucuggcgaccaagggcacgugggggaugaggagugagcccugagccugccuggagcucagcacagaggaccuggggcggugagccagcagcgugggguuaccgcccagcucggugccgccagcaccgugaaccggggcacagcccucccucuaugcugcucagugccaucauuuuccccucccaugacauacgacagcagggaguugagugguuuguuucaucucuucuuaagaaaaaguuaaauuuauaaucccagccccgaccuuccuuguaacucaugugcucauccuguuaacugguuuaauauauggcaccacuauuucauuaaacaacauacaggaauaauuaguucagccacgaugccucagaacaaaagcccuugauuuaguuuaacuuuauaaguugcucucuuuugaugugcaagagcacaucuggggucuuaaagaaagcagaaagaaaaauagaagacguucuggcaggcuggggguuagaguuuuccaagcagagccaguaacccuuugguaccaggccucaauagggcagcaagggccccgcagaagcagugcgugcugcuggcugggggacgacagccagcauucccaggaggucuguggcugucugcugccaggccaggagaacccguggguuuucuuccuucauacacacggugugcucacaugcagugcguccccagacuuguaagccuggccuguucuccgccccgcugcuggagcucagacgcucacucuggccuuuccuacccucagcgugugcuuggugcugcugcaugccaggcacacugugagaacuguggacaugcucagggaucagcacaagggccccucuggggcuggcguccucuuccugucauuacaguuugcuccgauuugcucugugcccagagucuuuuuccccaucaguccucuuuccacccgggcuaccacuggagucguucugaccuuuguacuucaucacuccucaccccuguguggcaucucacgguauucaucugccggcagaggagaguuccagcuccuuggccugacccucgggcuuugcacugccuggcuccugccucagcugcagccauuugugcucacguaccauucucucgccggcugcugaccaguugggcccucugcaggccucagggccuuugcccccuucagccuucugcuccagcugcuccguccauccacaggccuggcacagauguccccuccucucugagguuuccucccaguucccugccaggugguaaccaugguuccuuucucagggcucccccacccuccuugccacacuggggcagcccuugccaugugggccaugggaacugguuguuaggugacugugcacuccaggcagaggcaggauggaguugugccugguccccuguuucucuagacauggcauaguacagggcauacaacaggcucuguggacaggagcccaucuggcacaguggggagagccaggccgucagccugcccuggcccagcacuugcugguggugagacugcaugaagcuugcauggcgcccucccgugauggacugcugugaggcaagggggguuagaaaggguucagccaaugcccggaacauaguuguugcucgacuaguggcaagugcuguccuuugcaaaguuuugcugggacaacuuucucauagacuguguuccagcugguuuuuuaacugagguggacugagugacuguuuuccaucucuggcuuuugguuuccagagagccagguugugcaguggggacagauguccuggucugccagcugccagcaggcagcagccauuagcucccugucccacccguuccugcuccagcacaugaugcucuucucccugcacccuucacccaggacagcagaagguacaggacccuugguucucucuccuaauuaauggcagagacccaguuagaaauggcgggccccucccuaaccucuccacagccauuuguaaguccagcgagacugcggacugcugucccugguggcccugguugcaagcagcucccuuuguaacaaagucagugucaccuauuugccagcauggcugcccauggcaagccauucuggucuugccuggagugucacagacaguaucccacuccucuuccugaguggccguguacuaacagguaacagauggcagauguguagacgagcagcgguugaugccuggcuucgccaccgagggagcacuugggccaggcaccugcguguacagcagcuccuuauccucacaucaccugcaggaguaaggcgguuuuuaccccauuguaccaugaagacucagaggcccagagaggagaaaugacuugccgguguucaaguccuggacagggucugaaucuagguucagacagggugcaacacaugaaguuucugcccuuuuggcuccucgggaauucuucucaaccaucagaaagagaaagccuggggauuuucacaccugucccaccuggaacauguuucauguuaagugccauuccuuuccccacuguguuuuucugagguccugaccccccuccaaccccuugucccauuuucuguggcuccugacccucaaggcagaaguagcaggccagcgggcgggagccagcuuacccugccugcugccucaccaggggacagcaggcuucagaggcucuccuguaaucucucuauccacacagcccucauuuuaauuugcaaaauugaagccagaucgagagcaguaaagccagaggaugguaaauauucaugccucagugagcgaggguggcuccauuaccguucugagauugagagaauuaccugggggauuauguauauucaugggccgauuuuuauuugcgauauaacaugacucacguuggccuguguguuacagguucuacccucaacagacuuugcacaaagcguaugcccuuaagcuucugaaagucaucucaaguggauugcccaucgccuucugccuccuaggagacaggucagaauaauaagcacaccagugaccaaccagggguuuccaugcacuccucucucugccuuacaagcugugggcacuauucuuacguccaggucacagaggaggagacgaucugaaugccacaccauguucuguuuauguggcugucccugcacugugcugccauccucucgacugcagggauggugucucauucuguccugugugcccagaacauaauaggugcucaggaaauggcugccaagggaguagccccucuugcaggccugcucugcagacacgcucaguucugccgcuggccccuggcguguguacagcaccugcugcuggcagcacagguuuggcccugcugauuggcugggugucuggcuucaauaggggcaggucaguguuccuguucauaggacacuguuuacaguguccugccucggugcacagcaggagucagcgcacugcagccugccaccuguuuugauaaauaaagcacugcaauggcagagucaaguaguugcaacagagguuguguggccuccaaagccuaaacugcuuacugucaccuucuccaggagagcuuguugcccccuggcuuguaggcuucaagggcacuggggcagagcgccacuccucugagucuuuucuugaugccagugcagcacacagcuuaucucuuuuacuuucauugucaccauaauccaaaugaaguugggaugcucaucuccauuuuauugaugauaaaauaguagcaguaguaguuuuaaucgcuaauuuauauugaacaacuucuaauuuuuaaagauaccaugcuaaucauuucacguggauuaucucaauguaaccucacaaaugcccaauuaguuagguacauuuuccauuuaagggaacuuagagaggugacaucccuggccuggggucacguagcuaauaugaaggauuugaacccaagaagucugacuugaaaaccugccuuccuaaccacuguguuaugaggagaaaagguugcuugccaucaauugcucauuuacugaacuguuguuagcacuggcagcguaccaggcccccuucuggguguggcagaugcaaagaugaauuagagugaccauucucucgaggaggucccuguaggacaaacaagcaaggcgguagccacuccaccaguguauaaguguuagaacuggcuuggcccuaugaggaagauaggagguuugcagacuccuggacgggagcuuccugggcucaugccccacuccgucacugcuggacuaguggccucuggcuagucacccaaacucugggccccaguuuggucaccuguacaaugcaggacauaacgggaccuaccucuuaggcuugcugugaggauugaguagguuaauccaugugagcuuauagaacacugcccagugcugaugaccugaguggagguggcgacaaaggcagggauggcacaaauaugugugggaggcccugggggugccaggcagccuuggaaggcugcugagaggcaguggagcuucagagagacugggagaggcagggucaggcaggccaaggugggagacaggugggaagcucugggggagagugcugugcucccgggaugggcuggggcaaggagcugagccagggcccugucagagcuggcuuggaacuggcuuucugcuuguguguuuucagauuuauaauugcucucaugugccaggcuuacauuuucugagagggaagaagagcugccccagcugcugccaaguucugccuccaugagcuggcccucagggggcagccacaguggguggagagggggaaggacccaggcaaggauuuuaugaccugucccucucccuuccuguucaggccucugucccaggcuucacucccccaggacagucucugggcagaccacauggggugcauccugcuagcuaggacacuguccugacaggcuggaggggccccugcugccugcccaggccacggcacuccuagccuuucacuaugggcgcccgccugucccugcacuggcuuuccccugccuacugugccccucauccaccuuccacccaggaagggccuucccaggagcauguauuccauucaguaagauaaggugccagcacugggcugccugcugggucugcacugguggcccauccuugccccgauggaauguccagugccauguggaagacagacuuuaaacaacagugggcccugucaccacaaguggugaggcugaccugaggagcagccucugugagaagacagcagggguuuagaggagacuggggagccucccgaggcagugagcugggagcugaagauguccagauuggcagugaggggagaagcagugagugagggccagcgugggggagcagcagugcucguucacacagcagcaccgcuccucucuguccccucacugaguuuccauccugguacucuagggcuacuuugccuuuccccaggcugguaccccucuauagcaggagcaguuuccccaugaauugagaauccccagugcccagcuuggggcacaugugucaaggaaggagcuugcauuugucucuccuggggcuguugccaugacggcccguccagguucaaaucccagcucugccaccugcuggcugggugauggcaggcaagugacugaagccagcaugccugcgccuacuugcccugcagcuuguggagggaccgugucccuaccugggagccccucaguguggugcccacauggggcaagugcucagucaauguuaguugcugucauuacugcugccgacaucaucaucacggucaucacaauugucaccaacucccuccagggaaaguguugcucccaaaggaagcaaggcugacagccuggugggguuucgaggcuuuacucuugggccuugagaaccuaaagacacuaaaggccacucaucagcuuccuguggcauccguggccugaaugggcccaccuuagcccaaagucccauccguuaaugcauugccagaacaugugagauugugagccguucagacaugagaguagcggcugagcugauggggcagagacucagaguggcccuuaaugguuggucaccuucccugggcccuuuaaggcuuuggauccagagcaggaggugccacaggggcagugagagcugugggagagcuggggucugcagcccgaagcacaggggugguuuggaccuugcugccaccccguccccaccuuugccccugcugguccucuggucuuucuuugcuugacugacauccagcugucacuuuguuaggaaguacccucugacucugcagauuggugggggcugcuuuucuaccccaccccggggcagaguauuuccuggcauuuucccauucagaguauuugcuuaacauguuuaaaguauuuccauuaaccuuagcuacaacugauaaaguuuuaagauauuuaauauugacaccccaaccucaggguaaugacuucugaaugcaugacagcuuuugggaagagcugucacauaagugguguauacugguuucugcacuuagggguaguucacauacuuaguuagcuaaaucucuccagauaaccaggaaaacacuugucagcccugagcuuugcuuguaccuuuggagggaucucuugcauaugggaaaugggaacugcuggcagaagccgagccuccuuuugaguccaucugguuacccaaguucuuggagccguuuucuccaggcggauucccugagggucagacacaguggaacgaagggauccuccuugggcugugguggagcccaugccauucugucggcucuggcccggaacugaccuuuguuauuugaagugcuggaaacagcauaccucacuucacaggugcagugcuucccugcccucccagcccuagucuuuuaauuucacucugucaauccuaacacgaauuacucuuaccugaguguuaggugcugugcuuggccuugacuucucgccauagccccacggguguuauuauccccuuuuuacuaacaagggaacugggguaaagagcccaaaguuggccagccaggaggcaguagaaccagccagcaugauucguuccagagcuggagcacuuccuccccugaaggagccagcccccagggcagaucauggagaguaaacaugacccuggaaaaucacuugggcggcugccauguugaaugccagcccauccucucaguagggucagccuguguuggagcagccugguguuccuucagcagagugaggaugcaggaucagaagguacagguguaucucugagucugagcgccucccccccuguggcaggggcucccucagcugaggcuugcugcagaaaccagaccguugaaggggcggugggcuccccacuggccuccaucugcucuggggaaggaggcacguguagccauggacacggaccucucacggccugggucccucagcugaauucauccucaccuugcauacucuuuggucuggggcugggaguggggugaaugcuaucaugugccccagggcugaaugccgaagggccagcaguugaguuuucuacagugucaguuuucccaagggcaguuaauuccaaaccucacuuuuauguuaaaacaaacaugaaucuauuaugacauagaaugcaaaguuuccaugaaucuuaaaguccaaaacuugguauuucaaagaauuucugugcuucuagcagucagcuucagggauuuauucuccucugccauggaguggggggcuucucugugggaaagagaaacacaucaugcugucuuucaggacuuccuggcccuccauguguuggggugucagcacacuguuugcacuugaggauuccaggucccauggaaaauacagauuucaggugguucaaugaaugccuuacuccauggaguuacuaagcgcuuucccugagagaucccagggaggagagagagagauccaggaggggaaaguugcucuuuuauuuucugauagccaacuuccaacccauuccauccugcacgacagaagagugcacuuucuaccagcugcucugcccgccuguggggcacaguuguaggccuagggcuuugcauggucuggcuguaccaggcccucaauucuuuuugguggaguuaauuccaggugauuuguuugaguuuaagauugagacacugaauguuuccuuaaaguuuuaaauaugcuaauacuaaaggcuaaacuuggaaaaugaaaaagaagaaauagaaaaauagagaggagaaaaacauccuuagcacaggguaaccuuccuguugcuguugccagaccucaaacucaaggcugccucuccgucccagacagacuguaccuugaccucuauuucaugguuagaaagaagcuucauaacaaagagagauaacggccaguccgugcacuuguucuucacacaggcagggcaggcccccaacaucccucgcuggccuacucucugccugaaggugggaugcaucaucccagaguggaccuggagcccagagcugucacugcuccccgugccauacagucugugcagacccagccaggcuuuuguuccuggggaagggggaagggggaagugaucucccuguugagccuugcugaggacauccaaguugucuuuugugacagcuuccucacuuugcuccagauuuggacccaagccucugugccucaggcccagccauugcuguggccaaaugagcucccacuucagucaggccuugcugggcuugggucugaguuucaccauuuaccagcugaggggccuugggcaggcuacugacucucaguuuccucaggugucaggugguggugagguuggagagaguggucucaggugcccuguagaaggccuguucugcagcaggcucuccgggaagauguuugcacggggaggaauuccuaagagucuuugcagccucaggagccaggcacaacaccgagcuacaaccuggugggauggucuuucucuuuuaguuuagguauuucuuuuugaaccuuuucuucauguaugaaagcaaugugugauuacuuuagacauuuuuguggaguauaaagaaacugggaaaaaaaaccucccccuuaacuauaguuaagacuguauuuuaaauacauuuuuauaccuugauuauugguucaguauuacagagaaaacauuuuccaugcugauaaaagugcuucauauauuuuauuauguaacaccuugccugcuguuuuauuuagccauuccucuauuguuaggcagcuagauugucuccaucuuuugccuauccuaaauaaggugaauauuuuaucauacuaaggugaauauuuccagugauccaccuuugacuuuuggagaguuucccugagguggaauucuuggacaagaaauguagaaaugaugagagcauuccagaaaggcuggaccagugugaucuuguguggugcugggggagcaucuggaggggguguugagggauagaagcaugagggguuugucauugucuccagacaacugcagugaggaacagaugcuugcccccaggcaccucagaguuagggcuggugcgcucaaguuuaguacaaaauauauuggugucuucagagugccuggcuccugggcccagccuguggugcccuccugcucucuggcugcugggccaggcacugcgugaagcuuggauugcaccucacacuuuacugcauugcccuuuuuauuuuguggagaacugagagacucccaccaucucuuuugcccaccccaucuuggcaggugguacagcuguuucuguagauggagggaaaagauagucucccauccugggccaguuaccucagcaaggagcaccucgauuuucucauguggguugggcauucuggcuucucaucuuauggugguggcuuccagguguugcuggggaaggcgagacucaagccagcagugugacagacccagccaggaggcucagaagugcuucucuuccucccagcaccugaccccuccauuuccuccucucagcccagggcuggccucccccagagucugccucagaguagacugucagucuguauugaguaaacugauuggaacuggauucuauuacauuuaauugacuagaaaaucugucuuuuuauucuuaaauaguuaaguuuuaaucacacaaucaauucaugaauuuccuguagcaaaacugaaaccuuucaguuaagggaaaaggaggccuguugcaucacaucccauccuggccucucaucuagaggagauccuguuaauucuuuuggguuuaaccuuccaaacccuuguucuaugcgcugugcucacagaaaugcacagcacuguuguguaaaugugugaauguguggcaucauauucugagcaguguuugcacuuuucuggccaugccccacauggauucucagagaccuugccucaucacuacacacagagcuaccacacugccugcccccacgugugcucaucaguguggacaccucaugucacacaucgccauguccccacugauggacuuucagacugcugcccugucuuugugauuauucccugugcugcacugaccaucuucuuguguacaccugcacagcgcucuccugggagguaucaagaacucugccucagaccugcccuggcaccucccugcacuuuucccauccccccccccccaagguugucccccucucucccgaucucauuuguaugucauugucauuccagacccaauucagauguccuccucucugcugccucccucauaauacuuucauauucuaaugaaauaugaauacacaucauauucuaaauauacuuuauacaucugucuccccagugagucuggaguucggaggacaagggccauggcuucccccacaucccaaggccagcacauggccugccauggaguaggugcuacaugagcguguugaauuaaagccaguggaaggaauaagggagaugggccaugaagaaugagugcugggaaagaugugcaggaaggcauuccacauggauaaacaguagggcagaggcagggagugugcugggagaccagcccagagcucuggagagcacugcacagaugcaggaggaaggccaggggugagcaccagggcacccggagcccuggcagguuucauugaggaccuagccugacccaggcucuguacuagggaaguggccuggcaguacauggaggagggggcggcugcuaugggugucugagcaagaagugaggcccagugaccagaaagagacugugggugugaggcaggcgaacucugggauuuguuggcucgugggcuaugggaagggcgcccaugaggaaggagccaaaggcugaggcuugaaccgugaacaagggcugggggccaccacaguucacugaggacuugguacuuacaagggcucagggagacccuaggcacaugcugccuccuucaauuuucacagaaucccuguggcuaggaccugguacccuuagucuauuggugaggacacugaagucuagaaguuacagaacuugcccacagcucagagcuggagccacagcuccaaccucagugaaucuggccccaaguccagcaugcucacugcugacagugggcacccacagaagugggccaggccuaaguggggugggaggugagugcaggggugauucuggcucuaaacagaaucacagucuaacagccaucuuguggaguaaaaggagcccaugccucaagccacaugcgccguccagaugucagaaugcagguaggcaagguccaggccaugggaugagguguggggugcaaauuagaugcccuggugcaccccaggaccaaggagugggccguaagcccauugcaugccugcccuuccagcaaguuguaaggauaacaauggaaugucauaaagcucuuguaguuucuugucuguaaggcuaaaguuguaauaaacagaaauuaugagcaaaagaauaaaccuagagagaaagucaguucuuagggucaccacugcuuuacaucccuuggauuacaagggcuuuuaugccauauugguggcacauagggaacugccccucaggggguggggcuggccuccuggggcuccgagccuuguauccaguguccacugaggccccacagcaccgugccaggugagagugccucgccguuuuacagggauuaacaauguagguggcauuccuuuuucuuugauccaccucaagaaauaguggcagguugaauuuugaauuugaaaauacaucccagaccuagcagcccccuuuugcagccaccucagucccugggauuuggguuuggaauaggauacccugugucucaggaggcucgcaguggcagcucaauuggaugacugagucccagugugauccuuggcaccccgccucucacccuccuugcucacugucacagugaugauucucuuuucuucuucccuauuucuucuuaucauuacugucauggacccaaaugccuucaaccacucccccuccagcacccacggagggagagcgaggcccaggcucagcugcugggcagcuucccuggggccccugucucugcccuuggcuugcuggucauacccuugucuagccuugcugaugcucuggugccagcagccacaggccagugcuccugcaggaugugaguccaagugauguugccccugcacagcugcacuggggugcaggggaucaucaguugagugugacggacguuccugagcaugcuccucugugccagggacggagauuagugccacccagccccacccccccccacccccgcugaugcucucagucuggacaggaggcaggagcuaaaggcauggcuacauagcaaguaucggagauaaagugggggucaaguggcgggggcugugggggccaaggugggcaggcagcaugaccugcucuagcuggaguaaggcuggaaggacgaggaggggccuggcagucaggaagccagcucugcccaggcacagggcugggaggcaccaucgggccucuaggccaugaguuggacuuggcccaagcuuagggugcugagggcagugcugaggagugcucaggagccagccagauggccacaggccugugugcccauccagcagccugcccugaggggcgggagcugugggagccacacauaggagggacauggccagugcugggcuuucauaaaccuggcugaaggacaggguagccuuggaacuguggggaucuuucuguccaccuuggauccauuccuuuaagacccagacccaccugggcucuuugcucaggcccagggcccacaggugagguacuguucacugcuccauggcggugauggcuuuucuggcucagcccugaaaacagagcuggaucccuuggcuuaccucccaaggauuccuuacccccuaaaaagcccagggaugucauuaaaaacaaagucccaguuguauagaaaacagaagaauccagcauugcuguaauucauuuaaaguuuuaugggauggcaaauacuugggguggcugggaggaggagcguaaagcucccuggugaagcucccugguaggccccuugucacuuuuaugguuuuccauuguugcagugacugggagguuaaucacgaggguuuguuuguaaggucgccacagauggucaggggccuuugcugggccacaugguagaaagccagaucauucccuuccucucagagugugccccauguggcaggcacugugcugaggaucgguggugagcaaaauaaacccagccugucuaccuggggcugucugcccgauccaggaaacaacagagcgcacaggcacacacuggacagaugcuaacagguuacggggcuuaaggagcguccuggucugccuggagacucagaacagguuuugugagcuggucgggggaccccugaggucucagugagugggauucagcuggguacagggcgccacaggggugaggagagcugggcagggcagcaguguuccuguggggcuccagguaacacuagccacgcugugugcaagggccuuacugacgcuugggaauccgagcccagccugggcacaagggggcagggggcaucagugcaucuccccucuuccccgcuuccucagugcaucuccccucuucccccuuccucagugcaucuccccucuuccccauuccucagugcaucuccccucuuccccccuuccucagugcaucuccccucuuccccauuccucagugcaucuccccucuucccccuuccucagugcaucuccccucuuccccccuuccucagugcaucuccccucuucccccuuccucagugcaucuccccucuuccccccuuccucagugcaucuccccucuuccccauuccucagugcaucuccccucuuccccccuuccucagugcaucuccccucuucccccuuccucaaugcaucuccccucuucccccuuccucaaugcaucuccccucuuccccccuucucagugcaucuccccucuuccccccuuccucagugcaucuccccucuuccucagugcaucuccccucuucccccuuccucaguacaucuccccucuucuccccuuccucagugcaucuccccucuuccccccuuccucaguacaucuccccucuucccccuuccucaaugcaucucccuucuuccccccuuccucaaugcaucuccccucuuccccccuuccucagugcaucuccccucuuccaccccuuccccaaugcaucucucaucuuccccccuuccuaaaugcaucuccccucuuccucccuuccuaaaggcaucuccccucuucccuccccuuccucagugcaucuccccucuuccccacuuccucaaugcaucuccccucuucccucuccuuccucaaugcaucccccuuccuuucuccccuucuccuccaugcaucuccccuuccuaaagaguugugugugucacugagcaccuggcucacauaguggcugagguacaugcacuuugccaccccuaggaguugugggugggacaguagauguuggggagacuccagagaccccuucuaggagagacuuuuuccugguaauuggaaacugcacacuaagauagcaaugggucagcacaccuuaucuauuagacugcaaaaauuuaaaggccugcagccucaggugcuggggaggguguggggaagagguuauuucuuguacugcugguggaagcguaaccacccacuuuagagaaaaaucuacaagaucuaguaaaacugaaacugugucccacaacaccacaguuucucauccagauaucuaugcuagaaaaacccuauguauauauacaauuugauguauaaagaaauggccaccgugaaaucauucuaguaguauaaauagcaacucacauguccauuaaggguauggauaaaugacauauaaagaaauacuauacagcugucaaaaaagaauaccauauauauguuauuguauguuuuuugacagcugcauauauguguguauauauacacauguuauauacacacacauguguaugguaguauauauauguauauacacacacacaaauaugaauagaugucaccaauauauugcugcaggagggaggcaaguaguaaauuaacuacaaacauggugccacuguuuacacuaauaagucuauacaaguugaaugucccuuauccgaaaugcuugggaccagaaguguuucgauuucagauuguuuuggauuuuggaauauuagcaugauauacuuaacagguuaagcaucugaaauccagaaauccaaaauccaaagugcuccauugaguauuuuuuauuuuugagacggagucucgcucugucacccaggcgggagugcaauggcgcaauaucgggucacugcaaccuccaccuccuggguucaagugauucucccaccccagcaucccaaguagcugggauuacaggcacccgccauaaugcccggcuaauuuuuauacuuuuguagaguugggguuucaccauguuggccaggcuggucuugaacaggugaccugagguucccucucgcagccccagagguggugcuggggagcugggaucucaaccugcaggggcagcgcuggcagucuccagggcccauacugcucuguccucaugcacagcccuagguuugacuuguugugugugagaugugauuaaaugcauuaggcgggggaaaaugucuuaucuguacccagccuaggucgaagaagagggagaaauaagagcagccaaauugaaccuuauuaaacaaaauugguuaggucugauggagccaaaccuagacugaucuuuaaaagcuuauuucauuuuuccccuccagccugaaccucuuugaauugaaguaacugauccugcuguaagcuuauuagugucaaaccuuguguguuucuuuuccucuccgauuuacauuuuauuaaguaaugaugaaguugcaaggucccaacccuagcccuuggcacaaccaggagcuuccaggcucauuaguggaacaaaauggauaauagagguccaaucuuauuauagcugguacauuauuacaaaaucucugcacauuagaaaggcugcuaagcacaagucuguuaccugcuucacucaagcaucuguugauucuguaaaaugcuggagggaccccccaacacugcuguuccuuuaaaguuuguugugauggugugggcuguccauuucuuaccugacagaaggagugcccauguuagugauaucgcugugcugaauuguguuucaucuuggacuucugugguggaguguguuuuucuggugugauguaguaagagaauaugugcuuuaaugacaggcagauugcaugcuuugaauaaaugucuuaaccucugggggcuucaauuuccuugucuguaaagugagaucaucauuagccacuaucauuagaagugaauggaaucagguguguaaagauuuuccccaucauagguauccaacucuuucuccaucuuccauaucggcccugugguaacauaaugcagcucgugugcacuucaguugagugccuacuauuucaugcaagaugcuguggagaacagagaugagcacaggaugacuccaccucaaacuguuccugcuggauguuuucaguagccucagaaagugcaugguaaagggaaaccagaucaugcugggcacacuaccaugcagaauccucaaaacaccagaaagcuaaguugaaagacagucgaaaagccagaaggaguaucgagcucaucgggccugggagcagucagaaggggguguucauuuguucucucauccacuugaucagcaaacugggcauauugugcuacucaaaaacaggaaacaugggagguugggagggagggaugcagcugagaguuagcucugaaaacuccaugggcaaguccagcagggagagggcugcugcugaccuuccccaggguagcugcuggcaugagcuuccaggugagacagccuagacugaaccugccucugccacaucugagucucgaggcaggccugacuguccugggcuuugcuuucucacccgagaaagggggcucaucuuacuugcccauuggcauugaugugagagucacacugguggcgaggaguccccugucuugagucuucccucucugcuucugccccaggagccaucuuuuugggcucaggcugugugggcucuacauguucaaucacucaggagccacagcugccugcugccugcugccagcacccugacuggcugagccccgagucuggcagggcagggugugguucugcucgacugucagagcugaggccguggaacaucaggccugccuugcagucccagcguuuaucgucccaagucucagccuauuuguuuugugaccuuggagacaucaaaaaccucuguuucuucauccauaaaauugaaugucaaaauauugaccugccugugggguuuuuuaugaagaauaacugacccagaggauggcaaagcuucuuuguuaaucagaaaggaccaaacugcuuagcaagcacgaacuugaguuuuaaaaaguguuugcuuguuugauguguuccucccucccuccuuccccagaagugcuuggugcuggagggaugggaaggaugugagggagagccucugcaaucacccaugcccucuggggagcuaggcucaggggacggaccucccagaggccaccauggugguauagggcagcagcaccucuccccauuccaccucccagccuucucugcugcccuucucacugcguaccccgccugggacacugggggccccugggcagcaggccccagcccuauccucccauuugguagacucuuuacccuugggguuuuguggauccucugagggccuggccagccccaggaccacccuguuccugcagcugugaauguggagcuugggcccaggaggagcuccccaaaagagggcccauguggcuuggcuccuuucaguuacucuucccacuugcauugaggccucccacauuccaggcauggcgcugggcacugcagauagaaauggaaaaaaacaaagcaaagccugguccucauggagguuccauuccagugcgggagugacagccagugaacaaagggaugccaagcguugggaagcucuaugaugaaaaaccaagugggcaaggugcuagagagugacagggauaggccaaugccugucucuugcuggguggggugacugaggaggggcucugauacaguggcauccaagcagguaugggaaggaagugaggaagagaggaacugcaggugcagaggccaugaggugggagcaugccuggcacauucagggaaugggaagcaaggcccacaugacugaagggaugugaacagugggucggggucacagcaaauaaagucagagacaucacgggggcuguguggcauugugaguccuggaaaggacuucagcuuuuacagagugagaugggaggccaguggagagccuggaggcaaaccccagggucacaucaucuguguuuucccaagaacaggaagaacaggcuguggggaagaacaggcucuuggaagaacaggcugcgggggagggggcaacaauccaagccaggugaggcugggaccagggcaggcagugcagggacaggaaggggucaggcacuggaccuacuuggaagguagagccgacccugucuccugauggcugguuacagcuacaagaggacaaggagaguccagguggguggaagccccagcuuuuccccugacaucagagcguugcccuggagaagcagaaggcugaaggagacuuuagguucugggcguaguaagcugggaugccugucagccauucaaagaggcaguuggguguaagucuguaugcucccagcuccagucuccaccuccccuggaacucagacgucugugucucucuggcagccucagagacagcuccuacuugcagaacucccagcuccccuccccugaagcuggcuccucccugcucccaccuagcaugaggcagauccucaaacuagaaaccugggagcuguucuuuacacaucagcuguucuuuacacaccagcuguucuuuacacaccagucucuccuuguccccacaucuagucugucaccaccaaaauaugucuugaacucugaguaucuuccuugcuaauuuccauguuuccuuucuuacuucucuaccuccccugaaucuauuccccaaacuguauagccaguuugcaucuuuuaaaaccgcaaacuggcagugucauuccucugccauccccugugccccaucacugguggcuuccuggugcuuugucccauggcaaugguggcuggcccaugucuccaaccugcugccucccuggaccaccgcaccucagccagcccugccacccgcaguuccacugggggccugguucuuccccugcccagggccuuaggccugcucugcucuucccucugccuggaaucccugugggugguuuguuaccgaucuggucuuggcuccaaugccaccuccucagggaaguccucccugacuacccacaaugaauuaggucucccaguuguucgcucucauacagccucauccuuuuuucucacaguaccucccacaguuucauaauuccucauguauucaguggugaucuaauuaacaucuuucuucucuagaagacagcagacuuuauagaacccaacugucuaaaacuaucuguuuugcucguccugcuggcauuccagagccugggccugguccugagagaagguugcuacccacguguugagagaaugugcgugcgccaccucagcugcgccccguggacauuagcgaauguuugaggagugaguuauucaguagauggagagaggcccucaaaguuggcuagaagauaaaugacuaaaaggaaagccuguuuuucucauucuuagguugguaaaauuaucuacuuuucuuuaucucugguguucuaaaugggucuucuguuccgaagcgucccucagugagcgugggcucacugaccaccccguguggcaaugcugucugcaugcgccugugagaacccaugggagugccaugcugcccuguccccaucuuuaucugcugcacaauuuccugucuaggcccuuaaaaucuugauuugcacaguuauuuaucuuugugcucuucauggugcccugguaaggcauucuuuaugauuucaguccugagaacacaagcccuguugaaaagagaacaugcuuugaauaaagccugcuugacguucggcuugauggggaggaggagggggaaggggcaucagggcagcaugaggccccuggccgcccucucucacaggaaggcucauaaacacaaggaucucgcucaagccccggcacgucuggaaucucagcucggugcuuugccagguaugauuuugccacaaggggcauuucuuuuccagaaucugaugcagucacucucuucagagcggcugggcguuuaucuggaccugucacaaccagguuucucagcagcuccugugcugggcacugaggacgcagcauagggagagcacaguccuugucucgggauuuagaagggaagagaugcacauuugauaggccaaaauuaagaaaucuagcagugccaaauguuggagcagacguguaucaauggggugucuugggccuuauugauagaaguugauuuaucuaccuagcaaaguugaacagccauucacccugcaauccagcaguucaacuccaggaacuguguccuugagaagcccuugcacaugugcccaugcaggauccuugugacagaagaaauucauugcagcauuuuccagcaaagaacuggaaacacccccagugcacaucgauaggaguccagguugugcuaaauacacaaggugcagcagauggcaucggcagcaaaugagcugcaggugcaugcacuaugugcacagguuuuuaguaucauaacuggcacaaugccuuauucauacaguucagaaacuuauacaacaaagcaaauuacugauuaggaauguguacuacauauguagugagccuuuacacaaucauacacacguguguauaaaaagaaagggaaugcugugcgccaaauucaaggcagcggcacccucccgcuggggcaggugggaaugcugaguggggaggaccacacagguagguaugaguuaucgauaauguaguucaggggcggaaagggcaaugaacucauggguguuucguauauaauuuaaaucugucggcacacagaggcuggggcugaccuguaaaguagugguaaccaaacagugagucagguuccgauggucagcugugucuggaguuaucagagaagcccuucuaggagguccaugggagcagggguuagggacgaaugggaauuugccaguggaagaaaucccagggagcagccucaggggcaaagcacagagacauucagaagcacagcauuuacaaggauucauucaagagucccuuggcuacguuuucaggguuggggagaauguggggccgaaaaggcuguggaguugggcugcaugguggaggcuuccugguggcugagcuaaggagugggggcucagcccugugagugaggcuuuucagcagauugccuuguggggcgguggaggggguaccaggagaccgccacccaucacagggaguccccauagaauuccagcugaccagaggaucuuccugcucguggcaggaccaugacaagcuuugaaagccaugagguagacgaugggagcccacaaaggagguggugacaaacaauugcuuuaucagagaaacauuuuagaaagccgcacaggcugcugcaggcgccugggagggaagaguugugaccugggccccaccucacugggcagacgacgcuuaguguaaggugauauucuccagugacucugaguaauguucccaaaaaucucauucuccuauugccuuuucagaccauuucagagauguuuucuguuucuuugugauugaucuuggcuguggcuuuugacacugugcgucucacuuucucugcccccugaccucugguuagguaguuaaugaucuuuaaacaaacacuugaguauuauggcucuccaggaaagguccugggcucaugggccauuagcaacacacucucccuuuauccagggagaaaaugaguguucguacacccugacucgguagacagggaugcuugcaaccuaagugucaaaauucucuuuaguuuaacuauuuuugauggcaggucuucugaaauauguuacauauuucucugcuucaaauccaugaacaguuuccucucaucucagagacaguggaucauagguaggaauguuuguucauuucaggaacuuuuauuggagacuuuucuaugucuguuccugauuuacaaacugugaaugcagaaaucugcccaguauaguagucagugauauuuuagaaacagagauaagaucagguuacuccuuugccuaaacuccuccagugacuuccgggccuugcacucuacuguggggcccgagccuugaccucuguguuaguccguuuucacgcugcugauaaagacauacccaagacuggguaauuuauuuuuuaaaaaaaagagguuuaauggacucacaguucugcguggcugaggaggcuucacaaucaugguggaaggcgaaaggcacgucuuacauggcaccaggcaagagagagaaugagagccaaguuaaagggguuuccccuuauaaaacaaucagaucuagugagacucauucacuaccaguaugggggaaagcaccccuacaauucaauuaucucccaccaggucccucccacaacacaugggaauuaaggaagcuacaauucaagaugagauuuggauggggacacagccaaaccauaucagccucccucccugcugucucccuccccacccuugcuguagcccuccugccucgguguauucccagacucaccaagcuacugcccucuuagggcuugcacuuaucaguugccccauuuagagcugucuuucugugggucuucacacagcugucugcuucuuaugcuaaggucuuagcucaaauucacuucuucgagaccuuuaccccacccaggccuucucuaucacaucaccuggccuuguuuucuuuauagcauauguugucuaauauagucauauaauauuaauguagauuaauauuauauaauuauauuaauauauauuugcaugcauguaauuuauauauuaauuuuauauugauaugaauugaauuaauauauauaauuuuuccuauauagguaauuuuguuguugcuguuguuucaagauauuaagcucuuuggaaacagaggucacuguauuucuuccccuagaacagugccuggcacacaauaggcacucugggaauauguguugaaugaaugaagagagauccugcccuaggcuacccacaagccagcaggcagcagauacacaauagacagugaccaugcagcaggcugugggauucagaggggcuggguuaccacuaaggagucagggucaaguucugccacugggaguugggacaggcuuuccagagcagugguguuugucccgggcuuuagagggcaaaugggcacagcuuggccagcugagcagcuggggaggccauucuugggggaggaggcaggcaaaccuggacagagggcuggaaaaugcuagcaugauugauggaagggaggaacuuggagggacuggagccuggauuggagcaggggugaagggaacuaagguagucagggauuuggcugcuaugaccccugccuuucccccagaagaacagugagacuuggagaguggggcccuggcccugcuuugcuggcggcccucggccuugugcuuucagugugguaccugcucugguccagaagagugugccugggccccagaccccccuuggcugguccucacggugccugcagguggugguaagcacaggauucucuagcugcagcuccccucuccuccccacagccccgaggcuuguugguuucaugugcucucuugcuuacuccccaucagguggugaagaaggugaaguccaugcagauguuccacaugcccaucacuucagccaugcaaggagaccggcugggcaucugcgucacccaguuugacccuaagcugcuggagcgcggguuggugugugcccccgagucccugcacacuguccaugcggcccucaucucuguggaaaagauaccguauuuccgggggccccugcaaaccaaggccaaguuccacauuacagugggccaugaaacagucaugggccgguugauguucuucaguccugcuccagauaacuuugaccaggagccuauacuggacucuuucaacuucucucaagaauaccuuuuccaggagcaguaccuguccaaggauuugacaccagcagugacagacaaugaugaggccgacaagaaggccggccaggccacagagggccauuguccucggcagcagugggcccugguggaguuugagaagcccgucaccugcccucggcugugccuggugauuggcuccaggcuagaugcggacauucacaccaacacgugccggcuagccuuccauggcauccugcuccacgggcuagaggacaggaacuacgccgacagcuuccugcccaggcugaagguguacaagcugaagcacaagcauggccuuguggagcgggugagcaugcccuugccuggccccacaccccuucccuucuugcucgggcagcugggauccauggccugacaucugugaugagagccagaaaggcccucagagaccuucuggugccaaccucuguaguuucuguacaaggcaucugaugcccagaauggucagguggccacaguucucucagcuggucagucacagagccagggccagcaccugggcagggggacccccacuguacccaaucccacccagcuaucccacccccacuuauuuacaugguagauguggcacccaugggucugagcaggucugggcucccccacagccagugucagauggcagcgguuagcacuggcuucccuggccugcugcccugaucaggccccacucucuugaccuuggugggcacuguaccuccauccagcugggaucugcccaugugccccugcaagcugcuuauguccagagggaaacacugcccaucaguggugccaggccaggucuuuccucaccuguggacugaggggaaggggcuaaugguggccaggucuuuccucaccuguggacugaggggaaggggcuaagggugccagagagcaagaggaaggaagguacaggaagcugacacagugggagguccagccccuggcuaccuagggugccugaaguucaccaucgcuagaugcaggccuuaggcauguaggugagccagucuaguugaaguaggaugaggcccuggcugugccuugcugggcggcccuuggccuugugcuuucaggguggugccugcucugucccaggagacucugacugggcccugggccucccucggcugguccuguggugcaucagcaccugggcccagugcugggugggaugggccugccacuaggguggacagaacacgguggucucccccaaaguaguggaaucaccuccucccauggggcauccauccccagcagcuguccacacagugcugagugggaauccaugcccaucgggccuugaaggcaggauggauggacagccaaaccuugccgucucuucuagaaggcuagcucccuggcuguggguccaagcggaucagcagcagcuguacugggacaugacugggcuuugacuggcuuaaagagcacggagugcuggcaaccccacugucgggggcucaggcuccuagcaggaggggucugcccugaggcuuucaacaagggccucaguuccucacaggagccugaugagguccccuggguuuagugcaggugccagcacaacaucuggcccauccacggugucacauguggugggcuuccaucgcccacccuccgcuccaggucuccguccacagguuuucuccucugggagaaaauccacugguuuucucgucuggaauucucugucacugcagccccuuccccucccuuucuccuugucuuagguucuuccugggugcuccacccuggcccucuucuuuuccugccccuguaccuagaccugcccucaagugggggacugaggagcaaccccuuccucucccuuccucagacccagagcuuggacccuuagcuccgggggggccgcuggggccugcucagggcuccaucagccuuaggccagccccaagaugcugauugaagaugaaggugauaaagugugugucacucguuugucuagccugauuuauuagcaguguuuggaguauaauuauucuauaguaaaauaucuaugagagaguaauaucccaauugguguggcuccugggucuaauugcucccacucaggccugucaacagcggugcagcagucacuuccuuugagaacugggagggagggucugugaggagcaaguaaacauauggccucaaugacucaugccuccgaagggcugagggaggggccaggagacaugccuggccuauguccuuccaccaaccuggggccaccagcauuuuccugcucaguccagggaggcuggaaguggaagcacaagaacuguaggcaguccacagaagcugaguccaaaucccauauagacaacccugagcagagacaggcuuccuccaaccagggacagccucacagggugacuguggaugugugcagaggugagauccuaugagcccagggcuuuggucgaggaagaaggccuuccugaggcuccacaagggaggaaagggcaugggugcccaggcuaggagcagcucccccaacucgcaacccccugaggcucuagcugaaugggcaccugccuuaaugcuaggggcuggcuguaggcuggggcuucugugccacaugcucuccucugggccccagggcaggaaugagccugccuccugccucccuccacucugucaccacucuacugauuaagcauauacuaugcgccuuuacuagcuacauacuuuauuuugaaaccguuuaauaacccugaggaagaggucauuauuuuuccuauguacauuuuuccccaauuaaaucaaucaaauuaugugcaaauauuuaggaaaaguaauauaugcacaugguaaaaaauuucaaacaagacaauaauuauucaguguaaggaaguuuucuuccuacgaacccagguccccuccccaaaggcagccagacuggaaaccagcccaagaaaugugaagugaccugcccaaggucacaggguaguaaagcuggaguuugaacucaggacuagcuggucucuuuugagucaugaaauuuccacuuugucagacagauucuugcccagugugucaaaagagucugcguucucuugaaaagcucgaaucuccuuggugggagacuuuccuuccugguaagguggaacuuggagaucauacagaguaggcucaagcccuugcuguacccaaaacagcuguacgccuugggcagccauuuaaucucaauuguucauuccuucgaaggauggucuugaccucaucagguuguuuugaaagagccaccauagcuuguggcuucauauguaagagccgacucucaucaggugaagcaagaagguaguguuccuguugcagcuccugagugauuggcugaguuuguuccaaaggggcagcccuguuugcuuugaguaggccccagaucacccagagauuuucaggucaucuugcuugaccaggggcucagccauccgacagacugguccaaugugcaagccugggcuuuauuuacucccagccuuaccaccugcuagugugaaaaguugagcagaccaugagacuuccauguuaagugggaauuuucacagugcugcaccaggguuagaugaaggugagaugggggauugcacauaagguucugagaucagugcuugucuccuacugcaucguuauuguuuuaucauuauuaauguuuaagcucuuagagucaaaauaauaaugccuggagcguggguccacucuuuucccugggacuccauuauuucucuuugaagcacaggagccaaucccccuggucccuaucaggagccacacaguuuugguugaagagggaggggcugagagucugguaggcucaugggugugguuauccagcgcaggggccagagaagugcccuaugcucuucuuuccccaccgugcuuggcugacucuaaaaauuccugggcacaucacaguuacuagucagcuuucuggacaugucuauucaaagaaguuucuggaagaucagagaaucuugaaaaggugaaauccagucucuugggcagaaucuccaccaccuuggugagccagcacccagccuuugcucugugauucggggcaaggccagcacaucuacuuugcaagcacaguuagccuucugagaaccugggcuugggucucugagcuaucucaguucaucacaaagggagacccuggcacuauaccuauguguuaagugagcacuuuccgccaggggggcuuaaggcauauaggccuucugaucccauuuccuauaaaggcauccuucauucauauauucggauguuuacugugcuccuacguuugugccaggcacugugcauacaacaagauagacaaaguucuugucuuccuaggggaggcuaguagugaacaguaaauuagacauuuucagguuauaauaaggucuagaaagaaaauaacagcgugauguaaauaugugaugcugaggacaguuauugaaacacagaagaugcuaauuuccaagccucugcagacuguguuuuuauuuccugugcgucugcaucacuggcucacacuggaagcuggucagguacccuaccaguuguggcuuaacucauuaguauuacauagagcaaacuauggcccaugggccaaaccuaaacaacugcucuugcuccaaaucuaauaaucuuaaacaagcuuauuuucucuggauucuucuuucagcugcuucgaucaaacacaauuuaauuaacuuaccauugguaaauggcuuuccuugcuuggcuaacaaaugagccacccggaaaccuacuuugguugcagccuuauucuuauuuuuuauuguuuugcgugucugcuaugaugaaauauacuguuuuaaguuuucucuuuuuugacauuguuuuucugugagaugggaauaucgugaugucaguguaucucauauucuguuaacacaacuaauaacaaacacaguacuuugccauguaaugugauaaaauaauaauccauacccacugcgccuuaaaagugugacauuugaaguccacuuuucuuguuuucaugugauggguaugcaccaguaauaaaauaaauaaauaaauaaaaugugucacugggugagguacugcaaguuguaacuauguuaccaccaucuguaguuuacugagcaccucaucaggucucagacucagcuacucaacucugccacugugacacaaaggcagccauagacaauauguaaacaaaugggcaugacuguguucccauaaaaccuuuuguugugaacauugaaauuuaaauuuuauauaguuuucacauguaacaaaauaauauucuuuugauauucuccaacucauuagaaaauauaaaaacccuucuuaggucacaggccauacagaaacguaucaggaagaauuugacccuuuggcuauaguuuuccaaccccuaauauaaaugguuaauagggcucuugaaauagaaugagcacccugcgaggaaaaugcuaauaauuaucugcagcugaaagcauuaaacccucucagcaguccuuaggaauugggcuuuuucuugggugcccacugucucugugcuaacacugggaugcauauacuacuuuaugugcuguguuuuuuauucuuggauacauuugauuuuuucacauaaguccacguguacuucuauaagagugugacuuguaauaaaggguuaaugaagaaaaaaaaaaaagaagaagagggagcuuggauugguagagacauccagaggucucaccugagugggagaagaaaagaagugaaaguguucuaaauggcuaaucuuucuggggagaggguuuaggaaagacuacuagagcauauggugauaagggaaauaguugguauccuguuucaaaguaaaaauauagaaauaugugcaagauuuugaguacagagaaagggaaagaaacuauaugaaugcagugaaaauguaauagcacuuucacauucucagaggagaaacuggaaugaauuugauuaaaccaacaaaaauaaggaaaaaagaacaauguuaauaaauaauaauaauaacagaaggaacaacauuaaguaucagucauuacacuaaaugugaauggccaaauucuauuuaaaugcuaacgcugagagauuggguuaaauacugacaaagguaaagaaggacaucauguaacgauaaaaggcucgguuauaaacuuguacauaccaaacauaaaaauaaaacaguagaaaccuagggacagcuugauaaaagauggaauuauaaugauaggguggcacuucagaguccauauuuuaaaaucaggccuacuagacauaaggacaacgaggcagaauauauucaauaagcuugauuuuuagauaaauguaaacucuuacacuccuugaauagaguauacauuuuuuuuccuauggcuuggaacauuuacaaaacuaaauauucagcaguugacauuaaacaaauauuuguagaacaucuacuguguguugucuuaagggcuagggagguaacagugaaugaaaaagacaaaaucucugcccacauggaacuuagauuguaguuguauuuguggccacagagaaaaaacccuaauagauuuuagaaaguaaaaucaugaaccacuaaaaugagaaacaaagcaguuauauauagauauaggcagauauggagagauacaaagugugcaugcgugugugugugugugugcgugugcgugugugugugugugcguguguguguguguguucauucuuucacauauucuaguaaauugcuccucauuugauuaaggcuguuucucauacuaucauagaauguugaaucuuaguaauaaaauuuuucucuuuuucaguguucuuucaaucuuuugauuacuuugcagagaaagcuuuagauuuguucaaagaugucuuuaacaguccucuauuacauucuaaccugcuuuuuaacaaauggaaaacaagaccaagauuccagagccuucuaguagcaauaguauguaacuaggauuauucuuuggggguuuuuuugcaugguauguacuuuuacuauuagcuuccucuguuuaugguuagugacucuuuucuuuaggauacuauauaaagucuccuuuccaggcagauguaaagaaauauauuagguaaauaguaggucggguaugcaaagaucuggcaaaaaugauguggggugaaggauguguaaaagccgaggcuggaaccacuggguccuguccccaggagguuacuugcaucucagccacaugcagauucagaccagcugcuccuccuuuagugauccaaagccucauagaaaacugggucuuucuaguggaggacagagacucaugccugcaucagaggaauaugcagagggcuaggagaggaaacaaggaacucugccaaggugggaggaaguaggcuggugagggaaaagcacaaaauggugaccuuuuaaguguaucuuguaagacuggaagguucacugcacagacacuaggggccauguggggaaacaggaagguggaggaggggcauuccagguccagggacugcuucuguaaagcauagaggccaaauaaugccuggcccugggcaucugggagggcagggacagggagcuuaaagaggcaggcagggccagccaucgaagcuaggcccuucacccugcaggggggaguaaugcagguugggggcuaugggggguguucuaggucaccugugcuagagaaauccuuggagcagggccggcccaggcagccuagagaggggaggcucagccucucucaccuacccuucuguaucccagucucgcccugaggcucugggcaccuggucgucuggagccgcagagcucaauggucugggagccacucacccuauggagccaggcuucuccacuaguaacaaaucaugacuuuucaggacugugugaacaugaaggaggaggugagggucuggugcuuaggacagugagugcucugcaauaccugcuggcuuccacagcagacuucucacuguuaccacgccccaggaugcccuccucaccuccccaagccaccaccuucucaugggucucaccauagcccucuuugccccuggcagcaugcauagcuccaccccaguaauuuucugcaaaacaaaggggguccugccagcucuuacucagaaaucucuuuuagguccacaccaccugcaggacaaagacaauacccaaccuuagcauguuagcuggcuggcaguugggucccaggacauggcagguauaugugcuauauguaacaugcugaguacuccaccuggcacagaaugggcccuggguaaacaguggguaucaucaguacuauuuauuuggacuuuccucuggaaaugcagaugccuggguucccagcuagggugauagcagacaccaucccccuuccacaguggugggauaaggccaggugugccagccauccugggucuggcacccacuggcgccggucagggaaggccuuagggcugggccacaggagcuggcagcauuggcccaaccaaguguaaacaugcagacgccaucaggagcacucgccagcuuugaagucugaagcggcgcugccuccuggcuccuggcucugccccacuccacugcugacggcuuguuaaaugugcccagggcaccagggagcgugcuggccuggggugcaggcuggcucaugaccugccucuggcacagcuugggccccaucauucucagcagggauggucuggcaggcuuggugggcccuagcgggucagcugcagggccccucgcccuugcaggaagccaugcuguggucuagcuggccacugagccuguucugcuggcccucgcuccccugggucccugccagaggguugaaggccacauuggcucccaggcuacuugagaaaacagagguuccccugaaacagagguugagaagcucuuuccccagggagaugaucaaauggcugcccugguauucuggucccagcccaaauccucagcguuucuucugacuuccaguaucaggcugugauagcuaagugucuugcuuggcugcuggagugcuuguucaccuuccuuugaaaauugcuuuuuugcccauauagagacacagggucaggacagcuugaugugcuggaaagagccaguucuggaaacugauggacugagcugggcacaagcucgauguggccgugggcaagucacucucccccagaaccuguuucuucuuuaagagcuggucaggcguugaugagaccugggcuacuucagggccucugcucuucccaccacaccagaccauggccugcauugaggaggagacacuguccguggggaaaguuuucugaugauacuggaacaacaccaucauccuagguccccuuccagaauuugucaauccugguggcuuucaaguggccuagaagaguuaacaccgcauuuuuaagggacucauccaugaucaggcagccucugaguucuucccauuccucauuggauccaaggacugcuggcuucuguccuccgagaagacuuugcuggugggguggguaagagggagagaagcagagagcugugggcagcuccaagcaugugguugguguugaguacauguucuguucuucuggcuucucuugggcagauuagauaacuggaucuugugauuucugugcaucugagaucuccugcaccaaaugcugucuuauucuucugcuucucccacaauuugacauccacuaauugagauucuuuccucugggucauccauucucugucaagucuuagguguuaucaucaacaucaacaccccugauccuaacaacaaccuuuuucaaggaggaaacugaguuucagagaagucccucgcucaaggucauagagcuguaagaggcagagucagaagucaggccucccaagcccuuccuguccugcgcacgugguucuccucaccacagaccuggaaucggcacagggcuccauuucauggcacguuugccugccuuccuucguaucacuucuacaauuugaauuagaauggucacuucacagcuugggcaauucccaagccucaucaugggagccaagcccugaaagagggacacacacacguguaaugacauaauuauaugcaccggcagccaaguccuugcucaaaggccagggacaauggggacccaccuggcguguaagcaagcgccuggacuuccaugugcacagugacugcuccucaggagcucagucccuccagugacugaaggcuaauaaauagagcaaauuauucaugcaaacagugagaauccccacuuagcgccauuguuguaacugugcuggccuggauucaggacuguucccuagaagcaaggccuauugagcagaucccacaugcguugccuuugguuugacgucacaaugauugauuucaaaaugaaaacccuccaacuguucucugaaggucuuuccucauuggaugugcuugugucugaucucugaggucucuuuccuuuagcuggaagaaucuauaauuuggugaagaacccaaccaucacacaugcaugcacacaccuucuagugauggacaggacagagcaaagccauguucccccauccucaccuccugacacucaggacagaucaugaccccuggucuuccugaaguucuccagagauguaggccucacagcauccuguaggaauguaggagcugucucccucuuucuagccagacuuccuucugauuaaaugagguuucaugcagcugacaaucacugaguccuugcccccaguacacacagcaguaauuuccggagguguagguuuuggagaugcaaaaaugugcucagaccagcuccugccuuccaggacugccuuccuccccuccccgcauccagcuggugaggcuggcguagacaagccacugcugugcugagagacaggcacacaggcuucucuguagccaauucccagcgcaacccucugucugguucugaggccggcagucucuuagagggggccuuccauuagucagcgaugucuucucagaucugcagguggcggccauugagucgcaggggugcacaggcccugcaucugcugccccuguaguccuguguggugugucugagggaguccuaagggagggagacuggucugcccagggagggggcaggcagaggccagaccaacaacaacuguuuacaagugcuccccagcacccauuuaaaccuccagcaacucuguuuccccauauuauagauggagagaugccugcacccacagagguuaggccucuggccagagugccuaggcacccagacuugggauucgaaugcagguagucuggcucuagaguccagguucuaaccugugauguaaacagugcugugccuuuucucuuauucuauugucuccagugugcccauuuuuuuccaguuauggagaccuguacaguaaauccucacuuaacauugucacuagcuucuuggaaaccaugaguuuaagggaaagaacguauaacaaaaccaaucuauuuuuuucauucauguuauaacaaaauaacuuugauauauauucaaauaacuuuaaaugaagcaacauuauuuaagggccuacuguacauuauuuuguuuaaaguaacaguuucuaagaacuuaugaugacaccaaguaaagacuuuacuggaaauugaguauuuggaauucaugggaaggguaguuuuccucuuggccccuauaaccauagguggggaaaguuuagccucccuccaacagcagugcaguccuucucaguguggcaggggcugacugggcuggaacaccuuccugugauggugaaguguuugggccccacuauaagugcugcaucuugagggccaggaucugcccucuuucccuccucuccuccucccuuccaaauaaccuggugggggcuggggucccugaacuuggggauugucuucugcaaugacuugggguuucccacaacugggacuagcagggauggggcugcccagugccccugggccggacuucuaggcccauuuguguccagucagucaugacauggcucuggugagcccaaaggauggagaaagucgucugggcucauuugcugcuucggcaccucccggcagacagggcccagcccuuccugcagcaggaaaagcaccagccucuggauccagacagucugaguuggaauggggcauugccacacucacuagcugcgugacuuugagcaaaucauuucauuuuacugagcccccuguucccgacagggcuuuccuaaagauuaaauaaugauauggggacaccucacccaugacauggcugaggacacugccgcucaccugcugcugggaaaggggugagagagcagagugcgaaggauugggagaguuggagggagaugggauuuaccugcugacuucucucugcugcuccagccuccccuccccuggggcagccaugcccagagugccaguguccucugugggacugacacaaaugcaaagauccacccagcugcugugaaaugacaguguggggccaccagcaggcagaagacgccagcacucucgagaccacacgggguuccugaacgugugcagacguccagcuccugcccucacggugccucccccacaaauggaacugcggacacagaaguucgcaggagaguaugcuucacccacucagcacuaucaugucuucuggccaagccauaaaacaagagagcaggagugacagagacacucccuuugaacuugaaauccuuucuaaacugccacuccagccccagaggcccuccucagaaggucaaaaaaagcccacucacuccucaccuuaucccggaugcuuaaaacaauuuugugggaauguaggucagugaaccgagcugcaccacacaccagcaggauuccaggggccaaccagccugugugcuggcccacuaggucagaugagaacauaaacaaggaacucugggagcccucagcuuccccuggcucuaguccuuuguuuauguagcacuuaaacuaacuuuggggucaucucugucuggcaugaaagcccuggagcuuuuugaaguuccccugaaguuaauaaaauuagucugcccucauugcaagacccuggcuuggagaaagauagauccucugcugucuuuguggcauuuagcuuuuuaaaguuaauauuuuauaaccaaaagaaaggagggggcaggggagaagaugcaguaaacguguucugaaaggcuaauagguagcaugccugcuaucccaggcucugauuacccuggagccaggccuccaggcccacugggaggcugagcgaugggccugcuguguuuagcaugagggaaccagcacuggggacgugaauugaucugucaguguguucucccagguagauaggaggaaacuagcccgggcugggcuguuggcucacucucagaugaaucgugucucccaaggacauauccacuugaguaauguauuucuaccucccggcgucuuccccuugaugccaugugugggacuagugcaguuggccuccucacacucagugagcgccuguucaccaggccuguagugggucagggccacaggaggugcacagaacccuuuccucgcagaacucccaguccgaggagggagacagauaggucagcugucagggauaagacauaguggccaggcucucagaacagagggaucuuggccucaguccugggggccaaggggagaggaggugccugcaaugucggggaagcugucugaaggaggaaauguccaaggugggccuuggguggggguagaguccccggugcacaagcugggacuagcauuacaggagcaccacacaggcggggagggaggcauaacagaggggcaugaggacccugggggugauagauauguucauuagcuuuaucauggugaugguuucacaggcauguauauguauacacauauuuagacuuauccaauuauuuacuuuuaauauguucauguuauuguguaucaguuauagcugaaugaagcuguaaaaaaaaaaaaaaaaaaagccuacaggcaugagugagccuugcaaauguaccaacaacuacaaccauguauucuugcaacauuuacucacacauucaaggaauagauaguaagcgccuguuuuaugugcagggaauguagcuauggaggagaggaacauguuucugccuggagcuugugccugguuggaagcaauaaacaaguaaacagauaaggucaaaggcauaacgucagguggcaaucugugcucugaagagagacagggcaggaugaagauuggagaggaguaggggcuggaguacaggaagagggagccaugggccacagggaacgcuguaggcaccaggccuugauuugagccugcucagggccaggcccugcugggcaccaggggcugcauagagauggggagcucauaggaucugucgcugagaagugcaaaggcugugggcugugagauggagggagaauucuguuauuuuccuguaguacaugugauuguucacagcuacaggcccguuucaugguaggcucuuauaggaauaaaacaagaauauuaauaucagcuuguugagaacuuucugcucugcuaaggauaccugcguauauuaucccuuugguccugguggggccucuuacaagcuguuucucugagaaaguuguaagcucuuaguccagggacugugccuuuuuuguuucuuggccacugcaaugcuggaggacaggucuuauuucucagucagauguaaccccagggccuagcuaugcagaggcccgaguaguagcucucuggggugaccacaaugcaugagaacugauuaaagcugccuggguggggacagagggcugcaauugucacccuugcuggaccagaagccaucaaaggaaaauguucugucuuuggagaagaugucaggagaggaugggagguccgccugguguguguguagaagaaaugcacuucuugguuuguuuuuacauuuuuaaauucuauuaacuuauuuguaaacaggugaugcauucauguauuucaguagccaaagauagaaaagguguauggugaaaaguccccaggcacccugcucccuuuccuggaggcaucaguuucuccugauuccuucuguguauccaccucugcccugcccccauccauacacagccugcaacaugcccuuugccucucacucuucuuuuuaacgugaaacacaauacucugguuuuuguaucuguccauacacacugccuacucuccucuguggucacaucaucaucucuagaggcugugcuccacuucuugaacucaggcuggacuucuaagucauugucagcuuuugcugcugcagugagugaccuuggguggagcucccaucuucuccugacaucuucuccagcaagcacaucagcgggaugcauuccuagaagugaaauugaugguccagauggugugugcauugcucauuuccauaacagcugccagacuggugggcacuucuuaucauggggcccaaguuugcuacuggaggcaggaucuacagagcagggguggggugaggagcuggguggggcaggcaaggccaccuggccaugcugccaucccaaaagcaguaccugggcuggagcugccagagacucagaagggagggagugacacuuccagucgcugaucaagccucuagggagaagguucaggaugaacauagcucauggugaaaucagggcugcaccaagcugacuuuuucacagacaugugugucccuccucucagccugggcacccacaaagagacagcagcggccaacauggccagcaggagguaugagcucugcaaagaccuggccauggccaacaggggccagggaaacgagcaauucugccuggacugagggagggugucauggagguagggagguagggcuguggaggaaaagugggccaggccaagacaggcuuccaggcacagcuagagugagcaagaguaaagccuugggccacuguacauaggggugugugcagcgggugggagacaaaggccaggcucucgggcuccugugggaggggaaaccagagugaggaggccaguucuagaaggccuuggaugcaggcucaggagcggcccgggugacugugacagcuucaaggagagugcucugggcaggugcccuggggacaggcugggucauuguggccccccagggguggggggggccugcaacaggggcuugaauucaaagcuacuucuauccccugugcucugugaccuuggauagaugacagaacucugccgugccuccauuuccucaucuguaaaguggcgccacagagcugcuguggggacugaggugcuaucuguggaaagugcucacagcaugccuguuuugaagggcccguuguuauaguggcaguugccagucucagguuucugcccugcucccaugcauuuuguuaucuguuaggugggcucaucaccaggcuacccacaggguuccuagagcgggcagcagccagccaugccuagggcccgggagagcuggggcuaggcacacagucacagcucuuucagugugcaccacuaaugcccucucucuguggcuggguguguggggacaggcgauggaugacuacagugugaucggccgcucccuguucaaaaaggaaaccaacauccagcucuucguggggcucaaggugcacuuguccacuggggaacugggcaucaucgacagugccuucggccagagcggcaaguucaagauccacaucccagguaagugcagccacuuccucccgguuuagggacaccgugcagggcacagagagauggcagaggugaugccaagguggcgcuccuuggcuuagguuccuaauccugccuuugccgagacacggggugacuuggccugccuggcagcauggccucuggcugggaagccaguauggguucugggaagagccuggauguggagugaagaucuggucugagcagggucaagauuggagucugaguucccacugcaccauuuaccaucugagggggccuugggcccgcaccuugguuucucuguggaggcgggaauaagauugagccuacaggcaguuuggagaagagcaggugagggagaccgcugggggccuggcauacuguccuggcacgugguaagguuuccagggaugugaguugucacccuccuuugcccagcacagacccccaggcucagcaccaccugcugaguuugugcuggggccucuccgugggcugggucagaggguguguguuugcugcuggagagcccuuggauuuugucagugaacucauccuucaaucacuugugcauuuauucagccuacacugcaucauguucuucuguguugcaagcauugugcuuggugcuggggauauggagcuuacaguuguaggaagguacaaacaauaaacauacuaaagaaaucccugucagaugggaguaggcaccacguagaaagauaaagcagggacgagauggaauugcugagcaugcugcuuuggauagggugaucagggaaggacagagggagggaaggagccacauggguagucagggagagcaugccacagcgagggggaagugaauguuaagguccugaggugacagugagcuucaagugcauuugcaggucaguuguuuggcaaaagugugcugagcagagaggugugcaggacauaggccaggguucauacugugcgcuggggaccgugggaaggacuaaagccuguguucguaugaaugggucaugagccacuaucuuuuuuuuagagaaagggucuuacccugucuguggaauagaauguggugaugcaaucaaggcucacuaaagccuugaccucccaggcucaaaccauccuccugcuucagccuccugaauagcugggacucaguugugugccaccacccccagcuccccacuguccuuuaucuccuguacaauuguaccagauacaaccaauccaguacaauucuguuguauuucauaauacaguaaaaauuacaaaaauuuucaaacauacagcaaaguugaagauuuuacagggaacaccuuuacccacuccugauuuuauauugacauguuacuguccucuacauaacuccaggacucgagguugauccugugaggauggaaagcuguggggagguuuggaucaggggaacaaccaagguugguuuauggcuucuugugucaaaucuccuaaagagaagguggugcccuggcuccagcuggaaaacagagaccccagcugccuccgugcucacagguggcaugagcacccuucccucuccugacagccuugccagggaaccccuuccuuucaaaguccuuccacugcccagagauagcaucugccuucucaugagcaagggcaauggucacagaggcauugcuucuccagggcacuuuguucccuguuagcagccccuaaggccucugucaagguggggcuggggcaagggaggcagaggcacccagccaugggaggccuccagcggugaagcucuaaaauucuguccuguccuccccacuucuccauaguggcucugaguccucaccucagccaaacaggagucuuugugcaucgcuucaguuuggcuguggguuguccucagagacuggagcccacagggccccucucuggacuccagggagcaugcagggggcaugagccagacaggccagcguccagaccucaguccccaagggccucgugccuaugccugccugggcuauugugagcuuucugggagggaaggaucccgggauucuuccagcugggucgggggccauacugaggagcacugauccuuccccuaaacagcucuggggcccugcuggaccaggcagagggaagagcuuauggucuucuccuuugggaacugcuaggaucacgcugaccuccccugagcucccuuccuguagcccaaggcaaacucagagcugggguauucccagggcaggcaagaaccaagaggagucuugguugggcugcuggggugggagugaagggagccucucggggugcuggggcgggaguggagggagccucucagggugcugggguaggaguggagggagccucucggggugcuggggugggaguggagggaggagggguauagggacacugccucaguccacuagaguucacauuccuucgucuggucaauguugacuuuuuagucugccugcuuccuguuuguggcuuuuaagcuuuuuauuaaauaucacuggucagauuccuccaucccacccaccaccuuccaucccucccacccccacucccugcugauuccucccuuuuaaccuuuuugaagugccuuaauugugaaagaaucuucaggaagccugagccauccagugccaggugaagggagagagagugcauugcuagcugcagccuggacaugcaggguggggaagccuggguuuuggugccaugagagguaaggcucccagccugcagcucguggacagggcuggguucagaugcacuucaugggccucgcugccggcucuacagggcauccgggcugggaaaggcagaaugaagaguccccuggguuuccucccaucagccuuucaccuuggguugcaaggucagaugccaggaaggccaagcagguguugaagaggccagguggcaggugauagggagugguggggacuauggugaccuggagagcugcuguguggguccugccaacucuucacuauaugggaacguaggccuggggucucauuuuaucuaauuuuauuuuuauguaauaucuccugauuaaaaacuacaacugucugugcuaaacaaagcaugccuuuggccugguuugagcccuagcaacucguaacuccuguuugaauuuuagaaaggacacuuggcccucagguucacgaggugaagcugaaccguaauaugcaaacaguauguuuuaaggagccacagacacuugccucagagacaaggguccugaugcuagggcuguugacucccagaaugugcugugggaaaucagagggcugggggacggccccauccuuccugauauccaaggagccuucccagagagucuugggggaucucaagguuggaaagccccguauuuacaaaacaucucccuucaaagaccuugccauuugcagaauuguacuucaugggaggauaggaggccugacaagcugccaguaggaaccuacuggggaauucugcugguggugagagaguaguuggaggaaggagcuggacauggaggagguuccuguccaagucauagcaucacuuguaauucccaaggguuguaggguggagugagucuuguuaucuccaucucacaggugggagccggguagcagagagccugagggcuuugcccacggucugucugugucaccucaccccucuccaucagcucuguugaugccccuagagagcagucaugucuucaaagaaucuggagcugggaggcccauguggugcuuggagaagcacugcaccugggaggcugcgcucccaaagcucaucuuggcaagccgucugucccaccgcugccacccuccccucugccucagugugccaggcaucagcacucacucacagaggcaggcuggauggcgggugggacaacagcuuccgcagccccuccuguucccacuuugcagggagaaaagaacaccuugaugacucccaacuggagaagaaucaugugagaagcugaauagacuuguuccuaaugacagcucugagucacugggcauuuacucuaggacagaaaagggcacacaugugcccgugaucuuaucuccugaagcaaugcucuguaaaucuaaaaucucccagggcuguuguuuuguguaccugccaagauguggcaagcuuuuugaauggcccaaauucaugauagguggccccucucccacagggugcuccugaaccagcugauuugggacaguucaugugugugucugcuuuagcauugaggggcacgcggagcuuaaagccuuguuacuggaaagccccaggccccuauuaccacucgcgugcccaugugucacugauucucaccagguaacaacugaccauggaacagagcugcaagugcuuaccucauacuagccagagagccgugauugagaacauagcccacucaaggccacagccgcggccucauccuagcagcgggugcugcucacgugccgggagcucaaaaggguacucauaucucaggcacuuggucuugugaguagccagaauucucauucaaacccuaaaauagagaucuuacuuuuggugaucuuuaauaaccuuuugauuauuacuaaucacaaauuaauguacuccagaugagaaaaagaaaaaaaauuuguagaaccauacuuacaguuaagaccccagaaggagcuucuauuuacugauuaucagggagagccagcacucaggaggaggagaaacagcccccaaaaugugagcuaugauguauagcaguugggcugcccgcuguacagcugaggagacuggggcuggcaggaugggcagugcaguugcugguguucccauugcaacaagcaccucguuucacugcacaagcagaccauuucaaaccgcucugcugcaugccagggcuaggauagucugugcccagggaggugugccacagaggugggcacucagcgcaagaaagccagaacaaagcagacacuugggcaaagguagcaaacauccacaccugagauucgaacccagagcaccucacucucaaccacucugcucgagacuccccacaccaugaugccuuauaggcagggcugggggugaggcacugaaguguaucucccuuccucaggguaugcgggagaagggaaggguuggucauucagcucagugggcccuuggacagagggccugaaaugacuacccuauggccccugggaagagggagucaggaaagccacuucugcucaccucugaagaggguccugaggagggcuccugggccauccugcacccaaugcugccccugugcccacccccagggcugcaggggcugugacucugaauuaugcccaucagugugccaugcagaaggggauggauuuacauggaauaggaaguguugcuugcaugaaugaauaaaugaaggaguuugguggaauagacuggacuggaaugaacaaaugaauguacccaggcccacgagggccacucucagcucuguuuucugcagccucacaguggaggccaaacagccuggugcuuugugugcuacaggcuuccccagaaccucagcaaugcgggcagacaccaaccucaucagacucccucagaagcugcugccuaggaacagagcuugggggagggcucgaguuuccugaucuuuaaaacaagggggccaggcacaguggcucaccccuguaaucucagcacucugggaggccgaggcaagagaauugcuugaagccaggaguuuaagaccagccugggcagcaaagcgagaccccaucccuacaaaaauguaaauaaauuaaucaauccaggguuugccaguccauuuagcucggcaaacuuaguugaggcuuagggcucgggcgggggauacugagauccuucucagaguccugucccaaggugcuuucccugugggacaggcagagacaugagcagccauucacagucagcauggcaaguggccacugggacguguggcugggaaugggggaaaguggccauccugagaggagggccagagcaagcuuccuggaggaguagccuucugagcagaagggcgagcggggagcagaaggcugcauagagagcuagaaucagaugugugauguucgcuagaacccuguggccaguggucaguccagccucauggccagggucaggaaaaggccaggacaguggaaagaccaugggauggggagucgggaaccuggcccucauaccugcccugagcuccaguuccuucgccuacacagugggcaugugaauucucagacugccccuccagggccucuuccagccucauucaucuacugcugacucugccagugcucaagccacuccucuguggagugcaccugacccccaggcccugcagcacugcuguggggaugcacuggcaggaagcaggggcugggaaggccaagagcaccucccaaacccugucccggagcugccauuuagucuagcccuccacagccugcauggcagcguggccccaacccacaggugaggaaacaggcccuuugcucacaucuacacugcuaguaagugaaugggccagaguucucugucugccccagggagaucgagcagaggggccagcaggaguaagugggcacagcauaccugcugcugagggcagugccagcccugccagcuggcucugcucccuuagcccugcagccuucucccaggacucugggguuccagcugguagcccguggccccugugcugaaucaggugucucagggcucagcaugguaucccaucccauccuccucugucccucaucacaauuuauugggcccuccguguacagaccugucuaggugcuggagggggucagaggugaaacaaggccuggguggggagggggcucccugaguggauggagagcccugggccaacacccagugggacaacuccucugugaaccacucucugguuuaggagagggacgggucagacgaggccaagguugcaggggccgcugggcuaguuaccuggagggucuccuggggcaucccaggcucccuucugauugggaccagccacuuuccagucugugcuucagcuucuucagugcuaacccagagcuagucauucugauuuccaggaaggcugaaaauuuaaucauagaaucccuggagaggacugccuauaguauccacuuacggcaggggcucccuaagugguggcuggaauugugugcugugugcacccaccccucaccugccagcccuuccucuuggugggguagcucacauguccacugagggccucacuuuauccucccacccaugcccugucccuaccacagagcacugggaaacgaugccuguaggagccccggugcugcauucaugccaggcugcuucacaggagauuaaccagccaccuuucaagcagggauuggcugugccacaaggaccucuccaauuuauugacccuggaaagcacuuugcauggucaaaaacaaggauuauaccuuucccuccugauugaaaacagaagccaaaucauagaggcaucccccagaugccccgcuuugccucagccguuggauggccaaugucucucccgggaccaguacagggcagagcagcaagugcuucagcucagcccagaagcugaugcaccucucuguugaccaggcaacagauugucaggggcucucagacccagguucacaagguggcagauuugucagggccuaagucccagaagcucuauuugcuagaaauaugggucauuuaguauggacugggccaggccugcaggaguuggggacacaccccuucagugguuuugggggaccaguguguuggugaggucccaggcaaguaacucuaagaauagaaacuaugguucuaagaaauggccaggggcauugguccauaugggcuggugaccagaaggaauggaauuggccugggugacuuguagcaugagggccuacagccauccggaggguagcaggcagggccugaggcugagacaaugucagcaguacaaucagcugcugcccaugcccugugccaggcagcacgcccuuguguagucugaccacucaauccugccagcagcccagggaaaccaggcugucaucaccccaguucugcagaggaggaaaucagaccaaccccagugcccuggcagucagccugagggcacagaggaggaggaggaggagcaggagcugggguccugauuuucaaggucagagacaggagggcucuggccucacacagucacucugacuuuagcuagcucuucuuuaccaagcacugacucuuguguguggaaaguauuuuucugguaucagacauaguguuggguucugggcacauggcucaaacaagacacagucccugcaccccgggaguucacagcuaaucaccccucuguucaacagugugcuuuugagccccuguuaugugucauccuuguguuggguucuagaaagaccacagugagccacagcccacaugaccccugagcucauggggcuguuggguugguguacuagucaacucgggcuaucauaacagaauaccacagacgcgguggcuuaaacaauaggcauucauuuccugucaguucuggagccuggaaguccaagaucaaggugucugcaggguggguuucuccugcagccucucucuuggcuugcagacggcugccuucucccuguguccucacauggcugucccucugugcgugucugugucccaaccucuauuuugaaggacauuagucaguuugguuuagaacucaaccuaaagaccucauuucaucuuaauuacaccuuuaaaggcccugccuccaaauacagucccauucuaaagucuggggguuaggauuccaguauaugaauuugaagggacacaguucagccuguaacaguuaggaugcuggcacuggcagacuuucuccugagcauuuguguauuggcagccacaugcaugcugugcacagaaggugcacaaugccaugagaucuuacaguaggaccccaaccgagucugggcuugggaaggcuuccuucggaaguggcauugcacuggggucugaggacaaauuggagucucagugccccuggaggugagggugccacaguggugcugcucaggcuauuccugcuggcccugaguaucaccuccgcaucgaaccagccaccugcuguguggacuccugugccuguaagcaagagccacauccuguuuccacaaggccuaccucagggaugccgugagacugcaacauugcugcaccccuacuuaggcugccgauuauggacuuauguccccuucccaccuuacagggagagagacagccuugaaaccagacccagagaugagugaagcaccacaguuggugcuguggccccacugccugccuggccauaucacuggcuccaucagcccuccaaagaaaccagcucuacaauaagacucccuuuuccugucacccauuucaucuggaaugccaagcaguucugcacuggugacgcgugcugacuccagcucaggcuagggcucugcugaaaagcugccuccugcgaucacuugccuaaugguucuuccucccaccacccacugggagagccgugccucaggaauuccauggggccagucacauggccugaugcccuugggcugggccaggauggugcugccacagccuagauccuggguguagccccuugcacaaggucagcuggaguguguccugucuccagcuacagccagucacagcagauggugguugcauuuggcacagaaguacaguccacaggcugagugcaguggcucacaccuguaaucccuaugccuggggaggcugaggcaagcggaucaccugaggucaggaguuggagaccagacuggccaauguggcaaaaccccaucucuaauaaaaauuuaaaaauuagcugggcauagugguuacacaccuguagucccagcuacucgggaggcugaggcaggagaauugcuugaaccugggagauggagguuacagugagccaggagauugcgccacugcacuccagccugggugacagagcgagacuccaucuccaaaaaaaacaaaaaaaaaaaaacaaaaaaagaaguacaguccacaacacacacaagaaaugaaguuuucuguguuuuaagaaagaggaguuuuaaaaaacaauaaacaacaaugacaacugcgcauguuaaaaucacucccuggaugugguagcucagcugagccuugcuggucagggccacuucccggaagcuuucucacuguugcuaauccuucugaagggccugggucagcucacugccuuuggagcccucgguuuucaucugauaaaauggggguaacaauccugucuugaaggacugugaggaguaaaccagugugcaaggaugcccagcauguugcaggcguugggagugggcugccagccccuucccucaucugccugcaccgcaugagccugacacgugccggaguccaggccugaaaacccaaggggcugggcccccugagcuccaugcccguauugcugggcuguagcacagccacgguggcauuaccacuuccaauuuuucaagaaagccuggauaucuguauuuuuacaugaaaucuucccauucucaguugggccacaauguguggucucuguguuggcaccagguccuuaaugugccgucucuuccuccugcugcagccuucaagaggaggccaucgcccuguuucucccaaaggcacugugaggcucagaggagcuagaugacuggcccaccagacccugaaguucccaauggaaguggacaucacccaugguuccacuuagcugggaggcuucuggaaacucagcauagagcaaaagugaaaacacauccuggugccaaagggacaggacacgaugagcccugagguuguggauauuguuauguucccauaaauaacaggcccucagacaaugggcugugaggcuguguguuccucugggguuugaaaugaaacuggcuuucuucucuuuuaaaaugugcucucuccaaccauccagcugcucuguuuggagcagauucuggggcaaccccaauaaccuguccuugggauuucauuagcaccaccagccagcugccuggaaaguagccccugccaggaccaaauuaacuuuuacugagagacauuggcagggcugguauugugcacacuuggcauuuucagcccacacugggauguggguagcaggguaccuucaaagaacaagagcuucggaggcagccagaccuguguuggaauccuggcuagaaugcuacccuuucugaaaaucccaguuuccucaucaguaagguggguuaucuugaggacuuucccuccuagcuuuuuaaauaauuucaaacauacugaagaguggaaagcuuauugagcaguguugcucccuuggcuucaacaauugcuccguguugucuugucugcuuuguuugugcgccgagccgacugaggguuccuccuggugcugcugcugugccugcacccucagcacauguccccgaggaacaaggacauucuccugcagaaccacaacgcaguuaccacuggagaaaugugacauugaugccacauugucuaggauacaguccauuuucagauuccccaacugucgcaauagugucuuaggaaguuuuccaugcuugaggagucagugaaagguggcaccugcgcucagugcugccaccaauaguuuuacaacacugauguuuuugaagagcccagguugguuguuucccagugcacucuuugggucugucugauauuucuucaugacuggguucaggcugugcauuuuuggaaggaauucuacagaggugauuucggggccuuaguguguccuauccggaugucugcccaucauaggcaaugcuagguuugaccacuagugaaggugguuguuaggagguucaaugaggugaugaagacagagcccaggcccagagauagcuguguggagggagugcagcggcccacacucaccaccgguaucauagcucagcagcugugccccaugcaggaugccucuguggccugggaggaggggcaccagcaggucccuugggaaguuacaguaaaggccccggucuggcagcagugaggcagagcugacucucuggagccagaucuagggauauccuaccccucucccauauccccauggggcuaagccagggccuguggagggaggagaggagcugcuacuucccccaaagccuucucuuucucccucuccccgaccacccacccucucuccccagcccagcucuguuucagccauugccccucucccugugaccagcaucagaccugagcacagaggacuggcucuaggcccaucccagggggcaccguuuggguggagauguuacagaaaggagcaagcacuauaguaggggcccuacagggcuuuggagaaagagcauggagugacugcucccuuccagagugaaggugggaaguuuuaccgaugcagugaggcuugagcuugucuugaaggugaggagauuuccccagggagaaaagggaggaaggguguucaggacagaaggaacagagugugcuagggcacagaggauggaaagaguggcauauucugggaauauggaauagaaacuaauauucauugcuuguuaaaaugaguaggacauuguucuaaguguuguauauguuauuaacuccuuugauauauauaaaaugaugguuuuggagcaguuuuuuuuuuaaaagcaauggaauucuuuguuuuuucacccgaagucuuucauggaauccaauugaggcccuggggagccuccuugcuguucaccucaaauccagcccugaggcucauccuuggauggauggggaggaggggaggaggagcuuacucccgaaaggccuuggccuccaugcuuguaucuggccuuugucuagacaggguucccaucgacacugcugacacuggggcuggaccauccucuacuguggggcugccuugugcccugcaggguguuuguggguaucccuggcuucuucuuacuagguacagccucacccaaguugcagcaaugaaaaacuucucuagauguucccaaguguccccuggggaccaaaauaucccccaguugagaaccacuggucuaagcaaguggcagaaggaacuggugguuggugugcagggaggaacacagucagaaagcucugucuggcagcugguuggagggggcaagccaaggccugaggcuggacagugggcacauggggaggagggcagaggggcaggaugcaccccagaaccuguuggggugcagaaugaggagggugauguccagaauagauucuaccccaggccucgugggcagccucuggccagcaaggagggccuaggcaugcccccagagucccagccccaugguaggggcccuacagggccauggggaaagagaggacagagugguccugcaggggccggggcccggcggcagugccucauccauccugaggucucugggugcuuggugguggggggcccugagcucugggcccaguggccuugagaggagggaggcucuguccagccuggugcggaccaggagugcaggaucuuuacuggcccuuacacagugaaugcaacuuuucuuugggaacuauuucucuuugcuuaggacucucuaaaacuuuccagauuugccaguuuguaguuuuagggaaaauuuguauuuuuccauaugcaguuauccuaccuaaauaaagucagcagagugaacugauaaaacaauuaacauuuuaggcaguggaaaguggaacuugcgauuggcugucucuggagggucucuccagaaagucuugauuuagcaaaccaccagcaaucuuagauaccugagagaaaguuccagaaaucagaggccggcccauguucuaucguggaugaucuuggcuugggcaguucuguggaucuugugucugauacuccaugcccuggacugccauggcagcuggucaaggggccuaaaacccugaagccuuuaaauacaugugccagcagcaggaaacucccugccccaaauucccccaugauuuggauucaccacaacacuuaccauguguucagagacgcuuggucaucacagucacuagcaaggggaggaaaaccccuuccuggcuaggugcuggggguacagagggccuggggcaggacggugcuccagcaugcucugccacuacuaccacuguuacugccgauguucauuuagcuccugcugugugccagacuaccugacaugcuuuguugaaauccacuacaguguagaaauccacucuuuuguuccuucagcacccccugaggugggcacuauuaguaggucgucacucacccaaugucugacagaccacacugccuuuagugaccacagcacagcagcccucucugggacaaacagguuagggugaagggugcugggccccugacuauacguaaacaagguauucacagcagugcuuagagcugcgccuagcgaggguuggugcucaccagccacugcugcuguagaugucacuuccaugaaaccucugaguuguuccuggcuuccuuccugucugaggaggaggcaggggaguaauaacaauaacaccuguaauuguaccuauagaaaacauguacagagcagucccaaggcugaguguuuccugaagagcgucucacugaucugcccuguacaaaugucaagaugaggcccugagaaguggaaugacuugcacgaggucgcacagcugagaaagggaggaggagccaggauuuuaccccauuuugucugacugcagagccccagcacuuuaugcugaaagagaacugggagccaguggaguguggaguuccgugcaauguggagccaggcaggcagggacgagugagagaaccuggcacccauuguguggauguugggcccaccuugcucuugccugccuccuccaccugggcucucucaccuggccacagagucagcugaguuuagaauggcacuugaugagcuacagguaaccauuggauugcucaggcacccagggccacuccuggaaccugucuccagggaaccucuguggcccacacaggaucuagcccugggccagaguguuucacugcugccggguaguuagccagggaccuacagcagcagcgagccuuugguuggugagcaaccccuagcuggggcuccugugaccugguguuuauuuagugcucgaagguugggaucaccacgugcauguccagggagcucugcuauccacacacaaccuccucacagauacaggcuagugccuauaccaagcccuucccagcagggcucuauucauccagucuccuguccuuggggugggucagcucuggagggggcuaaccaaaaagauccagguaucacaugcauaucuuaagccaauucucacccauaaaauuucacagucccauuagagagaaagcuuaaaaaucuggggaaaaagucacccacagucuccucaccccaguagcaucccaagggacuuuugguuccauuuccuuccagcacuuuccacaugucacuuggccaggcugggaagggcucauggucgggagugagaguugaaggcccaccuccuucacuggccauuagaccuggaccagccccgcugccucccugagcugcacuccccucugcagcaugcaagggcagugcugaugucuaucauuagcucuggagggugcaguuggaaaccaugaguaugaagugcccacccaggguccagcaccugaagaugcaccaucggugcccagugcugucaucgacuguguggcucuuuuggacgugacaccacaccagacccccaggucauacugcugcuuuccuuggggcuuccucagaggcugcuguucauguuuuccccucgccuccaagggcugugcuuguagacuuguguaagcggaccgugcuuaccucaccaucuccuacuggucagguaccuacaauuuuucccacuguuuuucguuauuauggccaacauucagagucauccuggagcuuuucucaccaucaaccuuugagugugggccauucagucaggacacacuuacucacucucagauuucuuuaguuugccucagugggugagugggggagaccuagggggcuuucuacuggggaccccauuccaguuccuggcacuaauuguggcucaauaaaggcacacugaauaaaagaaugccagaaauuucacugagacgugauuuuccuccauguuuaugauucagugaucaaaguuagaaauuguuaaaaaaaaugaaaaacaauaauauauuucucacuguaugccauauacuuuucuaagcauauuauauauaauaauauaauuuacucuucacaacaaaccugaaggaauuauaauuauugaaauugccauuuugcaaaugaggaaacagaagcacagagagguaaaggaaagugcuccaagucacacagcucuugagccccagagcugagacuugagcccaggccaucuggcacuggagcucaugcucuuagcccuguguucucugccucugacuguucucauuuuuguccaucuguuccaccuggcccugagcuaagggcccaacaugaauuccagaaguucccauuuugguuuggcccagccuuuggggugguuaaagaaauacucuaaacugcaguuuccuuguccuauauaaaaaaaggaguggucccugccuucaggauuguaauagaggaguaagaaaauguguaccaagugccuggacccuuagaacuguccugugaguucgaguguguuucucuuccucuucacaggggcugcagacagucccugggggaucagguguaggcuaaguuuugguggugaggauuugugucugucuggggauugguaaagccacugccucuucaugugccaucuuccagcaccugucugucuggugagcacuucacuucuuguggcuguugcuugcuagccccuuaccuccugcccacccucgccaugggcacaaauccacaccaggcacuaugcucagaaguugccuugacagugcccucuuaguauggcauuuggcaugcuucgcagucggucucccaccagccuucucugccuccccucccucugucccucuggaccgcaggccacccuccagcccuagcccugcagcagcccauagcagcuuuccuucauucugccacuugcgcugggugcucuggccucagcucagaugccaccucuaggaaggcucccuguccuucucaaacggagcagguccucaauguucuccuccuuugcgcaucucuuccagugccacaucggcuucuccacucccuggacagagagcucugaaucccagguggcuccacacucauuccacgacugggcugggaggugcucccaaguggaaggucuuugcuguguuagucuguggccugcacaugcucacugcucacuguuggaugagugagugagugggcaaaccccugugaucuccaccacacacccuuuauaugaacaccacccuuuauuuaagcuagauggggcugagaaauaggguauuugaagccucagauugacccaugugccugaaaaaguucagagguggugcuugaucccaggacucagcccugcccuccuucaggcagcugucccagccaggcuucuccauagauggucuuccagcugcaaguccaguggaguagggugccucuuucccaguaaccccaccaaagugcuagagccccacaccauccccagaccagcacaggagccuggggcaugcacaguucucuggccagccugggucaugugcuccucuuggcaccaaggaugcacccuuuugcaacccugcauccccaaggaaaaccaggggcuguuacuagaaguaggcggaaacagcagguguuugcugcaagcaggaaugcccacugugcuugggcuuuccucaccacuggcauggccuuaccaucaucaucacccuaaccugcacagccacagcccuucccagggccccgcagcauucugggccagcuucgcuuccugagcccucuggacugcugggguuucuuccccagaggugagcuucucuaggcugagggcuggacugagucucccagugucuccagggucccacccaucagcuggcagaccccagguaagcuguguuuugucagguauguucauggugggauuugaaggaccucugucccuucagccauugaaaacuguuccucuccccaguaacagugaccaucccaguugcaaauacaucauucauccucauuagccuuggcacacugacuugugugguggaaagaugauccuucuggccaagcagugagcauaucaggauucaccagugccuaacugggacucagaagucucagcagagucagcagugucucaugauucuugugaaagaggaaagauuuaaugucagaaccuaggucaggaauaggugauuguucugcacccaaagguuuggggaacccucacacugugggcuaauuucccucugucaccugggggaagaaggccccauggcuucuucgugcccagcagcggcacaaucucucacucaggggucauggccuggccccagacuuuuguuuccauccaaacugguuugaaaaaaaccucacaaacuguuuuuuuaauaaccuagaaguauaauaguaauagucauucaaggagauuugcauguuaaagaaaauaaaaagaagucucccauagucccauuauuaauauuuugacuuaguuucuuccgucuuuucucugcaaagccuucuuuuuauguaauugagauaugguguauacaauuuugugucugauucuuuucaauuaauauuuauuauacaaacuuuuuuuuuucuuuuacuguuuuacucuguggucuccaagggaaguugaaccacguagugauuaagagccugggcuccgggcucagacagagcuuggucugaaucccagcaccauuacuuaccaggucuacaaccuagauaaccaagcaggccucgcugagucuuaguuuccucgccuguaaaauggauaccgaaugugcccuagguggagaugcuccaagauauaaauguccaguaaaauguaaaagcacaugcaacacucagcaauagcaagagcuguguucagucauguggccauuguuuucaaugcagcguaacaguaaccaaccuugccaaggccuuaaugggcuaccuaagcaucuguggauguuccaucucuuguaaauaacauugcuggaagcaucucugucuauaaaucucuguuuuaauauguaggguauuuucuuaagauggagccucagaagcugaauuguucuaauuuuuaaaaugaaaacaucacagacauuuaaaaaguucuuaagaguuccuggcaaaguguuucccaaaaguacagugccauuuuauacuuccaucagcagugggugaaggugucuguucucuaccccucaccagcacaggcuccccuguguuauuuaucuuugcuauuuuccuacauggcaaaugacaucucagugucuuuaauuugcauuucuuugauaacuaguaaagucaaccauuuugccauauccaaguuucuuuaaagagauucagaagaagaagauaaguggagaaaaacgugcaguucacagucuggcaucuuuaugacugucugccaaaauuucccacuucagccuccuacacuggggacuagaguaccucuuggauucugaccugcagaucuccauaguguauacucgucaccccaacccugugcaauccagaggcaccucuaccaagauggcuuuuguccuucacagcaccugcaucucucauccagaugcccuuugugacuggccccaugcugagucacgaacccagagcccagacccagggccugucauaugugggcauuccaacaguccuccuccaucugaggcccuucaggagggagccaccacccagaagaguaggggagguuucucagagccuuaaaagaagagucagucuuugaucaauccaaggacagccugugaccucccgccugggacaggaaucauguuggaucugugcaccacugcauccccagggccuagcacacugaccaaggagggagauaagcccaccuacaggcagcagggagccacugagggucuuugggcagaggaacuaggauggaggaguguuuguggacaguggugguacuaguggucugggggccuggugagcugcucguaggagccccugagaguucauggcaagugugggaaagccaguacaggacucaggcagcccucucuccugugccugacacccccaggcuggcugcuggccccagcugcaggccagccugacucugacagcugacuucuccaaguugcuggcuguucccagacagcucaucccacucccgucccacagggaggcccgaagccagcuuugucagggcagucuggauguacuugugaccccugaggugagggcaaacucuccacaggcaauccugggcauuccacuggguucugucccacacagcugacuggucggccagggagacucuggaaaacagcuugguugggagaaaagaguugaagagaggugaggggugaaaguugagguuucagaaaaucccuguaaaaaugaaaacaaaccauccaucuuucuccugggugucuuagcccgccacugcccuuuguggaucuugccccagugucuguagggacggcagcucugaaaccuaauccagcagccagcuagcugcugccaacccccacccagugcaggaaugcccugacagggccagccucuccuggaagccguccugacggaggagcaccuuuaccaagcgcagagagcacuucgggguguacuuuuuuccccaaaugaauagccagccuccucccgcuuuggccauugaagcauuucaaagcaauuguaaaaauuauaugaaccccaucgaagaacuguuacaacaguguuuauacccagcguuugaaacaaagacaaugauauuauaaauaauuguagaugaugaagauaggcaagaaaaaauaacauaauuaaaagaauuuuacaagacggaccguucacaaagauggauggaguaacacaauacguuaaaaauaucugcaauuaacauaaacacagccuaguggacagaaaccaucugcuggcuggccucucccugggcauggucccaugucacacagggcggugccagggccuucacuguggcugucaugucucuggggccccuaggaagaggcugucuagggguaucuuuccuugcggcaaucggaggcccugugaucugggaaugauugagaaggaaguacagaaacaaaagggaaacugaggacuuuccaagaaggagugucuucguggggucacagagcuuucuccaggagccccucccucaccccagaugagguugggucccgucagcuguccccacacacccaaugcuuuuccaucacagagguggaugaaugcccagggacucccaagaaugagucauguggccagccucucugggcccacacaugcuccaccuuguguuggcacauaguagggccucggccccuguguguugggugacugaccuauggcuucugaggcuggcauguaagguauagggagcaaggugcgauuauuggucucaugucauuagugggugucuacagcagggccugaccacagagcucuggcuggacucuaggugcuuugggugcaaggugcuuggugccauuucucgugaugacugccugaggugggcaccccgauacccacuggacaagagccgaggccccgagagccucaugcuuagacagagacugcccaggagcacaccugaggcuuuuauaucuuaccuccccuguuaucccauccccuuuucaucacuauuugauuuucuaaaaguaaaaauaaaauuuguuuugaacugugaaaaacuuucaccauacagaguacaguagacagcccuguaaccagcaagaucagacagaugugaacuuuuugucacauccuucaaucucucuucaccucucuucacacccuuccccuaucuuguuugggggaagugaaauguacagcucaagcccuccaccaugcucucuucggcugguggccucacacacaugugcagcuuucacacuuuuccugcauaggguggccuccugagcagccuggaggguucguacgugcuuuacguuuuacauacuugguuucacacugacccagguguuauuagaacacugauguuuucuuuguggaacuugcuguucuggucagcgguucugguugacuccauuugacugcuauauguuaucccauaguccgaauuaaacaauuuguacaccugcgaccuguuggguggguuguguccacgucuccacaaugcagagcaguauaagaggguuucucuaggcaaguagggucaccuggugcugggacaugugcaccuguggguggagggggccccaauggugccggccucucccccaccagcacuguguuaucugacucaccguucccgccaggugauggaugcagccaucugauaaucagagcugcuuucuccccagaaguucaugcucagccugguuucuuggaggccuaggaucaacccagaauaucaggccuugacagggaaucuuugggccuccccuaagcagaguggagcugggauuucugauuggcucuugcuauggggugaagggaaaccugggcauuuaguuggaaagccaggccccuggcuugcuccaugugauuuccugcuagagaccaccuccuauccaugacuuggagucagacacccuuggguuugaauggaccauggguuaagugccaccaggcaguugguucacagcucugcagccugugaagaggaaaugggaagcaaguggagaugaauggguugggcggcugguguauauuuggcccucucccugaguggucaucuuuauuguuguuagaaagggaugauugccgauugcuagaaauaaaugaucaggucaaagauuuggaaacuggcuuugggggcugggccuucccccauguagugggaugaugucucaugaggcaagaacaggcuuugggucaaggccaggaugaguuccauuaggccugaacagcgccagagcucuggagccccagaucuguacauucaugcgucaaucaccucugcgugccaacccucagcucaggcuaggacucaguggcaagagagacagcuuugggccugcuuccuggagcuuccacagaagggguaguuggucaggcccaggagcauaagcuucugugcagcugcgugccguggaggaagagggcaggucugacacggaaggggcaucuucguggggccugcaggaaaugcagggcacuucuaaggaagcagcacccaggagaccuggcccgggguucagagucuacaggguagcaggaagggcauucugggagggaucugcacaaagauguuccuuucccugagguggaaaaggaaagagcagaagggccuguggcuggggcagcagggagcagggggaagaacaguggagcacaaguacgcugggccacgugaggacgccauccacuaccucgggacgggaggagacacuagagauaggcccgaaugugguucugugaagccacuucccagguggccccaggcaaggcccucuccucucugagucuccugcucucuagaaugggggcuaugacgcccagcuccugggguugucaggaagaagaaagcacugcccaucaugaccucucuguaagccccucugggcugcuuguggagagaaacccaaggccucaaaucagaaaugcuuccuucagacuccugggccuugaggcaagugucaugggaaauuggaugccaaccaagcccagggcagacacgcugugccaggauucagcagagcagggagcgugcagggagaggcaacccuaugcccucgucucagagcaggcugugugcgcccagcggacacggcaccagcaggagcugugugggcucggcuccaugcaggugcgccuacgucuauguguguccauguaugugugugcgugcucacgcuuuugugugugugguguguuuuugacaggggggaggugagugagaggccagcuuccugacagggcaguuguaaaacauucauaaaacuuuuauuggacuugccacccuuccagauaaauauuuuucgauuuuaugggcuuguuuuaggaccccaagcuuaaucauggcuuuguggcugccuuaaagaaauuaaauauuguuuuggcaaaaggagcccucuuccccuaccccugccaaaggcagccugaacucugagcucauaaauuccugccacucucaacucuugcccuuuuucccuccguagucucagagccauacuaggaugagcccgaaaaaaaaagagggagagagagaagaaaaagcaaccccuacucuucucccuccagguuccccaacuccccugacccuggcgggaaauucaacccagcucauuuguccacacaagggagcgggcagaggagucugugcugggcagucaccugcugccucccugagauggcaggcugccuuggcuggaggcgcccccauucccccagccccucccugccuccuggaagaccugaguggaucccugcccccaguuccucagaucucauugccucugaggccccacuucccacacugccuccucgggccccucugaauacccuuuccaaaagaacacccccaaacccagcaccaucccgcugucucuuugcuguacugccuuccuagcaucuagcacuaucggaaacuuucuccuguauucaucuauugguuacaagccuguccccguuacagaaauaacucacaccaugcuggacccccaccccuggaacagggcccagggcacaauaagugcuccgugaauauggggaagguaugcucagugaaugggguggggugauuuggguaaggaauaaaaauaguaaacauucuuuagaccuugcuuugugccagccgcuguucuaagcacuuucuguuauaugaacucacuugggccuuacaccaaaccuguucccauguuucagaugaggagacuaaggcgcagagaggucacaugucuuuugugaaggcacgcagcugaucugcgccuggacuagggucgggaucuugguggucuggguauagagccugagcuccuggcuguguguuacacuggguuuccuggaggaggagagcaagguggcugugcccuggccuggaaggcaucagccagcacuuggcaggcaccacccccuuccuggccucgugccaggcccugagucagaggugcuggggccauagggcugggacaggaggggcucagacucagauacagaugccuucaaggggcaggcaggugacagaaaugaggggagccagucucagguaaaagcagcagcacaugagcggugacagagaguagcuggugugcccagggcccagcacaggcccacgccagcccacuguggcaggguaggaauccaaagagaagucuucuagcuuuucaagacaaacuagaaguucagaacuguaugucaaauguccugauuuaaaaggugaguuaguaguucaaauauuucaaaaaugccauggaggcuagauucuacucccaagcuaauauaguucuuuuugaucuuugugaaaguggugagccccaggaagcccaggcacagagccuagcuaaggaggccuucuuagaggaggcaguacugaguuccaucuuggaggaggguggagagacagccuggggagagguguuccaggcagaagcguccguggcucugcccaggagagaagguaccacugcugcccagaguggcugggcuguggaggacuacacaagggaaccagauaccuaaaugcuggaagaggucgggguuuccccugcagcagccugauggagccuccagaagaccucaugggccauguugugaguggacugguucagaggugauuugugggguccagcugccagaauggggugucccaggauggagaugagcagaccagagcagagugagugugggggugaagugcucaggacccagcauacacagguggcauugccagcuugugggggccuuaccaaagcccuguaggcgggcacccgucucucccagcauucccacaugcacgcaugcacaagcacgccaguugcuggggauggaguggaggguacaaggccugagguggcuguaccccugagccccuagggaaugcaacugaggcuggagagggaacacguccaaggucaagaacucguugagggaccacaucagaggaacagagcuuuaacuucauucagccgcuguuucccaagcauuugcugggcuagugcacagggguuuccucacugacuccuccucacugucugccaagagaggugguauuaucuaucccccuuccacagaggaaauuacugagggccaaaguggugcagggcuguccccagguugcccgcacaaaagcagcaguggugggacaggucccagaccccccaguugcccccugcuaucucccuggaaguccauacuggguuuuguuugaauguggggaagaccaauacaggcagaccauccuaccauuaugauuuuaccaaaccccauagaugucaggcuuccuggcccaggacaaggaguggcagaggcauagcugccaggcaccuuguccuagcccagcucccuccuccuccagagaaaguccccaggccaccccaagguguagcaugcagucuggacaccuccaggcucuccagagcagucccagcagcugcuauagcucagacccacgauaagacccaacccuguagguuucagagcuggccacaggggccaggcaggcagcgcaggagaguagcccgacugggggacugcaguggggagcggggagugugguguacagggaccauacauccugucugaaggggcagccugugcucaccucaagccaccugcugcccugggaaugcaggcccacauuuuaaaauguugacaacuaguccacaauuuuuaaagcacaugaagaggccaaagcaaacauaccuaagggucaacuuugacccacaggcagcagauugugagugcggcuguggcuugcaggguguccucccacacacagcucagugagcuugccaugcaccagucccgaugagaacaacaguggacacuaacauuuacuacaugcccagcacgugcugacuguuuuauaugaguuaccucauugacuuaugaguuccauuccaccacucacuggcuaagcuuggagagugcaagggccucacccggacucacgaucuggcucaugaggcuggcccucugcccgcagcccucagcucccuagccugaaucugggcagaggaacaagaggcaggaggcugaggccuggggcacgacacugauaggcaggucagcccagaacaguccaaggaggccugguucuaagggagggaacaucccacgguggaacaugagcagcaguuccccaagugggcugcucacauccacccugggcgugugcaggaugacucuagguaguccacaaauaagcccccaaagaauguucacaguuacauguugauuuuaacagguacucuauuuaugucaagggagacuggauuuccacuuauggcagcauagaauguucucuaauugaguuagaugaguugacuaaagaaaucuuuaguaaauagucgaagugguggcaauggguauggcagaacuagugaugcugagaaagauuugggaaguccugggggagauuugagaguuuugaugggugaaguaggguucaggugggccuuccaagggugcaugaaaucuaccccagggagagaaagaaugaccuacaaguuggggccauacccuagcaggcugcaggcuaccuaugcccugaaaacguucucaaaaaucaggaauuuucauguaaaaaauccagauuuccaguuucucuugaaaagcaggguguucuguccaugcugagcacauccccuccaguuccccagggcccccagcccugugggauaugguaucagcugagacaggcagugggggggggaugcagugacaggugacaccacagcugaggguagugaggccaggccuucaugguggcacagccaggccccauggcugcugugugagucugcauugcuauaaaggaacaccugagacuggauaauuuauuuaaaauaaaauuuuaaaaaggcuguacaggaaguauggcacccguaucugcuucuggugagaccucaggaagcuuacaaucauuguggaaggcaaagggggagcaggugcaucacaugacaagagaaggagcaagagagugaggaggaggugccaggcuccuuuaaacaaccggcucucacauggacucacagagcgagaacucacucaucacuguggugagggcaccaagccacucaugagggauccgugcccaugaucuaacaccucccccgaggcccaccuccaacacugggggucacauuucaacaugauauuuugaggggacagacauccaaaccacaucauaugcuggccucugcagccuccucccaggcagggcugccaggugcucaccccucauaggccuggcucugugaauuaccacagggcccaggugaggaggauggacaacuugccugguggcgcgugggcagcucccucagggcuggcaacaccagccacccuccucggcccugugcuccuccacugguacugcaccuggccgcaggggcugcaggggucacagggguaugggagccauggacuggggggcuuuggcucaggagguggcuccugaggacagaggcaguguucugucccuucuggucagacccaucugcccagcauaugcuugaguuuugcuuucauaaaaauauccacauguccuggcaguucucaauaguucugacuauuuaggaaagauaaguauacaccuucuucaaaguucagaaaugaaggugcuguguggcaagacacaaaggugcaugaguccaggcucgcaaaagucgugaugccaagaaagaucugggaagucuggggggcgucgaagaguuuugaugcgugaaguggggcucgggugggccuucugagggugcgagaaaucuaccccagggagaacagauaccagccugaauuaagucggcugcuggccucuccucagcucagcccagaaugggagaggaggcuauggacuggcacgaagaaggaucuuugucacgugugcuuagcauuggauggcagggccaggcugggcuggccccuguggcaccaccaagaccccucccuacaggcuccacuggggcuggggaaaggaaugugcaccuauggaguccugcgcgcauauggaggcccacucaaacccugcgaguguauggagccccgcuugcauguuuggagcccuggcagcccccaccugaugugccugccccaggcagcauggagcacuuccuggaggaaguaggucucagccagccuuuucuagaugggcacgggcaggcacuggauggcuauuuaggcaugagggugccacgagcagagaccuggaagcucaaguaaggugcagccauuagggugccaggagaaggaggccuaguggcccagccagccccugggguugcccuguccagagccuacacccaccagguccucacucugaacuggcaguggcagaaccacgacuugagaaaaaaaguccuuucucugagcucuguuccucuuuccauugcucccgcucuuagagucuuccuuuuuuuaauauccaauuuggucgccuuccuuggggacagccacagaagggguccagcccuguuggcagccucuugcccccgccuccacuaacucgccuccagcacuaccuccucuagcugccugcaugccaagucccccuccagugcuuccugacaccccuucucggaccccucaauuuaucuacaguccaucucugccuucgagcuccuccaggguggggaacagggaacaaucugccugccaugaguccgcagccaccagcagcgggcuuggccaggguccacgcucuguaacugccguuuagguggggucugagcccccggcugccugugacaugucugcccaggugggcugugucuccacugcagcacccacugcucuccagugagggacuggccuggcccgagccuccugaguuugcugagugaggccacugcuguguaaggcccauucccugguguagucugccuguaccccucaucccuuugccucuucgaggccuucuccuggucgacugugugcuuucaguggugccggccagagcgucuagcagagaggccaacugcugccucuagccccugagcccuugcagggguguuuuuugaaacucaguccagaagacgugaaauggaggagggcugucugucuugccuuccugacuagagguagaggguccccaagcugcaggucugcuguugguucuucagggccucuucaguccaccugacacccacucuugauuucugggucaggagccugaggaacugccuggacugucccugugccucauguggugcugggacccaggagccacaagagguagucagcuggggccaccaccugaagggcagucuguagggcaggaguuccaggcaagggagccggugugcccugggccgaggcagccugcgguguccuguggccggagccauggggauggaggcuggagggaggcaggcaggcagaggugcugcagcgaggcaucuuaacccagcuaaggagggagcgcagacaucuggagcagcaagggugcugacacucacccgaggacaucacagcccugcagaggaggaagacaagccaggccgcccaccacucuggcaggcauuuugguuggggaugggcgggcauaacaggacacaggaggucauccgauguccacauuuccccacacagagugguccugccuggcaccgucucagccaucccagacagauuuucuguucagccuugguugccauaugaggacuccacccagagggcccacauggccuccuaagucacaagugguuggugguaaacccaggccuagagcccagguuucuggcuaucccccuggaagaggcccaccuugggcacuugggaacaaccccugaccauccuugagcccacgcugcugggugaggcuggccgccuugcugcaggaagccugguuuauaaacaaguccaguuacaggaagaucgggaggguuuuugguuuucacuggacgugguuguuucauggacccaccccaacagggagcauggcaugcuugaccuugggaaagggaggccuuggcuuaacgccgagagccucaucugccagcagagugaugugguguggacugaggcugcuccagcagaaugggcagggcaggccccagaugugaacuaacuagcuugagagagcaccuagccggucaagccuagcccacguggauccagucccaccuucuuuccauguugguagcagaagcugggaguccgguugcagggguggcugaguuggcagcgcccguaagaugcuguggauuuggauuuggguccuggaggcagggaggcccagugucauggguaugcuaccaccacacaacuauuuuaaaauagaaggcgcuggcccuaaauuuuucucguaucaucacauuuaucugcaucuugugaaagugcuuugccucaugaacagucccauaguugggacuguuucuccuggauauaauuuacauuguugugacaacucaaagucaugauuaacacaaaagugggacuuggggucacucaguggagugaucugugcagucacuucuccucauucauccucucaccuguccgcucuguuaauguguacuauauagaggagguggcauuugcuggggagagcuggcugugagaugggcaugggcccaggaacaagcacagccaggcucaggaggggugcauguggggaagggaccuuuucgccucuuugccacuguauuuugggagguagaggggguuagagcuuugaccaccacagaagggggugagacagaugugaaucaccuucgccaaaugaaaaaaccuaacccagaauguuaguugcuuugggcuucugugucugaaagagagaggcccuugcuugcuguucucuacagacagucaugcuggagugggcccugcaggccugggcuggaagcgacacaggacacagcggccacaaucuaccucuucucccugcuccaugcuguggucugugcccagggcccaaggcagccagagggccccugcccucaggagccagacccagccccucugcagaucuagcaggagaccccacuuucugcaccacucgggcacccacacaaacacacccucauaccccaugaucaccccggcuccaucuccugcucuccccacacgcuggccccagugcuggcccuuggggccuuugcuuggcgcccucaggcuggguguucuucccucccaguguccucaucccucacaagucccuguucagaugucaucccacccugggcccuuugcugaucacuaucuaaaggagcaaaacacccucuugacacuccccucucccgagcagcuggcaccaccugucauacgacacauggauguguuggcaucgccugucucccaccagaacgcccacacugggccugcgugauucccucaccucugcagccccgcccccggugcaugccugcauagaguaggugcucgcuagcauucuugauuaaaugaaugcacagacucccuggccugggucagccauggcauucuccaaaccacaguuccuugcccucuaaagcaguggcuggugcugugcucauuaauuccaaaaggcaagaaacgaaauggucucccgccccaagcuauggagagcucuucaggacagcagccucccaucugucuccccagaggcagaagagccccacaccuggguugggguggccucccaguugaccaccaaagguguuuccaaccucgagguucugggcccuggcuggugaccaaguggggaagcccaucuggggaaggcagggaggacauggccacgacugucgugguggugcccuccaggccugcucagggugugguggaguccaggcauggcaggagugagugauagagcaagcgcuuugaagcaagccaaugcucccaguucccugacccucaccgaugggcucuucucucucagcacauuuuuaaaguuugguuccuggcacccguuccuaucaggugcucucucauuccuuugcacauuucucuacacauauaugugggucuugcacccccuggacuguggacuccaccagcauagcggccccaccuggcccacucaggcaguccucagagucugggacagugccuggugcccagcgggugcucugagggcaaucaugggcagaaagacaagcaacgaaugcaggagugagcuucugcuugugcugugccagagggaggcgcccagcaccauggaugcccugugggggccauuggagggagucugcaagcgcuuccagaagggcgagugccugagugugccccagccguggcuucccuggguccugucuuugcggagagcauggugauccuuugcuccucuucacccaguuugcaagagugagguggccagcugagggcagagcuauguguucugggguagggaucugcagcucuuaacagccugcuggcagcccucaugcccagugcuagccucuguugucucugagccagggcaugcgggacccagagugggaguuaggcagaagagacccgcaccagccccccgugagggcagcagacauugcagaugcagguucuggagccagccgccuagguucaaagccaggcccccuauguccuggcugugggaacugacgcaagucauucaugccaugucagcugguuguuccucaccggggagcaggguuccacaugugggcccugcccaccaggcaugcagucuugcacagacggggccugcccagggaggcagggucauuguccccuuguaauaggcgaggggacccaggguaccucagcucacccgugacagaaccugccauccaccuguauucuggacaggaucuacuuccaugggccgaggcacgcggcaucucgcuuagggccuagcugucaugggcacucagugccauugcugcugcccugacccagagcaucccuggccccacacagagccaaacaagugacaggaggcugccccucacgccaagcucccuucccagcaugcugcccagaccacugugcacaaccacucccgccucaccccugagccuacuugugcccaccugagagaguguggggggaugacagaggcugggccuggcacacacaggcugcucgggugcugcccuaggcucgcugucugcuggcuccacgugcccucgggcugguguggggcaccaugagcagggaagggggugguggguacagcccccuccccagaccuccuucaguguuugcugucuccuguggcccugguuucccuugguuuucagggucuucagaagacagggggccuccucugagcccagccuugcugucagaggcccacauguggcagccauguguccaugggaaggagcaggagguggcagcuuuucccagcgcccaggcaccuggccuuuaaggcuuccacauacuuuguuuaaaaaacaaagaagaagcuuucuuuccagagcccucuguggggcccucccuaucucaggcccucucugagggcuucccccuuccccaucauaacagcaggacccauuucacagacaaggaggcugaaguucagugcaccaccccccaggcaccugcagagcugagcaccuuuccaggguacuggccuggcugcuacagggacagaccugggaaagaggccaugaugacagcuguccuuuugguacacacgcuggugugucccagaugggaguccuggcguucacgcugcugcagaaacaugaacaccagcucuguuucacugguguuggcucuguccccaagacccauccuuacuagcccuuggagcccaggcuucugaggguagagggacaccuggccagaggugcuccaagcugaggccuaugcacuccaagaccggggggcagcauaucccagguguaaaacagcccccacccagccacaaugcaggaucugagccuguggccacuaagagaugcaaccugcccagggcagaggcacagacuguguuuuggaagaaaagacgcacagugccacuagacaaggcccucuagccccucagcagcaaugcuggacaguacugggccagggggcuacugcagagagcccgaguccauggcuggugagccaagaggcaguuacagugggagguacugagggcugugagguaggugcagggccagggaccaggauguggccacuuaugggcaccugcuuugugccuggcccuguccugggcauuggggacccauuuggucacauaggccugagagcugagguggacacacggccagugggugacacgugugcagcaggagugcagccagcaucagaaagcgugugggcauuccaguggggcgguggcgggggcggggggugcggaggucagcccaugggcauaccugccuccccugggccuugcagccacaggccaccucugggaucugccuccgagggacagugugugggcacauggccaucagcacagacacagggugccaggccccagccccuguacccacgcucacccugggccucagccccugcaggucagggagggauagacuguuggagucugcagcuuucaaaucaggaguguggguggggaccagagaugccacgccaccccugcccuuccccugucagcaagaggacagccagcaccgccgccugcccacggccucucgcucugcucugggaacagggcugauacaguaaucagggugcuacauaugggcucuggaaaaugacugcuccccgggccuuuguucgccuucauuauucuagacgguuuuuuucccccaccaagucauaaaaaugacauuuuuaauauguggauuuuuuuuuuaaagaaaagcaauaugaagaagacuuuuauugucaauaagcucuaccuuuuaaaccaguuaucuuaguuucugcucuagguauuuuaauugaagauuaacugcuguuaaagaguauacacauuuagggagugaguguuuggaguauuaaaauucggcucccuugguggggauggagcuccacgggaggccaccaggaaccaugcucccccaauggccagccuuggggggcugucugaggaggagggccgccugcaggaggggcccauccuugccucuggccacagccuuuucuuucauuggaaggggcaggcuggggugaguccuagccccacaggggagcagaggacagccugagagcauauggcuguguggucagaagggcauccuggcccggccucugcacccuugguugaagcaagcccuuccuuccccuuggccagccauuggguuugggcacaaaggaaggagagagggaaagggccacuaaccgagcacucugugugccaggacuucugcaugcagcguuggucuccacggccaugagcgaggggaguguccucccugugcugcuggcagcauggggccuuaugucccuagagcaucuaugaccccgggcaggccugucccccucauuagacacguccccagcauccucacagcaucaggaggucaggcgccuguuaucccugcgucacaagcagacaggagguuucagcaugugugugaggccuccgggccagaaggcagaacgggagccauggggagugggucagcucccagacccucagccagggccucagcagggcagccaucaguggcccacuccugccugacccacugcuccauugaggccaugcugccucacugagaccugcccagggaaaugucaccuuuuccaccacagucuuccugaccccagcuuccuuccuccuccuccucugaaugcccgggugugacugucuguggcuccuucccuuucuucccagggcuuuucacugcugucaugggugguuugcauccaagucucccucuaucucaagaugccugugagagaacaaaaagaggagaaaacuagcucugcauuucccuguucuuugucaggcccagcuuccucccagcagagugggacuccugccaggccucccucacaggggaucguggccgugcaaugaggcggugucuguccagugcacagcccagcacacccaggccaaucagcagccaggaacggggcccagcagagggcugagccucaguuguagcuuaguuagccccgagcugacggagacacaaugauacagcacccucagccacagccaugaucagaauggcaguggccucucuuuaccaagcgcuuccuggagagagccgggccaugugucuuauucccaccaucccucaccccaacugaggaaaaaaccaaagcuccgagcaggccagucaagcugcugugucaccaagccugguguccaaaccccagccaugagcacagagcucaggcucugacagcaccacugucaucccugccugcccugcaggugucaaggccugccuucaggaccugagauggccuggacagccaccauuccaaccaaacagaaccugcugaaggaauggcccugcccucuagggggucccucauucuagaggcacauguguaucugugugugguuuguguguguguauguaugucauggaccaggccuggcuuaccaacaguacaggcacaggguggcagcuggcggcgcuaguggagaagagagacagccccuuccucuagcuccagcuaccuggagaggaagcugggcuucuccagcuacuggcgaggacaugugaucucuucucugccacugacugugugaccuugggcacaucaauuugugucccugggccuccauuucuaccucucaaugauggaguggauaauguacccuccucacaugaguugaggcacagaaagcacuuuucugauccuuccuaccccaagcccugugccaggcacugggacacacugucaaaugggaucgucuccgcccucccaaagcccccauccaugcaggaguuggacacacagcugcugagagcugggacugguuccugaggguggauggccuacugggcaugaggcuguggugcugugaaggguuugagcucaggcccaccacguucuugcuguguuaccuugggcaaguuccugagugcucugugccucaguuuccuggugugugugaauagcaugauugugaacugagguuugcuguugucuguggagcauguggaauggugccuagccuguaaaggugcagcaaacauuagcugugauugcuacugggguucuuucugugauuguugagaacuggcuggugcccauuuuugggcauuuugggccagaccucccuuacacaagauggucuuuucugugucaggcccccucuuggccaucugggcugcuuucagugccagucuccacaguggcaaggccccgcagcccacaguccugguugccaauggucccccgacugguacccacaacacagaggcacccugggccucugcccuggaaguguuuggagacaaggccccaccuggcucagccccacugcccugggccugggagaugcugggugggaagaaacaucauucugguugggggaguccccaguugaucccacacccuugucucuugccauccucccuccuuccacaggagauggcugcagcccccugcugccccccacccauggcacugccauccaggcugcuguauucccuguagccagacucucaggcccguggcaggguggacagcuuugugaagcuggggccuggaugggaaucgcugcucccuggcuucccagcuguugugaccccaggcaaccacugggccugccuguaaagugacuuguaggauguccugaggcuggaauaaaaugaugucuuugcagccccuggcugagugggaggcauuuggaggaggcugcuagaaaggcagucacuaugaggguggcaaugguagcagcagaggggaccucuggccaagccgcaucccagcugccaaucugcagagccuagcuugcccagggcugcaguccaguguccuucccauccagacacuugucaaaccucagccccgcccagggccagccagaaggguccccagaagcacagaugcacaggcucaccuuccggaaacugccacugaagcagcucagcucuggcccagcuggccucuacucaucaagugcaugucuuauucucucuggacggaggagucgggcauccacccagcugcucuggcccauggauggggggcaugagccccaagggaaggggccaggcccaggccucccuacugauuccuccuccuaguucugggcaggcaggcucacugccugcagggaugacaggaaagucugugcaguccaguucucccaccucugccaucagcccagcugguagguggucggcagaccugcucaccccccagccucugugcacugacaggacccuguggaggcugucagccuggaggagggugaugaggagcccagaaggugggugggggagcucugaccccauuggcagaugagguggggugcacacgggcugaggucaccaauacugccccuuccuggcauugcugggcugugcaggcccugacuaucucugggggcauuggaucuguacucagggcagaguguggggggccuuggcccuaggggaaggcugggcaggcgucagagaaggccaagccaagaugcuacagagccuugugccgagagagccaagggagacagaagcgggcaagauagacaagugucauggguuccccaggccgagggagcgccagucccgaggcuggggcagugcugagauggaagaggaaugugugguaaggaugugcagggcuguaggggcagcuucugagggacuccuuagaggaauugggacccugucugagugguugugagggacugaagaggucuucagugagcagcugaacugagaggaauguugggguuuuguccuagaagaaucucuggcaacagcacuaaggacagaccagugggagaggguccuggccacucaugugcaggagccccguguccgggcccuggggcagggaccugccccugccgggccugcagggacaccuagagcaggagccuccaaggagccuguggcaaaccaccuucugagcugucccgagaggcugggcaggcgccccacucgcagcugugugagccccagccugagcuucuggccugcacagcaaggaagguaaccuuuggggcagggcuggcugcacuaggaaugcaccucacggaggccucacagccacuccacagggugggggaucccauuccagagggguaggcugagacuccgcugaugagggaugggggcuaucccugcagcagccccuucaggaggcagcugguccagccagucccagagggacugagaauuuaggacaacaaacuuuccuccgcagaggcugccccucccuguauaauugagacucagggccaagucauuuucugccuauuucagaauggauuuguuuuuugccuuaaaaaauaaauaaauaaauaaauaaauaaauaaaauaaaaaaaaacccuuccauccgcauaaugcacugguguucccuccccacgcuccccaaucuccacagcuuugacugcaugauaauuucaauuuacauggugcgggaaagauuucugcaaagggcccuuuuuuguuuuugaagaauucaucauugcugcuaagaagcuuaauguaaauuaaaggaggaauuaggcaacauuaagacaucaaaaugggggugcggggcgcugguugccuacgcuuccgcccaaucaaaggggugcaugagcccgucgagugcgcgcuugagagccucggaaagagcgaggcuccugcgaagggcccgcuccgccgccugcuucccccuaauuccuuuuguugcagggacagcagaguacaggucugauaaaaacuuaaucaccuuaucuuuuuaaagcaaauugcaucuuuguuuacauacgggauccauagcugggagggaaggagagaaaaccaaggagccggccccccccagccagcgacguuaaaggcuuuagcuccccaggaaaacagaagagcccagccugacaaagagguggcuggaggauuccagagucgcugucacugcucacagaggagacuggugucagggcuguccccucucagggagcgcucacacuggcucucucugcccaccuggcucuccccagcccugccaggccuguccuccugggccucucuguccccagccgggucuguguuagagcuaaacccucaucgccucugccuguccuccgggcccgggcugcccugcccugcuagcaggcagaggggucugcauucagacucagcugcaccacaacugccaggaagccagggcaagucauugcagcuccaugagccuggcuggccgcugauagauggggguguugaugucaaccauagccuccaugcguuucagacaugaccgccaggccccacauuagggacacuucugcccuugccagguucccccuucuuucugucuccccaccccuggccuugggggcagcucccucuuggccaggccugccuccagccacgcccugacuuagaggucucacuggagcacugugccacccacacaccuccgugaccaccuguggccugugcagggcagcuuccuaccuugggguggaggggaacuugacauuggagcccaccagcacccuguugagggacagggcuccaccccagcugccccauggccccugcugauggggguggccuugcuaggcagccccuccuguuccuagggcccaguauccaguucagacuggagccuggcugaauccaaggcccucuguggcuguccagccuggccaucccauauaucagccccaccugccauuuaggcucccagcugucagucaucaccaggaugcugaccccaaagagauccccugccccuggcucuggcucucuuccaacccucuccaaaacugcuuguuuacagcaguggguagugcuggagugacuagagcggccccagccccacagggccacaaaggggccagugaccccaagcugcuugcaaggguucaguucccacuggggcaugcaagccacccaccagcguggagaccccucuuccagucuggcccccaacaugaaagcaacgccagcaauuggaggcaauuugccggccuuugauggccaugucagggcggcaccauggcuagggcuugggaaacaguugugcuucccgcauucuucccugauuaccccagcccaagccaggacccggcagccugcagcccauugugccuuuguguggagcuggcgcuuggugagaaagggccagccuggcccugggagagugucuccacgggaagccaugaggagcaguguugcccccagggucauggccgcccgcccccacugcauccugggguuuggguucaucaggggguggagcagggccauaggcuccgagaauccugagguuugggaaaaaagaggcccuacugaaugacagacguacauguagcacacacacacccuagcccacccugccagguagagagccacccuccagcacaugggagagggaccagggggccaggucagccugagacccgagccuggacuucuuucucccuugggucacucaagggcagacagguguuuucugguccuggaggcagggguccugcccugcuggggcauuuuucuucccuccgcuguccugcaccccugcugugagugcuugugaggaugaauccauacucauucccuuuguuuucaucaaaccucccugagcccgugugcuaggcccugcacacaauccuggagaggugcccccucacaggccacugggggaggcaggcauauaaggcaaugacagccacaguggugcugggcagggcacccaggaggaucucacuuggcugggcagcugaggggcaccuucccaaggggcagcaucagagugugagcauggcaggcagagggaaccacacauuccaaggcccugcuuggcuucuuauagcugaagcaugguacaugauggcgucagagagggaggaggggugaggcugagagagaggccagaaagagaauagacgcuucuguugguggagccaggucuagaugucugacccggacccuagagcaauccuugggauagccaggugggaugagggaggaggcagcgaggcagggcuggaggacgguggauuccugcgcccacaccucccagucguugcccuugaugcaagcagcagagcagcaguguggggaccuugaacuuccagcagccauggaggagucaugagcaucaccaccccuaccuuaccucuugucccuguccuuccugggcagacucagagcauggcagagacagcaccaugggccuagagaugucagcgagcuuucuggcccucccuccccuccccggcuccugugugccauggauugagcagguuccagccagauugcaccgguaggcaccgugccuucucugggcucccagcuggaugccggaggccacagugauggggggccuguaauagacaucccccugugaguaacccagggucacaguagaagccuugggaaauacauaaaagaagaaagaaggaacagugcuugcaacccacucccgaccccugacagccaaauggacagucuuccggucucuuuucccuucaucccagggcugcagcagaauucuuccaaaaauuuugauugcugcauuuuuuuugaaucagcauuauaacauaggucuuucuuuguguaacuuuaaacucuucucagguaucacuuuuagucccacagaacauuuugcugcagcaaauagaugcuggaugggucugcuggccucccuuggucuuagaggcccuuuguaguucucaaaaacgugccgcucccuuaguggguaagcaaacgggcuugggaaucagauagccuggcguucccgcucugccuguaaauagccgugugaccuugggcaagguacuaacucuucugugccuguuuccucaacacgguguuacgagaggauucaguaccuccgugcuguggggacaucuuuguguagaaaucuucugccguaucucagaccacuuguuuggaccgaauuccuagaagugccuuucuuaguucacacugugaccaucuaggacuuugucccucccagguugucaccagccagugcuuaaacagcugcccuucagguucuuggaaaaccagagcaguuugccccucagccccagcagggucuccuccaacgcuuauuuggagaguguucucugaguauccgccacucaccagcaaucacuccagguguuaggguuacaacagugaauagacaaaacucccugcuaggguggagcuugucauuucagcagaggcagacaacaaacccaaaacaaggacaucauagaggacauuagaaggugauaagagcuauaggaaaaauaguggggugagagggggucaggggagcaugaggggguuguaguucuaaacaagggggucacaaaggccucaccaagaggugacaguuguacagugacucgaagaaagugaaccugcagcugccggagcucccaaguccacaggcggagggauuggcaaagacaggggccccgaggcagagacaggccaggugugccucccaggugggucuccaggcagagggauuggcaaugacagcagcccugaggcagagacaggccaggugugcagaagggcagcgaggaggcugacacaggggcggggcugugagccaggggcaagcagaggccagagguccagagcagcccccagugcagggaggaagaugggggcaggacugcaccucccugacagcguagguccuagcagagcggguggcagagcaggcccuguccugccugccuuggagacacagggccugcaggagguagacaccaggcagaugggcagucggcacucagcacguggccuugucaccgccuucccgcguacucugaccccaagucagaauggggagccuggcacacagggcaccguguggacauggugagcuguggucacccuggagccaggcccucguaccgcaccacgcauggcacacgccuucaucugcccucagcgccucucgcauacccuaggaauugucacucaaauucccuuugccuguggauccgugacagcaauaucuauggcugguccccgucaucuggccuuggguccagcauuccuccuccuccuccuccuccucccuuggagcaugcugaagcagcccuguccccacacagugacugcggugcuguuuccuucgccacccuucugcugucuggagaucuggcugccuuguucacugucugugccuucuuagaugaguaaacugcaugggagcugggcccuggucugugcauucaccacuauuuaucuccuguucuggcauguucccugaauauuuuuaagugaaaaggcacagaggcagguugcgagaagcagagagugggacccgcagagucuggcuggguggguagcagcucuuaccacgugacaaccuggguugcucuucacuucccuauguuugccacauggcuaagaaaggaaaaaaaaggccacugggaaaacaaagcagcuccuggugacauuugccacaaauccaugcugccccauguccaggucucccuuuggucaggcuuuccagguguggcuucccggccaguccauaauagagcagagguaaacgagccugaccaucucaggagagcaauuaaauggccacaucuucaccagugccagauagacuuuccggcucugccugcuccgggcagugcgagguaugcauuguguguaacgagagccaucgcgggugagauggacugccgauugggccacgccugucuccccagcccagcacagacgccggggagccccacgccuucucagccuccagaccuccuggcaccagagggagacgggcugcccaugccauuugucggggucugcugccagcuaccugcucuguuugcagaaggaaggccaggcucugauucagggagucagauaccuacaggccaggcgcucacuugaggggacuggccaggguccuccccaugcccacacucugugccccaucccaagcggggggcagaccaccuagguauggaaccugcagagcagacaccgcucaggcuccaaguaagguaugcugcucacagggagcgcuuccuuaaugcagguccccaaggccauagugucacaugucccucaggcaggcgugcaagggccuggcuucuggagccccguucauaucagcugcauguccucagucuucccaggggacucaggcuuuagauggccaguaaucucacuuccgccugccagagggagaccggacccuuugugcaguggggcaggcugucccuggcugacucuacagauggccucuuuauccagcacccuugucacuuuuuuuuuuuuuuuuuaagacugagucucgcucuguugcccaggcuggagugcaguagcgcaaucucggcucacugcaagcuccaccucccugguucaugccauucuccuacuucagccucucgaguagcugggacuauaggugcccgccaccacgcccggcuaauuuuuuguauuuuuaauggagacgggguuucaccguguuagccaggaugaucuugaucuccugaccucaugauccacccaccucggccucccaaagugcuaggauuccaggcaugagcccuugucaccuuuuuaaacaucuagagcugcagggccagugcacgaugcucucacagccuugagaaccauugucagaagcccucugaaagggguaucccccacccaucacucugaguggagagcagaagcuggcuuugccauuggguaagggcuguagcucaaauccuggcucuucugaacucacuguggggcuuccaguaagucacuggccucuuagaccuucauuuucucauccguauaaagaagggguggccaacaucuucaggaaacugagccagaaauaacccacacagccccgccagccagcgcucccagucugagacgacaggccagggcccuccggacugaagcuugaugugcgagccuuauagcugccuugacuuuucagggacgaagcuaguacugggcaggacugggaaaagggaggaaaauucuucaggugccagcaggugcaguggcacaggugccaacggcacauaggaagcugggcccucugccugugccucugcccagcuuccucccugcucugguccucuagguucccagccuguacaggcccuuugugcacauggggaggggauccuggugggacaccuccuuggcaggcaggguaugggcugccuucacccccaccugcccucagugccuucauacccagcugccccuagcagcagucucaggagccaccacccacuggggcucccugucccaugccacucucacaguguccccaugagcuugcucccaccaggaccccccaguggggcugugaggcucacagagugagugcuuacacugaggugcucugccagggguggaacugcuccgagcccugggcccacccacucccacagaugcagaggagccugcuaaguggucucacccuggccaguggcccacauggaggcugcaccaugcugccaccaggagauuccucaugaauacaagccccacagcacagaaagacaaaugcugaugaucucacuuacaugugguaucucaaaacccaaacucauagaagcagaggguagaagggugguugugggagccugggggugcaggcuggggugggaauggggagaucuuggucaaaggguucacaguuucaguuagaccagagaaaucgauucaggagauccgcugugcagaauggugacuguaauuaauaacaauguguaauauucaaugaaauuugcuaagagaauagauuuuaaauguucucaucaccaaaauaaguaugugaggugaugaauguguuaauuagucugauuuaaucauuccaaaauguauacauauauuaaaacaucauguuagacugggcaacauggcaaaaccccaucuccacaaaaaaaugcaaaaaaucagcuaggcaugguggcacgagccugugguccccacuacucaggaggcugaggugggaggaucacuugagcccaggaggcagagguuguagugagccaggauuacaccacugcacuccagccuaggcaacagagugagacccugucacacacacacacacaacacacacacaaauauauauauauacacauauauauacauauauauacauacauauauauauauuacacuauaaauauacacaguuugucauuugucaauuuaaaaaugaaaaagacaagcuccagagaaagggcaguugcagcagcauguuuaaggaugagugggacuucuauugccuagaaugggaaggguguuccaggcagagggaacaacacgugacaggcuuguaugugcaaugaggagcccaggaaugggccaugaucagcagggcugcagagacggugcacaaaggcagagaguggugaagauggagguguuggagugggugcgugucggggcaucagcagaaaacaaauuuccacucagguguucagcuggagggaguugaacaaaaggucuuuagugaggcgugggcugguuaaagcaacucauagagguagcuggaaagcggugggggcugcacccacccaagccugggggcggggcugcguauaccccuggcagaggaucccgggaugagccacugacucugugagccccauggccccacugggguguccugaugggagcaagcucucagggcaguggcaaacugagccgagggggcacugugagaauggcguggggcagggagccccagcggguggugguuccugggacugcuacuggggcagcuggguaugcagccugcauaucccacugagggcaggugggggugaaggcagcccagguccugccugccaaagggagccagggauacacacccugacugcccucucuucccacacucuggccuguuggggcuuccacugcuaaaccuggucgugcugucugcaggggucagccucccaggcacacaagaggguggagaaguggagaaugggucuccagaggcaaucagggaguaccccacccagggagccucagaugccgaguuuccagacguggacuuggcaugagugcacuggaaagcaauggaccacucggcacagagcagcagucccuccagggccugagcacggggguggugagcugaggccccaagaggcacagugcccugcuguacaccuaucagaugggugccggagggaccaaaaugucagaauggaccacaggccucagggcugauuggcuagggagggaggcagaagaggggugagucuaggcagcaggugcgcgggcagggagcccacgggugcuugggguacggcagagugacaggcucucuucugugccuugcagguggccucagccccgaguccaagaagauccugacacccgcccucaagaagcgggcccgggcuggccguggggaggccaccaggcaggaggagagcgccgagcggagcgagcccucacagcauguggugcucagccugacuuucaagcguuaugucuucgacacccacaagcgcaugguucagucucccugaguguccggugaccucccccagggccuccuugcccagcccaguccaggcugcugugccaaaucccaaccagccacgccucagccucucccagucucucccugcaguccugcagcagcagcccccacccccaagcuuggugcugagcccuggugaggagcugagggggauggguugcuggggccaggagggucucuccuccagccccugcacacucccacccaggacagcccccagcccaacuaggaaagggccaugggcagagggcugguagccaguaucuuccacugccccaucuguuggccaccugcaggccagucucaacccucccccaggugggcaggcacuugauggcuacaaauaaaugucccguggccccagcccacucuacuggugucucucucucugugacuucacuagguccgccgcccuccccagcuguguuccaaggggaaucucagaaaucccaagaguuccugcccaggucggggccagggaagggacccaaacucagagucuguaggcugugggagucugcagagugucugcgcuucucaaccccacuagguggcuccuggggcgcucugggccuucagggagaauggggauucucugggcagcuggguccagggaagguacccacagggaaguuggggaauagcagggugccuggccagagcaucaggcagagcagguggaggcuuguuccuccaccccaacacgaggagucccucagccccugcccucaaguuugagaaccacauacuucccagaaaguggaggcuagcauggugagggcacccugcagagccaucugccauccccugcacccacagaccacccugccuuguagccccaggcugugggauacucaggaaggggugaaugguggagucaacagacugaggggaaaucaaagcuuuuagagacauuugcaggaugaacagauguucaaacguuccuuuauuuggucuccagacagacgcagaggccucccuuuuaucccaguaaucggugcauuaugcuuuaauuugcaaauggcauuaaaaauauuaacaggggca

SEQ ID NO: 14774 - RNA, 970 nt, Homo sapiens
uaacgggccggaccgcggcgacuaccgagggaggugaggggcgggccgggcggguguccgaggcggcggcggcggcauggcagggcggcgggugaacgugaacgugggcgugcugggccacaucgacagcggcaagacggcgcuggcgcgggcgcuaagcaccacagccuccaccgccgccuuugacaagcagccgcagagccgcgagcgcggcaucacgcucgaucugggcuucucgugcuucucggugccgcugcccgcgcgccugcggucgucuuugcccgaguuccaggcagcgcccgaggccgagcccgagcccggcgagccacugcuucaggucacgcuggucgacugccccgggcacgccucccucauccggaccaucaucggcggugagcgcgggccggggcgggagccgggcucagggacgcgggcggagcgaccgggccccguguccgaauucgcucgagccuuugccgggacgggaaaucgccccaccucauugguggggcuccugacgccccaagaggcggacgugacuugccuagggcuccgcagcaagugagcggaggcuuugagauucagcuuuucccauccagcagaaccgagcugcaaggcgccuuccuuaaaaaaaaaaaaaaaaaaaaaucaaaaaaucccuaccaaauguguuuauaauacauggucaaguaaagaaaacucaaaauaagaaaacucacaagcuacaaaaaggguauacauacaaaggcugucuucauucaccugucauuuggucugauucccguuccuagagccaaccgcugcuaccaguuuuuguauaucauuucagaaaggcuccacgucaauacaagcauaucuguguguauguauaaaucccucuuucccucauccuuuuagacacgauuucacucaacauugugucuggagagugccccauaucuguacacaaagcuacaucauucuuuuuaaa

SEQ ID NO: 14775 - RNA, 42847 nt, Homo sapiens
agagagagagaaucaaaauaaccuaugaagauuuauagaaaacacaccagguaaggaaggguucuuucaaagcaaccacaggaacaguuacgauaacuuaaaaagaaaugcuuuccacacugaacugacagcgcugcagaccacgccugaguggggacggcagccccaagcccaggggcaagcgcccacaggcuggacccaggccaggcacaccuggggagucucuuacugcugaaaaccucagccaucucacuucauguacuuauccugcuggucagccaggauuuuggcggaggacuuggcaucauagaaaaguucacugaucucuucgacaugcucuuucucaaugcuguccuucccguugauuuuagcaagcaaguuggccggggucagcagcugcacugaguaccuagaguggacaggggccagggcuggagugaaacuggggccaccgaagaaagcaccuuccccccacaucaguaggcagcacuggcaccaggagcagagcccagugcugggcuugugccagcugcuacgaacacagaaaaggggagacaaaguugucacuucucagagagcugcagucauuaucccaucagagaggguccaggagccaccaagaagacauaagugcuauuccccaaaucuuuaguacagucuacaaauccuccaguaggaaguaaugucacugcuacuggaaaaggacugcaaacuuauauguauacagguguccgacagauagggauauuuaacauggcagggaaaugaaaacauagccagcuggaaguacaugcccauccaaaggcaugaagacucugccguuuuaaaaaguaccccuucauccaaaccucacagcuugcauuucugccuucaaccucaggagcaagaacugacucaagggauguagggaagggcugaggacugugaagcaaugauuuuacaaugagucaggccacugugaagggacaugcucugccgguccuguguuugagccgcuggagaacaauuaggagaacugucuaugucugcgcuccucccuggcucuccauauccaccacccagacauuuuuuauuugcuugaugguuaaauaaaucaaaaaaguuaaagauuuaccaggccucauaacaccaccgggagaacaggagccagggcccuggcuaaugagcuaccacauggucccugcucucuaguucugugcaucuucucugccacaagaaggcccagggucaaagcacucuccaccagaggggagcaucugcugcaggacauggggacuucacccuuacucuagcuuguuaaaaaccaucagauagauccucugcauuugaaacucaagugcccuggcacccaucgcgccaggaagagcggauggauagagucccaugcccuaggaagggaccugccuuuauuguccagaaugaccccagcgagggcccuggcugugcuggggaggccccggcgggcccaggguaccagcucaccucaguguggucuuggugccaaucucccccaggugguucagugccuccucacugauguugauuccuuccgucugggcacggauuuuaaugaucuuuuaaaggauaaaaaacaugaucaacggugacugaccucaagugccccauuucuaaagugcuuuaaagacaauguugcucagauuucucacugugcagcauaagagaaacugagaccuggguuggugggcagggagccaacgccugcccagcacugccggcccggcacccuccaggaggcaugugcggcccugcaguaugcaugaauagcaucacggccagugugcuguauucaacugacucaaguguggcuggugcccaaggagguaugcagcuucccaaguggcucacucuugccuccauguccucccguccccuguccccaggcagagaacuggggccucuucuaaccuacccggggcuccugcaagggcucuaaccuuccucuccagcaugggcacuacugccuacaagcacucaggcaagaagggacauuuuuuauuugcuugauaaauaugaugguuaaauaaaucaaaacaguuacuuuuaaagauuuaccaggccucauaacaucaccgggagauaucuaaucuaucaagaagaggcugacgcuuguugcaguuugaagaucuugguagaguuggaggggaggcaggcuggcggcggggaugcuguaacacgguggaccaggauccugcaggcguaccagcacugagugauaaggggcagccaggauaaugauguuguguguuguggagcugagauaacugcaggacuucgagccgcauauaauacaggaauuuuucacuuuggcagcuucguaaacaagauaucaagaagcccuuguugaaauuaaagccauaaaagcacacccaguguagaggcacaggagcugggaaagacugagucccagcuucagccuuccaggagggaggagagccagagguuuacugagguggccacaucaagccucgccugucagcucuccaggcugggacccugcgggcaggagcugcagggggagcccagucucugaugaucgcgguugggcuugggggacagcacauuggcugcccacagaugggaaaggccuuggaaagccccagcaggacagagcggcugcgaugagccaggugagggugaaaugcuuggccagcaaacacccuggggaggcagccccuccacccgcggccaccacugcugcaagguguugucugcagucuucccuuuucucaagacaggcucagaacucagauccuuguacgaaacguccugauuuuggcaggacacaauggcucacgccuguaaucccagcacuuugggaggcggaggcagguggaucaccugaggucuggaguuuaagaccagccugaccaacauggcgaaaccccaucucuacuaaaaagacaaaaauuaggugggugugguggcacaugccuguaaucccagcuacucaggaggcugaggcaggagaauugcuugaacccgggaggcggagguugcagugagcugagauugggccguugcacuccagccugggcaacaagagagaaacuccaucucaaaaaaagaaagaaagaaagaaauguccugaugucuagaugucagcaacuuguucaaacauuucacaaacacugcauaggccacaugaaacguaucugcugggcucaugggugaacugccagggugugagcuccacugaaacaaucuuagcuuaugcaggaggggcuucacugucugaaauccaaagcuaaaugcagcugggcaaaaaggggcccucugaaguuacuggaugguacaaggacaaccaagaaaaggagcugggagggacucacaacagaacuccccccugaacacagcuucaagguaaaaacggcuucucacucacagcugggacugaggaaaccaccaggucuugccaagaaaaauguccccagaugaccuucugaaacuccagggagauguaaauauugaauccuggagccuggucauaggagacagcuuaagcuaagugccucgccuucagugagaugcacugaaucuguggcucagcuuccagaaugucagggacacucugcucucucucucucacuagagagagcagcaggucagagcaaucgugaaagcgucugucucaggcugcucgaaaauggacaguucauaaaugagaucuuuaaucauuuaauaaccugcagggauaguuuaugagggugucggcuuggauugcagaguacacaaguuacauugaguuuguuuaaaaaccuagccccaggcuccaguaaaaaugcugagguuaucgccugggccagcgggaacaaagccacgaguccugagagaaagccugaggagaggcccuccugacagagccaagacagccccagcccagaguuggccuggcaagucacuguccuagaagcacaguacagaacauuccagacuguuugggccaggagcucuggguucgaauggcggcagcaagggugaacuagcucugaguggcaguccuggcucugcugcuuacucuccacauagccacaggacccucguucuuggagccuccaacacuggcuauugcgaagcuguuguauguuguacguagaggacccuagaggguaccuaugaagcacacaaagcuaugaauacaguaauaacaacagcaaugggaaggaugggagggcccguuauugccaauaccucacaaauccuaaugacaaucuugcaaaggagggaggagauguuccauuuaacagagaaggugaaggcucggugagaugcaccaaauugcucaagucauucaguaggcaaauggugucucuggcccugaacacaucugugcugggcugccuuuuuuggcaggacacaugggguuuuggacccaacaguaaggugcuaugucccgcaguaagaaugggccaguuuuccaagaauugccugggacuguuucugcuucugccuccguucagugaaugccuuggcuucaaccuggcagucacccuugcaagucaccuggcaagacacccuuacguggcgaugaggcccccggccauugacaccaucuccuagguaacauauacaauugcuacuaugaaccauaacugcuucaguaauuugccaaugcugguuacaaagggagaucugugacucuccugaugcauccccacagcacuccugcaugcgguaagagaugcuggcaggcccaggcugggccuccagccacaggagagcagcagaagugccaggaaaggcccaggagaggcccugacugcuccaaaggaaagguccugcucacaaacugccagaggaaagccaccucaugaauccuaaugacaaugagaugagagauuucuagcaggagggaagcuggguggcacggugauuaagaacacggguuuccggaucagaaagccuggauuacagccagucccauuaccugcuagccacugacuaauguuaugaacuugggcgaauuaguuacccuaggucgcaguguccucaucugucuuuuuuugagacagggucucacucugcuggagugcaguggcaccaucacagcucacugcagccucgaccuccugggcuaaagcgauccucucaccucagccucccaaguagcugggacuacaggcacacaccaccacaccuggcuaacuuuuugauguuuuggugaguaggggugucacuauguggcccaggcuggucucaaacuccugagcucaagugacccuccagccucagccucccaaaguacugggauuacaggugugagucaccaugccugggcaauguccucaucuuuuaaaauggcaaugacaguaguucucccugccucauggguuacuggggaucaaauggaaucaaacuggccaggcauguccugcucaacacgaugcucaacaaagaugccaugcucuggugaaaagacaagguccaggcaaagcgcaucgagacgucacugcagccccagucugcucagcaucuccaaccauggcugcaugccagagcccaucagaagagaacauuuggggcaaaggugggcagggcagaggaaagagcacagcacaugcugccucggagacaccaauucaggguauguaccacugaagauggccugggcucuacagggcacugccuggcuuugcauccugcacuuacagcuccaugacucaaauguaaaaaauaaaauagauggugaucacauggaauaccuggaaauaccaugaaggugacuagaaauuccuaguccaaugguauuccuaugcuuggcacauaguugugcucuagcuccaaaccaagcaagaggcaauuccuacagggacaacugggacuguggcccuuuggauaaagcccacgcucauacaucccugucgucucccaacucagccuaacccagauucagcucacgcagacuucagggcaugcacggugugccagccacugagcuagaugcuuccaaggguccuccaaugaagccucuuauuauaugaucaguuucacaaacucccuccuucaggugcucuucuaagcuguaugaugcugucucgccaucaccucuguggacuuggcagaagcccucaaggacucuauugcaaagccacagaccugcccaggggcggccuccaaagcugccgagaaacuugucaugcuguuuacagcagacaggcucugcuaggacacaagcacuggccucuuccaggucaggguggcuacauucuguacccugcuggagcuggcuugcuguugguucagguggaacagcgagccuggccuuguccucugaguagaaaaggccacaggcauauucuggccuggucaccaaaaggcuaucacuaaaucauauuuuauugcuuccuuuuuauagagcugguagccucccuaauggcuaucaucauguugauuuuuucacuauccuuuuccuaaagcuuaucaaagggggaacagcagaaaagcgaacagccaagacagggagcugagcuucuguugacacuuggggcaaugucuaguuagaccaauccaucuuucagauggggagacugagacucuggaguaaugugacuugcucgaggccaguagcuaaguggugagauggugaauggcagccagauccaagccgcagauaccuuucugcacagccaccagugaacacugggagcaaaugagagaagagagcaggagggaagaagggaggcucaccuguuucauuuccuguggaguauacagcaugguccggauuaucaucacucgguccagaaggucaagagggaugccgugaggggaugugauguccucagugccucuguaaggggcaaaauuaaucccaucaccuaagccucuguuagacaagaaacgacacuggaaauacagauccaacacucacaccacaagcagcuggcuaggcagccuaagaaucagagccaggaccagaguaaacagacuaaccuccaguggcauaaaaacaacuucaggcuaggcgcaguggcucacaccuguaaaucccaacacuuugggaggcagaggccucccaaagaucaccugaggucaggaguucaagaacggcuggccaacauguugaaaccccgucucuacuaaaaauacaaaaauuagcugggcaugguggugcacaccuguaaucccagcuacucaggaggcugaggcaugagaaucaccugaacucgugaggcagauguugcagugagcugagaguguaccacugcacuccacccugggugacagagugagacucuguuccaaaaagaaagaaaaaaaaaaaccaacuuauuuaucuugguaaucaucaauaucauagcaaaacugggaaggaggaaaaaaauaacuaaaaucauacucaaaaauaaucaucuagauauuugccaaacauucauauauaaacaaauuauauaguauaauauacaguauauacuauauuauaguauauacuaauuauacucuauaguauaauauauaguauauacuaauuaugcccuauaguauaauauauaguguauacuaauuauacucuauaguauaauuuuacaaauuauacuaaguaugcaaguuuuuuuuguuuuuuuucauguugcuucagucuccuuguuuuguuuuguuuuugagacugggucuuguucuguggcccaggcuggagugcaguggcaugauucuagcucacugcagcccuggacuccugggcucaagggcuccucccaccucagccucccgaguagcuuggaguacaggcgugagcuacugcaccuggcuugcaacagucuuaauaauuauguuuaauauuuacuuaacaauccauuaaauauuuuacuuaacccaaauuguugagcauuuagguaguuuccaauuguugcuauuauuuuuauugauauuuugauaauuugaugcauacagccauaagcauuuccuuagcaacuguuguagugcuugacagaacccugaauagcuacuugaaugaauaacuauccuaauuuauagagcuacacaugaguuaucuaaucucacaggaucauagcacuaccgaguauucucauucugaaauauuuugcuauuucaacaguuuagaaaaagagggaaagguaacaccuuaaguuugcauuucuuugauuacuaaugaggcauuugaauguauucccuuauauauauuauuuuacuucuuuuugagaaggguccaaucccaucuuuugccuauuuuucucuugaacccuuagccaagccauaggaauaacaccccagggaggaaccuugccaacccaccagacccugaggugcccugcgcagccacugguggcacauggggccagccuucagcuaguguuuggagggcccaagugcuguaggcuucugccuuggccucuggggguccuaacagcagaaaggcuacacuucuggcauucuuaaacuugugcaggauuguacagucuaugguuauaaguaaucaauauaacaaagaauuagucaugucaacuggauuuguuaguaucugaauauuugguuucaaaaacaaguaagcaugcuaaaaauuuaacuuuaguaaaaauaaaaucuaccuguuuaaauucuauccaguugagguauaaaaaugcauauuuaugacugcaaaaauaaaaugcaaacaaaauacaugcuagcacaggaugaacccugaaaacaugcaaagugaaauaagucaccgacaaaagaacaaauauuuucugguuucuuuauaggaaauaucuauaguaggcaaauucauagagacagaaauuagccaggccuggugguguaugccuguaaucccagcuacuccggaagcuaaggcaugagaaucgcuugagcccaggaggaagagguugcagugagccaagacuaugccacugcacuccagccugggugacagagugagacccuaucucaaaaaaaaaaaaaaaaaaaaaaaaaaaaaaacacagaaauaaaugagacguuaccaggaucuaaggggaggaaggguugggacuucaugcuuaaugguuacagaguuucuguuuuugaggugaugaaaaaguuuuggaaauaguggugaugguuuuagaaauaguggcgauggucaugccacccugugaaugucauuaaugccaaugaauuguaugcuuaaaaaugguuaaaauggcaaauuuuauguuacacacauuuuaccacaauaaaaacaauucaaaaagagaauaaaaugcuacauuaaugaauuguuaaaucuaauguaaaaaaauuaaaaucagccgggcgcaguggcucacgccuguaaucccagcacuuugggaggccaaggcgggcagaucacgaggucaggagauugagaccacggugaaaccccgucucuacuaaaaauacaaaaaauuagccgggcgugguggcgggcgccuguagucccagcuacuugggaggcugaggcaggagaauggcgugaacccgggaggcggagcuugcaguguaccgagaucgugucacugcacuccagccugggugacagagugagacuccgucucaaaacaaaaaaaaauuaaaaucuucaaaguaaauauggaaacaaacuaauaggaaauacaaguauuaaguuaacuuuagagaaaacuuaucuuuuuccagcaacgaaugucuuuuuaaaauuaagaagaauuauaaagaugaaauucuaucaugauucaaaucucaguauuuggugugccuggaaccuucacauuaagcaaaauaaccuuuuaaaacuacauuuaauuuuuaguuuuuuaauucuauuuaggccauaaguguuuuuuaagucuuauuugagaauucuuuugguaauuuugaggaaauccuaagaucucaauuuugccacauuaaaauaucccaaggacaaaaauauccaaaauucuacaccacccaugauaaaucacaacaaacauaaaaaguuuaaagaagaaaagguuagagaaaaauaaaguacucccaaaucaaacuucacaagaacagaauuuauagaaaugcauuaauaacauuucuuauaguuuuuaaagucuauuaaaaggcuaccaagugguaaaaaggaauuugaggagaaaaacaaaagaaaaggcugcugaggacugcuaagcauuuuucaggaauuaaagaccaaacauuucugagauuuguccaagcuaugaaucugaaguagaaaguuucuucuagaaaccauauuagugggagacgguucuagucagugaugcugcugagugggcuggcugaguggagcccucaugugccagcagcggugcuaggccaugugcugaccucagcaggagcugggggaacgggggguggggaggaucacaguuuaacaaggcagccauaaugguaauguuauaaaacugcuaauaagaagcuggauaauaauuacauuuuggucaaucugcagauuuauucuugcaucuuagaaguucauuucuggcuuuggccucagucuacuauuaauuuuaacauuuuaccauucagcaauuguccaaacucggccauuagugagcuuccuccagauagacaguuuggagcuaugaagccacagacccaaaucuccuuggaauccaauacagcguaucuauaaaagcaagacaaauauacuucuggaaaaguauccuauagauauaccaccacaugugcaacauggcugacucauuugugacuacuuuccucuuacaauaacugugacacuguggauguuuuggaccaaauuaacucuuuuugaagggcuguccuaugcacuccaggauguucagcagcauccuuggccucuacccacuagaugccagcagcacuucugagucauguuaaguaaaaaugucuccagacauugcuacauguccccagcggaacaaauuugccccugguuaagaaucacuacauaaaugcuucuuuauguaauccuguaacuacagggacacggauaacacaaagcuuuucugcugacagaaagcacaguaaaaacaccucucuggguaaugugauggguaacucaccuaauauccacuuaaccuuggcucaguggacacacaguaagagugcuaaaaagacagccauuugauuuucugaugaggcugccaaaacaauucaauaaaaaaagaacagucuuuucaacaaaugguucugggacaacuggauauucacaugcaaaauaaugaaguuggaccaaccccuuacuuaugcccuacaugaaaauuaacuacaaauggaucauaaaccuauauauaaaagccgaaacuauaaaacucuuaggagaaaacacaagcauaaacauuugugauuuuagauuaggcaauggguucuuagauacgaaaccagaaacacaaacaacaaaagaaaaaacauaaauuggacuucacugaaauuuaaaacuucugugugucaaaagacacuaucaagaaacugaaaagacaauccaaagaauaggauauuuauaaaucauauauaaaugauaaagaucuaguauccagaauauauaaagaacucuuacaauucgacaacagaaagacaaagaaccugaauaaaaaaugggcaaaggaugugaauaaacauuucuccaaagacaauauacaaauggccaauaagcacaugaaaagacgcucaacauccuuagucguuaaggcaaugcaaaucaaaaccacaaugagauauuacuucauuacccacuagaauaucuauaaucaaaaagacagacaaguguuggcaagaauguggagaaauugggaccuucguccauugcugguaggaaugucaaaugaugcagcuggcuuuggaaaacagcuggcaguuccuugaaagguuaaacaguuaccacuggacccagcaauuccacuccuagguacauaaccgaaagaaauaaaaaccauguccacuuaaaaauguuguacauaggccaggugugguagcucacaguaauccuagcaguuugggaggcugaggcaggaggauccuuggagcccaggaguucaagaccagccuggucaacaaagugagaccccaucucuacuuuaaaaaagaaaaagaaaaagaaagaaagaaaaaaaaaguuguacacaaauguucagagcaccauuauucauaauaacccaacaacccaauguccaucaacuaaugaaugguuaaauaagauacacuauuaaauauuccauauaauagaauacuauucagcuggaaaaagaaauaaguacuacgcaugcuacagcaucaugcuaagugaaagaagccagucacaaaagaccagauuauauggugcuauuuauacaaaauuuccagaaaaagcaaaucuauagagacaaaauugauuaaugguugccaguggauggggguaagggugcagaaggggacgaugacuauugauggguauaguuucuuuuuggggugaugaaaauguucuaaaauugaccguggugaugguugcacaacucugugaauacacuagaaaucacaaaaaaaaacuguauuuuauaugaauuaugucuccauaaaguugguuuuuuuuuuuguuggaacacuaucugccacaggguuacacugagcagaguccauacuguuucuuaagucuugauguuuuggugcaacaaagugacuuucagugagaaacuccuacaagaacuccuaaucccagggagcuauaccucaauaugaagagaaaaucucccaguuuucaagcugggaucagugcugggcucucaucuaacaguucaggauccugagccuggaaggaaagggacuucuuaugguggcaaguuagggaggagccaggcaagaaggcaacagagcuuugccucccugucauccauggauggacccuucccagaaggagccuggagcaucaagaggaccagggacaggugcuucuucuagaacggcucccacaucagcuguccacagggagaggugaccuaaaggacuugggggcugcuugucaaggucaggaggggcuaugaagaggcuucaugccuugcuggguucucagagaucccugaggccaagccauguccacagagcagaccaggcaggggcaugaaaucagcuuccaagagggcaauacucuagggcuggccugggugauaacuuugcacucacuuuuucuacucuucacauaauucugcaaaaaaggugcugauauucccauuuccugaugaggaugguaagauucagagaggucaaggaacucgccugggucaugagcuuccacgugacuccaaugccuguaauuuuuccaugugggaaccaggcuugugcugaaaugcaugcuccauaaaacacaauggccaucagagagugggcucacuucugaggcucaauccacaagggucauuuacacagggaggggugagcggcaagaagccgagagggagcguacacuaccugggaaagaacacuccuaggaggcugcauuuucacggcaaucuguugucagcauccaacaguuccccacugccaccuccaggcagcaccccgucaaagcuccauccccgcucacagcccaggguccacugggaagcggugugggagagcagugagagcauggaguuuggacccagacguuccucugggcucagguuccaguggcaacacuuucuagccuauggccugggcagguaaccucccauuugagucuggagauaaccucaacugcucacaggguugucaggguguccugggaggacaugagauggcccauguagagugcucuguauaguuucugacacacaggaagcccucaguuagucaccucccuucccccucucuuuccuucggagcucuagagaucagaugugguucugggggguaaggaagcccuguaguuccccucuagggguggagucugugggaagcauaucagauggcuauuauuguuggcuauuacuuuuuucauuaccauguugacauuauuaucaccacuacaacaaauuuccuacuagaacauagugccaaaauucucuuccaaagcaaacaaccgaaucugcguuaccugagccgaccugccuaaaaauccauguucugagugucuuccuuccacuugaguaacuacagucuagcaaggagucuccacaaccucuagcagcccuugaucaaaucagcccagauggggcuggggccaaaucucccgggucucaggcugaccagagcuuugucuccacugagcagguucugagaucaaggccaccuuucugugcaccuuaguccugagugggaugggacugagagaccuuacuucugagacgagagaugccaggcucugcagguaugggcugggcuggguucccuacuguggagggagggaagccuauuagcagagcuccccagcagggggcaccaucuguccaaggcugagcccuuucaccaacugcacugucaggcuucagccuggccuagccaaggcuaagcaaguccagacagccacaggcaugccaggcauaccagccauaaggcccacaugcaucugucuccagaagcugcccaaguagccaugcuggaucuggcacacacuuucucuccaagacuuaggaagcacuuaugacaguggucuugucuagagagcaucacggacggggauucagaguagcuacaagaugcugccacauggacuugaaucacgcauucgauuccuaauugcaagugaaagaaaccgccugagggggaagggcuguugcuauacugcagugcucacagcacuacagaacccccauuguggggcuuacccagagccagcaacaccagaguuugcauguuuuguuuuuuuuuaauuauuuuuagagaugaggucucacuguuguccaggugggagugcgauagcuauucacaggugcaaucauugcacacuacaaccuuaaacuccuagccucaagcaaucuucccgccucagccucccagagaguacacuacaggugcauaccacugugcccagcuuggacagucuuaauaauaaagcuucucuauuaaaagcaaacuaaaaucuuagauagggcccaccaucauucagagcugaguuaggcaaaucagcaguuuuuauuucaaacucaguuuggcuccagcuguguccugagauacucaugggccacagggugucuuucuaacucccacugccuccacugcccugagcaugcagccucagggacuuuguccccacacuacucuauugcaggcuugaaaacaggccccucaucacccaccuuugugcccccagcacugcagagaccaggcacuaauguuuaaacaagaucacagaaaaccaaaagagcaauaaaacuaccagguacugggaauacugacacugggcuugagagaugggaagaugggguguucuccaggaccacgagcguggagagugcuuaggagaaaaagcaaccgcaggaaaguuccuggcccagcuuugggccaaucuuggcaggaugagcaccguaugaacacuugucuuccaggggucaacaucugcccuucccaaaggcaggccaaagggaugggaaagaguggagcgggaggauggaaagacaccagugugguucagaggucugggauagaaagaaaaugcuggggccgggcguggugguucaugccuguaaucccagcacuuugggaggcugaggcgggcagaucacgaggucaggagaucaagaccaucuuggcuaacacggugaaacccugucucuacuaaaaauacaaaaaaauuagccaggcgugguggugggcaacuguagucccagcuacucgggaggcugaggcaggagaauggugugaacccgggagguggagcuugcagugagccgagaucgcgccacugcacuccagccugggcgacacagugagacucuguccccaaaaaaaaaaagaaagaaaaugcugguuuuguuaucagaaggagcuggguucuuauccugucuuuacgaugagggacaaguuaugauuccaguuuccuuauuugaaaaaugacgccaauaaugccuaccucucagagcgcagaugaagacugaagacguucauguguauaaugucaucaaaggcuagcccugucugaucucaccuuuguacacuccaauugaacgaccaaauuguaguaucacacccaaaagaucacgugggagacccuccucaugagugacaggacagcugcugccuuuggugacuagggaaaugaggccagaggcaagccacuuggcacauuuucccucaaaaacaacaugaccuccccucaucccugucccaccucaugggguuuggagagauccugaggaacaaaugagcccagauggaaguuaaaaaagccuuguggcuggcaggcagccauccuaccugaugacacaguugccucgguuggaugcaaagaugacgaugggagcgauagaagacuccagggcgcggugcagguaggugaagcacucaauguccagcauguggaccucaucaacaaacagcacacccgggaccagcucagcaaugcccuggucgauguacuuguucaccaccuuauuaaucuccccucgaaguuugucuaggagaugcaaggaugggcaggcaaggucagcacagggcugggggagacuaucgccuuuucuccuccaccugaauucaauccaaacccaugcuaggagccuaguuuuccuacuagcuaugugaucccagacaggguguguccccacuccagguuucagugucgucaucugaacacagugauaaucacaccuaaaaggucacaaaauuggcagccucccccaaaagaugaguuugguuaaauguaaaaagguugcacagguguucugcaugggaaucccuucacagcacacgcucacugcugucacacucccuaccaugccuuaucacuucccacauacccaaucuagcucugucugaucugggagacauuggaguuugggagcccugggugaaaugaguuuucacaugcaaauuuaccuguucuauacucaguaaaugacccuuucuuuuggucccauacaacaaugcuuagguuaauuaacuuucaaucaagugccuggacuaaggaagugggugcuuuuagaauccugagcagaaaccuuugaggaaugaaaggcucugaagaaaggcccaaucucagagcuccuagagggaugagucucucaaaaguuacauaacccagcuaaggucucagugcucauuuuccaaaccagcuccuguguuaucaucaggagggagcagcucacaaauagaaaacuggaagaucugaggcagcgucuuccaccaaaggcaagaggcggggauuguccaaagaggaugcacaccgaaaaccgugugaaaagaaagaaacugcuucugacaacucgaacagaaaggucucagauugcugcccuggcuuaaacuuuaaagacaauauuugcuuuaauguuuaacuaacaucuuaaggugacgaaacuguagguggaauuagaaaaaaaacagcaacaggaaagcugggaagagcagcagguuaaauaaagguucacaggggagcagcagcaguguccccuguggagcucugggaagugcccacaaacugggcagggcaguauguggagcuggucuguggagcugcccugugcucuacuagggagggggcugacagccccaaggcuccagagccugugcuccagcagagcugggcgacacaaaucccuauuucuggggccucauaggggccagaaacugugacugcaguggggcagauagcacacagugugcuauauggcugccuaaaugccgccagaaacuuaggcuagagucaagcucuaagcuaugaggaagaaagaacuguucugaggcauuuccucagggcgacugugcucacagagccgcaagagcaucucagaauguggggcccuccgcccugccccuugcucacagggcacacugguucuccuaccugugauuucugucuucuuuggcuucauuagcuggcccaucauggacaggauaucuuguccccccugcauaagagaagacuuagagucagugcugcuuucuaaggugacuacagaagccucaucccccugcaucccacucaucaacucaacaugggauccugagguauggagaccccuccucaaagccugaggagcuucuaaacacagaggaauuuuuagagguuccccuaaccuguaagaaucaaacaaaauccuuucauggcaaguauaagcuccguggggccugcccagccuccuuuuccagcccuaucuuuuuccaaccccuuguuccuugauuagccacacaagacuaccagcccugcccuggacacccccaagcuuuuuuaugacucaaugcuuuugagucuauuccaucugccaggaaugccauucuccuuccuagaaguucccagucauuaaaguucacgucaaaugcccucuagggcgcaucugacccuaaccggacucaggacuuccuccaaauguuccugugccuuuggggacacauggacuauaagaguaaguauaaagagcaaguauaaauauaccaugauuauauugcugugccuccucucacuagauuugaccacaggcuugcaucagccuaguccuuacuuaacuuggagcugaucauggcugacuccauaacagguucaccacucaccugcauccuccugcgggcuccuaacagugcagucagcaagaggaagaggcugguguuuggucauuuauucagcauuuagugaucaccuguugguuaccaggcccugagacacagaagggcucacuaaaugcugaauagcuaaaggcagcaaauguuuccugucugguccucaaaacugccuugccaaguaggagggaacucaaaaccgaaccccaaaccacagaaaacccagagacccaaagugacaaauuaaccaagcuggucagugauggagcaacacaguuccugacuucugacucccagcccagcacucuucucaggucaagggcucccaggaggucaguuuggggauggccauuucaccaaccaaggggaccuguugguccaagaugagucuucaguaaucucuugaccaaagcuccaaggaacaaaacacccacggaucaaauuucaagucagaaaacaaacuauucccuaauagugacuauucacuauuuccuagaaaugucauauagugauaacauccuuuccugcacuuuacuagccaaggcauaaguauccaucuguaugagaagcagacaacaguaccagcucaaagcuaaaacacuguggcuuuugcuaagcagggggaaagaaagagcuuuguuaggcuuucugaaauccuguaaagggcucauagaacacuccugcccuccugccauuaacacccagaaaaucccaggugugagcccacugcuggagugaagccauggaggaagcuggcuagcucagggccagaggcuuggcugggauaagaaacaauacacaugaaaucaucugugacuagagcauuugaaugggaacaaaggagucccucguagcucaugucgauguuaauugcugaacauuacagauagaaaaggaccgucuaccucaagaaaggcagcaagacucugacaauucauucccagaucuccacacacauacaaaagggcuaaugugccagaucacccaggcaucgaggcaguaccuggggccgcgcauuagccacauccaagucaugcaaggucacaucuuggaugauuucuuucuuuuugugcacauccccuuuuggcaaggggacauacucuucagcuucaaggucgaauucuguggcauagguaucacaccugcccugccucugcaaaaagagagaaacaugagugccugguaaguuuucacugccaaguccccaaauggcacagggcuaagugagauaaaggucucaguucccacugcaggccugacagccuacuugacaaacuccaaauaugccccacuccccugcugccaagagaagggagcuaucugcucaucgcugggcuccaaaaacuggguugaaaaacaccugauacuuucucccaaaauccuuuuucccuucuuucuuuuaacuguaugcaauuccugauaaaggccaaauccaguagauuaacuggaggcagaggagcugcucagacucuuuuguagguggaugauuuauuguaugauaugaaguauuaugcccauccauuaaacagugaggaacacuguacaggacccugaaaaucagauagaaaagaaugccaacgaaugcagcguuccuucccacaugcauauaucuugggaagaaaauaccaaagagauaaaaggaagauuaaauacacugcacauuucaauuugaaagugacuaaaguuguuuugguuucucacccuguccucccccucugaacagguuuuaguauuuuuucuaacagacuaucuguuuuaaucgcgagaagguuaaagaaugaagauaaagggaaggcaaacuuuauuauacauaaagggccacuaguugaccuuccaucagccucauaacagacaccagccccuccccacacaccccacacccucugaagaaagcaacucccuugucacuuaggucuucucauggcaaacaaaucagggacaaugcugugucccaaggaaggcauuaccuucacggccccacuguuggcuucaauguaaaucacaucuccagcuucuacucgcucuuucugcaaacuuucaaaaaugcugggguccagcuaaaaaaaaaaauguaaaucagaaguguaauacauauuccauuuccuucugacaccauguaagguaccuuuccguaagggaucugagguagcuagcaggugcauggagaaagccuguuuugcguuugcaugaauacugggaccugcaggagugugaaugcauaaguaccacacaacagacuggcugggggacuaagcacaccagggagaaaauaggggggccagcauaccugcaucccuauguaacgagcaugagagggacacaggggacacguacucuccucuuucccuugauuccaaaggcuguaaacuggcagcagcgcuuuuauaaggaugguccuggcugccgugagacgggugggcccagcccccacuguccacaggaccacaggcccuaucaccccucuugaaaucaucaucccuacuucacuccuucauuugccucaccucaggugggguggaacuuuccacaacugaaguaccugccagcaccugcuuaccaaucucaaagcuggcaucuugcagggccuuugauuuuggauaagguucucaguucuaaguuuccucaucuauacaacagcacccaggugcaaucacagauguauacaguaauucaaagaaaaacauaaaugagaaucuuucccaagccuuuugacucacaucccaguguuugugcccuugggucugccugcuuauaucuccaggaaaggaaauaagcagauuugcggaacuguugcuuuucuccagauucuggugacccucagugauuaauauucuaggacagcugccuuuguaaggauucuauaguuaaacacaaguuucucgaggucuucauggagaucuauguuauacaauguagcuaugguggaaaaaaaacuugggcuuugcccaaacaaaauuaaaaagugaaaacccaggacuuggugaaagaagccagauacaaaaaaagacauacacuguauguuccauuuauaugaaauguccaaaagaaggcaaccgaaaguagauuaguaguugccgagggcuauaguuggaauggggaaugacuguaaaugaguaggaggauucuuuuuggggcgaugaaaauguucugaaauuaagauuguggugauuguacaacugugaaaauaaauuaaaauuccuggaauuguauacuuaaaaugggugaguuuuauuuaaaaugcuaucugaauaaagcuuuuaaaaaacuaccaccacagcagcaaacccaggguucugccucuccuuagcuggguggggacggcagacccuggcagaacugcugugagucugugcgccuaaggacaaaagugggugaggcccccagguaaggccuggcaggaaggggucaugaguacuaauggcauucucguugcuagaacucagaagacuccuucagacuugaauauccaccaaguauuugagcaccuucuauccaaauaucuuguacauauucuaaaaauaccuaaaaguauucauuuuggaagaaaaauuucaucuucuccucuacauuauuuuuguaaagaaacuguacaaagcaguguuacaaauagcugaaauuuaaacuguacgccuuauuuuaucuguccuacauuggagaauauacuucuuuuuugccucaagcauuuuuauaucgguuaauuucccaaaugaauugacugaagauguaauuacuggaaagguggcagaugcuacugagaaaucuaauuaauucagaauggaagugacgagggguagguauaaaagagauauuugcagaggcaaguuccugagauggaaacccuguuaggaaaaagaaaaauggcccuuugaagaagugacauuuuuaugaucuccauaaagcagugaccaagaaacaaccucagagaaucaaagaaccauaaaaucguagaacagaauaaaaauggagaaauuauauggucaaucuccugcaguuuauagaugagaaaacugagucccagagagcucaacugacuuccaaaggucacacagcaagcuggugggcagacaguacaacgguuaggacucagagggucagcucugccacaugacuggcuggaugaucccaggauaaccauguaaccucuuuaugagccuucaucuguuaacaugaggaaaacuauacacacauacacacacgcaaacauauacacauauaaaguuaugaaugacaauaaauguuuguugaagcacuuaguccaaggccugacacauacaauaaaugagagcuauaaugauaauauuuauuaauaauaauaaggcaaagccuaaaauccagacugcuccauuucuccaagugaaggcucucacgauaacauuaacagcuaucauucauuagguaacuaggugccacacccaaagccauaacccugaaagacaggcaauuauuauucccauucaacaaauaaagaaacuacuacucagagauuaaugccacacaguuguaaguaacaaagccagggauuccuuaaggacuuagacuccaaaacucaugcucuuccccuagaaacucuacugccuccauccuaaagacuuacaggacagguggcugaggacugucuuugagcgcuauccagugucaccauucuggccucuccacaaagcccuguacuaaacagaaccagccacugaagcgaccacagguuccugacacaagcaacugcagucaggauucugcauguggccccugggaagcccauccaucaucuuuauacaacucuuauuugauuacucaaugcuguuucuuucuaugagcaugggcacugauaacuggaaaaauuaaugcccagguucagacccagcccaggguauuugaugcauggucauaauaugggacaugggauggcagaggcaguuucuugacuuaaccacacagcucacauuuuaacaugcagaguuuccuaggaguaaguaagaaaagagcuaucuuccuugaguccuccuaugugcaagcccuaugcuagguaccgcuuuauacacacaauauccucaaccaauucugugagaaaucaauaccugcagugcacaggucaggaaacugggaugcagagagguuacaccaccugcccaaagccacacagugcugggagagucaagggaaaagaggccacauacauguacucacuuucaacuguuugguuccuuuggcuguuuugaguccuaugaucacauggcuaaugguuuugccauauccucccaugggauucucugucucacacggaguuagcucugugacuucaccuucauaaacuuccuuggucuccuuuauucgcagcccuggaagagguggcagaggggccauggugagaagcagaaucuuuucucucacacugagagcccaaaacuuccaugucaccagaacugccaaaucaaccuuaauaauguacauuccagggugucaugauggguaaaaaggcaauacaaacauaucaauguaaauuagaggcacuauuagaaaugcaacuuuuuuuuuuuuuuuuuuugagauagagucucgcucuguugcccaggcuggagugcaguggcacgaucucgacucacugcaaccucugccuccccgguucacuccauucuccugccucagccuccagccucccgaguagcugggacuacaggcgcccgccaccacgcccggcuaauuuuuuuguauuuuugguagggacaggguuucaccauguuagccaggauggucuugaucuccugaccucaugaucuacccuccucggccucccaaagugcuggguuauaggugugagccaccacacccggccuagaaaugcaacuuuuuaagggaacuuucuagguucaaauccagaacuagauagacaaguuauaauucuuaaaauugucugcuucauuuccaagggggugaaauuuaccuuuagccuuuaauccagucucugaacccacacuauucuauuccaccagaacaguggcuaucaaaacuccuguagccuuguuuccugaauuucugacucucaaaggaaaucuuaaaaccaguggaauaacucauuacacacccucugacacuaugaaaccugagcagaacauacuaaaauaauuagguaucuaugucaacagugggugacacucaaaacugccagguguuaugggccucuggcucucacugcauacuccaagaagaaauacccaguugucaugcauuauuugcaauguguugcucuacaauuuucuuucuuucuuucuuucccuuuuucuuuuuuuuuuuuuuuuuuuuuugagauagaaucucauucugucacccaggcuggaaugcaauggugcgaacuuggcucacagcaagcuccgccucccagguucaagugauucuccugccucagccucccaaguagcugggauuacaggcgugcaccaccacaucuggcuaauuuuugggguuuuuuuguacuuuuaguagagauagguuucaccauguuggccagacuggucuugaacuccugaccucaggugauccacccaccuuggccucccaaagugcugggauuacaggugugagcuaccauucccagcugcucuacaguuuuucuaaggccauaacaacaaaaccaauuuccaaagcaccuuacauuagaauauugcaaauaaagguaaauuucucucugaauucuaaacaucauccacauuagcucuuuaauaaacguuuguucauuauccaagaaucauuguuaaauuaacuuuuagaacgugaucucuauguucauuacaugcuuuugcauauaacgguucugcuuccugaaccacucuuuuuagcuuaggcaacuccuccuagcagacucaguuuaaaacguauccccccccccuucacacauucuucuuccucauccuccaaauuguccccauggugaccuguguuuccacuggcacagcagcagcccacggcaaugccauaacuugcagaccuugccuaccccucugcagauugcccacaccugagcugagggcacagcacauaggcagguagagugaauggaugaaugaaugaagucacuaagagugaagggguugucauuaggcacaucaucuacuaauaauacccaagaaacgaaccugcagauacauuuacauguucuauaugguaauggccugagaacucuaaggagucagccauguaauguuauagccuguaucaccgaaacacccucaaccucagcacuaaaagccaggcauaacugaacuguacuguuagaaaucaagacuaccauuaacuuggggaaggaaggauggcaacugggaguggacaucaaggguaccuuggaguucuggcaacauucccuuuuuugauuagcugcugguuucacggguuuuuacuuuacaauaauccaccaagcuaugcauuuauguucugcacacuuuucuguacauaugcauaaaauuaccaagucuacuuuaaaaaaaaauuuuaaguaaauaauaccagugggacccggugaaguaagaccacugauggccuaaguuuacgaaauacugcucuaaaucuccgcuggagccuauggucaugguucucaaccuuuagguccaccugaggggccccuauaaugaaucacgcccuggcuguacccagacuacuugcuuccaaauccuaggggaugggccccugccaucacuauuaguuuaauauuccccccaugauuccaaagugcagacacaguugagauccaguuaucuaaagaauaaaugaaaaacuauucaacucacaaauguggagacauaaacuaguucugauggcaggguggcuugauaaggauuugguguucucaccauuaagcuaccuccguucugauauggaaauauuccaauggcacuaagaaacacuaccuauagugucagguacgcucuguaacuucucacuuuuaaauguggucauuaucuuaucauugggcuguuugccuucucuaccccagaaacccagucaggacaaagacucucagauauuaaaguuaaggaaaaguuuuacucuaccuucauucuaucugauagccuauaaauggaaguuuuggaauagccccaaaagagaggacccauuucauuugugcuuuaccaaauucuuaguuccugaacauuaaucuuagacaaaaauucuccaaacaacacgaauauaucagaacacugugguaaacugggaaaauccuguacuuuuaaagugaacuuugauuuuuuaaaaucaaaccuuuuauaucccacagcgauaaauuccuucaaauggaaugcuuacuuauauuuacugcuagaugaauguggcaugaaauuccucaaggaggggaagaaagacauucccgucucucacuagcccccacauuuguuuagaaguugcucugugcugacaagcuggcaggggacgugggugacggacaaugaaaccggcuguuagccaggaaaggggcugagcuggcgcuaucucuggcaacgacaacacaaaugacacagguuucaucugcuggcucagguuucuauaucccugacagggaccuucaucacaucaaggaaauagcacagacucccugcuuuuuauuucuggucggcuuauugcuuccuccccacccccucucccaacuucacagaauucaaaggcagaggaagaugggcaggguuccuuuuugaagauagucaauggccugccuuuuuauucucugguaggaucaagaaauuuucuuuucaccucgcugccaucaaaagaaugguacuacuguccccuccccucaaaaauggcaaauuacaaaacagaugccaaggaacuuaucucuauuuuucugaauuuuaaagcauucaaguuaccuuuaagcaaugcaaacacauacauccaugugaaagccaguuuucacagauuuuaucaauaucagaaaaacauuuuuuaaguaaauagaacauuuaaaaaaaauacucagggaccagacacggugguucacgccuguaaucccaggacuuuggcaggccaagguagguagaucauuucagcccaggaaacagauugcagugagccaagaucaugccacguacuccagcaugggcgacagugugacaccuugucucaauuaaaaaaaaaaaaaguacucagacauuugaacuaguuguaacaucuuacuguucaucucaucuuuauuaugaguuaaauaaaaccaugggcacauguuuaaaaaaaaaauacucagaagauuuuaaaccuuaaaggaguccugcgagucauuuccacugcuauuccaaauacaacguaaaaauccacaaaguacacugcauguaaucacaugggcugaaccuuacagauauagacgcugagcuaaagaagcaagacacaaggaacacauaaaguaugauuuagauaaacuuuaaaaagggcaaaauuaagccccaugguuuaaagauacacacaugggguguacaagguuaugaugaucacauaaaccauucccacacaauuauggcacauugugggucccaccuaggagaggaagggguugugaccagggagggacacaugucugaggugcuggccgugcucuguuccuucgguggugacgguauaagccuuuacuucauaauuaauuaauguuuuacauccuucucuauaaguuuguaauaccucuguuuaaaacuggcacugggauggguguaguggcucacuccuauaaucucagcacucuguggggccaaggcaaaaggauuacuugaggccaggaguucgagaccaccugggcaacauagugagaccccaucucuacaaaaacaauuuuuuuuuugagauggugucucacucuguagcccaagcuggaaugcaguggcgcaaugucaccucacuacaaccaccaacuccugggcucaagcgauucucaugucucagccucccgauuuuguuuuugagacagggucucacuguugccuguguugaagugcaguggugugauuucagcucacugcagccucgacuuacucaggugauccucccaccccagccuuccgaguagcugggacuacaggcacacgucaccacacccagcuaauuuuuguauuuuuuguagagacacaguuucaccauguuccccaggcuggucucgaacuccugggcucaaacaaucugccugccuuugccuccuaaagugcugagauuacaggcaccaccaugagccaucaggccuggccucucuguaaauuuuuuuuuuuuuuuuuuuuuuuuuugagacagagucucucuguuacccaggcugaagugcaauggcauaaucgccacucacuguaaccuccaccucccggguucaagcaauucuccugccucagccucccaaguagcugggauuacaggcguaugccaccaugccccgcuaauuuuuuguauuuuuaguagagacgggguuucaccauguuggccagccuggucucgaacuccugaccucaggugauccaccggccucggccucccaaagugcugggauuacaggcaugagccaccgcacucggccuacauacaguuuuuaaaaaauuagcuggguguggugaugcacaccugcaguccuagcuacuugggaggcuggggcaggaggaucucuugagcccaaggaguugagccugcagcgagcuauuguuacaccacugcacuuuagccuggacaacagaguaagacccugucucuaaaaaaaauuuaaaaagagaaaaauguuuuaaaaauagauaacuuaaauaaaauaggcaccaaacccaggcaugauggugugcaccuauagccccagcuacuugggaggcugagguggaagaaucacuugagcccaggaguuaaaggccagccugggcaacagagugagaccauggcacuaaaacaaaauaaaauaauuaaaauaagcaccaaaaaauccaauauuucaugguaaaaauaauauauuuccagucagaaauacuuugcaguuuuaaaaauauucaaaucguggcacugaggaaguguuaaaauuauaaaauaaaaauaaauauauuccaaguaacacaaaauuuagccucuggacacaguucauaaucucucugguuuagaaaaacagucacaaacuucaaugcuuauggggaccuggucagaaguacccgcucagcuccgccugcugugggaaggaaagcugcuucaaggaggcagaaaugagcacuuuaugacacuucccuauugcuaaauauugacaacuagcuccaaauuuauaaaaaauacuucauaaaccaaacaacauaugucuauagcccagacauauuuuuuagcuaaagacuucuguuuucauauuuuuuagcuaaagacuucugggauuacaggcaugagccaggcacgguggcucaugccuguaaccccagcacucugggaggccgaggcaggugaaucaugaggucaggaaaucaagaccauccuggccaacauggugaaaccccaucucuacuaaaaauacaaaaauuagcuggguguggugaugcaugccuguaauuccagcuauucaggaggcugaggcacgagaaucgcuugaacccaggaggcugagguugcagugagcugagaucacgccacugcacuccagccuggcgacagagacucucucucaaaaaaaaaaaaaaaaaggcuucuguuuucuaacugcuucaaagucuacccacuucucucacucacucagaagaacuuuccugagcacccacuaugugccaggaacugugucuacaaagauaagcacugaccacuguauccccaggagacgcugaguaaacacccaaccugcucccucccauucuuccccaucuccaaaaauggccaaaccugggaauuuuccucgacuccucucuuucuuucagccccacaucuaacccuuuaggaaauccugucagcgcuaccaugcaaacacacccagaauccaaccacuuugcacuuccacugccaccacccugguccaagccacuauuuuguccugcucagacuccucucugcccucacccuccuuacuauccacucccaacccagccggaggggucugguaaaagcaaaaccagagcccagggauaccagcacuuucuaacugcuucuccuuuuguucaauguaaaaucaaaagcuuuaaccauggcccuaccugaucuuacuccgaaacugaacuuuuucaucagucuuuuaaguuucaucauuuccuugaaguuuucugguaaauuuccuucuuaagaauacuuacuuugguuugacaaugaaagagccuggaaacugguacaggcacucugacuaguguucauaacccacgacucagcaggcaaauccuagaaacauacucgcacaugugcacaaagacacauaaaaggauauuccuaguagccuuguuuuuaagaguaaaagcugagaauaaaucuaaauguucaaaaaacagaaauggcuuaauaacuggacuuuuauguaacaguuaaaagaaauaagcuauuucuauaagcagaucugagggaaacuaggacuugcccagugcugugccagcagaaauggggccaaaaaacugccccagaaguccuagcuagcaaaaagcaaaaauucgaaagagaagccauuuucuucucacagccaaucuucacagcaacggcucuagaaaugagaaagaugucggaucaaacuacuucugccacuuacuaacugggucccuagcaaguuauuuaaccuucugagacugcuucuucaaaugcgaaauguagauugauaaucuccccucagaggagggaaggccuggcucaucacaggcacucacuaugauagccugaggcccuaaggguuaggcgccauaagccucuaagcucugccaguccccacuccucagucuccucacucuaugacaggccacaacucuucuggcucgccauccaggaccaggggcauucuggccacauggcacacaaagauucuggcuugaguccaaaaccuuuucaguggauagucaucucuaauggcaaaauaagacuuccaggaaaauaugacucauuaaaaaaacacuuuuagacacaucuauuuauugcaugaagaagcgcaggcucacagcuaggguccauaguugcuccaauugcuaacgcacuucaaugagaaaaacugggguuuuguuuuauuugaaaaauaaugcacuacuaagugccaaaagaaaaacagcagugccacgaauaccagucauaaaggcaucuucaccacaaagaggcuucggugcacaggcuucaggaagugagaccaacuccucccacaaaugugacacuacuuaccaauggcccugcggaaguucuccaucagcaccucugucuucuugaucucaguugaguaaacuucacuccccaccauugggcagaaggggaccuuacuacccagcuccugagcaauagccagagccagagcugucuacaaaagaaagcaacggaaacacaguucacaguccugaaaacaugacaguucagaaacacaugcuacagaaccaccaggaacuaggaacagcugaacaucuaguccuaccauuuagcauguuucacacaauaaauguuugaugacuuuuguggacagucaauuuaaaucauaaauggcaucucuuaucuucccuauaauuacaaguuaucauucacucagacuuacccagugcaggcccaacuccaaaugccucacaugauccucacaaccagccuaugaaauagacacuaguauucuccccauuuuacacaugagaaacugagagacauuaaguaaugcaacguaaguaccauaaucuagaaaauggcagcgcagauuuaaucucuggcagcaggacuccaaagaucauguuaucauaauuagaagagucuacucuucaguauccacagggauaccaaaauccauggauguucaaguccugguauaaaauggcaggguauuugcauauaaccuaugcacauccuccuguuacuuuaaaucaucucuagauuacauacaauaccuaauauaaaugcuauguaaauaguuauuauauuguauuuuuaaguauguauuauuuuuguuauuguauuuuuauuuuuuauuguuuuuuuccugaguauuuuugauuugugguuggcagaauccacauacguggaacccacagauaggaagggccaacuuuacagucauccaaaauuguucucucaauaucaauauauggcucugaccuaauugcuccgaauacaccacuggaucuuugagauaccugcuuucucuuuuuacaaauacaggaaaacaccaaucuacaacccaucagaaauaaugaaggaaugaaugaauggauuguucauuuuauguuauguagcccacaaagagugaagaaggauaccucaaguaggauuuugaagcuaugaguuggucuuaacaaguuacacuuaaacacgcccugugguaaacuacaaauugauuuuugacaagauaauuacagcuggcaaaugcuaaacagaaccagacuucacagguguacggucaaaugucaaguauggcaagcaaaugcuuuaaaguugguacagaacugggcaaugccauggccucuaaaugccauuuucaucuuuccucaacucugaaacaggagcacgaguaaggccagcuccccagguauaugggcuaagacugaaaacaagcuuguuacugaagaacaaagugaaacugagacggugucuuaaaauuaacagucaagguuccucucagauuuucuuuucuaugcccuuuuggugauaguuuugagguaguaaaaucugguagagaaucaguguauagcacaguauaaaaugcacuagccaggaacagaaagauuagugcugguucugccacuaauuuucagugugaccuugggcacucagcaaaucucaggugcccgauuuccucaucugucaaaugaaaguacuaaagugccaugcuagaucacaaguggcaaacucguugcucacagccugguucuguuuggccugcagucucauggugaccuucagcaaggccgagcaccuggggcucaaggcagacacgccacagugcacccagccacuucccucauccccguugccugccucauuaggcaucugcacuugugagcucaaggcugacaccuugaaaacugguauucuucuaagagcaaaggaaaaaaaucucuggaacaugaaagggcacaaugagaggagcagcacucuaacagcagacuccccguggggccacaggcuggacaggaccaccccuucccaguuacuccuuucucuuccuuguaucucugccagccccaauucccuacccucaguuuugaacuucaaagacagugaccacauccaauucaauggcacucucccucccuuuaacuaauacagaagagaugaacauacuuccauuaaaauaugauaaauacuugguuaaaaaaaaaaagcuucaugugugucucguuuccuccauuuaaagacuuccagagggaaaguauaugauauggcuacuauuccuacaccuacuacagagugcugcauagaccucaucgaaucuccccaacuagccuaugaccuugaucaucuaguuuguauuuuauagauuaagaaacaaacucaaaaguuaccaacacacccaagguaaaaccgcaagcagcagcaccaggaugcaaaccccaaucuccaaagccauuuuuuuuuguacucaccccaugugagugacaaguggcacaaaaaagagguuguugccaaaagaagguugaagaaaucucuauuuuucaaucucaucugaauaucuccuucuucuaaaacccaaacccauuauuaacagugugagguccucaagaguggaaaugcauaugaaccaugcauuugcaucucuaaaauaagcaguauuucugccugucacccagguaaguugccuaaacuuugggacccugcagcaaaccauuaagcagaagucaccaaauuccuucauacacauuggaagggaguggacaaacuuauaagguaauaccacagugcugagcacuucucauauuuccugggaggaaagcaauacaauaucaccaaaaaaaaugaaagacauaugcuucuagcaauauggcacacuggguccacugaaaaccucuccucuuacaaaacaccuagaauugaauaaauaauaacauucagagcaguaaacuauuugccuugaaaguucagagacuguagauacaggaaagcucagcaagguauagcacuuaagauagaaaccccugaauaaaaccgggacugggcacgguggcucaagccugcaaucccagcacuuugggaggccgaggcagguggauugcuugagcccaggaguucaagaccagccugggcaaaauggcgauaccccaucucuacgaaaacuacaaaaauuagccaaagcgugguggugugcaccuguagucccagcuacucaggaggcugaggugggaggaccaccugaacccaagagguagagacugcagugagccgagaucacugcacuccagccuggguaacagaccacugcacuccagccugggcgacagacugaaacugucucaaaaaacaaacaaacaaacaaaaacauuacaauuaaaaaaaaaacauaaaagaggacucuugaagggccacacaugaguaaaaaaggugggccauaacaaaauacaucugggggccaggcacaguggcucacgccuguaaucccagcacuuugggaagccaaggcagguggaucaccuaaagucaggaguucgagaccagccugaccaacaugaugaaaccccaucuccacuaaaaauacaaaaauuagccaggcaccuguaaucccagcuacccaggaggcugaggcaggagaaucguuugaaccugggaggcagagauugcagugagccaagaucacgccacuguacuccacccugggcaagagagcgagacuucaucucaaaaaaaaaaaaaaaagacauuauaacuuguaacaauuuaugcaguguguaaucuuugauugcauuuugauauucugguguuuuuuaaaaagccaaaaacugaaacaacuuggaaagauguuuucugauuucuaucaccuauauuuucuuuucauuaaaacaauuuaacuucguugucuuugaaagcacauuuguuaacugcucauggaaucauaugaugagcugccaggcucccucaucuuugugauuucucuaccacaguggauaugguuaccuacuccuuucuuuaaagguucuccuuucuugguuccugagacaccauucucucccuggcucugcugcucauuuuuuaaaaauuaauuaauuuaauuuuuaauugacaaaaauugggggaauauaauagcauuagcaaggugggucugaugauggcaccguggucauguaggaagacauccuuacaacuuacugucaagugguucagaaauaaacuagagaaaaagcaaaugucacaaaauauuuauaacuggcuaucuagguauaggguauagaggggcucaucacacuauucuuucaaguuuuuuguagguuccaaacuuuucaaaaugaaaaggaaaaaaauauucaauagauuggauuaaucagucacuuaaucauagcuuaagagacaauuagacuggaacaaagaucuaaaagaaauuacccauaauuuagcagagucaaaaagauaacaaauaugagaggcuaaaagacaaagaggacaaaacgagaagcucuagcccaggguuucucagcuugacuccaugacguuuguggccagauaauuccuuauuauggaaacugcucugugcacuacaggauguuuaguagcaucccuggccuccacccacuagaugccaguagcacccccaaccaagucgugagaaccaaaaaugucuccagacguugucaaaguccccugcaagggcaaaacugccccagguugaaaaccacugcaaucuuaaccucaucucaguggaguuccagaaggaaagaacaaagagaauggggaaaggcaauagcugaagagauuaacgcugacaguuuuuuuguuuuuuuuuuuuuugagacguagucuugcucugucacccaggcuagagugcaauggcaugaucuuggcucacugauaccucugccucccagguucaagcgauucuccuaaggcugacaauuuuccagaauugagcagagacauaauacucagauucaagaagcacaauuagcauuaagcaugauaaacaaaaauuaauccacucugacauauaauagugaaacaccaaacccaaaaauaucucaaaaacaugcagaaagaagacucaaaacccucaaaauuagacuucucaaaaacaacagaagccaaaggagcaaauaacauugagagagaaguacugugaaacaguacugaagaaaauaucugucaacugaauuauauagccaacauagcucuuuuucaaaacaagggcaacauaaugaaugcaaacgugagagacuuucccaccaacaaacuucuagaagaaauuucuaaauuauuuacuuuaggaagaagaaaaauggagggaaagagaaggucuaagauauaaggaauagcaagcaaauaaaugguaaaugcacuggacaagcuaauguugccuggagagagguaacugaagcucacaucuguauggcacuuuacaguuuaaaaaacuguucacaauuugcuuuuauauaggaagagaaaaaacuguucacaaauauagcacuucuuccucuuguaagauaccaauauaagauacacaaucaguaaucauuucaaaauuauaaugcaagucauuaucuuacaaucgaucaguuuaauaauugcuugaaauagguagaguaugcuuuugcuuagaaaaguuaagggaccugccucaggucucauagcaagucaauacuagagcuggaauuuaaagcccauuucuuuucacacacaaccccaagcuccuacuugcccacaucaagcggcccuuuugaagaauaagcaagcucaaauugggaacucuggugaguuucaaguaucuggccaguccccucacgaaucccaagaagccacacgguguccucugccugaaaggcccuuaucuucccugcaaagccaaauccucucccagcucugaagggaaaaugucaagucucaacccuuccagcuguaccagcccacagugcugccuccuuaaauuccagcugcauuuaauauuagucaauaccucaaagcugagcacucauacugaguccuccugugcugucaugauuuccuuucuuucugcccuggagagacuguaagccccuugaagauaaaaaucaugucucuaauucuuguuuuccuuuuuuucaucucccacacagccacaauagcgaugcguaaagcuagcauuuggaagaaugcuugacucauuuuuuuguccccucaaguaagaugucacucagaagaucuuuaugaagcccuaggccaacagaaauguauuuccacagcaaaggagacuugaaagagaaaaaggacaaauucuagagacaaugagaccccuucaaggacuucauucuuucuucucuggagguaggccaggauaauuugaauuuuagaagcagggauuuuagauacccaauuguauuauugcauauuaauuuuaaaaacauacauauaacccauuuagcuaaacaaagacuaguuaagacaugaauucaauuuggcuuagacacuaggaucauucuccuggguagauuuaaaaaaugagagaaaaugaguaccuugccaguuccaggagguccugccaacaagacagcucuuccagccauuuucuugcuuuugauuaauucuacuaugacgccacaugccuacacaccacaauggaaagaaauaauaaaucaauauuaaaauguuucacaaggggaaaaaucucagucccuggccuacacaagucacacacucauccaacuaacacugagugccagugcacugcagucacuguucuaggugccgaggguaacgaaggcaaggcagaaaagccuuguacuuguggagcucauguuuuagggagggauacaaacauacaaacauugcacacauaaucuucaucacuacuaugaagaaaaagggaugaugagagagaacgaguggcuagaaagugauccuggagugucuuucugaugacauuuaauuugauaugugaaccucugggaggagcaggagucagcguuccaggcaaagaaaacagcgaauucagaaaauccaaagcagaaacaagcuuggcauauccaagggacagaaagguugcagugaccaaaguauagcgaaaaagaccaggaagaugagguugaagagguagacagcggccagaacgcagaacaggaacuuacagugugugguaaaguuuggauuuuauucuacauaaauaauacaaagccacugaaaaggucuugaagacuaugugucaugcuaugauuuguuuuuaaaagauggugcuagcuacuacugugugaagaaugcacaguaugaguacaagugggaacacugauuuuuggcccaggguacagggauagacgccaggggcccaaauaccucuugaaguugggaacgaaacuguguuuauguucauauauacauuuuuuccagagaaaggauccauagcuuucaucaaauucccagaguaaccuauuaagggguaagaaucaaugacauagaguacuagcuggccaucagugaacacuguaaauacugaaugugaaguuaaaccuauggcacuauuagauccauugaauauguuuugaauccucaagguuaaauuacuuuaucaucuguuaguauauuuuaaauacauuauaaaucucugaauuuuauuaaccauuugcaguacacauguguguauauauacacacacauauuccauaaaugggcuauggaacuucauauauuuuagaauauuugacuauaaggggggaacacugagaaaguuacacuagcugagcaucuauaucucaggauuacauaauauaagguuugcuacacugauuuaauaacugaauacgugacuaucuaaaaggugcucuucucucugggcagugaccacacugugccagagucuugugaauacaucuuaucucuucuaccucuauuccucauggacugugaaguaccuuggucccacacuuauggcagccccucaaaaaauauguaaggacuacaggcgccugccaccaugccuagcuaauuucuuguauuuuuaguagagaagggguuucaccauguuagccgggauggucucaaucucccgaccauguaauccaccugcuacucgggaggcugaggcagaagaauggcgugaacccaggaggcggagcuugcagugaaccgagauggcgccacugcacuccagccugggcgacagagcgagacucccucucaaaaaaaaaaaaaaugauguaagcaauguguguggguaugcuauauccaucccauuuccacuucaguuaccaaagcacacugcccuuaauagaaccuagaagauauucuucagaugcuacuuuucuuuucucuuucagauggagucucgcugucacccgggcuggagcgcaauggcgcgaucucagcucacugcaaccuccaccucccagguucaagugauucuccugccucagccucacgaauaacugagacuacaggcgcauaccaccacacccggcuaauuuuuguauuuuuaguagagacaggguuucgucauguuggccaggcuggucucaaacuccugaccucaggugauccacuugccuuggccucccaaagugcugggauuacaggugugagccacuacgcccggcccagaugcuauauuucuaaauagauaaaaaaccuagccaggcgcguuggcucaugccuguaaucccagcacuucgggaggccgaggcaggugaucaccugaggucaggaguucaagaccagccuggucaacauggugaaacccugucucuacuaaauauacaaaaauuagccgagcguggugguaggcgccuguaaucccagcuacucacgaggcugaggcaggagaaucgcuugaacccaggaggcagagguugcagugagccgagaucgcgccauugcacuccagccugggcaacaagagcaaaacuucgucucaaaaaaaaaaaaaaaaaaaaaaaacuacuauggucuuuccacacaacccugucauaucauaauccccagcacugaagcucuuugggaaacccaagguagaagagacuuuacaaaccuuggagaugugcguuuauuuacagaccaggaccucuuccauccauucucccucaauuuccacuccaacuacucucaggugagauaagcuugaauucuaacauuuaaaaagaauuggaagggucuuuaaaagaucaccuagucuaacucucauuuuucagggagguuacugaugugaccagagucacacaagaaccugguagcugaggugggucuuaggcauacagcaucacucuuaggcauagagcaugcacuuaggcauagagcaugcacucuggguuuaaauacauagacuugaguuaaaauacuggcucucgcacuuaccagaugaguaaccuuggaccuacuuauuugaccucuaugaaccagaauuuccucacuugaacagaguucauacuagucaauggcacacagguuaaaggguguagggguaaaguguagugaugccugcaauucaccuugaaauguaaaaguggauugggagagggacagaugaaaagauauaugauaaagcagcacaguaaaauguuaauuauagaauuuaggcacacaaguauuuacaagucuuucaacuuuuuuugugucugaaaacugucauacuaaagcggggaagggacaacuaauacguuggauaugacaaggcaguggacauauagcuacuuagcacagugcuuggcacauggaaagcacucaaccaauguuagcuacuugcaguacuagcugcuuaguaagccagggucaaacacuuccuuuuuggaaagaugaugcucaaaauggaaaccugaggcuuuucuuugaggccuuuccauuuagaaaaaucaggcuaagaggcaguagcuuaacuuuauauuaagugaagauuuuuguagaagcuaaggcucuccaaaggccaaggggcauggcugugaccuuagagaacagcaggcagagaggguggcuguaucaucauagagcacugauuugggagucagaaauacacgugggugcaaaccccagguuuaccguuacuaaaacgagugucaagcauauacgugaagugcccucuccccaacucaauauuuucaccugccaaaaaauaauauguaugugaaaguacuuggcaucaccagcacuuagaaaaaggagauuuaauuggaauggucaaaaaggaugcuuggagggguggauaaaccagauugcucuucuccauaauucccacuucucucccucaguucccggauccugggaaccaaaaugagcuuuuaaaguuuagucaauucccuacuuuaaaccgucccauagccugccacugcauucacaauaaaauccaauuuccugaccguggccgacaaagcccugcaguaacuaaccccaccaagauaagauaauuauuuuuauuuauugguguacacguuuaucgucucucacuacacuaaaauguaagcuccuaucuuaauucccgcuguaucccagugucgcgaauagagccugguacgaauuaaggggacgggguuguguggguuuauaucagcacuuguccaugaguuggcaaaccgucaacugcccccaguggaucgucacuagguauccuggggcggccccucacccagcuccagggcggcgccccuccccgagccccuggcccauuuucacuucccugaggaaauaauggcgggagaccccuggcgcgcgcaucccgccccgagccaccgacuucagcagcucucucgccgcagcagcccugcuugcagcccccaacucccugguccacuggccacaccucucgcgcguucuccuggcccacaagcccugaggccgccugcuuggccaagccgcucucguccagccccagcccuuucacguggcugugggaggcgaugcgcugcgucuucguagugcucuucaccuccucaaucuucauuuugcagacgccgggagcuaaaaccagcguggaaaaccagcagcuaggacagugcgcccggcgccugaguuaccaugcggccguuacuagggcaauuugcaaaggcccgccuagaccggcuuu

SEQ ID NO: 14776 - RNA, 19386 nt, Homo sapiens
guaccuuguaaaaaacuggcuuuauuugucacuuauucaccuuaucucaguuaugccauuuuggcguccacagugacaguccccuggaagcuggggucagcccccacccacccaccgugaccaucacccacagggcgugagugugggccuugcagggcccagccgaugguuacaggcugcaggcgggacuauggggcuccuccugaggccuggugccuuccagcccccugcccaccagcuuggguacagcugccugccugccagaggccaagcauuccuaagcgugggcugggggaggcccugccccucuguagcagcagagcagacagggcagugggagaaccauguggguaggagggcaucaggucucaagagccucuccccugcucaggacugggucuagacaaggccacgugugauagggugguaagcccugggccauauggaggagccuggggcccaucuugguucugcugcugaguugcuggguggcuuuaggcaagucccuucuugucccuuggucacucuguuuccuggcuagcacugccagcaaggucuccagagugugccccucugccgggcuguggcgguggcccugugcuuugcaggcugccgugugcccacugucagaguggggucuccccgacaggcugcacgcacccccaggcccccuucuuaggaucagggcauccugcaaaacauccuuggucccaccaaugucuaaagccagcucgaaaccucgagcuccucaggaucuuagcacccaacucugcugcccuugcugcugggcagugccuguccuaagaggggacucccuaaaggccagagagagggugcucaucuccaggaccuaggccaccugucagcacaaacagaacuuauuccagacauaaacaugagucuucuuauuucaaacacuggagcaacugaucaacaccaccacagcccaugcaccccgaaccugacuucacuaccaaccuugagccugugcuguccucucucugcugacgacacuggugacgcagaaaggaagucgguggugucugcucacuugcgugcaguccuaagcacaguaagaaaauucugaacacagcugggugaucuucagcccagaagguguaggggcuugugagcacuaagucaguuucuguccaugucugauagcuaccacaaugucuccccuugcuagggcagcugcgaggagacguguccagugaugacuggcagaaucuggacaaacggacaucacugcaagggucuguccaccuagcuuggccaggcucagcuuggcagagcugaugacccaaguggacuaaacacggagcuagcagaaacaggcagacucuaagcccaaccagaagagucagcuagaagagccaauaggugcacagacaaauccacagauggccaggagugucuucugggaaagccaucccucucuuuuggaagaaguucuguccuuaaaaaaaucacuuuuaaaauaagggaaaacaauggugucuuagagagaaacaguccuaagccagauauucccacgccugauugugaaggagacaugccagcaaggucccacgucuccgggaaauacaugaucugcucccagcuucacacccuacugccaaaaugaaacguagacauuucaguguuugugcuuccaaccagagugagaaauucccuuuguggggaaacaggugagacggcugcagccgcauacagcacugagaaggugcaaagguuaaaacaaaaguuacauggacacuuggggacaauccuauaccauucccacuucucuggcagucggcugaauaaaauuucacuuucacaguucuuuuugccagugccaggauaaaaagcaaaauuuuaaauuggaaaaugucuagcacuuuacacaguggaaugaaagaauacgaaauucaaaaacauuauuaaaaguccauaugccgcagcagcacgcgccaugaugagagcuccccuuccgaggcgcuucuggagcagcuuccucaaccuguccgggagacgggcucagaagagcagggcccccaugcugccaaccucgcuuugcuccuuaacgaagaucucaaaguacugguagaugauugugacugcgagcaggaucccgguuccagacccaauggcgccuaggaagucagccaggaccgagagggccccgaugcacagcccaccaaaggccgcggcuguggggauguaccugggggaggggacacagucagcuccuggacacccacagagcuccccgugagccaggcggccaacaggcucaccugagacuuugggaccuaaugccucaaaggccccucugcugucuccuagaaagucaucuacuaacaugcuagcgcucuaggccaaggcgcugcuguccaggcaguggccacacuggccacacguggccaggggacugugacuagaccaaacugagaugucacauaagauuuuggagauuugaagacaaggauguaaaauauuucaucaugguuuuucuuaacauuaauuauaauguugaaaugauacuuuggauauacuagguuaaauauauuaaauuuaauuucaccuguuucuuuuuacuuuuuuaaugugacuucuagaaauuuuaaaaacuacaugugacuugaauucuacuucuacugcacagugcuguaaauccagcagcuuaauauuaagagaaugaacuaaauugccuaccaucccugcuagggauuagaaaaugaucugaaguuugcaauucuggcuuuuccugugguugcuuccuuuagguaaggcccauaggacaaccuggucugcagcugacuuuguagccagcuuuguaggaacacggccaugcucauuugucuguugucugucuguggcugcuucugagugacgauggaagagaugaguaguuguacugaggacugugcagacugaagagugcuguggcagcaucuaaggucaccuggacuuugcccuuccuuaccuaacugcuccaucuccaaggguacagcuguaucuggcaccaucaccucuggcccaaacucucaccacagccuggcagguauguggccucccccucucccucucuagcgugguuucauguauuagcacugaccuuccuaagagacugcaggcuccaucccuucugcccugcuucagaugcacaucaaccccuuccgugcccagccacugccagccucucuagccuuaaugccaccacaggccccaaaaugcgcucagaugccaggaccugccugcucugagcucagagugacccuccuccagggcgcucucuucagcaccccaccggcaugagccagggugagggucccgcugccagucacagcuguugcucucaggacccuuacugcacugucuccuauccgccuggccacaugcuuccaucuccuuacccaguggcucccucuggaggaaaggggcuguaaguguuuauuuuuacgucuccaguguccagcacuuagcaaguuuauaaauauauaacauuuaauucuguccuguaacccaaggauaagauuuagugacccaguaagugcuagggccuaucaggaugcccugcauggaaagaaacaacacauguccacagacgggagguuggggaccuggggccaccacucaccgguugaguucauggaccauggaggucucucgguggccucucaucaccaucugcugcuccuucagcugcuuugcaaccugcagggugcccacaggggagaaguuggaauuggaggcugaaggggaaauaggcauuccaagugguacugaacaguuacagaucgccucuucgagcacugacaauauucauacagagaacuuuaaaacugccgcaaggaagucauaugaaaaagucuaacuuuacaguguggauucagauucucauacccacagcugaucuacugcuggacuccaucugucagcccuuaaagcuucugaacugcccccuaaaggacgacgaucuaucugcacacgucacagaccauuauuuaugaugaggugacaaguccacaccccuuauaccagucacacuuucaucacccuuccagaaaguuuugcuucuacuuacaucuuuggcagaggaaccugagaccucaauccacguuuuggagaagaaugcacaggagcccagcaugaacacuauguauacaacugcauggaccgggucuucuaacacggagccaaaagauucuggaggggacagguaauagcaaaggccaccaacuggauaagcacgugcugggcccccagaagacguguccuggggaagaagaaaccaaacgcaugugagugcuccuucauuuuacuuuagcaucaaggcaaaaauaguucugagcagaugaaagaaugcaauuuuacucggugcccacaguacaauuuuuuuacugaaaagauaauuuaaugugcugaauuuguaaaaggcacaauggaaaauaucuuuggaugaaauaucuguucaugagcaagacacugauagaaaccacugcaacuuagcugcauugcuagcucaucuucaaagagccuacuuaccgaccaggugcccagcaggcugaccagcaaguugccacugaagcgagcugagagcauuugggagaugacauaaagguuggacaccagggcagacugcaggaugauggggauguuggacguauagaagagcuugaugggauagguguuguacuggccacgguagcgggccgacuugauuggcagguccacucggaagcccugagaagccaaacagaaccaaauccccuucacugccucauuucagccugcugcacagaaacacagcccggccggggacuguccagugggccacaagggaggaaauccugugugcugguucuggggcucccaguuccgagagcuugugcccacuccuuacccaccacugcacuccugcacuuggcacauccagaaggggcccagaaaagcugguuuaaaaauacacugaaggcuaggcguggugacuuacaccuguaaucccagcacuuugggaggccgaggugggagaauugcuugagcccagaaguucgauaccagccugggcaacacagucagacuccgucucuacaaaaaauaaacaaaacuggccgggugugguggugcgcgccuguagucccagcuacucaggaggcugaggugggacaaucacuugagccugggaggucuaggcugcagugagccgagaucaugccacugcauuccagccuaagcaacacaacgagacccugucucacacaaaacaaaacauggaagcaagcacgguggaaugauccccacccccacuuuuuuuuuuuccaaaagacagagccuaucacauuacauccacaucuguguggaauauggagaaaagccuggaggccacacacccaaaucccaagggcgcuucucucuagcuggugauguuuccuaagcuuuuacacuggcucugaggcagggccacuacagcaguggccucacaccuuauaauaguuccuuacaguguuuuuaaucauaaacagaaaagcuaaacuuuucuaggaauacaacuucucccucugaaaccccuggagacuagaaaggguuuauuuuuaugagcucccaguaccuagaacagggcucggaauacagaggauuuaaaaauuaaauacuuaaggccgggugcgguggcucacgccuguaaucccagcgcuuuguaauguggaggcgggcggaucacgaggucaggagaucgagaccauccuggcuaacacggugaaacccugucuauacuaaaaauaaaaaaaaauuagccgggcguggugacaggcaccuguaaucccaucuacucgggaggcugaggcaggagaaucgcuugaaccugggaggcggagguugcagugagucgagucgagaucgcgccacugcacuccagccugggcaacagagcaagacuccgucucaaaaaaaaaaaaaaaaaaaaaauucuuaaugaucugacugcaaauucuggcaaagccccuaaagagauagcuuuuuauuaagcaagaauguggcuuagucucagcagaaggaaugggaaaagcauguagcucguauaaauaccuuucacaaacaucaaacugccuuucaucucugucccuucuuuuaaauaaacaccaaaauacaaaguggaccaucaaaaaauacaaagaucaauccaauuacaggaaaacaauagcaguucaggucucuuacucagaagcaaguuuaagagauggaauacuuuuaaagguaagacagcuuaagaagauaggccguuuccgagaugcagaaguuaccuauaaauaucauacaaacuuucuauaagagagcaaugagguuucagagcuagaguacuuuuugcuucucuugaacuaagaacuuaaaaauguaucuuaccugucgauaggcccaacccagaagaacaugauuucacuuacguuagaacugccuuaauuuuguuucguuaauggcaggucccaugacucaaugaacaugcuuguccagcucaucuggaaaccugcugccuucaaauaccaucucaucguuucaacacaauaugaugacagugcaccccacagagugggggacugcacacaaggcauucugaaacuuaaauccagaccauggaaacucccugggguuggaucuggacacaccuggaaauagaugaccacugcaaagacaaagaugguggcgaugagauucaugagguugggaagauucuggcgguagaacgccucccgaagggcucggaccuugucugugcguguggccagcagauggaaaagugcgaugauagcaccuucaaauuccauuccuguuggcagaggaggagacauauaugaaggaacgaacaggcaacucaauuugcuucuagccuucuuagcagacaaauaaaaagaggaaaacaaacuuaaguuauuagacucauggugcccauagccacagggauacagcauguauuauucucaucccucccuucucuucuguagagaauucaaacuacagaaacgggcuauucugguuuguuuuugauuuuuuuuagacagggucccucucucucggcugccuaggcuagagugcaguggugugguugcagcucacugcagccucaaccuucuccuccugggcucaagugauccuaucucagacuuccgaauagcugggacuauaggcaugcuaccacgccuggcuaauuuuuuauuuuuuauuuuuguacaguugggggucucacuauguuacccagucuggucucgaacuccugaccucaagcaauccucccgccucacccucccaaaguguugggauuacaggugugagccacagcacccaaccacuauuccacuuuuuaaaauuaauuggucucauuucuuaggcacaugagucaguggccaccagagguguggaacgaugauaauuuauaaaaauaaaagcagacucugcugaacucuagcugaaaggggucauccacugaagagggggcucagagcuggcaaaucuacuuuccuggacaaucuugagaaguacaaguacccauucaacagcuaugaagugcaggcugcccuuggcuggugaguggggaggcuccagcucucugcuucucacaccaaggauacaaguacagaggauaugcuugcguccaccauguggucccauccaaaugacacccugccaggagaugcuccugagggaggcaggccuagggguggagugagcuuacugagggacugagggauauaggaaagggacccaaucuaagaaccagacaacagaguaacaagugagaggaaggcggggaguguggugcauuauuaaggccuaaguuuuagacaucagcaagaaauuuacuuacguuaaaaaacuaaaaagcgaaaaaaagaaacaagugauaaccucugccguuccaggacagcauaaccaucccauaauggaagccuggcaacucacgcugcuucuacuggcaggaagcuggcauuacuuccagagacagggucucugugggcaguguggggucaugguaucaguacucugaggagcacuuuuaaaaaagucaaauaggagucgggcgugguggcucacgccuguaaucccagcacuuugggagacugacgcgggcggaucacaaggucaggaguucaagaccagccuggccaagauggugaaacccugucucuacuaauaauacaaaaaaauuagccgaacaugguggcgggcgccuguaaucccauacucaggaggcugaggcagagaacugcuugaacccgggaggcggagguugcagugagccgagauggcgccaaugcacuccagccugggugacagagcaagacuccgucucaacaacaacaaaaagucaaauagggacuguauuugauggccacuuuggaguacaauuaauuuuacaugacagauuaaauaggaaagcugaaacugaaggucagacuguacuuagaggacccaucuaguacuguggaacuugucaaauguguccauucccuugugccuaacagugaaauagagugagauguaagaaaugaagacacccuacaaaaaggaaagcuucuauucaaccaaaauaacuugguagcugagggaaugggaagaguaaccaaacugaugguaugugggguuugccuuuuaaaagcacauuaaauaaaaacuugagaagggaucacuuuaacccaaagguaauaauucuguccucuggacccagaucuggauggugagccuagagagguggcccaaaucuguaguucagcucaggagccauccagaccccaagugccugacauugaguuucggugcugcaggugugacaucuccagauugugucucuggaugcugucaggaguagguucugcucccugauuuuccuuucauagaacaaaucuuccaacuuucacuuuuacuccucccaugacuaaaaagcaagugaaucuaggaaaaggugaaacuaaagaacucaaaagcacuguucccaaguuucuaacacgugauagcuaggaccaccugcuacaucuuccuggaccauuccgagaugacaugucaggcagaccaucuaaccaauaugaccacugaccuccucugcuguggcuucugugaaagagacaccauauccuaacuggccaucauguccucaucucacccuguggcggucuuucgucaauucccauccuuuccaccuuuugguccugugugacaaggcuggccuguuuccccacgguuucaaauuugggacuaauucccaguucugcauuguuccugcugcccagggaagcagcagugauuacugucucugccuguagaaucucauucaacagccuccccugucccaagccaagcugcaacaucuccaggcacagcugcaaagcugccgucccagcugugcccucuguguggcucucccugccccucccuaggcucucccucuagcaccacucacugcccacaugcaggccauggggcacagcccuuccugaaugcaucucgugucagccaggucccaaacacgagcaacugacauguagacacacugacuucaaggccagacaaauccaccuuugcuucuuaguuuucccccaccuugaaagugccucucugguccccucucucaacuugcuuccuccaaaugcccucacacagugcucuccuguaggauggcuuaauuggggcuggauuacugcugcacgcaccuagcugcucucucugccuuucagugcagagcaaaucacuucuuccaaacucuggcucccauuacucaaugcccugcugcagaauggaacaugagccucuggcggcuacuacugggcugcuaagccaccaggggcuccccucugacuuuacuuccuucccacucaggcacuccccaaaagccagucaccaugauggucuugacaaauaccugaacuccuacaaugccaucccccucuugccuuuucacauccugucaaacuuugccuucuggaccugcuucucccaauuuaccuuggauuuccuaaauuuauacaaaguacucaaggaagcaucaaaugugaucuugcccacucuucucuauggcucccuaucucaagcuccacucuccuuuguaaccuguuaggcacaugcagccuucacuuguuuggggaccaguuuuccaucucauuaaugagauaauauggucucuggaggccaaggacucuguuuccaacauucaauuaaaagaaaacucucaaauaugcaugauuauuucuccuggaaugcuccucagugaagaagauauuuagugccaaaaaauguuuauuuccuuucccuaauaagucacacucucuaaggcuucccuuguauguuuugaacuuuuuauuaaaaacaugcuguuacaagauuuccacggcacuugguggauguagcacagcaugccaauguuugauacacaucuaccaggagccaggcaucauguaauuucauguugcuucucacugcauccugguaaccaagauucaguggugcaggaaucugcccaaagccacguauguaugacuaacaggaacagccaggauuugaacgcaggugcuaagcuccaaguucaggccuuuuucagaaagcugccccuugcaugaccaagugcuuugguuuaggaauuucauuuuuagaaacuuauucacugagagcagcugccaaaauauacaaagaugaacauaugaggacagucaugguuucaauguuaacgauaaaaaaaccuggaaaugacuuaacguugcuuuaucguugcaauauaagcuuauacugugcuaagaaaagugaggcaggauuguguauucugacgugccaaacguccaggagauauuuuuauaugaaaagugcaaguuagguaucaucauaauuacaagccuauuuguguuuuuaaaacuuugcagauggacccaaacaccagaagagauaaaccuaaaacugacauuauuuuucuguggaauggggggauuuuugucuucugcuuugcauugcucaauuguuuuugcugaaagcugucgccaccaggggagcacagggcccuuaccucggccaguguugacaguaguggggcugaaugccuuccauacgaugguuucacagauguuaguugcaaugaagagagaaauaccagagccaaggccauauccuuuuugcaggaguucauccaaaaguaggacaauuaagccagcaacaaagagcuguaaaaauucaaaaauacaagacuauguguuacugcuccccacggacaugguuccguccuucaguaauuggguucucugauauaaacgcugaagacggaaugagaucacauccucagccccagagagcggucaguaaagccuuucucugcugaauucagagggcuaacccagagucuuaggcuucugcuuccuuucaguaggaguuccuuuuaggugugcuugagauucguuaugugagaauuguagguaagugugaggggcuacucaaagggagauguuagcauaauaauuaccugaauggugauuagcaggcaaauuccagcacccauuucagaaggguccccauacaucccggucaucacauacacgauagacuggccgauaguaaugaucaugccaaauacuagaauugaaagaaagaaguguuuuccaagugggucacuacacagaacaaaagaaacaauuaagaaacaccaauucaacgccaggcacgggggagaacaaagaugaagagcagugauacuaccuccaaggggcucggcugagaacgcgcuaaaccaucacaucagcaaaguacaugaugaaucaaaagccuuuuaacaaaagcacacuucuucuuuaguuuuaccuuuuccuagauucacuugcuuuuuagucaugggaggaguaaaagugaaacuuggaaaauuuguucuauucaaagaaaaucagggaguagaaccuacuccugacagcauccggagacacaaucuggagaugucacaccugcagcacccaaacucaaugucaggcacuuggggucucgauggcucaagagcugaacuacagauuugggccaccucucuaggcucaccauccaggucuggguccagaggacagaauuauuagcucugggguaaagugaucccuucucaaguuuuuauuuaaugugcuuuuaaaaggaaaaccccacguaccauugauuuggcugcucuucccauucccuuagguaccaagcuauuuuggucuaauagaagcuuuccuuuuuuuuuuuuuugagacggagucucugucgcccaggcuggaguacgguggcaugaucuuggcucacugcaaccuccaccucccagguucaagcgauuuuccugccucagccucuggaguagcuaggauuacaggcacgugccaccacagccagcuaauuuuuuguauuuuuaguguagacaggguuucacuguguuagccaggauggucuccaacuccugaccucgugauccacccaccucagccucccaaagugcggggauuacagacaugagccacgccuggcaaaagcuuuccuuuuuguagggugucuucauuucuuacaacucacucuauuucacuguuaggcacaagggaauggacacauuugacaaguuccacaguacuagauggguccucuaaguacagucugaccuucaguuucagcuuuccuauuuaaucugucauguaaaauuaauuuuacuccaaaguggccaucaaauacagucccuauuugacuuuuuaaaaagugcuccacaacaauuaguucuuaaugcaggaaaacauucaaaacauugugaagaccaaagagaaaacagccaauuugugcuuguacuuuuuuuguuuucuuaguguuuuuuguuuuguuuuaagagacaggcucuguugcccgggcaggagugcaguggugcacuagcagccucaaacuccugggcuuaagugauccucccaccucagccucccuaguagcuagaacuacaggugcaucaccacacuuggcuaauuuguuguuguuguuuuguagagauggggucucucucacuguguuacccaggcuagucacgaacuccuggccucaagcaaucauccugccuuggccucccaaagugcugggauacaaguaugagccaccgcucccagccacauguguguauuuuagaauccuaauuuuuaucuaaaacugacaaguuuaaauagauguauuucuuggcugggcgcuguggcucacgccuguaaucccagcacuuugggagccugaggcgggcggaucacgaagucaggagaucgagacugagaccauccugacuaacacagugaaaccccgucuuuacuaaaaauacaaaaaauuagcugggcgugguggcgggcaccuguagucccagcuacuugggaggcugaggcaggagaauggcuugaacccaggaagcggagcuugcagugaaccaagaucacgccacugcacuccagccugggcgacagagugagacuccgucucaaaaaaaaaaaaaaaaaaaaaaaaauagacguauuucucauucaauuauccaccauacuaauuuaagaccuguaaaacaugcugguguaggcgaaaagaugacuggauaggagacuguaaauaucauuuccuaauuaauguuuuucagcaaacagaggcuaaauauggcuaauuuugaugacuaguaauuguuacuaguaacacuuauuagauaugaggcaaauaccauuauuauccccauuuuuacagaugaagaaagugaaacauaagagcuaucaucuaacuuuuccccagaucacagagcugguaaauuauacagcuggacugacaggaucaccuuuucuucaguuaaauucuuuuuuuuuuuugagagaagucuugcucugucccccauguuugagugcaauggcuuuaucucggcucacugcaaccucugccuccuggguucaaacaauucuccugccucugccucucaaguagcugggauuaaggcaccuugucaccacgccuggcuaauuuuuguauuuuuuuaguagagaugggguuucaccauguuggccagguuggucucaaacuccugaccucagaugauccgcccgccucagccucccaaagugcuggggguuacaggcgugagccaccgccccccagucaguuaaauucuuuuauaaaacacuugccaaauaacuacuaugugccaggcauugugacagugauuauuuaauccuuaugacagcucugaaguagccauuacuuccuuuuaagcaauaaugaaaugguggccaagggugcuaagaccuccaagcucugauccuucuccuccauuacauggccucaggggcacuccagacacucuccccugccuugcccagcccauccccagcacccaccaccucugcucuaccagaagugcucucucacgcuaacacagggcauggagcuccugcaggguuggcaggccaaggagguugcagcacaaaagaaaauacuguuugggcugggcaugguggcucacgccuauaaucccagcacuuugggaggccgaggcggguggaucacaagaucaggaguucaagaccagcauggccuauguagugaaaucccgucuccacuaaaaauacaaaaauuagcugggugugguggcacgugccuguaaucccagcuacucgggaagcugaggcagaauugcuugaaccugggagguggagguugcagugagccaagacugcgucacugcacuccagccugggcaacagaguaagacuccaucucaaaaaaaaaaaaaaaaauaaaaaauaaauaaaaaaagaaaaacugauaccaaaaucuuauagcaaauucaaauuuuccaacuauagacaucagauuauucacaaucuuucuuacacuuuugggcuccguugaagagagcucggucuuuuggggugucaccaacuucaauuaucuuggcgccagccaagaguugcauuauaaggccagacgugacaauaggagagaucccuagcuccaucaaugugccuugaggaaacggggaagcaaaacagucaauaucagcuuggaaacguaguacguuauuuuaaaaaugaauacgcaaaauuugacuggguaccccuuauauaaaaccaauguguuucaguuuccuagcuguguuuaauuuagaaccccaaaauaucaacgauuaguauauaauucaauucauucuguucagccugccaggcaacagcuuauucuguuuaggaagucacauggugucuaaacagacugcugcauuuaaauucaccauaaacagauucauucugguuuuagagauaagaaauguucgucucuucaucaguuaauaaaaaaaggauaacauucaaauaauuuccagagucuggaaaaggagccuguacaauuguaucuaguugugaauaagccucuacuucccauuauguuaaaaugagcuacacuuccaacugauuuggaauuuaauugaacuauauuuuuuaaaugaguuaaucaaaugcaguaucaaccuacacauucagaauccuccccagucccauaaguaacugguuagaggauauaaaacacuguuacauauuuuuugacacuauauguaaccuauagauaugaaaaagauacagcugaaaaacaaauuacauauucugaagaauguuaucaauggaaaugucaucauuucagguauucaaaaaguauucuaguuuuuccauguuuuuuauucucucuauagcauagacuuaucuucucauuacagguuuuguacugcauucaaauacaauuccaaauaugaugguaugccuuggugcugaacucagcauuuaauaaggcuauucaacacagcacuuuaacauucuucacucuauuuuccaagucacucucuaaguuccauauaaagccaaagccuauuaauuuaacuaagugaagcuagguaagccuacacucuacagagaaaagacagagccagaguccuaccucuguuagaggcuagaaucacucucauccaauagaaagggucagcugaaucugaagacaugaucccaaacaggggaaucugggaacaggcaaagagcaaaacagucagcacuccuguuuccagccacucuuaucccccuccccaauacgaaauacaagccugagcuuaccuggcagcacacuaagaagauaaagagggugauagcgguccacagcacuuucuccuuaaacugaaucuagaguaggagagaaugaauugaagcagggaguuacuuugaaaagcaaauuaauaaaaauggacuccaaucagaccccuuucucuaaaaauggacuccaaccagacucuuuucucuguucagcagagaagccaaaccauguaccaaacauaaguaccauguacugcguaacuuccucugcacagagcacaaugcaaggaccuacaggcaucaccccagcucaccucacaccacagagcauuaccuuuauuuuacaacugagccuuagaagagcuaaauaauuuguaccaaaccccaaugcuaaagugaguuugagucccaaacugugcuuuuaaccauuagcauuaacaguuaagacucaagaacaaagaaugucacaauagaacaugacuuguaaaacacacgagcaaccacuuuucauuugaguuucagucacaaaaccuuguuauucuagagucaaguaauuuggaauugcucaauaguguauuuucuaugaauuaaggguaaaacaguguaauaaaccauauuggggaagggcaggagaguugcauguuuaaccuacuaguaacauuuguuuaaggauuuucacaucuucucagguacauagguugcauaggugacaagaaucacuguaaagaugacuauuaaguauuaaguaucauuagaaaaccucccacccaaaaccucugucacuaaagaguagagugggaacucuuccagguuuucugccucugaaacugagugucuucacuaauaccugcugccuacacuacauuaauggcuuuagagggcuuaacaaacauuaauuauuguacagacggaagauucugagguugaaauaccuugugagagacugacaguauuaagugacaaaacuguguucuuuaaaaacacuucuaggcaggcacugagucagcauuccuggcccucuggccagaacuggagucacaguccucuaacuauacaugcaggcaaaguaggacacagucauacggccacacaacagugggugaaucaguguucagauacuccauccaaagcugggggcauucacaggacucuucuucucuugagaaugguccucuucccaccuaccaucccaccacacuaagaaauuagaaaguggccaagagaaggcaacgccauuucagaguaaccugucugaaaugaaucuugaugggaaacaaagagcagacaauuuuuucaaaacucccuuucuaaucaccaaguccucucuccugguuacaaucaaauuuaacaucaaaaccccaaaagcucuuuauccaaguccugucuccucugcuucuuaguagccccuaaauccauucuugcucaguaccacaguucauccucugaugugaaaagccucuaaaccaacucuaguccucuccuuuucuuccaaagugacauucucaugucuggcccuuguuauucaucuccuaauguuccccaccuacaauuauguucuaucaauagcaacuacaucuaauaaccucccauccaaacaugcuacacucuugucaccaaugccuuugcaaacuauauacuccuuuuauuuggaauuccuuuccgucccuucaaggagacuucuauuucuccuucaaaaccaccauaagacaucaugucucccagaguuaaucccuuccugagccacugcuauaccuugcacguauuucccuuguuccgucuaccacacugaguuacaaggccaaggucacauagcuauuaaggugcuauguaaagggugggaccuaggcuugccugccuccagagccaugccccuucgcuacacuggaauugaggggguaaagcuuuacaaauucguccauuaaaagcagcacaugggcauuuauaugaaacuauuuuacguaaaaaaaugaaaguggauuccaagcacccaaguguccaugugaaugcuuuaacaacaguuugaaaaauaaugugaggacacaaacauuuuauuccccacucucuaaccuaggaaccuaaugaaacuuuuuuucguugacagcuguaguuacacuggcaacacucacuccacacaauuucugauucagcacagcucuaaauuuaaucuuuccuuguuuuaauacaccgucugugaaaagcagcagacuucacaaaagaauagccuuuauucccccuauugugacagccuacauaaaagguacaaaaucauuuguaaauacuaaagugacagcccuucccuuuagcagcuggauacaaagggcaucuccugggaaaaaaaaccaacccgugaucugcucccguuggaggugaaaaagggaggguaacucaaucugcuauccuaacugaggccuuauucauucauggcccggauccauuuuugggacagggcaaccggaggcuuuguucucggagcaacauccaccaaagaugcuccaaauaaagcacagugauuucaguggaaauuuccacacaaccaggucaccuuucgacagcucuccggaauaacagagcacaacuacacuccaagggaagagaagggagaguuuccauugccgugcugaagccauuuuuaaucauacuguaaacuuccagaguccagacaguuuccugaaaccuucuuuguuggcgauuugggguacuuaccuuccucucuggcuucugaauuuccggcaggaugacacagaagggcuugaugacuuccagaaauuugacuuugaugggagaaacaaaacaggaagaguugggacacagagaaguaaccuuccgcgcuacccagggacgccuucugcccacgacgagugagagcaggggccaggggagccggccgcaccccggacgcguggggauacucgagaagggccgggggcacgggccgcguucugcagggggccggucaggguuggccggcgggcgcccgaccgcacggguguggggaagggggaucuguuccgucccggccucaauagggcuucccuacaggacucacuugccauggcggcggcugcucgggcuccgggucccgcuucagcucagcucugcuccgcgugaggcgacgcugcccgcggcccagcgcguuccacugcacagcagcuccgccgagagacacgucagugcuagcccggcggcaagcggcgcggcgcggcgcggggcggggccggggccgggccucggaucgcuuccgcuuccugccacgcgcgcccgccggccgccgcgcuucgccgcgccgcgccgcuucgccgagaccuca

SEQ ID NO: 14777 - RNA, 380 nt, Homo sapiens
aggcugcccccugcagguggugcaugcauuugccuaucggcccacucugccuggcccaccuccaaaaaugcuaacucucagauuucugauuuauuuuacuggguggagcuuuucugaauugugaaacaugaaggaagaaggggagguuuugauggugaugggcagaagcaugauguccaauucauucaaggcuuucugaguucuccuuggaacagcuaaguggagaggccugauugccaauggaagaugcaguaggaugcucaagauggagacgaagguuuggaagccgucggccauuuauuaucacugaaaucaugggagugaauucaauugcucaggggauguagacuggaaggauaagcaggccuaggagagaucau

SEQ ID NO: 14778 - RNA, 8027 nt, Homo sapiens
ucaugcucccacggugccuucaagcuuuauugccacacacacucccccagcccuuccugaauggcccugugcaugggaacaccagcuuagagaagcaauucagggcuaggcaagggccagaggacuggauuugggacugggguggguaggggggaucuggagaaggaaagugcuaagaccaaagcccacccccaccccagguuucccugagugguguccacccccagggucuugggggcuggcuugugcauuggggggagggggcucaucccaaauggauccuccccuggggucuccaggcucauggagggaagagaagccccacugagccccucgcaccccccaugaagcccucaaugugcagggagcaggaagaagagcugcacacaaacgcauacacaugcuugucuccaagagagcuccuggccccuggggcugcccagccaggggcucaacaguccagaccgauggacacgagcagguccucgagugcccgcagacgcugcugcgccuccucuauggcgcuguaggucugcaccgugcuggccacguggaagcggaugucguccaccagcgggauagaguccgucuccugccgggcugccacagccgcugccuccuccuucaccgccuccacgaaguccucccgcuccaccagcuaugagcgggaagggccagcucaguggaggggugccugcccucucaccccuccuucccacccacugcagaccacuggcccaccuucucaaugaccuuggccauguacucagugcacugguccucaagccgcgccaggcggaagagcuuggccacgcgccacacacccaccacaguguccucgucuagcaucugagccaggcugcggccgcacagccucuucaggccuggcagcagguacaugucggcgacgcucagcacaucauaggcugccucgggggacagcugcagugaagacagggaugaaggugccccccgaggucaccaagggcucccagggcacaacagccaaggcuagggccuguggugguuggggggcacuggcgggaaggcuuccagugggaguaggagcucccugcgcauguaugggguugggggucggggggcuggcccagauucccacagggaucugcaggaccgcuagggggcagaagacugggggguucucccaugcccugagcaggcuggcagggcaggcgggaggcagggcccucgcaggagccagggucugagcuccgaguuauacagaccugggucugacacuucuagcuguggggcccugggcaagucacugcaccucccugugccucuaguucccaguccaugagguauagauaaccaugccuaccugcgggggcugucagaauggugggacagaggcagcuagucaagaccuaugcagggacucugccaggggugggagacuaucuaccagcucccucccucucaagaggcuguggggacacagagcccaccuacagauacauccugugcuggauaagacugaagcccucagauucaggccagagccuggguggcacagggagcaagcugcagacagagacaaggggagcucugcgaccacauuacaagccaugugccaugugccaugccaccuccuuuaccuggguaacccaugcaucugcacaaggccuuaggaagugacgacgagagcuauccccauguucuagaggcacagagcaguuaaguaacuggcccaagaucacaaagcucacccagugucacacagcucaaccaguaucaacccagguuaagagcccaagccacacucugagacaaggugcccuuuggguggcgaggcuccuugaagagggagcuucuccagggugggcaaagguaaccccugcuacaggggccagagagcugggcugagcugcaggagaugcccaguagagggggugggaaagauggaggcugaggggcugucaggccgcgcggagggauggacaagggagcugccacuggagauagagcagcaguagggacugcccucugucucccagcaugcuuccuccccuucccccacaaaacagggcccuggccacagaaugacuuuccaagccucccuuguuggcagguaggcacgaaguucucuccaggggaacaugagaaguggugcaauuuccgguggcuucuacaaaaacagcauugcuugcccugccuuccucuuccuccuagagcaugaguuugccuaggacccaaucuccauggccaaacgcgaugccccaggcaggauggguaagcuacggccuguggaccaaauccagccuguuugugcaaguaaaguuuuauuggaaugcagccucacccacucaucucuguacugucucuggcuaccuuugcgcuacagaguugaguagcuacaacagggccauauggcccacagaaccugaaacacucaccuucagagaaaagguuuuugaccuucacccuuaggcauacaggggcaagauggagggaugaccugaucuuccgcaagccacuugcccuggggcacccaccucagucagaagugaaggagaaacaaacuccccucuucuuuaagccaccagauauggggauugcuuuauagugcgcgcgcacgcgcacgcacacacacacucucucucucucucacacacccuggcagagcaaaccuucagcacucugcugcugcccugcagccuuggcuuacggacaccuuggggcagcuggagacagaggcaggcagcaagggaagaggagacugggaacccagaaccccagggaucugcagcaccacagagaggaggcuguccccacccacccuccacccuccugcuagagaagcugaggaucccaaguggcugacaaguguggagugucugugacacaggcucaucacucauccucucucuggagcccaacaaggcuuccucuaccugaaagaaaaauccaaagucccacagccuuccccuccagccuucucaaaacgucaaccauggggccagcugggcccuuccacagacccccagggcccuggcgcucccucucagcccacggcagcacagguugugugccauccccagcucugccugagcccccaccucaguguggucgcuguacauguaguagagcacgugagugaagacgucgggugagaugccaugcagggugacggcuggggggcccccugaggucgcuggcuccucgcucucucggaaguggucauccagcagggcucggaaguagucacugcggccacagaaaaaggccugggggaggccgggcucaggaagugugagggccagggucugucuccugaggagcuagacgggggcucagggcaacgggcuggggccaggggcaacaggagggcacaggcaccuuguggcagaggaagcugcagccagccacucggaagcagaugucagggcagcuguugaagccgucaggacaagggaagggcagcucccaaagaucacccugggguacagaagaggugaccccaucagagcaguuguucacagaagugaacgacuagguucagaaaagggaaguaacugguccaggaccacacaaggaauugagcccaaguaucugggcugccugucacggccugccaucccaaaacgcccuuccugcccaccagccccgcacuuacucggagcucggggggcagggcacaaucggccagcagcgccauguccucccggaggcgggggucugcaggugggggcucgauggucagcaccuucacacacgugccuggcuuagacgccacuacaggggaagaacaacuucagggagccaggccagcccugccaggccgcacccauggccccgggccccaaacccugcucgcaccaaacucagacaccuucucgcacuuggccuccaggucgcugagcaggucccacagcuggcauugcuuggccaggcgcucacagucacucacaugcucuacgccaauguccaggcggccugggggcaguggggaggaugagggccugcgggaccucagcugucaucaggcccacagaaaaagggugauccccucccaccuggccaccuggcugcaggacuaggacuccugggcccacuugccaccaugguuuccccaucaaaagcuguucuacaggccccagggaacagaugggagggccucagcaugugggugggacaagcucuuccugagcaggcacacuaguccucucucuugcaacccaacccgagaggcagcuggaaccaccccggggggaccaugaagugucuagaggugaaaggucagcccagccacaccuagguguacugcuguccagaaggacggcccacucccucuccuccuacccuggacccagggggucaccuguguacagguacugcagcagggccccaaaggccacgggguugaucugugggcagaaaaccagaaaguaaugucagaggcagccacccagcacaaccuccugcuguuccuggacaguucaugccccucugccacccugaagggacauaccagugggugccugagaaccacgacacucuugcccuuccauuugguguccagcauguuggcaaaguaggcacuacgugcacccaggacgcagcgaugcacccggaauggcuucccguguacuacaaagaccacgucacuguggaugcccugcucuagaagccuggggagggacaagccaggagggaggauacuuggcacagccccaccccauuccucggagcacucagaacccagugcaggccacagucagagcagacucgccacacccaccagggccaccgcaccccaugcugcaccccucgugugcccuggcucaccgcugcaagaagucgucauaguaaucccgccuccugcaggaagccgugaccugcuuguaaucgcguagagcccggcggauggggucacucagugccccauagaggcagcgcucaccaucgaagguguuggccucgcagcgggcuccugggggaggcagggcucaccaguuagcagggaaggggccugggggaaauucuaaucucccugucccuccuccccaccuucccacacauggggcuccgaaucucuggcgaugccuucccaaauuacccugggcccacucugaccccaacacccucccagucaagggcuaggcgaaugggcacgucugugugcacucacacaggcacauacucacucacacggaagacagacaacacagaacggagagcugacuugguggcugggcuugucccacacacuggagcacagcagugaacgagacacaggucccuguccugcugaacuuauacucuagugaggcaggacaaucaacccacuaccuaacgauggcagggacuauuaagaaaaacaagccugggcguggcagcucacaccuauaauccaggcacuuugcgagaccaagguagguggaucacuugggcucaggaguuugagaccaaccugggcaacauagugagacaccaucucugcaaaaaaaauacaaaaacuugccgggcgugguggugcacgccuguagucucagcuauuugaagauuugaaggggcugaggcaggaggaucacuugagccugggagguuaaggcugcagugaaccgagaucacacuacuacacuccagccugggugacagagcaagacucugucuccaaaaaaaaaaaaaaaaaaaagaaaaaaccaaaauaggaagaagaauggcacugaaugaagggaagucaugaaaggucacucuguaaugguggcagcaugcagagaccugaaugaagggggagugggccaugugaacguuugcagaacggcaguccaugcaggaggaacugcaggugcaaaggcccuggggcaggaacaggggcaugcauagcacaguggagccccagcgaggccaguguagcagcaagcaagcagcaagcaagcagggagagccgaaggaaugaggccagugggagggcagacccuguggagccuugggcauggccaggcaggcucacuguauccuagaggcaaugggaacuugcuggaggauuuuuagccgaucagauucauugugaaaagaucaacuuggcugcaauggcaagagagaggcaggcaccguguccggggagaaaugcugaugacugggcccaggucguagaaguagagaugggcaagguggacagagaaaagguuuuaaaguagcaauaauaguacuugcugauucgacugggugguaagagaggaaucguggugcuuugcaaauguguaucaaggccuuugaaugcacgcacgcaugcaugcacccacacgcacacaugcaugcacccacgcacacccgugagccgggcucccugcucucaccauuggccagaagguagaguaccagcuccucgugcccacacaagcaggcauaguaccugaagggaggaaggaaguacaggaggcaguccucagugcugaaggggugcaccaacccccacccuccccaccccucucuccagcacucacaagggggugcugucccacuugucccgcacauucaccuccacgucucgcugcuccagcagguaccugggcaggaaggaggucagagccugggucaggacggguucauggucugagaaagaaggcccguggaaaggaacggagagaaaacaucccuuuugguauggggaagccucccccaggugagggcaggugacaggcagaccagagcaggagaggcacucaaggcaaagugcaggcaaggauguggagguggggucgaacaggcagacacugugugcuaucagugcugggggacgaugggcuacagggacagaagccagagccagugccgaggcuggaccuuuggccuuucagcguuugggagaggaggugauggagccuucacucccaccagagcucucuacugcaggaagaagcuggcccuguuagaagcagggagcccgggaaaaagcugcugcaggccuccugaugguguggagggcacacaauucuaggaggcaggagucgcgggauacagcaacugaugggaugcggaaggugagcgaggggagucgccaaugcuaaugcagccccacugaggcgggggcagcccaaaggaggccuccaggcugcaccuggaagugcugugaacccacucagcguugacacuaugcacuaacucuugaguggcacgggaugucagggagcggcccagggaggcuacgggaguacagcagcccggcgccagcccaggggagguggaagcagucagucagcaccaggucaagggggaggaagggccaagaaaaaaggaggucaaacgggauaguggaagcccaaggaggggaagggccccagaacccaacugggcaccccuucccuccgcguccggcccauggagggggcaucucagcgccagauucacuuuagcugcgucaggaguuuccgaauccucagggaccggaggccgauuaugggcucuagguguuccccgcgccagguccagagagcacgagagaaaggggccacgucuggagucccaggccuauacccgcgcccugcgcccggggggucugacguccgggcccuaccagggcgaacaguggcccgccuucucuccgcccacuucugcgccuucgggccuccgcugagcagucccuucuuacaggaagcccuccgggggucaauggccaucaguguccccgccccagcgcgcuuccgcuggggggcugcggcggggguccggguggucugccccgcgggggcgcuccgagggcugugacccggcagaggcgcccgccucuccgcggccgcccagccgcccgucccagggcccgaggcguuccgagggcggccaccucccgcacccuccccgggacugcgagguccucaccgcacucggcccacaucccccuuccugcagcuggcgaacaggucgcugguguccauggcgcggaggaugguacccgagccgaacgaccucgggcggcgaagccgcgcacccggcggauguaaacacgcucagccccgccccgccccgcucugcagcggcguccggaggacccgcccgccccg

SEQ ID NO: 14779 - RNA, 8027 nt, Homo sapiens
cggggcgggcggguccuccggacgccgcugcagagcggggcggggcggggcugagcguguuuacauccgccgggugcgcggcuucgccgcccgaggucguucggcucggguaccauccuccgcgccauggacaccagcgaccuguucgccagcugcaggaagggggaugugggccgagugcggugaggaccucgcagucccggggagggugcgggagguggccgcccucggaacgccucgggcccugggacgggcggcugggcggccgcggagaggcgggcgccucugccgggucacagcccucggagcgcccccgcggggcagaccacccggacccccgccgcagccccccagcggaagcgcgcuggggcggggacacugauggccauugacccccggagggcuuccuguaagaagggacugcucagcggaggcccgaaggcgcagaagugggcggagagaaggcgggccacuguucgcccugguagggcccggacgucagaccccccgggcgcagggcgcggguauaggccugggacuccagacguggccccuuucucucgugcucucuggaccuggcgcggggaacaccuagagcccauaaucggccuccggucccugaggauucggaaacuccugacgcagcuaaagugaaucuggcgcugagaugcccccuccaugggccggacgcggagggaaggggugcccaguuggguucuggggcccuuccccuccuugggcuuccacuaucccguuugaccuccuuuuuucuuggcccuuccucccccuugaccuggugcugacugacugcuuccaccuccccugggcuggcgccgggcugcuguacucccguagccucccugggccgcucccugacaucccgugccacucaagaguuagugcauagugucaacgcugaguggguucacagcacuuccaggugcagccuggaggccuccuuugggcugcccccgccucaguggggcugcauuagcauuggcgacuccccucgcucaccuuccgcaucccaucaguugcuguaucccgcgacuccugccuccuagaauugugugcccuccacaccaucaggaggccugcagcagcuuuuucccgggcucccugcuucuaacagggccagcuucuuccugcaguagagagcucuggugggagugaaggcuccaucaccuccucucccaaacgcugaaaggccaaagguccagccucggcacuggcucuggcuucugucccuguagcccaucgucccccagcacugauagcacacagugucugccuguucgaccccaccuccacauccuugccugcacuuugccuugagugccucuccugcucuggucugccugucaccugcccucaccugggggaggcuuccccauaccaaaagggauguuuucucuccguuccuuuccacgggccuucuuucucagaccaugaacccguccugacccaggcucugaccuccuuccugcccagguaccugcuggagcagcgagacguggaggugaaugugcgggacaagugggacagcacccccuugugagugcuggagagagggguggggaggguggggguuggugcaccccuucagcacugaggacugccuccuguacuuccuuccucccuucagguacuaugccugcuugugugggcacgaggagcugguacucuaccuucuggccaauggugagagcagggagcccggcucacgggugugcgugggugcaugcaugugugcgugugggugcaugcaugcgugcgugcauucaaaggccuugauacacauuugcaaagcaccacgauuccucucuuaccacccagucgaaucagcaaguacuauuauugcuacuuuaaaaccuuuucucuguccaccuugcccaucucuacuucuacgaccugggcccagucaucagcauuucuccccggacacggugccugccucucucuugccauugcagccaaguugaucuuuucacaaugaaucugaucggcuaaaaauccuccagcaaguucccauugccucuaggauacagugagccugccuggccaugcccaaggcuccacagggucugcccucccacuggccucauuccuucggcucucccugcuugcuugcugcuugcuugcugcuacacuggccucgcuggggcuccacugugcuaugcaugccccuguuccugccccagggccuuugcaccugcaguuccuccugcauggacugccguucugcaaacguucacauggcccacucccccuucauucaggucucugcaugcugccaccauuacagagugaccuuucaugacuucccuucauucagugccauucuucuuccuauuuugguuuuuucuuuuuuuuuuuuuuuuuuuuggagacagagucuugcucugucacccaggcuggaguguaguagugugaucucgguucacugcagccuuaaccucccaggcucaagugauccuccugccucagccccuucaaaucuucaaauagcugagacuacaggcgugcaccaccacgcccggcaaguuuuuguauuuuuuuugcagagauggugucucacuauguugcccagguuggucucaaacuccugagcccaagugauccaccuaccuuggucucgcaaagugccuggauuauaggugugagcugccacgcccaggcuuguuuuucuuaauagucccugccaucguuagguaguggguugauuguccugccucacuagaguauaaguucagcaggacagggaccugugucucguucacugcugugcuccagugugugggacaagcccagccaccaagucagcucuccguucuguguugucugucuuccgugugagugaguaugugccugugugagugcacacagacgugcccauucgccuagcccuugacugggaggguguuggggucagagugggcccaggguaauuugggaaggcaucgccagagauucggagccccaugugugggaagguggggaggagggacagggagauuagaauuucccccaggccccuucccugcuaacuggugagcccugccucccccaggagcccgcugcgaggccaacaccuucgauggugagcgcugccucuauggggcacugagugaccccauccgccgggcucuacgcgauuacaagcaggucacggcuuccugcaggaggcgggauuacuaugacgacuucuugcagcggugagccagggcacacgaggggugcagcauggggugcgguggcccugguggguguggcgagucugcucugacuguggccugcacuggguucugagugcuccgaggaaugggguggggcugugccaaguauccucccuccuggcuugucccuccccaggcuucuagagcagggcauccacagugacguggucuuuguaguacacgggaagccauuccgggugcaucgcugcguccugggugcacguagugccuacuuugccaacaugcuggacaccaaauggaagggcaagagugucgugguucucaggcacccacugguaugucccuucaggguggcagaggggcaugaacuguccaggaacagcaggagguugugcuggguggcugccucugacauuacuuucugguuuucugcccacagaucaaccccguggccuuuggggcccugcugcaguaccuguacacaggugacccccuggguccaggguaggaggagagggagugggccguccuucuggacagcaguacaccuagguguggcugggcugaccuuucaccucuagacacuucaugguccccccggggugguuccagcugccucucggguuggguugcaagagagaggacuagugugccugcucaggaagagcuugucccacccacaugcugaggcccucccaucuguucccuggggccuguagaacagcuuuugauggggaaaccaugguggcaagugggcccaggaguccuaguccugcagccagguggccaggugggaggggaucacccuuuuucugugggccugaugacagcugaggucccgcaggcccucauccuccccacugcccccaggccgccuggacauuggcguagagcaugugagugacugugagcgccuggccaagcaaugccagcugugggaccugcucagcgaccuggaggccaagugcgagaaggugucugaguuuggugcgagcaggguuuggggcccggggccaugggugcggccuggcagggcuggccuggcucccugaaguuguucuuccccuguaguggcgucuaagccaggcacgugugugaaggugcugaccaucgagcccccaccugcagacccccgccuccgggaggacauggcgcugcuggccgauugugcccugccccccgagcuccgaguaagugcggggcuggugggcaggaagggcguuuugggauggcaggccgugacaggcagcccagauacuugggcucaauuccuugugugguccuggaccaguuacuucccuuuucugaaccuagucguucacuucugugaacaacugcucugauggggucaccucuucuguaccccagggugaucuuugggagcugcccuucccuuguccugacggcuucaacagcugcccugacaucugcuuccgaguggcuggcugcagcuuccucugccacaaggugccugugcccuccuguugccccuggccccagcccguugcccugagcccccgucuagcuccucaggagacagacccuggcccucacacuuccugagcccggccucccccaggccuuuuucuguggccgcagugacuacuuccgagcccugcuggaugaccacuuccgagagagcgaggagccagcgaccucagggggccccccagccgucacccugcauggcaucucacccgacgucuucacucacgugcucuacuacauguacagcgaccacacugaggugggggcucaggcagagcuggggauggcacacaaccugugcugccgugggcugagagggagcgccagggcccugggggucuguggaagggcccagcuggccccaugguugacguuuugagaaggcuggaggggaaggcugugggacuuuggauuuuucuuucagguagaggaagccuuguugggcuccagagagaggaugagugaugagccugugucacagacacuccacacuugucagccacuugggauccucagcuucucuagcaggaggguggaggguggguggggacagccuccucucuguggugcugcagaucccugggguucuggguucccagucuccucuucccuugcugccugccucugucuccagcugccccaagguguccguaagccaaggcugcagggcagcagcagagugcugaagguuugcucugccagggugugugagagagagagagagugugugugugcgugcgcgugcgcgcgcacuauaaagcaauccccauaucugguggcuuaaagaagaggggaguuuguuucuccuucacuucugacugaggugggugccccagggcaaguggcuugcggaagaucaggucaucccuccaucuugccccuguaugccuaagggugaaggucaaaaaccuuuucucugaaggugaguguuucagguucugugggccauauggcccuguuguagcuacucaacucuguagcgcaaagguagccagagacaguacagagaugagugggugaggcugcauuccaauaaaacuuuacuugcacaaacaggcuggauuugguccacaggccguagcuuacccauccugccuggggcaucgcguuuggccauggagauuggguccuaggcaaacucaugcucuaggaggaagaggaaggcagggcaagcaaugcuguuuuuguagaagccaccggaaauugcaccacuucucauguuccccuggagagaacuucgugccuaccugccaacaagggaggcuuggaaagucauucuguggccagggcccuguuuugugggggaaggggaggaagcaugcugggagacagagggcagucccuacugcugcucuaucuccaguggcagcucccuuguccaucccuccgcgcggccugacagccccucagccuccaucuuucccacccccucuacugggcaucuccugcagcucagcccagcucucuggccccuguagcagggguuaccuuugcccacccuggagaagcucccucuucaaggagccucgccacccaaagggcaccuugucucagaguguggcuugggcucuuaaccuggguugauacugguugagcugugugacacugggugagcuuugugaucuugggccaguuacuuaacugcucugugccucuagaacauggggauagcucucgucgucacuuccuaaggccuugugcagaugcauggguuacccagguaaaggagguggcauggcacauggcacauggcuuguaauguggucgcagagcuccccuugucucugucugcagcuugcucccugugccacccaggcucuggccugaaucugagggcuucagucuuauccagcacaggauguaucuguaggugggcucuguguccccacagccucuugagagggagggagcugguagauagucucccaccccuggcagagucccugcauaggucuugacuagcugccucugucccaccauucugacagcccccgcagguaggcaugguuaucuauaccucauggacugggaacuagaggcacagggaggugcagugacuugcccagggccccacagcuagaagugucagacccaggucuguauaacucggagcucagacccuggcuccugcgagggcccugccucccgccugcccugccagccugcucagggcaugggagaaccccccagucuucugcccccuagcgguccugcagaucccugugggaaucugggccagccccccgacccccaaccccauacaugcgcagggagcuccuacucccacuggaagccuucccgccagugccccccaaccaccacaggcccuagccuuggcuguugugcccugggagcccuuggugaccucggggggcaccuucaucccugucuucacugcagcugucccccgaggcagccuaugaugugcugagcgucgccgacauguaccugcugccaggccugaagaggcugugcggccgcagccuggcucagaugcuagacgaggacacugugguggguguguggcgcguggccaagcucuuccgccuggcgcggcuugaggaccagugcacugaguacauggccaaggucauugagaaggugggccaguggucugcagugggugggaaggaggggugagagggcaggcaccccuccacugagcuggcccuucccgcucauagcugguggagcgggaggacuucguggaggcggugaaggaggaggcagcggcuguggcagcccggcaggagacggacucuaucccgcugguggacgacauccgcuuccacguggccagcacggugcagaccuacagcgccauagaggaggcgcagcagcgucugcgggcacucgaggaccugcucguguccaucggucuggacuguugagccccuggcugggcagccccaggggccaggagcucucuuggagacaagcauguguaugcguuugugugcagcucuucuuccugcucccugcacauugagggcuucauggggggugcgaggggcucaguggggcuucucuucccuccaugagccuggagaccccaggggaggauccauuugggaugagcccccuccccccaaugcacaagccagcccccaagacccuggggguggacaccacucagggaaaccuggggugggggugggcuuuggucuuagcacuuuccuucuccagauccccccuacccaccccagucccaaauccaguccucuggcccuugccuagcccugaauugcuucucuaagcugguguucccaugcacagggccauucaggaagggcugggggaguguguguggcaauaaagcuugaaggcaccgugggagcauga

SEQ ID NO: 14780 - RNA, 24253 nt, Homo sapiens
acauccacaaacaaaacagcuuuuuuaacccgaccuaccuccuacagaacucugaacggagaagguggaaagggccuucagcggaaguccagguuacuuacuaaagcggaauggaagccaacagauaccagcguuuauauuuuauucaacuuuauuaaaaauuaaaacuacagaaaccaaaccgaaugcacaaauaagagaguggggaaacagacagggagcaauggcagcugauaacuguggcgaguggauaauccgcaugacucacaucccaccccugcgacugaggagcccagaacgcugcgcuggcacugucgugcccucuuccaccacaggggcacagaaaccugcaggagacugaaaacgauuacaaacaucuucaaccagcucucuggccaaaggcagcaaaagcagccugaauacgcaacucacgccaagagggcagcagcucuccugacauccauguaagaaggcuaacaccuaaaccacacgcaggcauccugaacucagcagcucugauccaagguacugaguggagacaaagcacucggagguggcaagauguucagcaaccaaguaagacacacuggcaaggcaucccacccaaaggugagaagcacaaagcaggcuuggagaaacaaacagucaugccaggugcagccagacauccugcuauaagcccugacccuaguaccccgaguucaucaagugcucugguuuuguguccauaaagcacagagggcacugaccaccccaaaccagaaucccaaggaauccuuauggauggcauagggccucagaacugcugcaggaucauuuuccuuuucaggucguggcugaacuuguucauccugaagagcucacugucauaaaaugcagagagguuguggauguugaucugacgagccugcaaggaggaaguguccagugagccaucaguggugugagaacaggcuguuuccagagcgccccaguuacagugcacuuucagacaccaucaccuccauuuaugggaggaaaauauccagggguggagaggccgauuaaggggcuucaaaucucugcuguacaagcugugcguguaaacugagacaaguuacuuggcugcccuguaucugucuccaccucugcacaacaggaaggcaguaacaggacucaccucacuccccugcugucagacuacaggcacagaacuggacucaacagacuguaagcauucaauaaauggcugucaaccaaggcccacccacuucaugacccauuaugauggagcccccaucaggagacuggcagcucccaagucagcauaccccaacccucaccucccuuccgggcccauaccuuauccaccaaguccuucucagggaccucaauaguguccugcugggccccaaagcgguugcgcugauaugucaccugcucugccacuaacugcuucaguaugaagagcaacagcucauuguugucacgccggaaugaaagguagcgggcaaaagucugcaggaaaaaagccucagucaaacacccgcucccacuacgccugccacacucccuuuacccuacgugccagcacccaggucagacaggcugccgcuccugggugcacguccaggccagagcccuggauacccacguguggccuccuucacugagcuugcccaucaggccccuaccucggagcacacccaccuugcgcaugcugcgcaugacgcugaacuucugugugucuaugaagcucuccagcaucacgcggauggccauguugacgucgucuucgaucacauagucccgcagauggaugcgcgcgugggccuccgccaugcggaucauggacucgaugugccgcaccguaauggggaugcugccugucgccuggagagaagcacagugucaggucuuucacgggcaggaaagagaagcaaggaaaauaaagcagcggcacucuuagcacccagagccaagaagacccaucugacagugccccagcagaaaugcagaaugcuugacugcgcugcccagugaaugcacacuuccuaucccuccuggaaaucagaggaugccaguggaugcugcaugcuuacggccugucaccaucacaccugcacaguucugcucccaccagcugacuucugugcaucucagaggcuguuguauuuguggccagcuguauugguuauugucacacacuaaauauugaauaauccuguacaauguaagugcaaaaaaaggucguuguuuguaggaaaacuaaauugaaugaucugaaaaaacuugguaaaguuaaaaggcagaaauuugaaaagcugcuguguugacuggguguggcugaggcagcaaucuacaaggacucggcauucccauggcuugcaagcugcuuuaaguuuccauuccacuaugaaugagccaaagaccuuguguucauuagagugaaauuuacacaaagucaauauggaacuuaauaagcacaucaacaauuaaggccuuggcccuacacugagacaaaugaaugcacauuuaaauuucaucuaaaacaaaaugguuaagguauauauuaauaccuaucauuuaaaaaaauauuuuuuuuuugaaacaggguuucacugugucaccaaggcuagagugcaguggugccaucauagcucacuguagccucgaacuccugggcucaaguagaucuuccuuccuuagcuuccugaguagcugggacuacaggcacaaaccaccaggcccagcuaaguuucaaaacauuuuuuguagagaaagggccucacuauguugcccagccuggucuugaacucaccucaagcaaucuuccugccuuggccucccaaagugcugggauuacaggcaugaaucacuguacccaacuuucauuuuuuguuuuuguuuuugagauggagucucacucugucacccaggcuggagugcaguggugcgaucucagcucacugcacccuccgccucccggguucaagcgauucuccugccucagccuccugagaagcugggauuacaggcaugugccaccacacccggcuaauuuuuggguuucaccauguuggucaggcuggucucaaacuccugacaucgugauccuccugccucggccucccaaaguacugggauuacaggcgugagccacugugccuggcaccuacauuuuuuuuuuaaugccucccugcucuggcaccuuuuggccugacugaccaccacccccgcugcauuggucagaaggcucacacugcacuuccuucucugcauagcaccucccggcucugccugggcucucaccauagauucuuuccucaggucacuguacaucuuggccaccuuguccugguccaucugguugagcuucggguggacccucuccuuggcguagaugauguacuucuucaggaccuccuggggcaggggcuccacgccauacguguugggcauggcgggcucagcagcgcugccauuggccagccccuccuccuccuuguugcugggguggugucugacguggcugcccaccacgaagcgggccagcaucucguccuaagauaagccaugagagggugggucugauugugggugugcguggcuuuggggaggucaguggcuggagaagggcugagugugcccuacaagggugacacucuuucaacaagacugacuacacugaccaugugccaggcaguucuggguguggguggcaaaccagacaaugggacagaguccccacagggcucaucuccacaaggggacaggagacaaauagucuuaaaaauuaauuauggaaaguaaugcucagaagaaaaauagagugauaggaucaagggaccaaggagaugccucuagcuaagggugcccggcaaagccccucccugaaagacagggagcugagaugacgacaaugagaugcaagucaugugacagugugggagagcgucugccaggagcaaggagcacaaucaagccccaaggcucggcccuuuugagagagaagggcaggugcaggugcaggugagggaagggagcgaggaggagguagcugcagagauggcgggugcgggccggaggggaggacccuggauucuauucugaugacagcagaaagccucaagcaguuguuaaggacggggcugaucugauuuaugccuucaacuggaagacagucuacaugggugccaggaggccaguucagaugaugguagugccucaagucagaggcagaagugagggagguggguaggcucaggaguugggacaacaggauuugguggauuguggguuauguagggugggggucgggggugcugugaaggaaagagaaaucagggcgacuucuggacaugagaagagaccgagggaacaggacuagaaaacagccuauggccccugcagcaccuguccccuguguugggcacacuguaugaccccaagccucaccugagguccccaaaccacaguucauggaaaccgggcacaugugagcuauaccuggacuggguccacggugucccucaccacacacaggaugucaaagcgugagaugaugggcucugugagguccacguucucagagaaagucagcgaggggucguagcgcccuccugaaacacaggggagcaccuccaucaggguggauuccccuauccucccaucucagggaccccaggcugcucugauggcagaaggggaugagggcaguggaagaggaagacauagguggguacuuagcaccugcugucugagacagcaaagagcuuacccuaaccagggcccaaaauagccuaauuuagacagaaagcauaacugcuuccccaggaggaaaaaccaagaacacagugggugacagagccuggguucuuuuacgcauucgcugcugagaccaacagccaacuccauccuggccagaggggcacugggcucuccucccaugccuucugagaacauccaaggugauuccaggaacaugacucaacaggaaacccaggugucccaggucccacuuucacuguuccccacucuggcaggauaugcagaagaggggaacccucugcugcacaaugacuuccucagaucggcuccuggggaccccgugggcucccaauucaagcaggcgggaccucccugugucccaccccagccccagcagucagggugccugcugcaccuaugggguuggcggcagcaaugaccgugcagcgagccugcagggaggugacgaugccagccuucgagauggagaugcucuguugcuccauggccucauggaugcugguucuguccuggucauucaucugcaagauuaaaauggcccacccuuagcaugguucacgccccuacuacuaagucuccgaugaggucccaauggaccccauuaacaccauucccgucgcuaaggcccaagcccacacacacccccugaguuccaccagccuccgugacccagggacccaccuugucaaauucaucaaugagacacacuccucggucagccagaaccagggccccagccuccaagguccacucccugcugacagggugccgcuggacauacgccgugaggcccacagccgacgcccccuggccaguggugaagauggcucggcuggacacuuucucaauauacuugagaaacugcgacuucgcugugccagggucuccgcacaagagcacguugauaucaccacguaccuugugcuugccaccuggaggggaugaguagaagcgggggagggggagagugggaagugagaggaggagggcacaguugcaucccccaccaauuccucaaccuacuuguuaggaaugguaaggcacagucccucuagaaagggauacaaugcccuacgccaugcagucccacucugggcacucccagggaaacacacacgggugcagaggaggguugcacgagauguccuuggcgaaugugaaauaucagaaacaaucuaaguguucuccaaagggagagcuaaauaaacugcguuaucugguggcaugauagucauuuaaaagaaggcaauugcucuguaugcacuaacaagaaaagaugcugcaguguggcacugagcgggagagcucggugggaugcacugcgcacaggcacagcacugggcacacacaggggacgcugcgcuuguacaaauaaacacguguagucaugaaacccugugguugcuguguaauuguaaauggccacaaagggagggacuaggaagagaagugggggucaauggggaaaucagccucacccaugacuuuuaguguucuauaaaaguguaauauaaauacaaacucaugugucaauaguauuuuuguacuuaaaacagguuuuuaaaagacaaaguauuuuuuacauagaagagaagcaaagacucauuugcuuaaaucacaaaagcaggcagacacuggcucccugaccaacagcccaacacccagaaugcccaacucagggccacccucucccuugaagaaugagucacgcccagccagaccaucuuuuaaugcauucuuucuccccagcacccaggcuuuaaaaacacuguguccuucuuugaaugcuggcuccccaaagagaaagcugcuaacaccccugcagaggaaaggugggugcucaccuggguuuuugggcuccccuccgaacagggccagagccaggccucucuugaugucuucaugaccauagauggaaggagcaaugcuggcaaagaucugagaaagggagggagaccgacaagaaugggaacagauacucacagaguaggucacccacaugcucuggcaucagggaaccacgacauccccagcucaaagacacccacuuccacagcugcugcaacugcaucaggcccugguaucaagccgugcccgacucuaaagcuuuucauuaguuggcucuucccaagagucacagaacuuuggaguuuagaagaaccuucaucugaaccccuaaucuugacauauuucagaaaggccuuucccaagaucacagaccaagagcagaaauaagaccagaaccaggucugucauggcacuggccuaccucaagccucaguuucuucauauggaaaagagagauggcaacauccaacucacagaaggguggguacaaaugcgacaguucaugcaagugccugccucgucaaugcaauaaauguggcacaucugggagauguguccaccaggaaguaauuccaacuagugagucacuggaacauuucuauuucagugugugugugagagaaagaaagagacagggagagagcaaaaucuucaugaauuuuagauagaauuagagacaucaaagacauuucuugcuuguaggagacugcuuccaacuccaccugcagcagagccauguuuugauagcuuucagccuucauaccccccugcacuggccacacccacauccuucccuccuuguaggacagacaaagaagcucagaaagcacuggcccucgccuggggagaggggacuaaggcaggaaaaccagcccugaagguggaggggagacacccccaucaggcugcauccuguauguccugccugcaccaucaaauucaugcagcuuuagaggugucucuaacuccuaucucccucugaaagcaaguaacacuucccacggggcuucuuggagaaauguccaauuccagguccggggcuggaaauguacaagagaagccugcaauaucuucuaccagaaagcaaaaaaucacucaaagacaaccagggucaugucaacagaacucaggagccaacaugaauagguucacgcuggcaaaaaagggacacuugagcauuguagggaugacaccugcagcguggaaaccucaacacccggcgggccuauuugucuguuaugauacccaggucaccugggaaccaauucauuauuuuuaaaacuaguaagucaaagaaaauaagcaggcauuuaccugacuaggcuucagugccugacugccaaauuacagaaaacacaggugacagaggugugugucuaauggggacauaauuagcaauaucucgacugcaaggcucaacagaacaaaugacccaguuucuuccacaaaaaauuacaaggaaaaaagagauggagaaaagaucuaaagauuaugagacuuaagagauaucaaccaaucacaacuuauggaucuuauuuggauaaugacuccaagaagcuguaaaaaacagggggaagggguaagauaaucagggaaaugugaacaacaacagaauauuggauauuaaggaauuguuaaucaccucuuaaagugagauaaugguauuguggcuagguuuauucaaagagagucuuuucuuuuucauauacauacugauguaguuacagaaaaaaacggcaugccuggaauuugccuugaaauauaccaagggugaaugggugguguauuaagaacacucgauuggcugugacuaugacagcuguggaagcuggguagagugcuacaguuugaauguaccccccagaaagcauguguuggcaucuuaaucccccauuuaacaguauuaaaaggugggaccuuuaaggggugaucaggccaugagggaucugcucucaugaauggaggauaaaagcacugcuauccagggaguagguccuuguaaaaggaugagucuggcccccucugggcucucacucugucucuuuaacucucaccuuuuugccaugggaugacauggcaagaaggcccucaccagaugccagcccucaauuuuggacuuccagccuccaaaaccauaagucaauaaauuucuguucauuauaaauuacccagucuaugguauucuguuguagcagcagaaaauggacuaagacaaauggucaaaguucacuacaccauucuacauaccuguuugaaauuuucuguaacaauguuuuaaaaugugggccaggccuuauguaacacagagugcccauggaacucacaauaaccaaauaaacucaccaacuguuggcacaauacagucacugggagcauggacucaagccaggcugcugacucugccacuugcuaugugacuauggccaacuuaucuaaccuuuugugccuuaguuuauucaucaguaaaacaggcagagaugaaaccucacaggaacauugcuaucuagaaauuaccuagacaaugccaagcagauacuaaguccucaguaaguauaaugacucucuuaugaaacucuuacuuugugcugcagaugcugggcagaccacuccacggaccucucaugccccaacacaccucgugcuggaugugccaagacugccaauccuugacuccucuuaacccagcucauuuccccguauaauuuuuguagcgagcaaccuugcaggaugagguaaugucucccuccagggccaagagcuuccugcuugcuaugcagggcagauugcccaacucaaucccccuccuguaaagcaaccacugcauccagggggacuucccugugggacuggagggcaagcagcgcaaaugugugaaugccuacacugccugcugugccuuccaccgcugacccaguuacuccaggagagaguagcaggcuaauuuaauggcuggaaaguggggcagaaucaaaucccagaccugccagggaauaacagcgcuuuccaugaauuaccucauguaauccucauaauaaccuuguuucucucgauccuacagaggaaaccaaggcucaggucaaaauauuuucuccuagaggagaggcaagacucgaccccagaugcaucugaauccaaagcucaugcuccuccuggcucuaggugugcugcuuccuagcacuccucagucuccgcacccagcaaacagggauagagugcccaccugaguggguacugugagcuccacccagcaaacggagaaaaagcacccaccugcauggguaccaugagccugagauaauguguguaaaaugccuaaagcaucaggcucaaagcuauuuuuguccuaccuacuggcugcuuaugcuuucuacacgccugucacaggcucuuccauccaguuuuuguacaaauaguuuaacuuugguagccauguacaguaacagccagauacugagcacucgccaacagccaaguacuuuauaugcacuaauuuauuugaucuuuauaacaacucuaugaguguuuacucucauccucucauuucuauagauaagggugacucaucugaccauccuaaggauuaggccaaaauucaaaccuaaaaagucuggcuucagacugcaugcugcuucuguuaguucuuuaaaaucucuaaguguugggcaugacccugaucucuuuaauacuuuaccagaucaguguccagggcccacggaaggcaggcagggccaugaaacugacagaguaggggacgggguaaaccuggggacacaggcccuaccugcaagggcagcuaugccucagcuccgucagcguuaccagagaggaacacagagccagcacccacagaucuuggauuuucaaaaagcauccggauuucuaugugaagucuccggaucccucaaggaugauaacuaacucaaaauaaaaacaaauacaaaaagucagcuguuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccugucgucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaaaagucagcugcagaagccugcagggcuuccugcuggagauggaaucugcagaagacagaagucagcuggggacaagugagggagaaggugcucuauguagacacaaauagcaggcaucaagacacgggagcgggguagggcugccuccauuuggggaacaagucguuuuggaaccuggggcuccagaagcacauggggauggcccgggcagaugccuuauuagugcccaggcaugccaugcccgccacacgcucaccuaugggucucucaccucuucaaucaacagagugggagauuaguggcugaagcucaaggcaaaggaagagaaggugccagaagagaguuccucaagcaugcagcuccuuuggcgugguaggcacagacacagauaaucaugugggacacagguggcccggcugcuuagggacuguaagaccccagcagggccaaguccacccaagccugaagaaauuagcucaaacaucuggaugaaauucugcaaagguguccacugugguagcacucaugagccucugcagguggugaggguagaaggcugggagguccuggcuuucuuugccugugugacugucuuccucgcauguaaaacuacaugaaaagaucuugucuauuuccuauuauugggaacccuaguaaaauaugagcucugagggcaagggucaugucugacuuacucaccauuguaucccuacaacuuggcccuaggaggucuuccaggaaccaauguguguuggcugaacugaagcuccuggcuuccugacgcugagaaacacccaccucuccuaugggaaccccagaucuucgcagacuagguucgauggccaagagcugggaaggaauggcaccaauaccagccucugccagggaugcauuucuggagcuuuccugaacaaugacaguaacauauaagcccacaaaugcuggaugcuuugccccuacuggguuugcgucuagccugcagcagcuucucacgguggaugcaaagacacgcaauacacuugagaaaaggaaccgagacacaaaacuacccugccuacuuggaauacacgccucaaggaguaaagaaaggaacagaacaaaccaugcauguguaggaauauuaaguggcaggcagacauggguaaaugugaugcgugaggaggaaaaggaaggggcaaccauagccgugccucagaggaaccaagaaagggggcuccacaggcuucaggggaagguggauggagagaaacaaccaaaacaaaucagcuaaccugcagccuggacacagcucuccuuaccccaccauccauuccuucaaaauuacucagggccuccugcagccaggcccuggagacagaggugauuaagccagugauggcuccugucccugggggguuuacauacgucagaaggaaaucacccaguucacugaagaagccaaaugggaacugaauuuuaucuugccagagggcagaagaguggagguuaaagggcgaacuaaacugcucugcauuaaaaacugaaguucaaguugacuugaaggccgggcguggugccucacaccuauaaucccagcacuuugggaggcugaggcaagcggaucaccugaggucaggaguucgagaccagccuggccaacauggugaaaucugucucuacuaaaaauacaaaaauuagucaggugcggugaugugugccuguaaucccagcuacucgggaggcugaggcacaagaaucgcuugaacccaggaggcagaggcuguagugagcugagaucaugccacugcacuccagccugggugacagagagacuccaucucaaaaaaaaaaaaaaaaaaaaaaaaaaaggaaguugacugagaaacagaggaaggaaggaagagaaaggggagagcagcgagcuugagaacacacggugcucugggggcaggauggagguaaugugggagaaacagcaaaggguuuuuaucaacagaaauuuaacguucuguuuaaguaauccguauuucugcaacauaaauccccaucuccucauccuucaguaaggaugucuauacuaaaaaccaacugcccaacugccugggcacaagggcucacaccuguaagcccagcacuuugggaagccaaugugagaggaucuugagccaggaguuugagaccagccuggacaacguagugagaccccaucuccaucacaaaaaaaaacaaaaaacaccaccauucuggguuguuuuucugaagaaauucccguuggccacagcuggaucccuaggaaucccucaugacacaaguuauccuauugcccugccucuguuccaauuucaaaccacagcuugaaaugaucugcuaaaggaagagcucuucucgucgcaaccccguccucagcaggggacuccucccaccacacagacucagagaggucauccaaguuaucccacuaccucgcuggcccaugguggagccacagccagguucacccauccccaaugcgaguuuaccucuucccuggagcacagggccucccuuccagacaagcuuacugagcuccaggggaauaaggcaagguuugagcagugagcccuaggugccuaccacagccccagcaacccuccauauccucucacagcauccugacagccccugccccugccuuccaccuaccuucucuccgaucugcugauccuuggagaggcuagugaucaucuucacaucuucaucggucaguuccccuacagcaaccuuguuguccuucuuggccacgugguuggcuaggaugacaguggcaaagacagggaagccauuggcaguguugagggagccaucauaguuguugugauagaugccagucagcuccuggggaaagggaggggccaagaagucagagccuaacccaggggugcccaccuccgugcugccuuccuccaguuucuccuauugcaagugcuccacacuacagacaccaagauaaguaacucaguaaaaccccuccuaaacccaccauuccaacaacccauccaccagaagaaaguucuuugccucagccaugcaaaaacagauccuagcccgagugccccugcgaccauagacaccgccaccggcccagccacaacugcuucugccaguucccucugcaacuuggcucccucccagccugccccggccacuuacuaucucgucuccuggcuugcagcuguccaccagaucugcgaggagaauggcguccuuggagcggggcagccggccagccgccacuuugccuggacucuccuggauucggauacgcugguaguucugauagauggucugcgagggacacacagaaggccucaaaucacugacuuacuaugucaccuaaccuugacccccgaacaggagggagaacaggcaggauuccgacuccugaguggcaaauggagagccaaagacagcaaggaaugaguucauggcgacucagcacaucaguugacaguccccacuccugccacaccaucccucugggaugccuucugacggccagacucagcaccugcucuaugcuuuacagcuaagcugucuugaguaccgaugcuggaaccaggcugccuggguucugugucuaagcugugugaucuugggcaagugacuuccucucucugugccuucucugcaaccucacaauaagaauuaaagcaagucauacauacaucaaccuaauccagcaucugauaaauguuaaguuacaggaaguuuuggcugucacugucaaguaucacaggccagcacugugccaugucauuucguacccauuaucucacaacauggcacugcaguuaaaagcacaugcucuagaucaagaugccugagcuguggaccucuaacacacauucugguugggugaccucagccaguucucuaaacacucggcaaaguggggccaguaacaguuccugccucaugagcugugaaaaaggaccagguaauaaaccacccaccaccuggcacugguaaguuacuccaugaaugauagcuguaacuguuaacccucuaccagguacuaucucaggucccuagaagcaaggccugagggagacagacagggcaugggaagagugagcaaagacguggcucagcuggcaucuggccugcagcugccccacccgagacgagacgggucagcuuuuggcuguagguggccacagguggaaccucugaggcauuuucuggcaagguggcuccagcugggacaguucgcagaacugcacugcagagcggugagaagaggacagccaacagccacagcagcaaggcagucaaggggccugggcgccaccacagcgauggcgaugagcccauuuacagggacgcucaaguacaaaggcacauuacaugugccuaagaccuuaacaucagaggcuuuggcagcgucuccugaauauggugcaggagguugguaugguccaggggccccacgugagccagacaggucccagaaacaagcugaggggaagucccgaugggacugcagccaccccacgugagugauggcaccauggagacugguaagcacacauccugaaggagugaccuggcaagaagugggcccuguuugccagaucuucucauguuucaagaggagccauaaacuuguaugguuuaaacaaaucgccugacuuaaauauugacuugaauuccuaaaaacgucgugugggccaagcuaaguccacuggccagacagacuggguccaccccaggguguggccaacacacaauucuaucuugcuucuugcggcugcccacacuggucuuccacagccugagaggccagucagguccugcauacugggcaccccuaaggacagcuggcagcagaccuuguguccucucucaccuccuccauguugaccucaaaggggccggccgacuggcacucaggacaggagccugguuucaccuccugguucugggacuggcagaaaggacccaggacgaaauugcacuuguugcaguuguacuugaccaugcugagcuggggcaggacgccagugcagcuggucaccaccccacuggugcggaucagcugguucagaugcagcugccugcggaggcagagggugcaucagaagccgugagccagggugaggccaggcugcagacgagagugucccaacacacuguccuggaaauugggcccagcccccagcccgggaagaucccucccaucacacuccugugcaaccacaacucaccugcgaugaggaugcugcuggcugcacccuccccgcccacaccacaaucgcucuucaggaaucacgaccgagucacccagcacugagcucggaccugccauccucaccugcccucagcucaccucagcgagcgcagcuccuccaccagaggcaggugggagaugcggacauggaugugguuggugaugcggucguacuugggguacauggccaguaccaccuccagggcagccucaucaaagaucugcagcagcuccgccggugccucaggcaggaaguaggccagcacgugcucccuggcugccaaguccucauaguucaccaccaggcucucacgguucucuagaagggggcacagugggaagagaguuaacuaagcaugaggccugggcugggcugcaacaaugccugugugagaagcaaggccuacccaccccgaccauugauuuugaccuagaaagcccagcuuucacuucuaggucuaccacacuucagcugugacauagccugagcuucaacuuccuacuccguaaaaugggcaugucacacaguguacaaaguugcugggggguuaaauuaaauaugagcagagugccuacacagcuacaaacaugaaacgccuuacaagagccaggaagaaacugacaaacacaggacaaaaagcaguggaaggaauugcaggaaucaagaucuacaugucccuuuuaaaagucaauuccuggcuggggacgguggcucacgccuguuaucucaacacucugggaggccaaggcgggcaaaucaccugaggucgggaguuugagaccagucugaccaacauggagaaaccccuucucuacuaaaaaaaaaaaauuagucaggcaugguggugcaugccuguaauuccagcuacucgggaggcugaggcaugagaaacgcuugaacccaggaggcggagguugcagugagccgagaccgugccauugcacuccagccugggaaacaagaacaaaacuccgucucaaaaaaaaaaaaaaaaaaaaaaagagucaauuccuauuacaaagaucaaaguaguaauccagauuuuuauauaaaaucuguccauuuucaagcuugucaaaaaacgcuuugguggcccagauguggucacugcauagccagcaggagagcccugaugcaaaacucaaaacuuuugguuucucugacagaccucucagccauaugcccugugcuucacguguucacucggcucagacaacuuucuggggaggauuuagggaggcgcuacaggggcugaggcgggggcguagggaagccacaccuuugcacaugucgcugaugcgcuccuugaagacguuguggccguggcugucgacgugagugcgcaggaaguucuugaagcggugguggaucuccagccgggggcccgccaugcucacccacucgcgcacagaguggccuuugagauccuccagguucucgaugcucucgaucaucuccucguccuccucgccguccuccguggcccgcuccaccuggcggcgcuugcgggcagggcgcuccucguccuccucaucgcugucuggggaggcaagagacaccugcuacugcggucauccccagcaccuucuacuccccucccagacuccuucccagcuucccagucccucgggcaggcagacaacuggaccuaccauacaggagcccacggcgcaugcggcccaggccccggccagccucccggucacgcugccgcauggcccgcucugcugccucccucugacuggccgucagcuccucuacguccucaucauccagagccagucccucggccucauaggcguccagcucugggauggcgcgguagucccugagggagcaccaaaacagaugugguuacugccaaaaaggaaaacccuaagcaccaaaccccauccaggaacugggccuguucccuaagguucaggagccccauuguggguaggcucagcgcuuccaggucagaaacacagaaggcucagaaaagaucuccaauggaugaacaaaacacgaucuguccauaugauggacgaugaagccuuaaaauagaaggaaauucugccacgugcuggcacauggaugaaccuugaggacaugauucugagugaaagaagccaggcacaaaaggacaaauccuauaugguuccacucacugagcggucaaauucacagaaacagaaaguaaaaugaugguugcuaggugcugggaagaauggggaguuaguguuuaaccgagacaguuucaguuuucaaacugaaaagacuuuuguggauggauggcggugauggccgcacaacaauaugaauguacuuaaugccacugaaccauacacauaagaaugguuaagauggcugggcauggugguucaugccuauaauuccagcacuuugggaggugaaggcaggaggaucacuugagcccaggaguucaagaacagccuuaacauagugagaccccaucuguauaaaaauagaaaauggccgggcacgguggcucaugccuguaaucccagcacuuugggaggccaaggcggaugaaucacgaagucaagagauugagaccauccuggcgaacaugguaaaacuccaucucuacuaaaaauacaaaaauuagcugggcguagugucaugugccucuagucccagcuacucgagaggcugaggcaggagaaucgcuugaacccgggaggcagagguugcagugagcagagauugugccacugcacuccagccuggucgcaacagagugagacuccgucucaaaaaaaacaaaaagaaaaaaaaaauaacccaggccugguggcacaugccuauaguccuagcuacucaggaggcugagcugggaggauugcuugagcgcaggaguucaaggcugcagugagccacguucgugccacugcauuccagccugggugacagaguaagacccugucucaaaaaacuagcaaacaaaacaaaacaaacaaacaaacaaaagggcugggugcgguggcucaugccuguaauccuagcacuuugaaccagggaggcagagguugcagugagccgagauagcaccacugcacuccagccugggcaacaagagugaaacuccgucucaaacaaacaaacaaacaaaaaagguuaagaugguaaauuuugggccagggcaguagcucaugcuuguaaucccagcacuuugggaggcugaggcgggcggaucacgaggucaggagaucgagaccauccuggcuaacacggugaaaccccgucucuacuaaaaauacaaaaauuacuugggcgcgguggugggcgccuguagucccagcuacuugggaagcugaggcaggagaaucacuuucggagguugcagugagccgagaucacaccacugcacuccagccuggcaacagagugagacucugucucaaaaaaaaaacaaaagaaaagguaaauuuuguuauguguauuuuaccacaauuacaaaaggggagguagaucuccagacagcuucuaugcgcccaauaagaaaaaauaauucaaggaaccacaaaacauuagaccaaaaggcuucagagagcugacccaacuccccgugagggcuggaauucucccuguacuuuccccaucucugacuaugccgccuucaacaaccugauguccuggcuuccaugcacagucagccaaaccagcccucugaaauggccacccacugucucaacccuuugagcuacucuaagaccaucagacacacauuuuccacauuaucuuccuucagauacugaagagaaguaaugccuuaauaaggcacccagcgagugcaaagcacugugcucucuucccugcagugcucucuucccugaggaggagacacugucauuccaucugaaagaugaggaaauggguaguugaggggaaaaugugauuuuugccuauggucgcucuguagaccugagugucaaaauauaguccaagcccagagcuccuucccccaugccauacugccuccccaagacaauccccuugaauucuccuuuuuucagguuaaauggugacaagagaaacugcuacuauuuuucugcaauaaacauugucaaacuacugucagaacaaaucuuuuuaugcuguugaugccccaagcagaacccagccaggcagauaucagaguugaccaggucugauuucuuccauguuuucggggaaaagguaucggucccauucucccuggaucucaagucacacaaaaugcccucagcaaacuucuaauugguucauacaaaaaaaaaaaaaaaaaaaaguuaaacuggacuucaucaaauuucaaaacuuuugcacuucaaaagaaaacauuaaaaccacgaaaaagauaagccagauugaggagaaaauaacugcaaauuacauaucugauagaggacuuauauucagaauauguaaaaaaccucuuacaacucaauaguaaaaagacaagcaacccaauuaaaaagugaguccaggauuucucugaagauacacagauagccaaucaagcauacgaaaagauguucaacaucauuagccaucaggaaugagaugccacuucacaccugcagggauggccagaaucaaaaagaccaauguuggcaagaacacggaggaguggaacccucauguguugcuggugggaaugcaagauagugcagcugcuuuugaaaacagucuggcaguuccucaaaagauuaaacacaagaccaacaaucucacuccuacauagccaacagaauuaaagaucuggucacauaaaaaccuguaacgggccgggugugguggcucacaccuguaaucccagcacuuugggaggcugaagcacguggaucaccugaggucagggguucaagaccagccuggccaacaugguaaaaccgaaaccgcaucucuacuaaaaauagaaaaauuagccggugugguggcaaaugucugugaucccagcuacuugggaggcugaggcaggagaauugcuugaaccugggaggcggagguugcagugagcugagauugugccacuacacugcagccuaagcgacagagcaaaacucaaaaacaaacaaacaaacaaacaaaaaaacacgaccuguaaugaauguucauagcaacauuauucauaaucgccaaaaggcuugaggaagccaacauccaucaacugaugaauagaugugguaucuccauacaaagaaauaugauucagccacaaaaaggaauggagugcugcacaugcaagaacacagaaagaccuuaaaaccacacuaagagaaaaaagcccaccacaaaagugcauauauaauaugauucaauuuauaugaaaugaccagauuggaaaaucuagagacaggucuuuaauucuuaccuguggguuggguaagaacugagaaugaacuauaagcaggcaggagggaccucaaugggaaaacggcccuguucucacacuggauuguggugaaggcugcauaacucaggaaauuuaccaugaauuugcauugaauuauauuuucgcaagggguaaacucuaaaaaacuauagcccaauaaaguuuuuuuuuuuuuuuuugaaaaaccacaaaaacaaauguaauugggcucagccaucccucagauaccucuacccagaagcccccugccaagggccucucucuuugcuucucagagaagcaaagagaaagggucaagacagggaggggaaacagcagaggaggggcauccggccugaacaacuccaucaggcagaacaggaaagccgucuaggacccaugcccugaccccaaguccagggcagauuuauccagacuccucauuccuucuacagccuacagcacaugcagucucaucguugggggugguacugauaauagcaaagaugcauccagucuggagugcccuugaaagccucucaacugucugacauccuagggacggcaggaugcccugcacaguacucucacacaugcuaaggcugaaaaggcacaaaaggagcaucuccacgaggcuccugggcauucacacaauuccgcuacugacguuaucuaccagaucgcagcuggaaaugcagaguaaggcagggguagaaaucuagccuugcuuaugcgcagagcuuacuccacucuccuagcauuaagucuugcuaacuuauuuauuuauuuauuuuugaaacagaguuucacucuuuucgcccaggcuggagugcaguggugugaucucagcucacugcaaccuaugccuccuggguugaagugauucuccugccuuagccucccaaguagcugggacuacaagcacgcaccaccaugcacagcuaauuuuuuguauuuuuagcagagacgggguuucacccuguugaccaggcugguuucaaacuccugaccucaggugauccgcccaccucggccucccaaagugcugggauuacaggugugagccaccacauguuuacuaauaaacaagaccauuccuaacaaagggcauggugcacauuagguacaauaaauguuugcugauugacucuaaaacuuuauuuaucagaucccuccucccccaugcaccuuuccuuugaaaaguuacugggaaacacugggcuuccugcuuccugucuuuuugaguuggaguauuccagauuagagaccccuacauucucuggggugcuuauggagucggggcuuauccucagcuuagggucuagucuuuccaaguuacaugcaguaaguuaaagagaccugugucauggcucuguaaaccugucuccucagaacccuggaucaagcugugcucaaaggcaagaaugccaucgauucaucugcucccagcucccaaagccaggccaccaggcacacaaugggcucucugcaaaacuaucugcugaguccagggccuugaaugaaauuaccuuuccaugccaucuccaaugagcuccucuccauccucuucuuccuccaggggccccucugugccuaggagccccucggacucauccucaaaugguggaaggucacggccagggcuggaggugagggcaucaguacgccgggagcuucggccagggcuggaggugagaggaucauugccucgccgacgcugggccgggcuggaugccauggugaaggauuccgaugauuccugcaagagaaggugcgguugucagaaaccuaggaagcuggugaggcaugauacagcuuccuuuuuaccaucaggggccuucccuucuuucucuccaccugugacucuuguccuccaacacaccaaaccccuuccagccuccagaucuuugcccuugcuguucucucaccuggaaugcucucagcugagcaaucugagucaguggcuuccaaacaaauagaagccagcucaaauaucggggucacccacaucaccgugcuuucuccaugaaaaaccacugagguuaugucauuugccuauuuaccuguuuacugucuauuaucuccccuuaagcauuagaccuauuucagcacacacagugcgcaagguauugugauagagauggcauagaagagccaccaaaacaagaggucuggaacucagauguggaacagacaguauacaagacaaagggacaagaagguaauacaaaaguaaguguaguguuuggaacaaggaucauugggaaauuaaaaaaaaaaaaaguuuaaaggaguguagugaaaugggggccugucuuuuguacgcucagcgccacacagauggcgcccaauaaguauguguggggugaauaaaggacagaggcugaacgggccgagcucgccuuagggagcccagggccccaggucagugguagguaggcgagucgccucacgcagggugcaggcgagaaaguagcugcgccccagagccuggggcccagccucacccagagcgccgcccugggccggggccagaguacgggaagcgcgcagccuccgcacccauguccccggcgcccgcccgccacgcgccagcgcgcucaccgccauagcaguaccacgauccucuccgccacuacagcaacaaccagguuucgcgcgaaaagugguucacgugacccaccaaagcccgggaagagcccuacggaacgcgacgucaugacgucggcguccacuggcgaccagaagggacacggaggg

SEQ ID NO: 14781 - RNA, 17887 nt, Homo sapiens
cuggagguuagagggcgggccugagugauaacagggacucugggacucugggacuugugggacuguggccguuuucgcaauuugggcuggacgaaaaagacggucuugcuuucccggucgccgcugucgggaagggcugcaggguguccgcgagacccgcggcccggcgagcugaccccgccucgccuuuccugccuagcccucauuccacggagccggucgcgcccgguccuugcgcgacgcuucccggcccaggccgccuggucuggcgcuggaggccggagucccgcggccugugcuggauccgcgcacacccaguggcggcggaugggcggccggggcggccggggcggccgguccugagcgcggcccgggcugucagguaaggaggggccuucuccccgucuccugccgcagcuagagggggagccccgucccucgccccggcgggaagcccagccgccguuccccuccuugcuccgcgagcggcccauuuccgcucgggcgcagcucggacggccaaggcggcguuugggagggaaggcccuggaugugggaacccacgggaggggugccgggcagucgggagucgcucggggcgcgggggcacgcgaggcccgggagggagccgcacguagcggcgucgggcucggccccggcuggaggcagugcggguggagauccggaccucggcgacccgguccggcgcgggguggcggcacgggcuccagccccacgguggcugcccgcagcggccgaggugcuccugagccaagccugccgccgguucggggcuuugcugccccgugagggggccaugucgaagccuccgcucccucuggacucggggaaugcaggugggggcuggcuuugcccucuucucugcagugaggaggggccgcagggucguccaguccccagcggggcuuggcggugcuggagauucaguuguucccgucauaacaaccuguugagggcucgugucgugccaggccuuguucuaggggaccgaguccugagcacucccgggauagagaguaguaaauacccagacgcggcucgggcgcuggagacagcugagaagggaaggcuucucagaggaggugucaggagagagcugggggagagccagcccaaaggcccugaggaacggaccagcucagcagguggaaggcaagcagggagggcaaggugcaggucagauugggcccaggccuccccaucuuacuggggucuccggcuuaggacagggaccacacgccugccagccccaaggccgaaggacaacaggggagagcaaaguaacuuacuuggccucugcccuauggagccuuccccaccuugucaccccugggcuccaccccuucucaccacccuuaggcccuaggguuuguaagcucaacaacccgucggugugggaagcacugagggccccucuccccaggguuuccuauccgguagcugugggugggguuuggucaauccuguugcacagaugagagagcagggaaagcugagucccagagaggagagagaaggccuuacccagucguucucagcggguccugcauugcgugaccaugaccugagccuagccagcauccugucccucaacugggugggagggagggaggcagaggccccuggaauguugugagucugggagacuccucccagguggaagaaacagucugucccaguuucccuguuccugggaggccugggguugcccagggugcucugcaccgcaggaauuccuccucugagaaucaccccugggcuccaccccuucucaccaccccuucucaccacccuuaggccccuaucgugagcugaccaaccccucccacuucuuugucagugcuugggagcaucagucuaagagaacuaaguagagaaggcugaggacugaccccuucucugccucuccucuccucuguauaaggggacaguaauuguccucucucccuuagaaggcgaugccauuguuaagugugucaccacguguaaagcacugagcaccaugucugcacauaggaagugugcauccuauuaacuaaaagucagugcgggccaggcgcaguggcucaugccuguaaucguagcacuuugggaggcugaaguggguggaucaucugaggucaggaguuugagaccagcuuggccaacauggugaaaccccauuucuacuaaaaauacaaaaauuagccgggugugguggugcacaccuguaaucccagcuacucaggaggcugaggcgggagaaucgcuugaauccaggaggcggagguugcagugacccaagaucgcaccauugcacuccagccuaggugacaaagcgagacucugucucaaaaaaaaaaaaaaaaaaaagucagugcuucaguuauuuccuaagcuuugauacguaauggcaauccugguauggccagcagccccauaaccccagugugguugcuggaucaaguagcagcagcaggggcaccaccugggagccugugggaaacacagacuguucagcccuaccccugcccuugggagcagcaucugcauguuaacaacaccaggguauuucccacaucaggucugagaagauagcucuagaacaagccuggugcucuugacccacagguggagaagccgaggccuggagaggggcaccuggcaaguuguugacugggggccugggcucuggagacagacagccuggauugcuggccuggcaaguggcugccccucugagcuccacgugcacaaugcggauaacauaaguaccucccucccaggguuggaggccagggcucagagguuaggcacagagguuacuacguuguuggcaggggagugggggcaggcagagcagcugacaccuccucuguguuuccucagaccccacagcaaugggggcuucacaagagguccauggaccugggaaccaauuccuuucccuccuugcccuucagucucuucucugguaaucccagcaacuugggaggcugaggugggagaauugcuugaacccgggagguggagguugcagugagccgacaucgcgccacugcacuccagccuggacgacagagcaagacucugucucaaaaaaaaaaaaaaaaaaagaaaagcagcaaccaccuuuguacaugugucacuuuuguagauguuuacaucccugguuuuguuugauccuuacggcacccuuauuaggcagauguuguccccaugauacuuggagggggagugacucaccccaggucacacagcaagcacguggcagaaccagcagugcagccccgucuuguugacuccaaaaucuguguuagcuggagguuuuucacuggugaauuagagaagucagacucaaacuggccuaggcagaaaaggggauuuguuggguuuuauaacugaaaaguccaagcggguaggacuggcuuuggauguggcugaauccaggggcuccagugagcucaucaagaucugucuccauccgugucucagcucuccacuccuccgcgucggcuuuacucugaggcggguaccugagcgugaggucaaggugguacagcccugacuuacugagcucagcagagaguguuuccucaauugucaaugagaaucugcccugagacuuuugcucuaauaauuuauucuaauaauaauuuagaucaaaagccucagggcagauuuucauuggccagggugauggaacauccugacuagccagacuuagaucacaggugcauucccuggguugugaaggguuagucacgcaucccuaaacuuccagagagucuagagucugggagcugaguuuccaccucaggaaaacggugcucuuaccaacuggcagcagccuggaugcugggcaggcaaaaccagaagcccaccccgcccuccauacccuggacucugccugacucccccacucuccuacucccugccccuguuccuccccacuggccucugugccucaaggggccucucagcuugcuggugacugcugggugccuggccugcacccuggcccugcccgucuuggggcugcgugacauuccauucugggucagaguuggugcugggcugcuaggaccaggcguucacucugccuggcuuggcuuuauaauagggguggggauagcuggucaugguggcccacaccuguaaucucagcacuuugggaggcucaggcagguggaucacuugagguccagaguucuagaccagccuggccaacauggcaaaacccugucucuacuaaaaauacaaaaauuagccaggugugguggugcacacuugugauccuagcuacuugggaggcugagaugggaagacuccuugaacccagaaggcugaacuugggaagcagagguugcagugagcugagauugcaccacugcacucuagccugggugacagagugagacuuugucugaaaaauauaugaauaaauaaauaaugggguggggaggagagggcuguagaaucucccuccuucaucaggucacugauacucucaacucaaaguuacaaguuauuaucucaugccaccagaagucaugcaggaggcgcgcugcacacccgcuuccagcuguaagcuccugcaugcucagcgugguggcccaguccuccaggggugcaggaagacaguucuggacaccccacacaggcacagauccccccaugaggcaucacaugccuuugccucaaccaacugcuggccaggagcagaagggccacccuucuugacuucgaccagagccacucugcagggcaugcuagcuguaggggaagacaguuaguuacucauuuggcagacuguccuaugcauugcagacauuuggcagcccuggacccugcacacaaaaaaauccacaguccuccauucccuagcaguugccaugucaaacuagagcagugcuccacaccggcuccaccccagagaccauuggcugaaauuaauggagacucaacuucugguccuggggaggggccccugcuugaacacuagguuuuauggagggauccugaacaaaauaguagcuuguuagugaggaagaaggggacagugucugguggucaguguuggccucaguugcaaaacauccagugacucaggccagaaacugcaccaucagccgucuuuggccucuucucucauucccuguguuugaucugucagugggucuuguuggccaagccucccaaaggucucccaagucccucuguuccaccugcacugcugccacuagugcaagccucuguccucucaugcauggacuguugcaggagcuccucauggccucccugucucuguuccuccuccacuucagucccuuuucacuggcauccuguccccauggaaaccagaccucucacuccuuguaacacccuucugguugcacuuagagugaagucgaguugcaugugggaccuggcccugccaaccuuucugguaucagcuacccuggccuguuuuuugcccuugggacaggccaaaccuguuucuaccucuggacuugugcaucuggaucuuaggugauucucccuggaauguucuuuaucucgaucuuuccaaggcuggcuccugcuuauuuauugagaucucggcucaaaaugucaccuuguuugacuacccaguccaagcaguaccuuuauauucauugggauuugggcuagcuguugaaacaaaggcuaggauaauaaaauagauuauuuuuaucuaugcaggcagccucugugcaagcuguccaguacaugcacggaggccucauugugcuggggacccagacaccuucuuucucauugcucuguuacccucguacaggguuucugccucguggucugaggaggcugcucuugcucccacugucguaucuauauuccagccaccgggaagggaggagggcaugaucugaaauuagcagaccucacucugcucgugucauauguuuauaacaaaaaaaaaguucuuuuuaaagacaagucaggguuuuuaucuuuguugggccucuguuuuagaguuuaugucuucacaccaugggauuagaucaaaugacaggcugaaggacugucagccugucucagcucguguccaguuggauaaaacucagccacauggccacacccaguugcagggaagcugggaaagguccccauugugcugggaagcgauguguaagcuaaacuccauugguuccaucacuaaagggaaggguagauguugggggaacccagcagucucuacuguguuucuugucauucugcuccaccucucuguuuucuucacuuagcauuuaucucuagaaguuugcuucuuuuuuuuuuuuuuuuuuuuuuuuuuuuuuuuuagacagggucucacucuguggcccagccuggagugcaguggugugaucauagcuugcugcugccugcugccuggagcuccugggcucaagugauccuuccaccucggccccaccgaguagcuaagacuacagguaugcaccaccauaccuggcuaguuuuuuaaacuuuuuguagaaauagcgucuugcuguguugcucaggcuggucucaaacuccugggcucaagugauccucccaccucggccucccaaaguguugggauuacagguguaagccacugugcccugucaaguuugcuuuuuuuuuuuuuuccaaguuugcuuuuuaaauaggguuuucaugcuuguuguuggcuucaccuugcugugagggcagggccuugucugcucuguuccgugccacguccaaccaccuagacuugugccuggcacccaguaggugcuaguuaaggucugcugagcaaauaaaagcacgugugggcugggcaugguggcucacaccuguaaucccagcacuuugggaggccgaggugggcggaucacgaggucaggagaucgagaccauccuggccaacgugaugaaaccccgucucuacuaaaauacaaaaaauuagccggguaugguggcacgugccuguagccccagcuacucgggaggcugaggcaggggaaucgcuugaaccugggaggcagagguugaaaugagccgagaucacgccacugcacucuagccuggagacagagcaagacaaugucucaaaaaaaaaaaaagcaugugugaaugaagggugggcuucuuugccccccucccaacaguagggaaggagccaucuucuuucuuaggaucuacuaugugucaggcauuuguucucuuuaauauuccccaucacuugaagauugcagcuauggccucauuuuauuauuuuuaauuaauuaauuuauucuuuuuugaggcaaggucccacucugucacccaggcuggagugcaguggcacgaucauagcucacugcagccucgaacuccugggcucaagccauacucccaccucagccuuccuauuagcugggacuacagguaugcaccacuauaccuggcuaaguuuuguguuuguuuguuucuuuuuuuuuuuuucugagauggaguuucacucuuguugcccaggcuggagagcaauggugugaucucagcucaccgcaaccucugccuccuggguucaagugauucuccugccucagccuccugaguagcugggauuacaggcaugcaccaccaugccuggcuaauuuuuuuuuuuuuuuuuugagacggagucuugcuguguugcccaagcuggagagcaauggugugaucucagcuaaacguaaccuaugccucccggguucaagggauucuccugccucagccucccagguagcugggauuacaggcaugugccaccaugcccggcuaauuuuuuuguauuuuuaguagagacaggguuuuuccauguuggucaggguggucucgaacuccugaccucaggugauccacccgccuuggccucccaaagugcugggauuacaggcgugagccaccgugccuggcccuaauuuuguauuuuuuuuuuuuaguagaggcgggguuucuccauguuggucagucuggccucaaacucccaaccucaggugauccaccuaccucagccucccaaagugcugggauuacaggugugagccaccgugcccagccuuuuuuuuuuuuuuuuugagacagagucuugcccuguugcccaggcuggagugcaguggcacgaucucagcucacugcaaccuccaccucccggguucaagccauucuccugccucagccuuccaaguagcuggcauuacagcuggacgccaccaugccuggcuaauuuuuguauuuuuuaguagagaugggguuuuggcauguuggccaggcuugucuugaacuccugaccgcaagugauucgccugccuuggccucccaaagugcugggauuacuggcaugagccuccgcacccggccaauuuuuguauuuuuuguagagaugaggucuugcuauguugcccaggcuggucuggaacuccugagcucaagcaguccucccuccucagccucccaaaguguugggauugcaagugugagucacuacacccugcuguccuuacuguuuagauggggacuugaucccagagccagugaguggcccacuggagcaaccugagccccagcccauggcccgcccccuucagagucuucccucccuuucauccagagguguucugguguuuaagggcuuggaccagcaauggaaauauuccuaaguccccccaccccugucuugggcugcuauuguucagggauagcuuuggugacaacacaagcagggcuccuguugcguuucugcagaccuugcugacaggcaugcagcucacugggcggcuccuugcugaaggggaggccugggccuuugauguguugucgggacaaaucuuuuuucuuuuucuuuuuuuuuuuuuuuugagauggagucucgcucugucgcccaggcuggagcacaguggcaccaucucggcucacugcaagcuccgccaccuggguucaugcaauucuucugccucagccuccugaguagcugggacuauaggcacaugccaccaugcccaacuaauuuuuuuuuuuuuuuguauuuuaguagagaugggguuucaccauguugucuaggcuggucccgaacuccugagcucaggcaaucugcccgccucggccucccaaagugcuaggauuacaggcaugagccaccgcgcccggccacaucuuuuuuacuuuuuaaaauuuacugaaguacaccuaugacuuaggagucaucgguguguggcuugaugaauuaccacacagugaacacaccuguguacccaccaccuggaucugacacccagacgcuggcaggccucccccaauuaccaugcgcuucaucuccccaaaggcgcccugucugcauuucuccacggaucauacgccugucggcccuugugccuggcuucacgcuauaucacuucugagagucauucguguugccuguagcaguggguuguucuuuuuaugcugugcaagugucaaccguaggaaccugccaccauuuaugcccaugcucuggggcugcuccccgccuggggcugucauccacagccuuuacaagcauuccuggugaagcagagucacaggcaucuggcccaaucuguucaaaucauucuaaauguuggcaucuguuacguucuggugccccaggccacaccuggaucaccccgaacucccugcggaaguaccuguugcugccuccugagaguccucuagcuuaggagucuugguuuuccgaccagacccucaguccccuaaccccagagugguucccaggaccccagaccaccagcucuccugucuuccaggcuagacucgaccucucaugcucagagugucauguggaccucuggccuauggacccacccugucccuggcuucacccugcagcguggccauugcagacacacuugccuugccccucugugguacagccucuucccccaugcccaucuccaguuggagaccuccugugcaucuucuaggcauggcucaguguccccuccaucuuugucugugguggcagagggagacaagggccagagggugcaaccgaggagggcauggugcucagcucuggcccucagcagcgcuguggccucacacaagucaguggccucugaguucugcaugguguggcaggucagaaccauggcugaccgcuaccaagaacuccucacgugugugccuuguuugaggcacucggcaucaccacagccucacuuguuacacccauuccaugguggggggacacaggcacggagaggacaggaaggaaggggcagggcugggcugugaacccagagccuaugcucuuacccacgcugcucucaugggcccucaggacugaaaggagccaaguggcugugccuugcacauggagaugcuuagcugaggggguggcuuuguuagacuauuugcaggucgugagauagagccugagaugggggacugggccccugccugggggauugggucgugaccuguguggagccccacacugagcugcaguggguggggagggugguuuacaggggugcucugugcagccccucugauuuuccccugggagucccagguccaggggaaggaggacaguggcccaggccacacagcucacugggcggcucucacucccccagggcuggcugcuggcgggauggacacccuggaggaggugacuugggccaaugggagcacagcgcuacccccaccccuggcaccaaacaucagugugccucaucgcugccugcugcugcucuacgaagacauuggcaccuccaggugaggcagucacaacgcugggcaggcucgcugagugucaguggcuuuuccugguguagggggguggugaggguggggcagauugugucuuggagagggggugcauauguggccucgccagugagccagcuccugugcccauccgccaggguccgguacugggaccucuugcugcucauccccaaugugcucuuccucaucuuccugcucuggaagcuuccaucugcucgggcgaagauccgcaucaccuccagccccauuuuuaucaccuucuacauccuggugaguucacugcaguugacagaaaagccaacuccaacuggguuaaacaaaaagggaauuaacugcuucuauaaugaaaauaagcuucagguauggcuggauccaggcaguuaaaugauaucguuaggaucuguuucugcaucucugaucucuuugggacuuaucucagaugaguuccccucauauggugucaaagauggccaggagcaacuuugagcuaacauccugccucuacaacucaggcaaacagugccuguuugcugauagugccaguguagaccugggauuuccucugacuggcccaccuaggaucccauccucaucccugagccaagcacuguggcuagcaaggaaaggggcacugugaagcugggagggcagcaucagcucagcuggaccauauggacugagggagcccacaacagaauuggggagcugguacuagaggggaggggaauggaugcuggguggggaaaaugcccacugcauccuccauccauucgucccccaucuguccauucugugaaaccucuuuggagaagacaucuuacuugcugggagagccugcauugucaccacuuggugguccuggcacguguugccuggggagaggugucagggcugugguugagaaggcagcuccaaaugugggcucuccugguauaggcuccaggugugggcugucccaguauaggugccaggugugggcuucaggugugggcuguccaggugugggcuucgggugugggcucuccagguguaggcuuccggugcgggcuguccuggugugggcuucgggugugggcuguccagcugccuuccuucagggcgcccuuccccugucugcagggccugccugacuggaguccucccuucucuguggcccuuagauaccaccacaugagagcugaguggcucccugguccccuccuuguggucuagcccagaacuucccagucagaggagugggcugugggcaggcagagagacagacaaggggcuggggaagccuggagguuguaguggccugaugucccucacaccuacaagauggugguagacaggacugggaacugaggccugcuuucuuugcuucucucccacugcuucucucaccauuuauucauuuguguauuuauucaacagauauuaaacaccuacuguaugcuaggcagauguccuuuugugggguaagggggagugcaggcagggagaaagagccagggcuaaauguccaggaacauauaacagggcccagcccaucaacuuuuggggacuuuguccuaaagaguucaggaggcaguguuaagaguggacucaggaaguccagcucugaaccccagccaugcugcugugugaccuggggccaguggcuuggucucucugugccccagugcccuucugcauaacagauguugaucugcuuuagcuaugguguucaugugagcaccuaugaagucgucugcauagcugcagcccagugggagccuggcauacaguaggcgugugguaguuuguugcuuuuacugccugcccugcugacacaauuucucauggcacaaaagacagaguauauauggaucugggcaugugucagaagacccaacugagacucacagaagccaguuuuugacugagaaacugggcaguuccugggccucaggcacagcaggauuugggggcacagcagugcugcuggggcaccaucuccaucucccacucagccugggaucuccccgauggcccugcucucucgccaucugcccuuguggcagcagggugguguccauggugccaggcuugcaugcuguccgucugccuuucccagcagccccaccugacauccugggucucucucacaaggcucccuuggggccuaugcccuucccugaacuagcccugaggccaggggaauggcacacaccacuggccagugcugcgucccaggcccaucccugaagccaggagcgguggacucagccucaccuggaaccaccgaagugggggugagaagggagaggaaggggauggauauaccaggccgauaagcaccacagaugcugagcaggcacuuugugaaaccugcugggcugguggcuucccuagaggucucugcaccucuucucggugaccuuuugccuggucccgcaugccucagaauuaaaaccaugaauacgguaauaacagcaaauguauacuuggcccuuccugggugccaggcaggcuucugcugcaucuguuaauccauuugacccaacaaucaaacacaguagguuuuguuucugcccccauuuuauagaugagaaagcuaagguacagagccaggaagcagcagcgugcugcuugugaugugaaccuggcccaucuggcuccaccaugcgcacuccugcucaccagcccaaggcuguuggugcuagccaggaagcuggggccccgagagggagggccaggcuggaagucaccugcaguugagggucugcaacucugugagccuugcuuccuggagugauccccaccucccugugucccacccugacuuugcgccuuccuccuuuccgaccucaggaaucaaaggcuccuguagauaugggggugggcuugcugccccugccgaugcagaggcucuuguucccugacugccacaccacucccuugcccaccagguguuugugguggcgcuggugggcauugcccgggccgugguauccaugacggugagcaccucgaacgcugcaacuguugcugauaaggugcggcugggcccucugagggaggccagggaggccuggccuggggugggcuggggaugcugguccaggcugacgcugugcccacucugcgugcagauccugugggagaucacccgcuucuuccugcuggccaucgagcugagugugaucauccugggccuggccuuugguguguguaccgcugggcucuugggcccuggcgaugcucuccccugccccucccuggcugugggcugacucuggaguggucaccugggcuggcuccugccugcugaccagcauguuucuuccaggccaccuggagaguaaguccagcaucaagcgggugcuggccaucaccacagugcugucccuggccuacucugucacccagguaagagggugagugugggcaggggacgcuaggagucagggcaccaggcacccacugcuucugggucugggucagguuuccagucuuuaucaccuucagaguucucaaaacuuugcaccugagaaaucacauggggugcuuguuaccgaggcacauucugggguccccuggagauuuggauccagugggccagggcgccaggaugggaggcucaggacuugccguuuuaauaaggaguucagguagggauggugcagguccgcagaccccccugagaagcaugcaucuagaggccccuuucuuagauugggggcagggacugcaccuuguccaucucugcccccuuccccaugugacucagcccaagacugggccggcucuggaugcugcaaucaguugggcaggacauggccagggagcagacuggggcaggugaguugagggucaggccaagaggcugaacuuggugugguggagagcuuagggggcuuugcaucagggaaagccccugggagagagaagccuugagauccucucccuuccucccuuccugcuugccccugcaggggacccuggagauccuguacccugaugcccaucucucagcugaggacuuuaauaucuauggccaugggggccgccaguucuggcuggucagcuccugcuucuucuuccuggugagguucaggcuggggcagcugggguggcuggggccuuagggccagguagggauuggauuccuggguuucuggcugugggucugggcuggcgcccccagcaccuucucagcccugccugucucuguaggucuacucucugguggucauccuucccaagaccccgcugaaggagcgcaucucccugccuugugagcagcuggccggcggcucugggacaggcggggaugggagggagucuaccgggccacuguagagcugguagcugggagcuggagcuguagaguuccaggcugggagcuggagagcccugggugagagggaggccuagaggggccccgggggacacaccaggcuugaggguaguaggugcuggaggcagagccuggccuguccagggugggaccucacgacccacccuguccggcccccagcucggaggagcuucuacguguaugcgggcauccuggcacugcucaaccuacugcaggggcuggggagugugcugcugugcuucgacaucaucgaggggcucuggugcgugggggccgcagggugucugccucgugggggcaugggaagugggcggcaggguguccacccgcugggggcauggggagguguggagucagcauggggcuaggaggccccgcgcugacccgccuucuccgcagcuguguagaugccacaaccuuccuguacuucagcuucuucgcuccgcucaucuacguggcuuuccuccggggcuucuucgggugagucuguggccgccggcgcccccgcguggcugccggcggaacugcgccuucuuccagcaugggugugaggauugaagcugagaggcuguguaugcauacagugcgcaugcgcacgcacauacauacaugcacuugggcacacacauacagauacacaugcacaugcacacagauauacgcacacccacccacaugugcauggacacgugcacaugcacacacggaugcacaagcaugcacacaugcacaugcacacacaaacacgcacauacggauacacacgggcauaugcacacaaacaugcacgugcacacccacaugcaugcauacacacaugaacacgugcucaacauauacauacauguagauauaugcacauauccacauauacauacauauauaugcacauuguauguacaguacacacagacauacucuccccacgagagagagagugacuaugcacgguguucuacauugcugguuuuuauuuaauaauauauuaacucauucauucgcaagcauucauugagcaccuacugugugccagacacugcuagagccagaagaugcgaggcccacagcggaugcaaauccuguccucacaaagcuuguacccuguugggggaagacuuaaguggggagcagguuuggggugggaagucaguuggauucucugggggugaguacacugcugugcacaugugcaucugcagaagcgucugugagaugggaugcugaagacaugggauugggggucccacuccagaccuuaauguggucggaauguggguguuuuguccccccuuucucaccugccaggucuuguggggaggggaucagccucccaccugggugaagcugggagagggccagacugguccauggccccagcuuggaucuuugcacacaauuucuccccugagccucaggcuccuuuuuguaaauuggguguagugugucccccuuggagaguugcccugagggccgagggacgaggucagaguggagugggugguaacaugagcagcaggggucacaggagugggggcggaggccacagccaaugucuccugagugcuugggcaggcacuguugaagccucaugauuuauguccauucuuccuccacacgguguccacacacccauuucaccaugaggaagcaggcacagaugccccccgccugagcucacacagccagggggaggagggcuggguuccaaaacaagucuagaugggcucugggguccagcucacaggcccacucagagugggugucaggcgacuguuggucaauuccuuccuuaucugguggccccaucagccuggagaggaaggcucuuccugaaucacucagugaggcuuccaugccccucuuuuccuuuuaucagcucggagcccaagauccucuucuccuacaaaugccaaguggacgagacagaggagccagauguacaccuaccccagcccuacgcuguggcccggcgggagggccuggaggcugcaggggcugcuggggccucagcugccagcuacucgagcacgcaguucgacucugccggcgggguggccuaccuggaugacaucgcuuccaugcccugccacacuggcagcaucaacagcacagacagcgagcgcuggaaggccaucaaugccugagggcagcugccagggccuguggaggacaggccagagaggaggccagcaggcccagaguccccaggggaggaggaccaggucaagggacguucugugggcaguagcccuguguggcccuguucccaccaugagucuggaggccccaccucccuggggcucccaauccccuuugccaucucugcucucacuggggacccuccuccccuucccaccugcucucauacugcucagugacauggcccaggcuuuccuuccagggccaugcuuggcaagguuggcugagggcacccuccuucucugcacccuuggcacgagggcagggcuggcucucccaaugccuccaucccauccccauggugcuuuggccuccucaaagcauccaccaugguggauggacugaaguguguauauuuucuugaucuauuuuuuaauaaaaaggaaaaggagcagaaggugcuaauguggagguuuugcaggaauacuggggcugguuccuuucaggagccugagggcugggugaggggcugggaggcucagggggccucugcucaaccaaggagcaguccccagugcccaagcccugggcuggcugcuggggaggugaagagaaacagga

SEQ ID NO: 14782 - RNA, 55412 nt, Homo sapiens
acugagccuggcacagagcuugugcuugcagccccacugucaagaugcgccuguuugagagugggagguauuguugaugacuuaugggccacugucagcccugggaacgaguucauggagaggcuggugggagacaggugggagcuugggggcgguggggagggccuggggucccaagggccuacguuugggcgggcugcugcuuaccaccauguggcugggacacauugugcaaccucugugugccucaauuccucagcugcaggugcagcugccccuaaccucccaggguugccgggaagucccagugaguucacuuacaggcagugcucagacgguccagguuggggucugccuggaggcgcagcugcagagcaggugcccagggcccuuggggaugugucacaccugacccugcacccacccucugcggcaggagcagccaccccuguugagccauggaugaaaugagcccagggacggggccacugaccaaagccaugcacuggcagaagcugcauccacaccuccaucauuaguaucuguacacauuuucaugagaugaagcagcauagccugucucugcuggaaagaccaacauuucucaaacccgguuccuuggcugcgagucugggaaacacaauuccagccuuggcuacugaaggcagggggcccaggacugcagccucagcucccccaggcugucgcucaugggccccucggggucagaaucugauuuuaguuaacaaggcacccaggaauuccugccucacggcaugggcuggaagccacugcucugagcuaggggucacgggagaaucgccugggaagcaucuaaaagugaccaccgcucagaccccugaagcuccaaggcuccagugggggucaggcacugguguuuuagucuccgccaagggcuccaaugugucaccugggcugagcgcacccaacucacagaguguggccaucuguccuggguguggcugagucucccagggagauaugcuuccguguuugggauguggcugcacuccugcggccgccccugcuucccagcaaggaaaaccuggagccaagagcuuuuagcaaaaauguuuaaucucuccuuaauguguguguuuauuuacaaguacuaaaucugaagaacaguaaaauaggaaauagccguauauguacacaucugagggccgggcccacagucagcggugcugcuucugcaaagagcccggcugagggugcccgcccggaccguccgagggaucgcucuucuucugggaggggguucugcgguguuaaaggacagcuaauugugggcuuugucuuaaaaauaucucucucucuaaauauaucuauucuagcuguguagcaccaacgugagccacugaauccagacagggagaaagccagggcggaggcucucagcaaggccgagccgagauggcacgccgcuccgggcucucucccggacucgacgcugcaggucguggggcccccagccccucaggccaaggggccagugguccuggggcuggggagcacaggggaagcucgagguauaucaagaggccaggcucccaggccgaggcgugagcuuuuccagcacuccugagccaggcgcggggagagggaggacacggagcaggguaggaggugcugcaggaagcaaguggcggcagcagcacgccaggugggugccaguuucacagcacaugugccgcagcccuggcucccugcagacacagggcccaugggagccgcucaccgcugcugggcacagaacggccuccaacugcagcuccuaccagggccuccagccccaggccagagcucccaggugcugcacaguuaggagcacagugggaaccagugacaaguagggacuggggccuaacuccacgaccuggcagagggagguacggaguagcucggagacugcugucccaguagacagcacagguagucggcuugauccuugcgcauguaaacagauacugcuaaagugcuugcgccuagacacagccaugugcucugugguggccacgccccagccacacgcccaugugggaacugcuucaugaggccuguggugcacccccuucaucaccacugccguccccaccacccgcccaugcuacucacauggacaagggcagccuggcagggcagagcagagcacaaggccuaaggagaguggggguuggaacuggauucugaaggugaugcaggagccccuaccuaacccgugaggaacuggaagaaccagggacuucaaccugaagccagcauccagggaagacuuugggggaaacugagguucccaccccaccauagccaggaaacaucagaagggagguggaggcgcacccaggaacaggaaucccagccaaugcuaggggcuacugaaaaaaacagcccagccacuguaauauggacuggccucagcucuggcccccaagacugcccagggaguaagcccacccccucagugggcugggggcaggggcuggcccaggccugagcuggguguggcagcagcagaaggccccagcccuggcacagugcccacggggccaaggagcucccugagucagcagucacugacuccacaccgacccgcguucagggaagaggcgggucucuguggcgucaucuggcucacgcuacucagcuggggcggacugcaagacuggcacaccccauggggccgaguccucuccuugggccuggccaaggacauggggcugagucuggccacaguuagcugucccuuaauguccaugggaucuucgguaccaucaaaaaagugaccuugaaaaggggauggaccgcuuguuugcuuuuacaagugacugauuaauuaaaaaacauaaaaaagggucuaacaaccucuaguauucaacacuugcaguuuuaaaaagaucaacucagacuaaacgcuagcacaaucaugcaugccccguggugccgcggcaccccagaggcucucagggucagcaggaaguccuuuccuugucaugucaaaccaaaacagcggcccgcaggucggggggcacaggcuucagggcugcuccacuccagggaggcuccggccacuuucuccacaaccauuuggcauugcuuucccacugccuucauuuucuuguucaaaucgucuuuaaaauucuucuucaguuaacuguacaguaccccacuggggcuggagccugaggcuagagccacauauauauauaugcauauauauacauguacagcuuucuuuuaagaaugcauucucucuugcugagggcaaggguggacaccgcuggccuccagucccucuggucacugcccgucacucauggcccagauagauccaggccacugcgggccagaggagcccugccacagaccucaaggcccaagcagagugcagcagaauuuuuuccccuaaacacaaaaacaguccccagaugucccacugcucuggaggggccaggacacugcugagaugccacacuggaagccgcuggggcagggacagagagaguggagagagaggagugcucaggggccgcccucaggggcuccaggguggggagcucagccuacccuugaagacagcugccagggcagccuguguaggacgcggaggggaauaaauaacgggaacgugcucucugcgacccggggccccuggcccaguggcucccagaggcacagcccugaggacggagaggggcugcccgguccgucuggaagccacccaggagucugagcagccuggcccacagccccuccauaggagggagcagagccucucuggggcgagguggauguggugcuccggccucggccgcgcagagcacgcggugaaucugaggauggcagcggugcagcgggcaugggugcuggaggugggagucgguggcaacgggcccagaccgacuugagcuccucuugcccggcuacgggcuuuuugccucuuucuccagcugccaaccgggccccgggacccucagacucugccgccugggggcagcuuggaaagcugggaaugcugacacccccagccucuuguccuggucucaaggggacagcccaagcuggcuaccccucccccuggagggcccuggccucaccccucagccccucagaggucagcccuucucccaugaaggccacugggcagcucuugccaggcaaugaagguccuuggccagccugagcacccagugcugucccggccccugagcaagcagcugugugcgcagcugugguguggcagguaccaucaccuccacacaggaagagccgggacccgaccgggugaggcaggggagggagggccgggcagucgcugcacugcggcggcccgagcaccaccggacacuccacacgcaugcggugagggcugucccggucccugcucagcuguccucacgcugcaucaugcuggaugaucacagcuggggcucagcugcucagggccaucguguccaccaccugcuccagcuugcuccgcagccgcugccgccgcgccugcucauccuucuccagggcugccaggaucugcagggccaggagaacugucagcaugccgggccaccagccuccaugcacucagcaggcccagggcagaugccuccagaguaggugccagagguucaaccccaucuaccccuggccaaaggaccuugguugugagccuggacccuccaggaccccaauauggagaaugagcccugccccugucaucauccuacucucacccccuaaaacagcaggcucugaucccuuggcugccuggccaugcugcugacauguccccacccaguccucacacccugggguuucugugccccuuuaaagcagagcuccccagagagccucagcuccccuuucccuggugagccccaggaccccaggcuuuuguccccacuccccacccuaauacaugcagucucuggcugcuccucugcuccccuggggcaccugccugaggacagcccucugccuccugucugccuccuguggcacccuggggaagguuccuugccucugcugcaccugcccuggccuccccaggguggcucugguucacucccguggccuucuuagcccucagagccuuggcacaggccgagacuguccugcccucuggccccgugcucccauccugugcggcccaggagccaguucuccuuccuggauaccuccuggaccccguccccagguccauguacguggccucacuccaagucagcagaaaagauacugaaaggaaagcucugccaagagccuaugcccagcccuggagaugcuggcccagacuagaaaacccugaaaugagccccucagggaaguugcucaccacccacacacccucugccucaggaagaagcugccaucccaucuuccccaccccugaccccacauggcugcacacagugacuccaccacggccuucucugcucggccuggcaggcucccuccuggccccaaggaaccagguggccagagggugcagaggagugaagguggucaguggcagcccagagauucagggaggaguggcagggcggggcagagcaggugacucuggcaggggccggcaagcccuccuagcccagccugugggcucccacgguguucaccucauccuuguacuuggugauguaggaguagaucucgugcaaggcgcucaugcuguugaacuggcucaggugcaggcgggacugcucagccagauacgcacucauguccuggucgcugauggcuggcaucuuggcgaugucugcauaguaccugcaggugaguggccaggugggcacaugagcagaguccaggcugcccccgggccccugcccccgaccccugcacccuccaccuaccucuccacccagcucuuguaguuggggauguccuuggcguagagcagcuuguuggagggugaguccuugcccagcuugugcucagagguggagcaggaguccaugaaggucugggccaccaccgacaagcaggcguccgugaugcuguucuugugaaugucgaacacaaacuguggguucuugaucacguucacccagaagcgcaggggcaggcugcaggcgagaguccaggcgcugcucagauaggccucugcucccuccugagcagugaccuuguggcccucccagcuccgaauccaaagugggcauggcuuuccaugcagacggggaaacgaggcccacagaggugcagggcccaugguuaagugaaggccguccccugccacccaaccagagaugugcugcccccaccaccugcaucucacgcagagcaucaugagauaggcgugcucaaacgcacucguuugcacaagggcaagaugugaccaggcccucaggggcccacuccacacagccaccacccuccuaggccugcaugcuggcuugcacucauggcuccugcacugagaccugcagcucagcuccggcccaggggacccauuccugcagagaccagcccucugugccccaaacaccaccucagggacugccauuagcugggcugccuggcagcacuggccacacguggcugcuuaacuuaaaugaagugaagagcccagacacucagccacaccagugccauuucaaaggcucaggagccaccacccuggacagcacgggucuagaauguuccacugugacagaacauucuccaagaacaugcugaccuggagacacugcgucccuggaggccccaccucccgcugugcccaaucagcauggcccaggagaggggcuucgugacacuucauuuaaauccuagacuccgcgagcagugggcggagcugggacagguugggguggcugcaucccagguuugggaagcaacacaugggauggacaagaccaagucggggguggcugcuggcccgggagccagcagaaguggcagggacaguccaggagagaggggagcuaagacaguggagagugugcacagaacuggggggagaccccagcaggaugcacggugaggaggggcacuuccuggugaagcaggguccagccauacaggcaagggcauccaccugaccccaggugugggggagcaguccuaccccagaagcccucggccaugcagguagaggggccuggugcacagagaggggcuccccuguagcaggcaauggugggguugucugcuggggugggggccacacacacagcagggacccgcuccaggggcuaggguguggcuacagugugccaaccggagcagggggccacagaccagagcuuggggguccugaguaaggagugaggccaagggcuggccugccuguguggcagagaggaagccaacauugcugaguugggcaguccaugaccagggaagaagcaggucacugucccaggggugggccaggccggaggaaagcaagggacuggcuggccagggaggcagauacucuggagggaggccacucagaggcugggugccucuucauaacaaaacccagccucauagagccccagcucacauugguguagcugugcacggugcaggcugggcaggcccugcuccguacuccagcugcuccgugagaccguggcaaguggcucggccucugcgccucaguaagcaggcucuggccuggccccacacugcaauggggaggcuguaaauuccucgcacuaaagacuaccaggaguaccugcagucccuguugcccucaucacugcaaccagccggcuuggggcugguccacugugcccuguuucucacgcugcagcccacacucauguccgcacagcugugcacacccagagccacucacaccugcacacaguuccugcagcagugggaggggcucagcggcuggagcagagggcgagccgugggucaaggggcacaggcagauagggaaggccaguuagcacaggacuggcccgccaugccccugcuggguuguguccccacgccagggagccccaagugggggcuccggaucagaacagggcgagggcccugggaacacaucuggccuggcccugggggaugccccuccucccccugcccugcauuaccaguugcucuuccagguguggcgcacgucagcaucguggaucuggugcuugucggccugcucauccaggaagucgaacauguacuugauggccagcggcagggcugagccccggugugccgugcugaagauggucucaaacaggucguccacaaacuucugcagugugcccugcggggggcaggcagggacacugagccccagggcgcugccuggcugccuacaccuccugggugacuaggcaaguggccaugggagcaugggggugaggcccuugcucugggcuuggcacuuucucugagcucaguuggcccagcguccccugcccccaucugccagccaggcccaccuugguggccaguagccgugucaaguagaucuccgagaccaucuugcugccgcggucacccucacgcugguccagguggucgugguucuucaccaggugccacagcuuggugccgcucuccaggucgggcgugaucaugggcgugcgcgagcgcaggcugucggggcugcuggccgugcgcagcaugcucucugcagcaccaggcugucagcgcccgcguuggcuggcaccccgcaccccccgcccgagccuguuuccccaucugaaagcuggggauggcacccccacccaugugggauuuuggggcagccgaugacaccacagagguggcauaauuguguacggacacacagucgcgaggaggcgcagccuccagagcuggaggguaaggccaagagugcgagugacaggcuugacaccugccccuggguccucccguccggcugcugcagcgugggagcccgggggacguccugcccaggccagggacccaugcgcugcccucucgcccgcugccuggccccucaccguaucugcugagggacuuggugaagguggaggaguuggagauguuguaggcggacgucugcuugggcaccagugccaccgaggacccgucugucaccugugggcagagggccagggacccugugacccaccagggugccccugcaccaccaggcucccacuccccggcuggggaccccggugacacccuagugcugugccuggaggcagccaccucacucagucuggaacucuauaucaggacagcccagggaugcuaggcaaucccacaagcccagcucgaguccugggacgguccacacacauaagugaccaccuccccuccucucccugacagauccagcugcuguccagcccacaugcugcaaacauugguggcugcgcuguggaagccccaaggggagggaggccugugcuagggucggagggccgggagccaccugguagugagccaguguguucagccucuuccaaucguugucaaucuugguggugacguccucguccugcaggaugaugcgcgccaugcggcccuggcgccacucugggggaggagggagcuggaggguggggccgcuggggcccucuuucccuccuccaucacagcaguguagugggacggggccugccugcagcucucagcaccagcacagggcagggacauaccuccgccccugcugcagcacacuuaaccugccauaguccccugcaaugugccacagcccucccaaucugccacagcagccccagccuaagggggucugcccugccuuccgcaagccuuagggccccaacuccucagccuggcaccgaggcuucuguggggacccagccucuccagucacaucugcagcaggacuccgggccccaccccaaacccgucccauccccucuggcccucaauggcuccaccugccccucucaugagccugaguaucccccucagggcuccaagagcccacugccucccagagugcacuggaacccaccaccucccagagucucugcccagagcagggcagccacccucuauacccaaccugggacuggacagcccacucgccauuccacugcccuccagaccagccugguguggaggacuggccuggccuuccccgccaagcucaguacuaggccauggcccugccccucugcuccagcacacaccccgggcagccguggccccgcccgcucacccagguccauguccgcggccuugggccgcugggaguagggcacgcccuuguaggcagcguccagcagcuucuccuuggccugggugaccgugucacaguccagccccuucaccggcaccucaggugcauucucauucucaggguucacacaguucagggucugcgggcgggguggagcaagggggcagcgucagccccacaacugggggguggggggcaccagggcacccaggacagagggcagccacgcucaccagugucuuguagucaaucugcugccggaugagcuuguccucacucagggaguagcgugccucacccgugauggcgucaauggggcccuucuccaucugcugcuugauggcgcaguacagcaugaacagcggcuccccagcgcacuccugcggggguggcggcaugaggcugcagccaggacccccgggccuacccccaaccugccccuccacccgucgagugccagccaugguguuccuggcaaggagaaaugagcagcacuucccaacucuuugggaggcaaguacagccuuagucccaaagcccagcagagacugcaagaaaaucaggaaacaaaacauacccaccaucccacaaauaucacaugaaaacccuaaauuacacaugagccaggaggcgcaguaguguaucgaggaacauggcguggcacgcgggaccugcaucagggagggccgaggccuauuucacccagaagucuccccuggucucagcaggauccccgccuagcuccagccucccaggggccugcuccccagcuggaggugcucaggacaaagcuccccauggcccaccgcccauggcacaagcggaccccauacuacgcaacuccaagugugacugugauccacuggccuccuagggaccacccagcugggcccccauauuacucugggacacaacuauggugugucauggauacugacauacccaccugaggaggcuugcccacccagggagguucaccagcacccaagcacacagcacagggccagcagcacagccccgggcccucagcgggcaccugaccccucacccuccggcuccccgcgcuguagcaugagaaccgccuccugucccaccucagggccuuugcaacugcugccucuacaaccagaaauuuccccuggcaucuucaugggcccuuguggacccaacccaaugugcccucuucagaaaggcuccuggggagcgcccagcacacguacccccgaccacugccucgcugagucuccccgccaucugucguucucugaaggauccugugcaccccuggcaaccccucuggagugggagcugccuggccugcucacuauacccuacugcuagcacuggcugagccugugcauggggcaucacagacacuugcuggaugaauugagugaauggagagcugucccugggaaacguucacgucugggcugggugaguuggccacacaggcgaggcccgcccagagccugggcaugggguccacuguagguccugccugcccaagggccuucagguguguguacaccucaauggaggggcagguuuggcagcccugccuccuacccggcccuggcaaacaaacagcagcucugcuccuguaaccagaggcuccaggcaccucguuagcaucugcgguaauuagagagacagcuguuaagaccaucccagaccuuccaacaacaugucugucuaugaaauuauguuucauuugcaaacuugguuucauuaaguuagccacgaaggaggaggaaaaggggugcagauccggauggagagccauuaaugugacaggaagccuuugaggguuucccaaagucagacaccuguccgaggguucccaggccuggccucagagagugaaaggacggcagcuagucucugaaggucagggcagugcagauauuggcccaaggucacacagcaagaaacuggagaagccaagaucugaacccagauccagcugaccccaaagcaccugccccauacaagccagguguacccagagaaggcucaggcugagccgggcauucacacucaacccaggcagcaggccccgccccacuccacccacuucuucagccaggccagccuagaggcugcaaaggagguuccaagagcucagaggccagggaagaggaaggcccaguccuuuucuugucgcagccucaaucucucgugcagugacggggaaaaggaagaccucagacuccucccagccccacucaggaaugugcaaaaacugcccaacaaaaagugccacuuuucaaauagaaggauaauaugggcaguucaauaaaugacauuacgacaagcacuucuccauccucccuuccagguuguuuacaugugcuaaaauggcauggguuccuuuucuaguuaaaguuuuuguuucuaaagacagcaaggaaugaaaaggauuuggguuguuuaaaaagaguuuguguucucaaaguucauccauguugcagcaugucagaauuuccuuccuuucuaaggcagacuacuaucucauuguaugcacagaccacauuuugcuuauucauucaucugucgauggacaccuggauugcuuccccauuaagcugaugaaauuaagccagccacgaaaggacaaacaaugcaugauuccacucauaugaggucccuagagcugucagauucacagagacagagaguagaaugguuccaggggcuggggaggaaggaacaaggaguggguguucaauggggacagaguuucaguuucacaagaugaagagucauggagcagguggccauggccaacaccgcuguaaaugcauccaauaccacucaacugugcacuuaaaaaugguuaagaugguaaauuuuaugucauguguauuucaccauaacaaauuuuuuuaaguuuguggcacacuacaaagaaaugagcaacaagcuaugaaaauaaauaaaggaaccuucaaaauagauuacgaagugaagggagccaguuugaaaaggcuacgguaacagugcacgauuccacuacaugacaucuggaaaaggcauaacuuauggagacaaugagaucaacgggugccaagggcucagggggagggagagaugacaagugagcucaggggauuuuuagggcagcgacacuauucugugugacacuauaacgguggauacauggcauccuacguucauccaaacucacagaaugcagagcaccaagagugagcccgcacagaaacgaggggcacuggguggugaagaugucuccuggcagguucacugacuggaccaaaugcaccccucuccuagggaugcugacaguggggagacugugcaugugugggagcagcgggcgcaugggaaaccucuguaccuucuguucaauuuuacuaugaaucuggaacugcucuaaacaauaacaucuaucuuaaaaaagacaaaaacaaaaaaaccccagauaugguggcaaaaacaaaaagucacuggccaguuauguggauggaaacagcccuaggcccaucucagucccauccagggggcgcccagcuccagcaugucugucugcgccucucagccucaggccauguccuugcgcccaguacguguccucccuugcauauauagggguccuccuagaacuggaggagggcagugaugaccuaaggagaucuaacagcuccuggccccugccugcccccgacacugguaccccacuaacaacgagggugggcuggggucaugggcaugggcugugaagcccccaacacacagcccgcaccccuuguaccugcaccacucccacccaaauggucaccccugccucccuccucccuguguccccuuccuauggcucccuuggccaagacuggccucccucucccucccuccacugcccacacaucccucagcgccugucccaaauguccccggcucuccauggaaugucugauccggccuaaagacaaccccuccacagugccccacugccacccucucugcuuauaauacccuguggggccacacucugcgcuggcugaagcuggcccccuauauccuggcaugaaagagaauccacacccaacgucggugcuuauaggcauuugcugcccugagcccugucucuguggguguggagaaucgggaucagacagggacucagguuagcggugcccucuccaccucacccaggacgccugcugcuuuaggcucacagagcccagcuuacccagcaugcacacauacuaugcagucuucauagaacuguacuuucuacaggacacgcacgacuuuguguuaccugcuuccaguucugccuaaggauguuaucaucuacugggcacuuacuaggugccagggacugcuauauacacauaaaugucccaccuccagagacgacccaggacagacaagcccagccccugccuaucccaccuggggccuucuccccaguggccucuucugccugggacucucuucccuccccccgccuggucuucagaccucugcucgaaucccacccucccugcucggcccugccccauugccugucugcuguauuucccguccagugucucucccggcagcgaggaugucuggccaggacuccgcucugugcaggcaucugugcgcugaucaccugagcucagcagcaucuggcugcaggaggccugaaagccccacggcccagagacagaggugccaucccuggauuccauaaggaaaccaggagaaucgaacccaggcagucagugccagcucccacccucgaucacugggcuacacugucagucacccucacccacagagcagcgacagggaccacugaagccaggcgaggagcaugcacuucaccaugcacacaccgggcuccucccaccucucaggagugggcuaaccaggccuucagauuuccaagagaagccagauaccugagucuguaaaagucccaacaucgaaagugcagacagcaauucaacugcuuacugcccagauaaagcccacccagauccccauccagccugggcccuggccugcagucucuggccuacacccuguuccuguucugaggacggcagcauccuucugcuggggggugggaggggcuugaauggacagcacaggggaagcccagugcggucaccuguccccaugacaggugguggacuggagccuucaggcacccccaggcuggccccucagaggccccugcccagggugcccccacccuccugagcccaggccagcugugggcacugagagccuguauccgaacucccacaccuaccuuggugggcugugugagggccugacagccucagaaggagggaggagggagccgggagccaggagcugagagcggcugcaugcccaggggccuuggcccaagccagaacucgaccaagaccccaccagcugucauucuccagcaccucccacuaauccccaccucucuccguuuuccccucccgcuguucaccugccucugacaccugcuuccucccgccucugcuuaccuugaggaacuuauacaagaggaaggugaaccaguuaguuagcaucuucucugccaccgacucaguccuggggagcacagaauaugggcagaguggugucauuccagcuguccagcaggcacagggccccugcaggccucacucaccgaucccaccccacccugccccccuuccuacagcaccgaaggucaggucucgaaaggcacccacaugagugggcagcaggcgcuucaggggcugccauggagaccccaguccuucgcccagagcccaggccuguguguauggagacuccagccuggguccucacuaucaguaccuagggagguggcagcugagccucagaggccaggugaguccucccaccccugcccggugggaacugccacagcaacgucucugggccugcuagaccaaccuguccaaagcuggaggcaugggccugccucccccaaccccagugccccccaggcucaccggcgcaguagcagcuuggggugguucuugcucuccagguucuucucgaugaggucggaaagcagcugcuugagcacgccuguggcguauuccaucucgcccugcagggccgucaugaugagcgaggccacauucccgcggucgcgcauggagaagcugcgcugugccuccagcgugcggaugaaggucagcaggaagugcuucuuggucagcagcugcccgaacagugucagcgacuucuccacauuggccugcaccugagggagcacacagagcucagaccacagagaagcacccagccccagcccccaagcugaccagugaggggcuguccaggccuggcuggugaggcagggccccaucagaggacaggccuggaaggcaagugacaaguugcccugacuccucagcucggcgggucauucccaagcuucaccuguccuuagcaaaauggacacgaccugggugcugccaccacugccuguugccaucagggcagccuuggccacagagucccuguggcagccugagaagccccugcaagccgacaugacaaagguguuacgagugcggcugggugcagaaugagaggggcugcucacgccacccucuccgugacugggcccuuugaacagcaaccccugcagcgggccugcagcagcucaaaggaaguccaacucaaugcccccauccacuggguaccaggagugcaugucuaccaucucccuccgccuugacaaugauaaccaaugcacgaccagucucugcaucucauggaugaggacacaagguuggagacaggaagagguuugauuagggccacacugcagguaggaaaaaggaguggaguagaggcauagcuggcuccagggucccuacucucucucucuuguucauacuaagguuuaucagggcaauauguucccuauuaggcagagcccagaggccaccagugauaccaggcucccagccaaggccaacagguaucaggcagacagguaauggcccaggcagaacauacacagucacagcugagagagacagugugacagacacagcaaauggaggcacugaaagagagauacaaccuggggaggcuguguagccccguguggcagcaagcccaggaacaggauggcagcacucagccacaggcagcccagggcccaaggcgggaaggucugcucaguaucagcucaaaagggacuucccaccaacagagucaccacaagggacaugggcuccccaacauccaaggcacacgguuggggggugcccucagcuggagagugugacugagcuaaccugccgagccccuggccguggcucgccaaggacuggcuccuagccugccugccgcugggggccuuuuaggggugugggagccagcccucuuuucccucgccaggcucgcugccaaggucuacggggcaaagcccuacucucugagacccuggugcuaugccagccacaugcuccccucccaaaccgccauagcagacuucaucaggcacccgcaccucccagcacacggccccugcccagcgaggcuucgcauccagagccacccaggagaccaggccaguggagccgcaggcgggacccccaacagaggcagggcccaaggggcagccaccggggaggugccagaagcccaggcugacaagugguuugcugggaugaggccuggcaucccacggaggcccuggggccagagccuccuccugcccucuggagguacuuuauggagcagagccgugcuggccauuccccugccccaaccccagggcucagggcuccacugugcuugccuggucuugguucugccucccagcaccugcuccccacuuggcugagcccagagcccugcaggccuggacccucccccaggccacacaggcugccccauaccauccaucagcacccaaggagccucaaaggcagaagauagcagcugccucugaguuccugugaccccccggagccagugguccuaccuccaucuccuugagcacagggugguccucgaucccaggaaagagcacccgcauggcauauguccgguagucaaggaaggggaugccggcaccguccaggucauuggucagcucguggaugucugucugcagcucugcaaaggcuguggccagaugcggcgucaggggcagcaugcccugguggccccgcuccaugccccaacccucccacucuuggggccuacaucaaauccuggcucugacacuuacugguuucgugaucuuaaggaaacuacugugccucuucgucccccagcuacuacagcccuagcacagggauaguaacucuccucugcaagguucccacaggaucaagcaagacaagggcagagaaagcaucagcaccaggggcaggcugggcagggccuccugcaucucagacacuggcaguuaagcguagagcagcuuuggaguucgggcuccuuccacccgcugugaggugguggagugcggccaggggugaggucccagggcugcaggcuguccccaagcccccacaccauugcaugcacaucucgggccuggugcacccucaacauggcccacccugcucagggccagcucugccucugucaggaacaaaggcaggcaggcccugacagaacauuccagagcugugaggugucaguccuguggcagcccgaggaucaggcuaucugaucagaagccaaaggagugccaggcaggcucugggggacaucugacagguuuaauuaagagcuggagucuucgucuccugggcaucgcugccaggcgucuaguuaucugcaccuggcuggccuggagcagccaccagccacugcauccacacacgccagccucgccagacagccagccucagcaggcgggagcacaagggagguccaggccaccugccucccaccuggccccaacacacaccugccuccagucccaccagggcugcccaagagguagggugacccucagcccaccacagggccacuuagguuugucugggacugagagggcucccaggaugcagaacuuugcauuuuaagacuggcugaguccugugcaaacaaaacaccccaucccaguugagucccaguggaauucaugacaaccccaugcuggaccacauggcuaagguccuacacugcagcaggaacacuccuaguaucugcccccuagagcccugaacaugugugaguuacuaucugcaaacgcucaaagucucgcccggcauggaacagauuucugccacucacaccugcccugaucaggagcaugguguggcaugacucccccuauagacaucucaaggacaaaggucagcucaggccaagaucucuaugugcccagggacugccaaagcgcaagggcuccccauugcugcaugguggaagcaccccucucugcugcuccgcuggcaccagccaacccaccacgacucccagcacccagggaaaguaggcacugucauugugcccacucuagagacgacaagacugagccacagaaggguaaguagccaccuucagccuuauagcccagcugggauacaaaugcaaacagucuggcuuuggguucugugucgcaagcagcaccccaaggaggugguaccugcugcagggccaggcccuggucaggcacccgcccacugcccugggaccagcucuggcacagcaaggcuaucaggaacauuguaaacugagcugaagcagggugggggcggcggugggaaguagguguggggacaggccagggccuggcucggagguggcaguugccccagugagcccuggccccaacagaccuuccuugcauucgagggccacgcgggacuccagguuguccaucuggagcugcagccgcuugagugugcggucagcaucucgugacuugcgcuuguaggcgaugagcacagccacgaugaccagcagcaggagacccccgccuccgccaaugcccacaauggcaggcagcgucagcaggcuguccgaguacaccugcagugucccuggcgagaacucgaagccaccugcccgcaccugccaguggguggaggccacucaggagcuucccaugcuuuccacaaagcuugggagccccucccgaugggcaagacccacccccaacaccugccugugggaaaggucccaccgacaggggcacagaguggucaccaggguggagacacugggacccagggcaggcgccuggccagccagggcaccacuggcauggcaagggcucaggguggguaggcagucucggggggcucaaggagguggcaggcugaaggcuacggcagggccugcacuggagccgggcgcccucugagcuaggggugagucucgggcaaggucagagcuggggcugugcuaguggggcaggguccacagguggggcauggcucucccagcucugcacccccgguggacagacgcaccgugaccuugugcugcccagugagguugggcgccucgcacagcaguugcgucuccgacacggugaggguacaggguguggagccgaugagcaccguguaguugagucgggaguugccgggugcagguggcaagagguuccggcccuguaggagaugggggugagccagagcccaggacgaggggccucuucccuggcuuggcccagccuacgggcaauggugacccaccuugaggaugaguggggagcugggcuucagcuccagcaggccaguggggcugaguggcuccaguacggggucaggguaguagaggaaggagguggaguugagcacaagcagggagcgcacguuguccaugacgaagcccagcucauccggccgcucccccagcucuggugggcugcgcacaggguuggccacagacggggcgcggcauaccaugguggugucauuguacaccaggcagcccuggagacacaggguggggaugcugggcgggaccuccgcgaguggcccggcagcucccagugacagagccccuggccugggggcugccugcucccugcacagaugaugccaggcacuagcagggcugguccugggccacccacccgacguggaccagggacauguggccugaaggagaggugugugcagccagcaacccagagccagaccuucuacccgccaggcaggacaggugccuccccaggggucuccaggcacagccaagguuggcauaagcugggaaggggcagggguaggggcaggggcagggacacggguauuccuagcaggagccccaucccaggugaaggccuggaccgaggugggcagcugagggcagggacucacguucucccucucaaugccuccauacuuggcccggauucgggguucacggacaguggccagguuggugccugugaccgucaggagggucccaccgcuggaacaggacaggggugggggggucaccaaaugaugcuggggcccagugagcuggaaacgugggccacagcucagccaggcaaagccugccuuccccaaagacaggaaacagguaaaagcucuuggcaaggggugcuucccggcaggauaguacccggcaugcaggagggccaccgccaagugcccaguggaagagcuccuggcucagcgcugcucucaauagcuggggauagggaauggguguugcugggccccaccuguugaugcuccacucggggucgauccucaggauggugggguccucgguguaguuguacuucaccucaggguuggugagcugggcgcgguugauguugaugaugaugggagcgcugccagggcucugcccggggggugucaggcaccggaucucacgggaguuccuccuggaggugcccgagugggacagugaggagcacacggguggaacccaggcagguggaaugcagaugcauugagggacggugggaacagcgccaucugucacagguacugccuuggguggcugcauacuaucaccgcuacuuucccucccagggcugugcaugucuguccuacccucgcccuggcucccagccccuucaggcccccacuguugcccagccuggcauuugggacccggccugccgccucuccaggucugcuuucaucacagccucccugucgcccacacccacuccuggugacccuggccagggcuccacacccaccaggccucugccuccccagaggcaguaggcagcaggcccgucccacgcacgccaggcugggagguaggcucaugcugcccucccucugucccuggggagggcuggcgagacuaagcccuggcgcgaccuucccugccugucucagggccagccucacucagccggggcuccgagugcugggagcccagcacccacuccuacuacccugggccaggcagacaccuucccucucggcaccugucccagugggaauaccucgcccuauccccgcaucccagggggcugugaggagacuagaugagcuggccugggugggggucacggggacaccccacugggcaggcagccaggcauagcccacaccuggguccggacccucaguucuuccaccacugccaggagccccacagccaccaggcccccucagcugcagacaccaaugauuagucugauaacggguaauuaccauaggaaaauauuuaaagggacauuccauuaucaucccuaaucuaaaauuauccacuucaagccucagggcuuuuguuaagauuucuguuuucucucuuaaaaauuuuuaaaaaauacuucuuauuuuguacccaagggauuccccccuuccccacagggaagaaccagggcagaggcagccaaguugccccgccccacaaaggcaggccccacgcccaucaccgcccaguccuaccacucuggagguagccuguuuccaugguaaccuccgccucuggguuucacagugaucaccccagccaggcucuccauagccccguugcccaggcaacaagaaggggcaugcaaccaucugaaacaggaggaggggcagccaggcccccacccccaccugcaccccguaccaggagaaggagcagggccggccaccgaccgacacagccacaucacugccugcguucagguggcuucccucgaugccaauccaggugcccccugacagaggcccacgggaggggcucacacgguagaagguuggugucugcaggaagagggaacuugcugaaacucucaggaaagucccccucgggccacauggggacaggccccacuuggccugcuuacccccacagacaguuccccagacuaggagcccgcaugcccgggagcugcacuucagagccaguacuuccagguuucucaggcacagcccaaggugagccagggagcccuggagcuggccuaggcacaggaggggaggggcagcacccaggccguggaaaagcaguggcagagcauggccagacaaggggcccugaagaggcacagaagcccugagcggcacccucucagagcagcagagaauagggagagagggagggcagcagacucaccacgaaggugaagcgcuugggugacagggcgcgguaguguggugagcagucccgcacacacaccuccaccagggcgucaugggcacgcacggagcuggcguccccgaucucacagacgauccugugggcaggcgggccucaggggcugcaggagccccgccccgucccgucccgccccgcacacacccagggcugcacucacugcuccgcacugauguacucgcucuccacagggcugcacagcaccuugcccacgcgcacgcccagacgcacgucuucgaaucgcaggcccagguucucgccugugauagugagccgcgugccgcccugccucgggcccgucucgggggacagcugagggaggcagaggcugggguacaggcaucccacagggcguagggugugcgguggugcagggcggggcauggggugugggggcagggcugggggcccuaccuugaggaucuuggggucggugcagcgacugcugccgugacgcgcgugcauccacgaugcaggugugucggcagcgcaguggugucgcagggagcagcggcgcucggccacgcaccauccgcacucgaagcgcgggucggccuugaggcagaggccgcagcucucgcgcagggccgggcacuuguagaggugcgcuguggggaggggugcggucagcucgggcccgcccacugcccaccccgccggggcgcccacucacccuggauguucuguggguugucaaugacaaaguugccguuccacacgacugacagguucacuggcaggucgcugacaucguuccccucguaggaguacuguuaggugauggcaccgucaggcuucccagcuaagcggccuccaggccucccaagccucacgcccacaaagccaccagggcgccagcuuagggggaaguuucugcagccacaaccgcucccucuccacccucauccuacacaggacuuccuuccuggcuccagagcccccucucuccaggcuagcaaccauaugaggugcccuuccaagggaaccucugugcuucccacagucaccucuguggcacccccuuggagaccaccuccaaccacaggcagccucugaccacucccuacagucagccaggcugggaaaccaagacucccagcuggcccuagaauacgcaucagcaugcucuguguaccucagcaucuuugcugaaugggccaggacugcccugccuugaggugggagauccguguccccggacuggggcagagacaggcaaaaucacugucaggugcagcucugcuccccguccccuccucaacaaggcugggcugggcccaggggaacugccccuccccgggagccuggcuaggacuccagcugugccccacuuucugccacagaugaccucaacucuguucccgugcugggacggugcagggagcccagcaucuccaaggggcggcccggcaauucaucauuauuuuaucugcaggaauuuaauuggauccugucaaauuccccgauacucccgcuucccuuuaaacacagcugaagggaagauuaaugugggccuggugagaagggaggguggggagggagacgcagguggaaagugcagggcaggcgaagaguuggugauagaacagaaaugucuggaaagacuggauggcagagagaacuccagauagcugugguggccaggagugauccucauggcugaccugcaacccaaccugccccaggaagccuguugugacccuccagacccuaccccacacugcugggacagaccaggggucagccaaggggcuccagaccucugaccccaucaaggcccuccccagggcuuccaggggaugggguccagccaaggccuugucgacagcccagugccccacacaacagcccagccaccugccccugcagugaguuacaggaagcccacugcucccuggaucacacccguccugagcagaaggggagacagaggccuacugggagugcaggacuucagcccaggccuccaacugcugggcaacugggccccacucccccaccacucaggaaauggcugguucuauagagaucccgucacugaacgcacugcaccugacaguagagcuuuucaaacacuauugugucagaucugaaggucuacgcaugcucggaccacaggcaacaaccgucugcuagugugcaagugcgggccaaugggaguguuuucugcauuuggccagggauggacggagccaugcgcucuggcacccugaccucugcccuccgggagccacagugaugaaggcuggcagccaccuggcuauuccugcacacacucagaccugaugaucagcccaugccugggacccacggaugcugcaaugugcgagucccaugaggcuggcugcuguccacucccacauucaggcugcucccaccacacaacugggugcucucagcagcuaccaggacagcaugggcccccugcagcccacuugccuacaugacccaggcacaucugaagggccuggcaauggccuggggaagccaggaguggcuucugacucaucagagauacacgugagcacgugcacugcccuuuaugaacaagcacacgccaggacccagggccgugaggauaaccggcccauuccggcucacggcccccagccccugcccuggccaccucaccgaggaauucuggcacugcaggcuggagcuguugaagcgcagggcggugacacgggccgggcugcccgggauguggaagaggcacucauauccacgcuggccugacuguggcuguggcagguuccgugcggccagggugauggguuuuaccacucccacuggcacguagaucugcguggagggcaggaucugugggcaguccuggggauaagaagaguuuggcugagcccgggggcggagaccagugagcaaggugcaccccacuacgcuccagaugugcacugggccuguggugcucccagccaagcaccaaugugcccauuuuaugcacuggcaaacugaggaccgcuggcugggacagugacugcauacuaugacccagacaggcucuauuaccucuggccccugaaugcccugccccauguucuaggacccccaccauuccagagaccaaaggagccccaucuggccagcagcugaaaaggccccagaggcagaagagauuggggcucuggggcugcaggcucugcgcugggggcccagggaguguauaaaaauagccagagcccagcagaaaaacaggccuggccucuggggccagcauuucggcaacaauaacugaugcaauggccuggcuuccuugcagcauggcugcugcuggccucaggagauggccccucgggaacacugagaagcugggcuuuaaauagggaugcugaaaacaggcuguaauccccaagcccugcaacagcccccaaggcaggcaggaaggcccaggcccagcucugcagagauuuuccaggacccaagagggggccuggacucuggccuggccccucaggagcuccagggaagcagaguuaacaaggcccagcugggcaagaugaccacuaaucucugggucugcagggaugcuccuguguccacuggggagaggcaggugguggcaccuugcagcuagggccacuggccccaacuuaggggcugcacuugcaacucuguguucccagaacagcugcagccggaaggcacaggcacgcacaguggccauaccuaugcuguaccucccuggcagucugaggcgcgcccagugacucugcaugcugaggcucaggcuggagucucaccgugacacgggccaccgugggccuugucaccuuagggccccagccaugaaaacggguggcucagggcacugagacuccuuucaguccaagcuaggcugcccgugagcgcccgagaauggucagucugagaccagcugagcugcccccaccauccaaccaacugaaaaaugcccagaggagcccaggcagcucagccugcagcaagccagaaggugacuauggugagggacgggcuuuguuggugcccguaaguucaggaaaccucuuggccgguagcacgagacaugaagcuggcucaccuggcgugaggucucagucauggcccacccccagaacccaggucccagccaggaaaaagcaccacccaccccaacaccagugugagcgugugggcccagcacgcaucaaggccaauguggcuggccccuaccugccugccccaucacccugaagcuggccuguccccucgccaccccugcccucugccaggugcaggaagcugacuggcugccugggccacacccgguccucucaggugcuccccauacccccaccccaucuccuccccaacacccagcugagugagaacccaggaagcucggcacccaugcggcccacugagucaggauuaggcugaaacuccagugaucaccugacucgaccuggccugacucugacucugacaggaggccugcaguggcgugggucuccugggaucaaugacagcucagagccagguccaguuguccccaaaggcucugauuacagccucuuccccagugcauagucuccccgguaaaaggcuggagguccuucuucagagccagguccgguuguccccaaaggcuccgauuacaaccuucuccccagugcauagucucccugguaaaaggcuggaggucccucugggaaacgcugggggaagauuaacagggugcauuuugccagcgcacaaggcuccuuccucaagggaccccagccucuccuucaagcaaggagucuauagacuugcucagaucugggagcugacuggcggggcaugcaacuguuaugugaagacacgaaccacacuccucccuuucugcagaguccagaaacaggcauuucuaagagaaagucccgacuucucagcgugucucaugagcucagcuucggugggggcuccacgugggagcccuuaggcccuggcacacagcaccagcugccuccauggccccagucuggcggcccuucccaucaacaugcacaggccacuccgccuucagacaaaacacacagaccccagcaugcaggcaggcacaagaaggggccacagagacccccucccagcaugggggcagggggcggaugguggccuuggggguuaggcccggcugucucagcaggaagcugaauguaguacacuccugucucaggggguggcccgaggaacccaccagaaacagagacggaaagagggcuuguggggggguuggggggggacugccacuggccauuguucccugagucccggaggacucacgucacaccccuuaggaauggcuccauaaaaaucugggacucaagcuaaaaaaaagaguaaguauuuguggagagaauccacuccccacauaguccugcgaccccacacgugcccccagcccagcccugccugcucugccuccccaacccugaggccuagggccacuacuccaggggccacuuccuccacuccccaagggugccucgaaguucauggcauggauggggagggcucagggaaggcugccacugaggaauugggcuaucucagccccaaaaccaucccaagcugcccagggcccugcuaccaccccugacgaccacugugcugccccccacugcucgaacccugggcugcgcacagcgccaaagccacugcaucugcacaucauccccacagugacuucaugcccagcucucccuggcccgagaggcccccaggaccagcucucgccucagauuccaccgugggcucugcccacacccaggacaccuuggccuggcucuucaggcaggccgcacccccagagaagcgccccacugugucccuggcuccugcauacccacuguuauaggcagucacccugacacaggcacuguggucccugcugccccgggcuacccuccaccgcuguccugugcccugaugucaugccagggagcagaaaaguccaguccagagggugacgcugggggccaggggaccucugugagaagggacccagaggagagagggccaccaugcaacuuccucagcccccagcccccagccuggcagggaagugcagcccagcugcagccuccaaggucucccuggcaagcagaaccugcccccuccagccaacaggcggaguguccacagcaaaggaaagggaccuggcugcaagucccggcuccacacccacagccagacccgguggggaugggggugggggcugccacagcuccggccucagcuuugccacucagcaccugugggcccuggguccugcccuguccugcuacuaagcgccucauguuccagaaggaacagccugcuguucauaaagcuagugccuugcccagcccagaauaauuacuacuuaauuacuagcaauuaccacucagcgccuggugacuccagaacccaccagccuucaggcacgcuaggccggcaagcuccccugcccaacauggaggccucugugccugcccagccaggcacccgcacuccaggcucugcccgcaccugcuuugcagccugacagugcccccaauugcacccaggagcccgugucugcagcccccacacagaggcccagggacagaacucaucugaggcuuuucccccucccugagugucacgaaggacacccaggggucaccaacaaauaccacaggccugacuucaggccaagacagugaccccacaggccucccagcuggcauccagggucaccucacugacccagccugguggugcaugcaccacacggugacaucccagacauccacaggugcucccugggccaggccucaggcgacacccagaugggaugucucaacccaguucugcuccaccucugaaaaccugacccucacccuugcccggccuuaccucagacacguugacacggcccuccaggaaggcgcagucagccacguugugugugcacacguggcgguauuugcaccaguggcagggaaaggagccguugacacaggacaggcagcugcagggagagggugggugcugaagccuggggacccgcaaccacguggagucacccaugaucagaaggacacugugccgccccugcugguauucauagugccaccucagggucuuggcacugacugcuccuggccuggaaaguucuucccccaaaccugaauguggcugccucucugccuccucacaccuccccgacagcuggaggugucuugccuccccaccuucuugccugcccacacuccugaccccaggcucccuauccucuuugccgcuuuuuccuccagagccuugaucaccaccugacugccagccaggcauggguacucgcaucagaaauguguuagugcaacuaaggaacuucauuuuaagucuugacuccuuuuggcaaacuuagauuuaaacugaagcagcacgugcugccacagaacuggacagggccaugcacaucaccucccugcagaaagcaggaucgcuggggcaggagcuugucuguuucccucugacacaccccagggucugccaggcuggccacuguaggcgcucugcccacaacucagccuugcacagggcuggcaccuugccaucucaacagccuccaggaagacaccaccuccaucuccucuccaggaucuccugacccgccagcucccccaccacccugcuucuccuguagcccucggcccccuccaggccucugccccagagaucccccaccccaccugggacgggagaugcugcauccuggaaauaaaaagccugcuuggcucacggcaguugcuccacaaagagcugugacagaguccaucugugagucagucaacaaacaaaagcauaccugaaaagccacgcaccuccugucucugaggccaaacccuacugccucagccuggguccucugguucagggaaggagugagggcucuccucugggcucacagugggacucacaggaggcccccagauccucccauccuuccucugaggcugggggugcucacagccaaaaugggcagcaggcauagcagcugccuccuagacacacucccugcccaagcagggggcgugcacaggggccagcaccaaccagaggggaccuggaugcugcaucguccaacaguagccugccacaaccagaagcagcagguacccaggggccgugucugggccccugcucaggcccccaaaccagcccgcagcuccucccugagcgccuccccuccaugccagugcccaugggccacuguccauaucacgguggcaacauugcacaaugugcccuugcagccauacacagccaccuggggcccuacaagaucccuguggggcaggcacugccgcccacucugacugcugcuuccugguacgccugccccagccucaggcacccucugcacucauggccuugcccuggcuggcuccucuaccugcaagcugcucucacaguggccucuccucccucccugaccgcccagccucaggagccccaaucauggaaucaccaucugcugccuggccacaugaggacaggucugcagacagcaagcacagugggaccacagggacgggaguggggcaaguagcccaggcccaggcgggcggaggggccuagagacacucacgacugguggacgcugcaguuguagaagacgaaguccacagacgcaaacuucuucccugucuccuuggacuuuagguagaguuucaccacccgcuggucuccugcacgagcagcauggcugagucaccaggacugcuugcccaggacucccacacagggcaaguccagacaggggaacaacuugcccggagacccuccuagcugccaccaucagucgcaucaaacacgcauccagcccccucagcccccaggugaccagggccugggaucugcccugcuugccuccugcucagugugagggguugagaaccgcgagacucuccccaggcccccaggcugccugcuccuguggaagggccugcagagcgacuguccaacgggcuguggcagccagagggguccugcaccccaaguccccaugagacugucccccacccaaccugcgccccacauagcccaccccucacccacucccaccuucagccugcagccccccgcaagaccccaggucuccgccauguggucccuucaucccaccuacccugcccugcucuuccacccucugggucaccaugggacaccuaaagaccuuaaugccaguagggauggcaauaauuaugguagcggaggugaaguaugcucaugugucuauggcuauuccuacuguaaauguauggugagcccauaagauaaauccuaagaaggauguauccgcuguccaccucccuggcaggaaggcucucacucuggcuacaugccuggaggguuuucuccacucccagaccagcagguggugagacccccacccauaucagcugucagagugucaccaacaugcccuuggaacugaacaagggaggcgcuaaacaggcggcaacuggauugcagcccuggaccuggccaggcagcgggcaccauuguguuggggccacucacccuggccccgcgugaugggcgccaccucccgggcggagggugagcggcaguggauccggccauccuccaggacgcucucagauuccgugaaguccucgaaggagcaguugacgccagcugagaggucaggcacguuccaggccugcagcacaagcugggcaggcagcaggaggcauggugagcaggguccccauggcugucccccaccccuuaccaccuggggugccacacuuacugggaccugggacauggugacagacacauugcggggcugcacagucagcugcacacacugcagcagguccgcagcaaagcgcuggggcucgucugcucgcucacaggcgucccgccgcgagcagcugcaggcagagggguugaggcugggcggauggggagaccuacggggcccgccugccaggcgggaccugggcagagaacucgggguggcuugcccugcaccaggcucccccucccccacugugagaccaccauggcccuccccgccugccccugcccaccugcccagacucacaugcugugcaggacacaccagccacagugggggucccgugaccccagacacagcucacaggacguguacugcacacagcucuccacaggcacccgcgucaccuggugugggggaggugucaggccccuccaguaccaccccagggguccuugaccauccucaccucugacucccuacucugcucuccuuaggcccggggaggcccugcacuuguucucagucuauucaaaggcagaucuggugacccugcccuggccaagccaggucgcacaggucaggccucugcccuggaaacccagggggcagcagccagagagaacaguccauauggggugagacaaucaaagaagcaccugcagcuucaaccagaguuccucuccaucugucuggacucccucccagcucugagcuuccccagcgaucaaugggcuuggcaggucccaauccuaagcuccaaugcaggcccagacaaugcucagaggggcaggcugggccccagcucacucuggcuccuuggcucagcccagcaucccagugcccacggaggcacgucccugagguccccaggaaggcagaaccccacugcgcccaggaggggcagaggaaaaacgagccagccagaaggggagggaggcuuggccucagcuggugugcccaaccuggccccaccugccccaucugcccacccuccagcugccacgagguuaccagguugggccauagggcagggguggacuccaggcaagccaggccagggacucaacuccauggccuuacagagcugggccaggcaccagguuggguagaccaggccagccacaggcccugugggcagacccacuggacagagacccagcccuaggccugaggacucaguggcccaguacacaccccaaacccuccagugacaccugccucugaaauugcucuccuucauacaucuguuucuguggucaggaagucaacaggggaggggugggaaugccaaacccagcccaggagaacauggaggcagcaaugaggcuguggggccccuggugaccagaccgguuccccugcagacccagccgagcccacaagucugcagggaggcagagcacagaccagcuugaaacuacuuuuaccaggagccauggacgcccaacuugugauguggccccaccccuacugcucugugacugggguuccugguaggagggcccccaccuucagccacaccgucugacuggugcagcacccaccugcuucucggucauggcguagagguacuggugguuggggcugaggacgaggucucgcaggauggggcugcccuccugggccacgacgcucucguaggccagggcaggccggccaccgggguuugagagguccaccaggaucugcggcagcaaggggcccuaacuggagcugugcugauaccucccugacccagccccaccccccacagaaggucaggggucuaaagccccucccugagcugcccagacaugcaugagcagagaggaccagcgccagccauacucacucuccacauccccagccccagccccagccccagccccagccccagugcagggcaaacucagaccccaacaggccagucugugauucagccccuuuaacagucagcagaggccagaagguauuggggccuggagacaaccacagcccagcacccaccacggagcagcauggccacacccagggugaaggcuacaggagucccacgggugccuagccaucccuggggccaggcugggcuuuugaaggagggauguugguugucgggggcagaggccagggcucacaggaagucuagggcaguggaccaggagacuccagaaugggguguccuaggggugggggcauccuggcaaggcaguggaggagggugggcgucucaucggcauggaaauguauuccagaucccaaacaaaccaggcguuaauuagccagcucuucuccgcagcucacgaugcugcaaguauuuuuaguugcuuuuaccaaacaaauguauuuaauuaacagagagacccacggggcuuuccagagaugggacucuuggggcgugucugcccagcucugaguccaggguaggcucucaggcugcgggcuguggccugcuucccccagccugacccacuccugcucccgcucuaccucuccacuuccaccucagggcaggggccuaggcccagacucaguaccccuccucuguguccucacuccucacgguuacagagcagggcagguccagggcagcagggcccagcgaaagcccugguuggaguccgauccaucaggccugggcugagggcggccagccaggguggggcgcuguguuucugagccaaagaggcugucggcugggagagggggagggccgcauuccugagcgccgccggccaccccccacauccgcucagcugccucgccaccaagcaggcuuaagucaaaccagacccggaagaguggagcccaaagcugggcaggggaagaggcggccaggaugggcccagcugcacuggcugcagggccauggcccacggccucugggaggagagaugcagggacagcgggcggcccaggagcaaccaggccacggccgcccagcaccccugccgguggggccuggacugcacccacacccgcaccaagugcacccgugccugccugcccugcagccacagcaggaguaggaguccuuguuuaagaugaccacuggcccaaggccugcccgacggacgcuuaggaugccagcaccacaaacccccugcuuugcucugggucaguggccagaggcagguacucagacccaggcggaugccagccaggaccagccucugggccacagugccuggguccaaaccucucucugccucccucagacagaguuguucugaggauuauaugagaaccaggccaggugugccaggcgggagcagggggacccaggguggccaggcccacagcaaucaccgcaccugcgcagccaaccacacauccaagccagcggcuuaagacagccaccagggagugggggaaggaaggcgaggagggcaggacacagacuggguggaggcuggggcagguaugcccagugcgcagaccugcggcuccaaccuggaagaccccgguuagggaccacgauuccucucaucuccuccauccucacaguccuguggauauccccagcggcuucccgcugugaagcccagccccagcucccccuccccuaccagcaccaggggauauggccccuggccccucuugccccugguagcagagccccuucagccugagcugauggacccuggcccggcaugcagggagcacuugagaggugucucaacaaggacaugacccaccuccccaacagccagggccacaugaugccggagccugacccuggcccggccugcaaggcauccacccacucaggguugggggcacaaaugucacaccaaggggugaagaaacgggucacagaagggcagguccagggggcacaccagcuccaaggaaaggaacggugggugaggggugcaaggaggggucccaggaagggaagaagccauaggagcuucuucuggagcugggccccaggcuccagaacgccccgcuccacccagcagcaugccgacuggacaguuggcucugacagcugcagccgggagcacacgcguccagcuguccauccgccauguacccaucuguccacccaccugccaccuccaccccuucacacacacaggcugggcccagggagacagagccccaggagaggccauggcauggccagugugagcggggcacuggggaggccacuacggcacagcacaccagaccagaggauggaugugacgcaggugcaggccccacacuguucacugaggcgccacgguccagacucagcagggccccugugcacccacacauguucuacagggcauccagcuaggacaaugguccccaggacaugugucuguguccuagccagaguucagggugaagggccugugcagccaagccagcuuuaucaaaccacacagacaggagguaagcugagacucacacagcaccugccagaggaaccuugggcccuggacccgcaacugcaccugggaggaguacagaggcugcucguaaagugggaagggggagccaguacccagcaggaggguauuccaggagaaccagagcacaggggcacagacggcaggugaaccuggggccagagcggguggcaggacagaagggcacacgccggccgggagcccacgugccgacgcccacacccuggccacagcuguccacuuucgggccacccgccuggaggcagcccacccucgagguggcugggcccagaagccccucccacagcagcugggcagcuggcagagcaaaugagaggcuugacgugucccgggcaugggaacgggccacaggcaugcccuggaaucuucccccagcugucaccuccuugcucugcaaaucuuuccccaaagaccaccagaaccuuccacaacuggccccaacagcccacccucccaccucccagcacaaaccaggagcuggcgcugcccaugcaugccgcccccugcuugagaggacccuccccuugacccaaggggcuucagcagagccagcagccucccuggauaugccccuuggcugcaccaggcccccacccaccccuggcuggcggaacacgggaugcccccaccugcuucugccuggaccaucuaacccugggguaccuguccuacaugcacacgggcgagucgacccugggcucggagccgagaccgaagugcagucccgaggccucucagugcccaggccacgccaggcauggcccucacuccuggacugagcaccucccaccaccacagggcucaucugacccuccccacagauaggccagggagcagguucaccccuuugcccccaggacacagcaggcagggcucaaugcaggccccaggcuggcccugcuggcuguacccacucccaucaccgccacagcccuggccaacugcugccggcgggcagcugagggcccggccaggucagcuguccaucccgcccagagccaacaaagggcccauucuccgggcugagggcaggcgggggugccgggaggaugucugggccacccaggcuaugugccaggaccggcacgcgccccagccgccgggaggcagggggcugcccggcuuggcccugaccuggcaaggggaguugcccaacucugccugccccaugauggcagccaggggccuggcccucccucuuucugugaggcggggaugcaccuguggagcugccuccgggccccagggcugggagaaggacaggacaagguggggacaggcaaagaccggggcagcagcuaaggaggugcccacacguggaggccucacacacuucucagccuuucugcagaggcagcugccaaacccguccccagccugagguggccccaggaagggcugcccgaggggcaggagccucugcugcccucucuucucaggacccccacagggugcagagcccaccugccccuccccuucccagccagaacugcacagcugagguaggccccagcggacccacucccagacccuccucaccccucacaggacugcccccuccuccagcuguggacagguucuaggccuccuuccuggguccccaccacucucagaaaggccaggaggaacuugauacuggaaaagcaauuagcaauuuccucuuggcaguaauuggguaauuaaaacaggauuugcaggaagcccgagggcuggaaucaggccagacacaccugucgggggagagaguguccuaggaaucccaucucuuccacccccaacccccagcacacagggagagcagagacugaggucaggguccuggcaggugaaggacagccagggcugccuuagacaggcuccagccugccccagcagcaaccccucagcaaggaguggaccuccccaaccccuggucucaucugccaacauccaccucacagagcugugugagaauucaggaguucaugguuccaaaggggaagugcuuggcccugcuguggggcagaugugcacagcugccuggggaaccuagcacccagcuggugaggccacaccugguggggccaccgugaaccaccauagacugcaccaccucagucacauaccacugccugggcuccgggcuaaccuggggcuuggccagagucuccgccacagccaggcugucaccagcacggguccuguggggacacaggcagcagggaccaucugccccagugucuucccucaaacccaccagcugccuggugcccucucuccuccauccugugaccucaaugccaccuccagcucugacccuagugccaccccauggcccugggcccucaaagacccacaucagcaccuaccccccauccagcugguccagccaccuucucuggugaagugacccaccacacaagcauagugugcccgaggcagccccugaaaccccaaaaggcacaguacgcuucccagcauccacggggggcaccucugagcuuuggcccuccuguuccuuguccccagaacacccuuccagcagaccacccaguccccuggguuguuccagccuccauacccacugcacgcugccagcaccuccuacaucguggucucugcugugguugggaccacaggccccaugugccugugggggaaggcgacugcccgguguggauacucacaaggcugccccugccaggcuggccaugagcccgagcacacacaggacggcauggggaagccacugcugccuccaccuuaucaaugguguugacgggcccgugcccuggcuuaggccugacuggcuuagggcucuccgugagugccccauggguggcccugccagccacugggaagcagaagcgaugcuuaugcacccucgcacaccaccagcucugggacggcacucaucaugcccacagggcaaacagcaggucgcucccugcauccucauggcucagcccacaguggccaacuacauccaggagaggcggaaagggggcgggcacacgcucaccaggaagcacagaugucggcagguuaccgugcagggccccgugaaggggacugggacugcuggccugggcgggcaguggcagcacacacucaggccccacagagagcagccaugacaggcagcuggcucugccccaucccaccaagacuaccagugggggcacagcaaagacggacccgguggccugccccagagcaccugccucaugcccauugaccccacaugcugccgggcacugccacaggccgccaccaaguccuucagcagcagcagagguggucccagagaguuaaggcagaacaacaacagaggcuccacagccuugcucccaggcugaaaccccaaagaaauccauccuucugccacaggaauccacacacagccaugcuuacaacaggccugcaaggacuggcaacaccauggccauccagagugggcaggaugcacaggcaugugugcuugaaacacgcaacaugaggacauggcacgcaccacagcugcccacaguaaggaagagucuugccaagcaaaagaugaugacucaaccccagagcccacauagcagcacacagcgucaaaggagccagccagggcggucacccugggaagggaaggaccaggaggggcugccggggaugguaggugccuaugcucucccgugacacacccccaaugcacgcuuccaugugugucacuuccauguggcgucugucacaggcugaccaugcagggcacaggacccuccugcaggcucgggagugggcugcaugcugcaggugcaaggggcacguccccaaagaacgccaacagugcagcacaggcuguaccugggaaugacuguaggcuucaagggcaagucauugaaaucaacuccccuugucccucccucaacaacacacaagaugaaacucaauggugggggacagcagccucuccacggcuaaggggcugggggcucaguccugcccugcaccucccuugggucagggcugccuguggccagcacacuucuugcccccccagcuccagcucuuucaggacggucuccuaccacaucccuggcacagacccuggacagggaggcucacuacagaccugaagaggcucaagcugccaaccccacagugggcaccugccaccaacugccuugcacuugcgugggcugugagaugccacucaacuuccagaacuuacaaauuccaaaauccugccugggguccggggguaugaggggagugcaaagaggccucuaaagcaugcugaaagcuucuagagcaguggggccucuagggggcagguguuccuuguccccaggcagcccaggcacacagcaggugcccagcugucugcagagaggaagauggccgggcggaggacaccucccacgcugcgcagggcuccagaggcuucgcuccagcuccaggccccgcaggccaccauucccgaagcucagggauggcaacuaaugccacaggccuccuaagcacuucagagacccagcugcugcagguuccaccacugggaaccccuaggagugcugaagaaugguggggaccaggaaagcugcaggaggugcugcagcaugaguccugagggcccaugagcacagggacaggggccagccaggccaggacgcacacagggaacugcagcugcagccucugugcagggaccgccacagggagaugcugugauggcucaucggggucagcuccagaaggaacuucaagccccaagccucccugggguaugcccagaugcacccaacauccagggaaggaaaccaaggccccagaggauggggcuucaccagggccaugccucagagcccagguggguggcuucccuaagcuacucaaggccacagugcaggucccugggccacaaacugguggccaaagggaugcuugaguugguccuguuauacucucuuacaacguggauuuaauaaccaagagaucucacacaaaauacagguuuccagaaucuugaaaaaccgggugcucaggcagucaggccuacauucccugaaugggcaggcugggccucagccaggggcuggcuccuuuugccccgcagcagcagcaggaccagagcagggcuggccucgggugcccgucagccggcccacagggcaaggcucuccccagcuuccucuguagggggacagcacccgcucugcaggaggccggggccugugcucuccccucccauggggguacuugggcugaugcuacaggacccaaaacaggggcugcuccugugagcuccugacauggcccgggguccccagaggccacgggaggagcugggagcagggcgcaggaaguucgcugagagaggcaccccagggggagaggcugccugugugggugcagagcaggugccaggcagggcucuggugaaaggaggggggacaggggcacccccagucagccccauagccgaaguuggcaggucuuaaauuaaucagcuacaauuucacaccccaacaguuugacaggaacuggcccggggccagccaagucccuggagcuccccagacacuuuuuaaagcccggaaaagacuggccugggaaagacagggagugguaagccuggcaggccugccccugggucaagcgugggcuggggguccccagggcccagcuccaggagaccaagugaagaaggcaggaggcggggcccugugcucugagagcacagccaggccagcugccucagggaaggagaagcccuaugugaacaggcaggagggagccccggggcccggccucucccaaggcccugagagcaagaaggaggcagggcagcccaggggccgggcucagcauggcccuccuuacccuggcucuggacccuggaccacagccagccccacacacagguugggucagcaugacaaggagagacgaggagaagugaaguucugcugcccccgggccaggccaaguagaggccuguguggccagcggggagcaagcauccuucacaguggagcaaggccagaggccucgcacuggagucugcaggacauaacagagccaaggcaagcagaguaggacucgaacccaggccccagaacaagugaggguagaucuccuccuccuggccccucaccccaaacccagggcacccucugcccauguggccuguggugggaaguuaggcuuugaaggucccacgguaacuagggaacaagggaggcagagcggauggaacaggcagccaccccaaaaugcacccacagcagcagcacucccagccaggucggagggcaggagcuagccagacagccagggucuuggacuguaacacaggugggaguggguggcaaggggcuccucagagagggggucacugaggaaggggccuagcucucaaggcuagcagagaacucugcccagccuccuccaaggaaccgcagaaagggagggaagagccagcagcccugagcaccugccuugagcacucaguuuccccaccugucaaacagaugacaggcugcuaugaggccucuguagggugcaggcgcauggucaacacucaucacacaccccaggccacacgagcaugccagguccgcaugguacgaggagacaccaaggcucagagaggcuggacggcuugcucaaggccacacaaugggcaaggagagggcugggacccacaaugacaugcagcauuugcaugacguugagguucaaaaacccugcacgggacaugcccagcugcuggacaguuugagagcagguggauuugggugaaagaguacaggcggcagguucuucaccaacaugaccgugucugcauccagggggacaaagcagaggcgugccuugccugggggggccuccgaacaaaacucagacccaaguccccgacugcagacucugccaggccagcaaccccugggcacagcugaccccagaugcucccaaagggugccacucacacauggcccacggcacccagcccagacuuguuuggggguggagggaggcgguacccagguugggugcugggaggcagguaugggcaccuagagccucugaggagaacuuggggcucugaggggugggggcccggccagggucaccaggaaggaacuagccaugucaggccaugaggacgcagccuccaccuucccagcugcaccauccagcagcugcccacaaagccaggcucaaggaggcaccuggcccagggagcagaggacaggcuccacccauaccugccucccugagaacgguccuccuugggacuaggggugggaaggggaaaauugggagaaggaaugggggcaggaagaaggggaagaguugguagaaucucaacccagaagcagccucuucccauagaugggcccaagcccaacucugcaguucccuguucuguaccucaguuucccucugugggacuggggugaggaggcaggggagacaggccaacuggcacccagaggaacagcuguguccugcugcucccucagcaaagcucugacccaaacggugccccuggggcacaagagggugagugcugggcagcaggaacaggguagggcuagaggaaccuggucacuggcuggguaacaggcucuggggcgccccacaaaaugucucuaagcugcugcacugggcuuccacacaagcacgguccucugucuggcaaaacccacuccaacacccaccccaugcgcucgagagcccugugugccuuccagugugaggagagggagugcaggcugagaggacgggaggggccucgcaccagagccacagggcgguaccccacaugggggccaagagggaagucacagcagaggacccaacucaggggucacaggacuuuccccaucagcuucagccucauagccacuaugagcagaaccagcaggaccccagggcacccccacccuggggggccuacaaucagcagcugggcccccacgggccccaagaccaccagcaccccccgcccccagcccagagccugaacaucuggcuuauuucacagagggaagcugaggcugcaggggauccccucccagagaucacagagccagggaggggcaggacuccccaccacucccagggcaacuaccauggcagagaugggaggcccccuuccuaacacugggcaccgggcugagagcugcaagcccuggccagcccccggcccagccccacucgcgggcacacaugggcucaggggagcugcaucggcaccagccucuggugccgguuaugcaccccaggacccaccacugcccacugggccucugggguguccaaguauccccacccuucagucucuccgggagcuuccuccacaccaggccagccuggugcccaccccagcccaggcagcuccccuccacccacacccuccaggaagcucugcacugccucuguccagcccacuguucuggggaaggaaaggagaacccugaagaccagacagccaucccuguagcaccuagcccucccccugccaccguggggccagcccagggcugugugcuggagcuccucaagcaccagccaaagacaggcaggggcacuacccuugcccugcccuuggcccaguagaggggcuggggagaggcagggccaaggccucuggcccggcagagugcugaggcagcagacacuggaucuccuggcuggggagcagggcccagaggggagggggccgcgcaggccugcccucaccacccacacacagcagccuccccaggaggucaagugcccuuggagagccagcccccgccucagcaucccugggccccugcacaggcuccugcguggucucaaaguguccuugcuuagugggccuggggccagucaugggcagaggcacagaggggaguggggcccuucaaggucacugggccuaguguagggcaacauucccccugcccccuguacgccagaucuagccucccacagcauacagcagcacugggccugccaccugggacggccgcaagccuuuguuccugccccaagcccccuccucaccccaccccacccaggccugaccuugcggaugcggccacuucgcgugccggcgaauaccacagugcggccccgauagucauaggcagccacggcggucaggccaucauccuuguccacgaacaggggcguccccucaauggugacugugccccccaggggcugguugaaguccugcccgcagaagucgucaucgaucugcaggggcugugggaaggggcagggugagagccacuccccgggcaccuucucccggaggacugggccucccugggcagggcugggagugcaguugucuuucuagagagguuggggguagcccccagaggagaggugcagacagagaggguuuaagacaggagggagcagaucacaccugaaaggcagagggcgggcucccagcuaagagcacgagaaagcaaucaauagcuugagguuccggagcagcugggggccaguguggagggggcgcugcuccaccgccaggccuaaggagagggcagggcaggcagggaagggauguggggagaaguggggcagaugguccuugucugcagaggguucauuggcaggggccaggcugcucaggaggaaggagcaggggaggcugggccagggcuaggccacauggaaugaacaggugggagggggcaguggggacuguccccagggaugaaagagcaggccccagccuuggggcagggcacaaagagagagugugguggggcuucacccaggcucugccccuacaagccucagugucuccaucuguauggugcagagaaaacacguuccuugaaaagccaaggggaggguggacaaccgcaucugccaagcacacaugggcccugccucacacaggcagugagcgugagacggaaggacugaggggcccuugcagucccacucugcccugaggacaaaaccagcaacacccucaggucagacaugggagacuacagccagagagggcgaggccuuccccugcgauggccagcgacccccagcagcaagcccagaaggccuggccucgggggucccaggucugggccgagucccagccccuucacuuuccacccuaagcaaggcccgugcccucugagccugcccaggagugugaacaagacacucccugaaaggcagcgagauagaggccccaccccagcugugccuucugaugggugcugggggcuguggcucccugcagucagggucacuuucucugcaaguuguuaacuguggccugcaccaggacaccaucagcucccauugcugggcaaaagcagaggcccagcgggcaggugccaccagggucaugugggggacacaagcgcuccauggaaauggugucugggcucaccugauaggcucuggcaccagccucucacuugcugugugacccagggcaaguuaccccaccucucugauccuauaaccucauuuguaggauggggacaagauggagcaggcaagcaccagguguaggaccaggcauguggcuggcacucuguccagugucccacaggggcuguggacuaugccagcagggccucgucaccccaucuucugaggcacaagacagcaucauggcugggagcagccuuuggggcuagcacccuggguccaaacccacucucugggggauggaaaagggcagccccaccuagcugagccauggggauggccaagccaaaagccaggccaggcacacagcaggcaccacugggcgugcaucugacaccgaugccgucgucccuggaggggauggggccgcgggaggaggggcgccccugcccaacucaccgaguugaugcagcccagcuccuuguugagcagccacggcagggagagcuugcccucaccacgguagcaggacuggaugcgcuccuuaaucuucuccuugauggcccugagcgugaacaggcacagugcugacuccuuugguggcuucacgcgguucuucuggcccugggcgaacacagugaacagcacguccucguccucagccaggcccagcuggugggccagggcacggccgggccggcucagguaggcauccugcaccaggcgguacuccacacccgccugcucgcagccaauggggaacucaacguacgaguagaauuuggggucguccacacagagccgcacgaucuuggacgugaagaagugcucgccggcggcaucaggcgaggucagcugugugucuagcugcagcgugagguaguagacaaacugcucgcugcggaagcuguacacauaguagaugucaaaggccgggaacuuggacagcguguccgaagggaucuugagcugugaugacacaaacucauccugguacacgaagccgaacaugucggcauccuccucguuggccaugagccgacggcuggacaguguggggaaguacucggacuugccaucgaugggugugcccacgaagagcuuggccuggcccuggcccgguggcccggcaaugagcacgcccgccaugcugccugccuccugcacgcuggacagguagugcuccuuacggugguguggcucacccaguuugaagagaucguccagacgcaggaacuggcagaugcccugggaggcgcugccacaggccagcaggcgguuagcggcauaguccagcagcagcagcuuguugacguugucaguacugcccaggccgugggggcaggacugcacgcugggcggcggguagcacuucucguuguccuccacagggcccgugacgugggcccgcagcagugucagguuccccgacagcuuauagaugcgguucacugcgcccacauacaccucgccugucugcucaugcaccacuaggugggugaggccccagucgcuggccgagaaggugcggaaggggggcugugaacccccgccugcccugggcaagccugccucagcccacaugcccggcagcagcagcagcaacagcagcagcagcaggagcaccugcaggcuccgcgguggcagcggcauggcaggcuggggccuugggccucggugcucugguccugcuggggugagcaucauggugccaggagcuucagcccuggggaaggggcagaagagggcaugugaaugcaggcauggcccaucccaugauauuaugaucucccagugugagcccuuccagugcugggcgugcccacugcaccuccaggaggcagaaccugacccaccaggaggagccaggggcaaacugggcaccucccuggccugaggcccuauaagcuguggggugcaccagguauccccaggacaccuggcaagaggucacuccguuggcaccugugcccugccaucacuggcggaggccaggaacaggaaggcaggugacaagggccugagguguggaaugggaccccagcugacaccaacaucugacaccaaccuggagagcagccuucacccagagccucccuaugcacuggggagcaggacccuccccacagcucuguacucccagggugggcaccagcucccugccugaggcugguggggacauacuccaccaccguccccuacagaagcuugacauagaugggcuuuagugcucacucccaccuccacagcccugccucucccccgaacacgcccugacagcccacagcagaggcaccacggaggacauggaggcccaggccacacaggcagcaguucucacuguggauagguggcagccugggcugcucucggugggaccccaagccccaugcuggauaaaccuugagaccugcaguccagaagccaggcaaugugucccacccacauccccaccccagccgacgggugccccgccacacggccccuucccaggcucccuggcccaccagcccugacucucagcacucuauccaagccaccaguccugcucccagccucacacccaacuccaaggaaagaggaauuccuccacagggaaggcuggcaggugcucccugcacuccaccccuccacagugaccccuucccagccucagcaccccauacccacccagaccuguguggcccccuccugccuugcuccacaucgggcccucacuuccuggucacacucacuaccaagguccauugacuccaccccaaacuccacaaaaugcccaccccuccuuccuggauugccaggguacucggcucccuccacccacaaccaccuacagccaggucccuaugcagaggcuaaggccacucuucugaccugcacacgaggucagcgcugcccagauccuggcgggaguccccauauccuguccuggccuccacugccucuggaaaagucucaccacacccugccuagcaacuggcagccaagcacugggcuaaaucuagacccuguuacucuguaggcagaugacucugauggggacacucccuuuuccuagccucaguuuccccauuugcaaaaggggcaugaaagcucuuuucucauggaugaaagaggaaagggcacaccugcccacaaggcauagucagcagugccacccccuugguugucaguagggccugcugcccuggaugugccugaugugcuggggccucucacccacuccuggcuggagccggcuacagcaaggcugaguccugagucuugaguucaagccucagccagccaguuugcacagaccaucccagacaccccuuguauggucuggccccauuuuacagauggggaagcugaggccugaagauggaugccuucuccaagucuaccagggagcugggcacagucccaucagccucugugccuggugcccacaugcaguguggggcugccugccccucccccaggccucugugccccugucuccacuccccgcccugcucagucacccuguucucaucugcagcacaggacucgugaagggucucuauuacuuauugcucccauucucccggccagaauggcugcccugugagagcagggccuggcucugggugguugccacugcauccccaagccaagccagggacccaggaagacucaauaaauccccgugagugagcgaaugaaugaaggguaugcggagggccagccaggucugggugcggcagccccccaugcuucuucacuccuguuucacuccccacacacucccugcccagugugugcacagcacacacccacugcucagguggggaaaccgaggcucucagaagcaaagagcuuuggcuggaaucccagagcaggaacugcagggugcuccuagcaggcugccagcugccuuugccggacagcgccccaagaacagcaggggaggaguccccacucccgcccccgccucagagcucaaggaagacccgggagccagaaaacaggcuccucacaguggcaguggggccggggcugggagcugagcacaugugaacuccaaagaaaacaugaaucacucaccguuuaucaguucaaagcaggccugcaauuaccaggggcugggcucuccccuccucugggauaauuauacacgucuuaaugcaauuaugggcccuacuuuuuguauucaacaggagggaccaggcuaagaagccaccauccaaacuccagccuggucuugggcccaccgccccaaacuccacccucaccccacugccccaacaaagucugcugggaagggacuugccuggggucacaggguugccggccaagaaagggggagccccgagccuagggcugggucccucaugcccagcaucuaauaaaggccagugacaaugcuugggccacuucuuccaccuuagggguauaagacuuggggcucagacucaaggucacccaacuagucccagcagggcagggcccaaauuucgagcuuccagagacuggaccagccagccagccugcagggcucaacucucauaggcuugggucugccuaggaaaaaaugcauucauuccaaagcugggcccaggugccagggugccaggggcccaugccggggcuaggaggggagcaugggcagaugcugcacucuaccgaggagcagagcuggccacuguggccggggaaaggccucaagagaggaccagguagccugggagcuggugcaggagggugggcauucgugguggggguggggggcagaacaggaggagcaaaggccuggggugggaaacacuggcugugcagagggcaguaggaacggcuguggcucuccggcauggccagagcuguucuaggcugaggcagagccagagccagggcaggggaggcuagacuggccuugggaugccgauggggcuagccagggagagagaggcggagagagaccccgcggucugcgugcaggagccccagcccaggggcuccucuccuggacaggaggggaucgccgccugguggaacgccaagccaacaguguccccuucccuuuccuggccugagugacaccaaagcuccuucucacccugagaaacaaaggcccccaaagcccuccccacaaggaagaguccaauccccccaaguccuccugcgccagauccugcuauggcucaggcagguugggguguggggcugccauccugcccaguggcucacaacagcagccgggggggaagacagcugcuccuggcacuccgccucccccacaacgggggucaugggagguggucccagugguucugcucccgaccaguccuaggggauccggcucugaaggccuuggaguccugcuccugagaaaaagugccuaccuuugcaggccuuccccuggggcacccgcuccucccggccagcugcucuaagcugcucugugcacgggggcuuuccugggggcucaaaacaggcaggcaacgaccuuggggggccaggaguccagcaaagggcugucugcuuuguccacaggcaccucaugugucccccacccccagagcacacacugaggccacaaacccaggccuccgcccaugcuguccucugcccaaaacgcccuuccugggccccacuggcaccccccaggaauggaagccuggcccugcagcgaaucacugguucacaugccugccucuggcagggggcugggugcuccucaagggccgggcagcaucuuggugccccuggugcagcaccuggccucugccgcacaccccaagccgcaggaaaucgaggggaccugaggcaagcuccucaagggcccggggagcagaaacugcgccccaucccugcaccgacccccaaaccggcuacgugugaaaggagauggggcagcacggagcagccugagccacaggagccgcgcugaggggacagaggcucgaccacguccccuccccggcacacacaccccuuucuuucaaggggcguggccccagaaccccacacaggagccuggggcagaucgccgcccggggccgccccucggagccccuccccuccuuuccagggcugcaccugggaccucacgccgaccgaggggccucccuggaguccccacucccccuuccccuggcagcccgggaucggcccgcugccuccagcuucgccgcacaucaggcccgggacuauccaggaagcaaucggaagccuccgggagaagcggcugacccuggagaggccccgagagggggaggccaaggaggcccgagcggggcggccuccugggcggcacccagagcccaccuccccgcacuccgggccagugggagcgguggcagcuguggucgggaagccgcuccaacuuccaccccgcgccccagggccggccgggggcuuagccugcacgaccuccuccggcccccgcggcccugcugggaggcuccgaucccuauccgggccuggccaccccguccucgcccgcggccagaggucugagccgagguccagcggccgggacgggccuggacaccgcaggggccuccccgcggggccgccgcaaacuuucuccccagccuccguggaggggcagcgcccgccccccgccaccccggagcugccgcggggcucggcgggcccggccggggggcgggggaggccgcggcgcuggaucccgggccgcggucccagccccgccgcacgggggugcggucucuccgcgucggcgccgcgaccgcgcccggacacacgcggacgccugggccggagccgcagggacacgcgggccgcggacacgcgcgccgcaguccccacgcgcgccgcaguccccgcgcacacccccugccugccgccucacgagagggccgccgccggaggccgccccgcgcccacccacgggccgcccggccccggaccccagcccggcccggcccccgcccaccgucccgcgccgcggggaaaguugcgccccgacucacccgccgccccggggcgcgccccgccgccggccaucgccgcgcccagccgcccgcgccgccgccgccguccgccccgccgcggggccgccgaagccgcguaggccgcccaggccgaggccgccgccgcgcccgggcuccgcugcguggccgcgcagccgaugcccagcaugaauggggcgccgagcgccgcgcggcugcggaccggccucgcucucgccgcccgcggagcc

SEQ ID NO: 14783 - RNA, 1110 nt, Homo sapiens
augaugggauuaaucauuuuaaaaaggauaugcucaucuuaagagacauuaugcauuacugaauaauuagggauuuauuguccuucucccacauggauguucagacuuugaucauucauuuuucaguacugacuagcacugaaggacugaugguggcauagccauuguccaccagcaucuggacucgaugacggacuggaucacuguuccacaccaguccugagcaggaggcgacaacacaguccaaaacauacacaaucacaaagcaacucacgagcagaagaauggucugcguggccauuuuuucugggggugcuuuuggagaaagguuggugcugugaaaaugcugggacugccuguuacgccuggacaagagaaucaccauguauccacuggaggggggccgugagcccugcaagggagacauccugaaaugucaucagugugaaaauugucugcucaaggaagcaacucaggaucccagcagagcaggauugagugacaaauguaaggcuauuugaggccagauuuuugaugggaagaguggagacuaagaagcugucacuaauggauauguggaagacccauaggaagagaaagcaacgugguuggugaugugagaaucuuugaacacugccaaacaggagcuucuggggcugcaggugauggccgggaggauacucagcaggcaggugguggaaauggagaggccucucaucaaccuguaccuguagauaacugacuuauguuugaugucauccucugaauccugagacccaaaaauaucuguagcuaugaacucuguggguagcagcaauaugauauggauuagagccacaugacaaacgaucaggucagcgggcuugguccugugcuugagaaggcacgugaggauguggaagagaaggagcauggcauuggcagagaucccaaugccgacuucagagaaagcagcauuucuuauggcuaugaaacuggaagguuuguuguuuuuauucaucuuauggggaaaauaagcacauagugaaugucuaagaagaaaagcaagaaaaauucuuuauuacaaauauuaccacuucuuucaaucucaaccaacauuauugccaucau

SEQ ID NO: 14784 - RNA, 1110 nt, Homo sapiens
augauggcaauaauguugguugagauugaaagaagugguaauauuuguaauaaagaauuuuucuugcuuuucuucuuagacauucacuaugugcuuauuuuccccauaagaugaauaaaaacaacaaaccuuccaguuucauagccauaagaaaugcugcuuucucugaagucggcauugggaucucugccaaugccaugcuccuucucuuccacauccucacgugccuucucaagcacaggaccaagcccgcugaccugaucguuugucauguggcucuaauccauaucauauugcugcuacccacagaguucauagcuacagauauuuuugggucucaggauucagaggaugacaucaaacauaagucaguuaucuacagguacagguugaugagaggccucuccauuuccaccaccugccugcugaguauccucccggccaucaccugcagccccagaagcuccuguuuggcaguguucaaagauucucacaucaccaaccacguugcuuucucuuccuaugggucuuccacauauccauuagugacagcuucuuagucuccacucuucccaucaaaaaucuggccucaaauagccuuacauuugucacucaauccugcucugcugggauccugaguugcuuccuugagcagacaauuuucacacugaugacauuucaggaugucucccuugcagggcucacggccccccuccaguggauacauggugauucucuuguccaggcguaacaggcagucccagcauuuucacagcaccaaccuuucuccaaaagcacccccagaaaaaauggccacgcagaccauucuucugcucgugaguugcuuugugauuguguauguuuuggacuguguugucgccuccugcucaggacugguguggaacagugauccaguccgucaucgaguccagaugcugguggacaauggcuaugccaccaucaguccuucagugcuagucaguacugaaaaaugaaugaucaaagucugaacauccaugugggagaaggacaauaaaucccuaauuauucaguaaugcauaaugucucuuaagaugagcauauccuuuuuaaaaugauuaaucccaucau

SEQ ID NO: 14785 - RNA, 936 nt, Homo sapiens
auuagggauuuauuguccuucucccacauggauguucagacuuugaucauucauuuuucaguacugacuagcacugaaggacugaugguggcauagccauuguccaccagcaucuggacucgaugacggacuggaucacuguuccacaccaguccugagcaggaggcgacaacacaguccaaaacauacacaaucacaaagcaacucacgagcagaagaauggucugcguggccauuuuuucugggggugcuuuuggagaaagguuggugcugugaaaaugcugggacugccuguuacgccuggacaagagaaucaccauguauccacuggaggggggccgugagcccugcaagggagacauccugaaaugucaucagugugaaaauugucugcucaaggaagcaacucaggaucccagcagagcaggauugagugacaaauguaaggcuauuugaggccagauuuuugaugggaagaguggagacuaagaagcugucacuaauggauauguggaagacccauaggaagagaaagcaacgugguuggugaugugagaaucuuugaacacugccaaacaggagcuucuggggcugcaggugauggccgggaggauacucagcaggcaggugguggaaauggagaggccucucaucaaccuguaccuguagauaacugacuuauguuugaugucauccucugaauccugagacccaaaaauaucuguagcuaugaacucuguggguagcagcaauaugauauggauuagagccacaugacaaacgaucaggucagcgggcuugguccugugcuugagaaggcacgugaggauguggaagagaaggagcauggcauuggcagagaucccaaugccgacuucagagaaagcagcauuucuuauggcuaugaaacuggaagguuuguuguuuuuauucauc

SEQ ID NO: 14786 - RNA, 954 nt, Homo sapiens
auuaugcauuacugaauaauuagggauuuauuguccuucucccacauggauguucagacuuugaucauucauuuuucaguacugacuagcacugaaggacugaugguggcauagccauuguccaccagcaucuggacucgaugacggacuggaucacuguuccacaccaguccugagcaggaggcgacaacacaguccaaaacauacacaaucacaaagcaacucacgagcagaagaauggucugcguggccauuuuuucugggggugcuuuuggagaaagguuggugcugugaaaaugcugggacugccuguuacgccuggacaagagaaucaccauguauccacuggaggggggccgugagcccugcaagggagacauccugaaaugucaucagugugaaaauugucugcucaaggaagcaacucaggaucccagcagagcaggauugagugacaaauguaaggcuauuugaggccagauuuuugaugggaagaguggagacuaagaagcugucacuaauggauauguggaagacccauaggaagagaaagcaacgugguuggugaugugagaaucuuugaacacugccaaacaggagcuucuggggcugcaggugauggccgggaggauacucagcaggcaggugguggaaauggagaggccucucaucaaccuguaccuguagauaacugacuuauguuugaugucauccucugaauccugagacccaaaaauaucuguagcuaugaacucuguggguagcagcaauaugauauggauuagagccacaugacaaacgaucaggucagcgggcuugguccugugcuugagaaggcacgugaggauguggaagagaaggagcauggcauuggcagagaucccaaugccgacuucagagaaagcagcauuucuuauggcuaugaaacuggaagguuuguuguuuuuauucauc

SEQ ID NO: 14787 - RNA, 39146 nt, Homo sapiens
ggcggcguccgcgcacgcgcgguuccgagccggacucuacgccggggcuuggcgcggaucgcgucccggggcggcgcacgcacaccugggcggggcgcgggcagcucugcguccgaagcugcuccgacgccgucgcugggaccaagauggaccucccggcgcugcuccccgccccgacugcgcgcggagggcaacauggcggcggccccggcccgcuccgccgagccccagcgccgcucggcgcgagccccgcgcgccgccgccugcuacuggugcggggcccugaagauggcgggcccggggcgcggcccggggaggccuccgggccaagcccgccgcccgccgaggacgacagcgacggcgacucuuucuuggugcugcuggaagugccgcacggcggcgcugccgccgaggcugccggaucacaggaggccgagccuggcucccgugucaaccuggcgagccgccccgagcagggccccagcggcccggccgccccccccggcccuggcguagccccggcgggcgccgucaccaucagcagccaggaccugcuggugcgucucgaccgcggcguccucgcgcugucugcgccgcccggccccgcaaccgcgggcgccgccgcuccccgccgcgcgccccaggccuccggccccagcacgcccggcuaccgcugccccgagccgcagugcgcgcuggccuucgccaagaagcaccagcucaaggugcaccugcucacgcacggcggcggucagggccggcggcccuucaagugcccacuggagggcugugguugggccuucacaacguccuacaagcucaagcggcaccugcagucgcacgacaagcugcggcccuucggcuguccagugggcggcuguggcaagaaguucacuacggucuauaaccucaaggcgcacaugaagggccacgagcaggagagccuguucaagugcgaggugugcgccgagcgcuuccccacgcacgccaagcucagcucccaccagcgcagccacuucgagcccgagcgcccuuacaagugugacuuucccgguaaccgcgcucucgggggcgggcgggcugcgcgguguugcaggcaggucuggggugccacguccgccccacagaggggccugccagaccuuagcaagccggggacgcaggcucuucgggauuuguauucuagcuccuuccaugucauucgauuugagaucuuggcccugcccugccgcagggauuccgauggcagguagcgcagaucaccacagcugcgcuucccaaagguggcggcaacagauauccuuaaccugcuugugcuugaugaaagcggcacgcaucuucacagaguggcacggagcuaugugucaggucuuuauuuuccucagucucgucauuuguuuacggggugcacacuccgugcuagaggagcagagaugaauguggccagauucaggaccuuaacacgcugggaggauagccacaggugugcgcacauccuggcuuuuuuugccuuuugcacuuugauuuccguugaaccucacaguuuugugaaguuuuaaaaauuagccgucugugaagguuaaaaacuguccucuuuuacagaugaagagacagaggccgagccuuguggauaaaguccacugcugguggcugggcgcgguggcucacgccuguaaucccagcacuuugggaggccgaggcgggcggauuacgaggucaggagaucgagaccauccuggcuaacacggugaaaccccgucucuauuaaaacuacaaaaaauuagccgggcgugguagcgggcgccuguagucccagcuacucgggaggcugaggcaggagaauggugugaaccccagagacggagcuugcagugagccgagaucgcgccacugcauuccagccggggcgacagagcgagacaccgucucaaaaaaaaaaaaaaaaaaaaguccacugccuguucuuucuccuguguguugaccugcaguuguugggaauguaggacuccaacacagugagcucuucaccaggaugggcagcuuucccugcuuucacagggauaggguuccuccagaagggcaagaaaggauuccucccuggaaaggcagaagaauggagucggcuggguggcagagcccagguggggauuguggucuguggugagggcccaggaggaaggaccagucauucaaacagaaacuggaaugugugccuagcaugccccuaaccuguauaugcacacggcucuccuuauaauguccuuaaacaagaauuuuuaaaggaugagaugagaauuaugaacggguuuuauuauuuuuucccucgcauaugccuguggacugucuugcgcauuccucuucagagagaauguggcuugaggccacuagcucaaagucuuuuucagucauacacucuugggaaucugaugguggcuguagacccuuucccugcuaaaagaguaucauucuguguaugacacugggaaggucagggaucccgccugcuuccaggcaugaggucucuugaggguuuuguguuggcugauccaugaggcuucuuguguugagaugagauuagaugguuagaugagauuagauguuuagaagcaggagcaggaccagggaagcaucaucaaagggcccagaccugaguuuucugaaggccugagccagggagugggaaugaugagggucucuagcaggugagauugcagagggagaaccaaaggguguaauuaucuaugggggugugggggguucuugccaaggcagagagagucuguguucagauuuacaugaccaagugugugaacacaccgaagcccaaaauacccuggagguauuuugggaccagauugaggccaaagaucagcauuucugaguuagauguugcuggggaaaguaggguuccuugggcugauacuuuugggcagugcuaugccauguacaucuguguggcaguucauaggcaugauaguaucucguuaaaggcuccaagaggagcugcagcaaagacuccuguuaaacauccugcagccucauguuuuccacccuguuggagcccugaauguuucugucggaggagaaguauugcuguggaauuguugaggcuuagcugcuuuggccagggguuaggauugaggugaagauuacaaagcagggaaccuaaggaaauugcgaaaggaaaaagaauccaaacagcaagggacagggcuggcaguuggagggugucagggaggaaauuuggauauguagaggaugcagcaucacccccaaggggugaaaaauccuggcuaguaggaugauuuguagccuuucaaagaucaacccuaccagacaaaaucuuguuccuuaguauuugauuucucucaugggguucuugggucucagugugugugcaggaucagugcuccggagccggccaguagauggcugugaacggaggacuuucucuuuaucgguugcuccaucuccaagucauguugcaacagguggccagcgugugccuauuggcugccauuagcugccuuccuguggugaucacaaagccaagcauuaauggucuucccuuuuuagagagugcuucugagucauguuuucccuugucugcuucagugugaacagggucuggugggugugacuagcauuagcuauguuguauaauuuuugccacgcuuugagcaggguuuguguuuuccuuguucaggcugugagaagacauuuaucacagugagugcccuguuuucccauaaccgagcccacuucagggaacaagagcucuuuuccugcuccuuuccugggugcagcaagcaguaugauaaagccugucggcugaaaauucaccugcggagccauacagguaaugagcuagggaacgcacagcauuuggacccaagauuugucuucaucguagcuguuggaguuguaaauuuuaugcuguauaauuuuuucuuuuauaaggugaaagaccauuuauuugugacucugacagcuguggcuggaccuucaccagcauguccaaacuucuaaggcacagaagguaauccuuacauuuugguuugcauuaucagguuugaaaaugagugguuugucagcagcagaaaccaaugaaugaaauaucuguagacauuuuuuaaguuguuaaaaaaggagcucaguguugaugauuuggaaaauucagaaaacuguaaaaagaaaauugcucagaaucucaucaccugaagucaguuuuuucuguguauacuuuuuuuaaaaaaagcuaaauuggcauacucuguucuuaaaaaaaaaacaauuccagguuuuuuuuuuaacuuaacauuguagaauaagcuuucuucauguaauuacaaguuuucauggugguaaugacaacccuggagacuguguccaggugacacucagcacuuuacaugugugucuucuaccuucccaacaaccucaaagcuaauguucuuauucucccuguuuuacagugagacucggagagauucagugguuuuucuguacuugcacagcugggcucugaggauuuaauauaaaaaugucacuuaggaaaagacacagucuuuacaaguuggcuuaagagaguccuuuuggcauugcagcugaugcucugugcacauuucucacgaccgucugucgcucggaaagcuuguugaucauugggguuucuaaacaauagaaacaccuucaucaauacauuugggacuccacuguucuuagauuagcuuauauuagauugaaguagcauuaauuguuugaugugugacucuggggucagcuuagucauuaaaguagaauuuuuaugggguagcuaaauugcaaaucugcucacauggauuaaagacagaauuaagauuuuccgaaauguacugaucauuuuuguaaaugcaaaguuuguguuuugguauguuuuguagaauuuuaaagaauuauggugaguugugugaggaaucacagcuccuuuauuuuucugucuggcaggaaacaugacgaugaccggagguuuaccugcccugucgagggcugugggaaaucauucaccagagcagagcaucugaaaggccacagcauaacccaccuaggcacaaagccguucgaguguccuguggaagguagauuuuaaaacauugcuuugagcaguaaacuaagugcaaugccaacauuuauccuguuaaguuuccguuguuuaaagguaaauguuagcugcuuaaagacugacucaauauaaguugcagcauuauguuuacuuaccucauugaguuaauuguacuauuuugggagcagugacuugagaaucagacgcaguuugacucauggcccugauccucauuagaucuguggcucuaguuaaguuaccuguuuaauuugguggucgugaggauuaggugaaauguggaaaaugccuguuuauccaucuggcauggagcucggacucaguaaaugguagguacuuuugagaucacguuugaauugucacuccaaucauuuuguaauuggagagcaguaaagcuagacugacuuuuucuuuuuuuguuuaauuuuugagacagucuugcucugucacccaggcuggaugcaauggugugaucuuggcucauugcaaccucugccucccagguuuaagugauucuuaugccucagccuucugaguagcugggacuacaggcguaugccaccacgcuuggcugauuuuuaugcuuuuaguagagacaggguuucaccauguuggccaggauggucucaaacuccugacgucaagugauccacccacuuuggccucccaaagugcugggauuacaggugugagccaccacgcccaaccugacuuuuuaaaagguauaguagagugguuuuuuccuuuaaaacacugaaggcucaguucauuugccagaaauuggcugcgugaccugugcgugacuugugcgugcuggcccuacucuaguucugcaggugcacugggaggcagugagccaggacacgucggguggucauggauucaaagucuggcucuaccgcucccuaaagugguggccucagucaagcugcuucucugggccuugguuuccuuaccuggaagagagaauaauaaagacccauuuaaagcugagccuagcucuuagaacauaaugaacauauauacaagugguguaacugagaaacaguuccuccuuccgucagaguuucagcuggaggugcagacaggggaacagguaacauguagggugcugcaggggcgcagagaguuuccccagaccggggugagaacggccucgcggucagcugaagaagaggggagagcaccagacacgugcguguggguguuggaggcggaguggccugggagagccucucagggccaggaguggcaggcuugagugcuugggugagcguaugaugucaucauguuugaguuguggcuuagccuggcuucaggauugaaagcagccagggguguggggaggugggauggccuggacgggggccuuaacagugggaaaagagaaaggggcaucaauagcagaggugggaguuagaagucacaguauauggugauggauuuggauuuuaguugaugucagugugucagcugaguggauuuggaggaagcagaguuugguuuggacauguuguguuuuugguacccuugugcgucuaaugcgcagagggcaggggaugugccacuggugcuggggagagcaggccaggcagggagcgaagcagacagcacccgaaucaucauuuaagccacaaaaguggaugaaauucucaaagaagaguauaaauggaggagagucaggguaguguaguugaucaaaagccugaauucuggagucagacugccuggauucgaguccuaaguuugccacguaaguaggucuggggccucggacaaacacuugaagcucucugugccucuuccuuaucuguaaagugaauaaaaccucccaggguuguugagaaggcuggauugguuacuaaguuuagcgcauauggaaaacaucaguauauaugucaguuacugucguuguugugauugcuguuagauuuucuuaaaaaggaccuaggacagagcccuggggcugccccagauuccgguggaguggcugggacggguacuggcaggaccagcaacagcacaguggggguggugcugaggugaguggggaauguguggaagugggggucaccuggagugcuagggugagccaggaccagggaacacaugccucggugccaccugcgggguugucuuggugugcugauggaugagguuccgugggucacucaggcagaguccugcucuggugcccugagagguggccugagugggagauggggaugguuugugcugacacuucugccagaggugacuggggaaaggggaaaggugggaguuggccguggaggauagggcauuuguuucuguagagcucuguuucuuccagcaagucuagguguugugcugggagagaaacugggcacuccccacgugguguaugggcagcacguggagauggaguuggagcuggugggaggagcccagaaccucuucucagcuggacugagaguugaucauucuugggguugggcaauaguuggggcugaugacaccauuuuuuccacuuugguagguguuugaacuguucuguaauaaaaaguagaaggcaaaacuaccuuuuuuuguaguaacaggaggaggaggaaaggacaaggccacagaccagaaguaugucugagggcagguguuggguggccucguugcggccucggggcuaugugugcuggggccugugucucguguugccgagccuugugcuugccuggccguccaugugagcgccucacuguccucugaaugcagcuuugcagacaggucugucagugauggcugcuucugccucucccugguugcagcuuggauuuguaaagaauggaaacagaucucaauauacuggcagaauuuggaaaagccagcaguuaguacacuuggagaaaugauuacauuccugguugucgcaggaaauacaaaccaaaaugaaauauauuuuuugccuauggaauuagcaaguacuuuaaaaaauggaaacccagugcuggcaagagugugcaaggguccuguuguagcguggcccugccaucaagaaggcauuugacagaagaugugcucagagccucugcucugugaccugucucuagaaauccgugcucaggacccccagcugggaaaggggguuccaggguacccuguguaccauggugagcagggcaugcagaggaaacugcgcgcuugcagggcaguccugggccgucggacugucuccuuuguuucccagaugguuuuugacgagccugaccuggaaacgaguuugcagcuguauuagaaaaugaaaaauguaguugaaaacuauauucacaggcauccaaggcccuuacucaucuggccguauccuaucuucauagccucuuuccuuaaaauaucccuccuccaggcgcugggcucuggcaguaccaccccaccgucuuaagaaggugccgcgagugcgucguugcucgcaccacuugcuuaggcccgugcagaggcucuguaggcagguauggcuuuauugggcccucagcaccccugugagguaggugucacucccguuucacagaacagaaaaaggagacccgcaaaagauaaauaauuugucuaaggccacacugcugguaagaggcugaacuggaacccaggcuggggugccugcacugcugcccuucaugcccccaugccuuggcugggcagcuccugcggcaggagcaccaucugcucugcugcaggguggcccagucaccucgagggcugcauacuccugagaccgcuuuucugccuucucgggaggugugugguuuccucugcugcuugcauguuucaguguuggcacugacuuccuucugcccuuuguugcagcaacuggcuguucuauuugccccuaccaggucauaggccucugaccgccaagagcuccacgucuccuuccuguguccauauggggcagagcuccagcguaguagaaagccagggcacggaggggaggugauuguaacuuugaaugugucuuguuuuuccucugaugccugugugcagaucagagacauaaguggacugggaguguaagcaaggaguugccagcucugggcuccaggacaccugcucagucucccugggcauccauugucucagugggaaagugaaaggacuggcuuuggugaucugucaagauaguuuccagcucuaaaugucauccuaggauuacauuuuuuaugauaauagcuuaaucgagaugacuagaauaaauuguuuucaacugaauauuuaagcaguuaauacuuaauuugacuuaaucuucccaacaucuccauguagugggugaagaaacaggcacagagguugcuuaggcauagcugagguaggacuucaaaucucccuacggguuucacuguaucucuugcuuuuuaaaaacaguuugcuuuugacuugaauugcuugugaugcuacuucuagagauauuuggucucuguccuugccaguagccagggugcaaaaugcaggucuggugguucugaucugauggggaagugucacuuguuccugguuccuuggugauccuuggguuucacucucauuacucuuuuuguuccaggauguugcgcgagguucuccgcucguagcagucuguacauucacucuaagaaacacgugcaggaugugggugcuccgaaaagccguugcccaguuucuaccugcaacagacucuucaccuccaagcacagcaugaaggcgcacauggucagacagcacagccggcgccaaggucugcacuuuccacggcccccauggggagcugcuucccugugagaaacgggaacagugccagugccgucuguuccuucuucaccucuuggaaggcgucaggcagugggguugugggcguggcugccaagccaaguggccucuuuugcacucucugccacuuucuugccuuugacccucuaaucccucccaugucuuuuguuuuuugagacagggucccucucugucacccugacuggagugcaguggugugaucauggcucacugcaaccucaggcuccugcucaagugauccucccaccccagucuccagaguagcugagcccacaggcauccaccaccaugcccagcuaauuuuugcauuuuuuauagagacaggguuucacuauguugcucaggcugguuuugaacugcuggccuuaagcagucugcccaccucagccucccaaagugcugggauuacaggcaugagccaccaugcccugccccucccaugucuuugaaaugcuuuccuggaagaauguuucacuuuguugacuuucccuagcauauguccccuaagccugugucucucacugggacuuuuguccugaauucugaaccugccccuccuguguuuccgucugccucagcuauucuaucuccaaguaacaaaggcuagagcagaguuguguuucaggaguggacugggaguaacgagggcuggagagggcaggguuagagaggaaagugacgguggccuggugaccugugaggggaaugcugagugugugagugccuagucauugggcagcuuugcagcaugggacuaggaaaccuaccccacuaggccuucuccacaguccaggauacagaagugccuggcagcugugguggcggccccucuggggagcacacccaugugcccuauucucugggcccuggugcgguugucgcuccucaccgggccuggcugauggcauccuagcuggcccuagaguuacuucugcugcucaguccguggaggcugugugugucaccaacuggguccucacgucuccugugugaccagcagcaccacagcagagcaccggcuuuggggcgcagcugugucacagcugccgcguuggcaagggacaggccuccaugccucgcacagaguuuggugagggguugggcucagggcaguucuguggccuuugcuuucuugugauccuauuuagaaguggucaugaagccccuccuugggaucuuggacacugaucuuucacaguuuacagcaguugccguucagcuuuauauuuaaauaaauugcccuucuggcuuuaguagugucuugaggacacggaaugugcgugccaccugauucauguuggagggugucaccuuugcucacagaggcccacaugaccaggccccuuuucucugagggcucugugagacuacaucacuuaggccucuccccuguuuggccguucccucucauggcacacuuccccuuuccugaccuggccaauugagaagucugcagaggcccaguguuauacuagaugcacuuuccuuaaacucuagugggaugugagacccucuucuguagcaaccuauguaucccaggauugaauuuccugugugacaaugacuuauuugugugucaucccccugccagcugucagggguagaagaccaggugucacccuuucgucuagugaaaaacaggcacucgagaacacccaguuaccgugggauuaugucacgcccucaauggguuguuucagucccccuaauggugguccugggaguggguuccucacugcuuugucacugaugaaaccaagauagaaaggacuugccagggucacaccugcaagaagggcuggggcugggcuuugaacuguggugaucaugacuguuuugccagaugcucugcuaucuaauguuuauuuagugauuguguuaauaucuggcccuuguacaugucuggucucugguaguaaauguuuauagaauuaguaaagugcuaaguaagaaauuuauuaauaaguggguaucauuugcacugagauuauucaugaucucuucacagggagcugaguccucaagagagucaagggaauuuuuaggaaguuuugaaaaacugacauaguuuuccauuuuuaauuucuccaaaggaucacuaccauuuucuuucaaaaugcuucauugguacuaagggauauuuauugaagaagugauacuauauugauacuuuuuuuaaucuuuaaaguaauaugacaacuaaagaggauacauucugaauuugauuuucuuuuugucuagaauagacuucuuuuguagauuugcauuauuaaaaauauaaaauauaauagacauucuggccagguguucacagccugcagguaugagcuugggaacaguaacagcuggcaugggagaaauaggaucagagaaccgagagcagcuuuuccucugggccaggugcuggcacagucaggaagcugcuggggacaguccuauggaaagcgugacaucaaguccuuauuuggcucuuuugcccaaauuaauuaugcucccauuuuacuguuugcuugaugcuugaagcauccugugauuugguguaauuggcauguacuuguauacaaacccuaaacuugccuaugcauuaaaauuuuuuggaagucauuauucccccaaaaguaugcugauuauuuaaauuacguaguugaauaacaaauaaucaaauauuuaaagaguauuaugaccagaaauuaagacuccagaugaagaagggccuguuagaaucaugacaugcugcaggcgugguggcucauaccuguaaucccagcacuuugggaggcccaggcgggccgaucacgaggucaggagaucgagaccauccuggcuaaugcggugaaaccccgucucuacuaaaaacacaaaaaaauuagccgggcauaguggcgggugccuguagucccaguuacucggggagcugaggcaagagaacggggugaacccgggaggcggagcuugcagugagccgagaucgcgccacugcacuccagccugggcgacagagcgagacucccucucaaaaaaaauaauaauaauaauaauuacaugcugcaucagggcugggcacugugcugggggcugaggggacagugguggucagauggcucuccacccucaggaggcuugcaguccugcuggggaaaugugaggcuggagaugcagugguaggggaggcugugggagggaaagcccaucaggaaaagcuccgucuagggggcccccagcaugccuggaagucuugugcaucugccuagagcugaagcuuugggucuguccuggcuuugccaggcagccaguuuuauuuccuuuguucaccccuauauggcuccagucgguuuugggguggcagcuaguuguggaguggagcacagaguuuggcaaacaugagcugacaagcugauucggaaaauauccucagagcacaggccagcuagcaacuggcagcugaguggaaagguucaguccucucgggcagcuccgguggcaccuagaggggagagggugcaggcuuugaagccagaaagacauggaugcaagucuuacuuugcuucuugcuguuaccaguuggccugaccuuaggaaauguuauuuaaucucucuccaguuguuuccccuggagaaagcccugucagccugaggauccaagacgcguacguaaagugucugauuucagccagugucccuuccugucccuuccuggggugugugucgguugcccugagcgaccggccaugggacucugucgugauaaccaagcuucagggugugggaagaggacagucagugcuuccuuggggcaucacucgguaacaucaugggcauaaacaaaaguacucagucuucaaggucauaaaguaaccagaguguauuccuuuuuuuuucagaucucuuaccucagcuagaagcuccgaguucucuuacucccagcagugaacucagcagcccaggccaaagugagcucacuaacauggaucuugcugcacucuucucugacacaccugccaaugcuagugguucugcaggugggucggaugaggcucugaacuccggaauccugacuauugacgucacuucugugagcuccucucugggagggaaccucccugcuaauaauagcucccuagggccgauggaaccccugguccugguggcccacagugauauucccccaagccuggacagcccucugguucucgggacagcagccacgguucugcagcagggcagcuucaguguggaugacgugcagacugugagugcaggagcauuaggcugucugguggcucugcccaugaagaacuugagugacgacccacuggcuuugaccuccaauaguaacuuagcagcacauaucaccacaccgaccucuucgagcaccccccgagaaaaugccagugucccggaacugcuggcuccaaucaagguggagccggacucgccuucucgcccaggagcaguugggcagcaggaaggaagccaugggcugccccaguccacguugcccaguccagcagagcagcacggugcccaggacacagagcucagugcaggcacuggcaacuucuauuugguaugaagcacucuauucagucaccaccauauaggucacuucucucauacucggucuugaggauauucuggauuaauccuuucuaugcagacguuucugguuuacaaaaggacgcagcccuggacuacaagucuggaacugacaaguucuuaugaccuugacaaaucaccuuaacccaucugagccuuaaauucucauuuauuuccugcauaaggagauuuggcuaaaugcuuucugagguccuuuggaguccuguggcuccaugguaaugugcuccuuuccuugaagauuggggguuuuguaauguugagauacuuugccucuaugcuugucagcucaugaccaguccuagaagaggagucgagacauaagccaccuucagagguucaauggaaacuuuaaaaccauaccaaacucuuuuuuaaaauuagaauuaacaagaaaaaaaaaaagggugggguuuaugagccuuaguucuuggaggauuauaagaguacuuccccaguuuugaggcuggacaguuaauauacuuuauaucaauuauacauuuaauauaauuuaauuuaaaauaauuuaaagauucuuaggagauagucugacuuuccugaccuagaugggaaugaucagauagggauuuuuuuuguggcacaggcuaaauuugauggugacauuuauauuguugagaauguuacaucuuauuuuaccacaacuuuuaaaaaauguuacaucuuuugcaguaggaucaguugugaggcacauaguagcugaggcuccauggagccaccuuucauuucuuucagucagagaggaggacagucucugucucugcauuucuggugucuugcuugucgguggcagagccaugcuugccggcauuugcuuaggcggccauaguaguugcuaaguguacaggugacugggcagggaugggagguggccacaggucagagacaagugcucagucagucccuggugccaggacugugugccucggugccuugggaaauggaagcucccuggugcagcugcagcuguggguggagguagagaagccagcaagaccuuggucuuaaccccguguucauuuucuugcuagcugugugacguugggcuaccucgcuucucugaguacaaaugguguguggugaaugggucccagguaugcuacgagcuuugagggcugcucuuuuucucuucauagcgauaaguguuaaacugucuuucuuaggaaacguucacagacuugcaacagcugauguccucugaguacugucugacucccucaggcaaguuccugaauucaguaccaucauuauuauuuuuguguaagacuuugacaaaguauagccccugccaccagagcagccuguacagugggucucuaaggugggaccugccccgggccugccaugcacgugugugaaacagcgugaaaagugucgcgguaaggugacccuggguuacccaggcaaggcucgguguuuguuucagaaagcagagaaguauguaauugauuuuaaaaguuucuguuuaaaauauuuggcuauguuuuagacuaugaaggaaugaacuuugcuucucuggauaagaaagucacauacauuguuccagcuccaaguuuguucggcccucgccacaaguggauguagcguuuggcccuuugugugccuugcuggugacucugguuuugggagcucggauaugucccagaagcaggcuuauggcacuucuguagcucccuugcuacccuuccuuugugucuagauaagugacugacaugcuuuucuuuggucucaggaaagugggggcucagcaagaacugauuaccgagccauucaacuagccaaggaaaaaaagcagagaggagcggggagcaaugcaggugaggccgugugugcugcagccggacgagcaagggccugaggguucucugucacuguuacuggcagaagaaacacagcagguguuucugugcucuugguuuuacuuuucuguucagaauacccuuuuaucaacuccuuaguuuuauuugaacuuaagggaaaaaauuaguaacaaaauucccagcaucaguaugaacauauuuuauuugccuaaacaagcuuugugaaaguuaagcguucaaacaccagugucaguuaccuggaaggcuacuaagguaaauaagcaaagcaggccaguugucaggaaagcagagauugugccuggugcugaauggccuuggggccugaucuuggcauggcagagaccuggggacugccacuguccccagguacguguacauggagccaaacuguguguccuguggcauugucagaguuauguugaaaucuuauuugaaaauguuagcaacuuacuugcauuuuuaaagaccaaacaagagcugguaaccuauggccucaagcaucuguccuuccuaaaaauggaauagugggauguagugcuuaauggaaacugcuaaaucuuuuucuaaaaacuaacaguggauuuuuaaaauauauuguuuuuuguguauuucauuuguccuuuguauuuaucuaaaaggguugauaugauuuuauaucuugcucucuauuccuaauaguauuaugacuucuuauuuaaaauaaauaacaauugccgguuuucuguuaaucaguuuucuuaaagccaguguuucacuauaguguaugcaucagugugaauugugacuuaggaagggacaccucaacaguucacaaaguaccagaauggaacuugcagagauaauagaaggaagugugguggugaaauuuguagaaagaguugaccauauaccaaggaaaguucaugaaggaaagcggaugccuuuauugaaccugguagauaaucuugaagaaaaaagagacaaacauucaaguauauaacacguguccuauuuauuacauugcuuuggaguacuaucuauaaaggagguuugauguuuucauuacuguuuuuguaaauauuucagcauuaucuuuaaaaaguaaggacauuggccaggugcgguggcucauaccuguaaucccagcacuuugggaggccgagguggguggaucaccugaggucaggaguucgagaccagccuggccaacauggugaaacacuguuucuacuaaaacacaaaaaaauuagccaggcgugguggcacgugucuguaauccuagcuacuugggaggcugaggcaggagaaucgcuugaacccaggaggcagagguugcagugagccgagauugugccacugugcuccagccugggugacagagugagacuccauuucaaaaaaaaaaaaaaaaaguaaggacauuaaaaaaaauuauagccaucuaauguugccacuucuuuaaaaauuaacaguauuuucuuaaugucaguaucuagcaaauguucaaauuuucaguugucccagaugccucaaauauuuuauguaacugucuguuggaaucagaauccagugggguucauaugucacuacugguugauacaucaucucuugacuguuugacagcuguaggguucucugcuaggucuugccugguuuuuguugaagaaacugauuguucuuucgagugugccagucuggaccuuaaugaucacaucacuguuuuaauagguuccuucguuuuuuuucuuuuccugaaaauuaguaguuacguuuagugguuagaucugguugguugguaaaacuccgcugcaggugggagugggcucuugcaggagacccccagccucugguggcaaccauugugaccagauacuggauccacucauuucuuagggguuacucuaaacggugguacucuaaaucugucauuccuuucuuacuuauagcugggacaugucuauaaagcgcagcuucucguuuuuuuacccugaggugcaguucaugauguuugaaucugugugaguuucuuagcauccugcagugauggucagaguauuuuaaugcacucauugguuuaaauacuucauacacuucuaagggaaauggaaaccugguaccugcuaggucuccgugugugagugcagcaggagaauguccucgugagggugaggcugcugucagugccacccacauccuugaaaagccccuccaggugccucagccagugcaggaaggccaccgucucuuuuccaaaacaugcagggcacuggugucuucccgcgcccaugggucugcugugguuuuagacacauauuccugcacagcgcuccucugugugucuugucacaguguugcauccucuggcggggaugccuuugcccgccuccccucaaagcagcauccugcauacucaugcugcauuuaucacagcugagaguccccuguggccgcaguccuggcagcugaauggcagacuugaugugaaugugaccagacucccccagugcccuucccuguuccagguuccaugugcauuuaauugucaccccuccccgucuccucuggucugguugagggccuuggcccucccuugucaugaugcuuucaaagaggaugggccuaucgcucuggaccguccucccugugggccugccugaugucuucuggagaugagacccgggcuggguugcuggagacgggggugaggugcccuccccacacauccucccugggccaugcuguccacacggcagaugugguaaccuggaucacugguuagggugguagcugcuagguuucuucaccaucaacuucuuguuuuucccuuuguaauuaacuaucuugcaguagaugcuuugagacuguauguggggcuugggggucccuaagaccaccuucacuucuaauagcaacugcaagcuuggggguccucaagaccacccuuagguaauucucuagaaggacucauggagcucacugauagcuguuguacucacggcuaaggcuuauugcagcaaaaggacacagauuaaagccagcugagggaaaaggggcccaggcaaggcagggcccaugagaguuccuagugugacgcuucaaguguccucucauggaggugugaacagugccaacuucucccagcaugugacagcacccagagaccauugccccccagggaagcccaccugagacucacugucuggaguuuuguugggucucaguuguguggauuggcuggccuuagucuccagcccuccagaggcugagcuggcgcugugugcccgaggccuccaccacaggguuagcacagacuguggaaguggcccagggcacccaguuagacagacauucuuaccaggcaggacuuuccaagggucuagagaucucccaggagcugggggcagaggcgaggccucucuggcaggguuaacccuuugccuugcacugcaagugcccuguuucucuuuaagcuuuccucucauguaacacucagcaggggcuuuuugccugugggguuuaauggugauuuuccauuucccuuauucuuguguacuuauuaauuuuauaaggaagagcugucucuucucccucauuuacuuauucgcaguauggauucaaugauacugauucuuuuuuuuuuguuuuuuuuugagauggagucuugcucugucgccccggcuggagagcaguggcgcgaucucggcucacugcaagcuccgccucccagguucacgccauucuccugccucagccucccgaguagcugggacuacaggcgcugccgugcccagcuaauuuuuuuuuuuuguauuuuuaguagagacggggguuucaccguauuagccaggauggucuccaucuccugaccuugugauccgcccgccucggccucccaaagugcugggauuacaggcgugagccaccaugcccggccucaacgauauugauucuuugggcuguagucaguauuggauuaugaucaauauuaucaccauuuauuuuguugcuccaguucuuccagcuguggccaauccuucaguuggauucuugugccccaucaacauucuccauccuggcuuuuuguuuugagcacuuccuuccuuccuagcaccaccaggcucuuguauuaucccugucccugcccuggaaucgacuccuccuccagagagcccugguuucuuuuguuagaggaugguauauagaauccaacaugcagacacucgguggacuuauuguuacugggguuuuguuauacuaggguuucaguggucagugcuaguauuuauguauguuaacccacgcugugcuuuggauucaggcuauuucaaauuuuagauaauaugguacauauauuauuaauaccacuaguuacuacauugguacuuuucagcaaaauauaucuaagugggaucaaaugagacuguaaauagcuuuacaucaguucaggucaguuauguugcuaaauuacuuuuggcauuaaguuuagggaaaaaaaauuggguuugggauuuuuugguuucaacauuugugauugagagacuauggaccuguaauaaguccaagaacagcaguugcaguguaacaggacuguuaauggaaucgggucauuuagaaacagucaagacuucgcuguugugcaugugguuaggagccagugcacacgucaguucuuaggaaauguacagucugagcaauagcauuugaaauccaagacucuucccauuguguugcuguugaguguagaaaauaaaaugugugaauuucuuuaucuugaguauugagauucuccccuuagaauaaaacaagaauuuuucucucaguguaaaaaugucaaguuuuauucuugaaaugaauagcaaaguuaagcuuaaaaacgugaacagcuucagaacuauaaauggguauguauaccuuucugcugucuaagggcagagaagggaaagaaaguguggugcuuaucagaggagacagcagcaagacacauugugacagaaaaccaaggguauccugugucacagugaaguguaaugagggcaccucuccuuucaagagacgaagauugaauacaugggaagcacacucuccgcuguguguugucuaggagaggugcacccuguauggaaauauuugggaagguuaagauuaagacaggguaaaauaaagcaaaggcaaaucacaaagcaagggcuaauguuaauaugaaaagugcagaauucaaggaaaaagcauggggacaaagaagauuuuuccucuuuuugguugcuguucauguguagccuacaacagaacuauaagaccuauagacauuuauaugaauauuuauuugaaaacguauaauaucaaacaauguaaaagccaauagaaaucucagauaauugaauguauagaaacuagcaguuugaaagugauuaguucauuauuugcugaucaagcagaaaaauaagcauaugaaagauauuuaaaaugggauuaauaaaguugauuuaacagauccuauuccauguccuuugaauauuuauagaaauuaaauggaacaaauuagggcaucaggaaaacuauacaaaagucuuuaccaaaaaaaaaaauauauauauauauguguaguacuaccuauauauauacauaauauauaguacugcuuauauauauauaugccuauauguacacauauauauauacauguauaggcaguacuauguuuucugaucauaauauguuaaauuaguaaaaauuacuuggaaaacaaaaccucuagacaaucaggugaaagaagaaauaaaagcgaggcugggcgcgguggcucaugccuguaaucccagcucagcuacucaggaggcugaggcaggagaaucgcuugaacccgggaggcagagguugcagugagccaagaucgcaccauugcacugcagccugggcaacaagagcgaaacuccuucgccaaaaaaaaagaaaaaaaauaaaagcuaauuacaaauacaggaaaauggauaggccauguguuuauaaguuugagcucuugagccagugacuucccugcacguucagcuuucuccuuugugaaaugguaauagaagcacgcugcacuugggauucuuguggauuacaugugagggucuuagaaacacuugauguguaagccaacuauuauguauuacuguauauggaacacaagggauguagccaaaacuaaaugcaaguuugugccucagaugucuuccuaucagaacagagucaaauccagauuuugaugcuuaaaugugacagcuuauucagauuuagaaaaacuuuugguaugggccaaagaaaacauauccuuaaggggauauggccccuaggcccucauuuuccuuuucugucugagcaauuaaaaaaagcauuaaguaaauuccacaaauucuuuggaauaccuagagauaaacagauaucauguuaacuguaugauaauaaguuagaauacuugcaacaaaaugcagaguuuucuaggaaaacaaguaaucauucagaaauaagaauaugaauaguuccucaguucucccccuuuguggaauuugugcaguaaaugcugcuccaaagcucuguggaaaacagaagcuucccaugaaaaaucugacaaggguaucucucagaaagagagcuguaaucccagcacugugggaggcugaggugggaguauugcuugaggccaggaguucaagaccagccugggcaacgugguaagacccccaucuguaaaaaaaauaauaauuagccacgcgugguggugcacaccuguggucccaauuacuggggagacugaggcggaagaaucgcuugagcccaggagauggagguugucgugagcuaggaucugccacugcacucuagccugggugacaguaagacccuugucucaaaaaaaaaaaaaagaaaaacugcagauuggugacucuuacgaagauagauggaaauguucuaaauaaaacacacuuaggaucuggcaauauauauauuuaauguacuauucugaccaaauggagcuuaaucagauagcuugagaaugauuuaauguuacgaaaucuguuaauugcauuaucucaauaauagaucggugaauaacuuuauuauucucucaacaaauccuguauuugauuuacaaaauggaugggagguuucagggagagcaguuggaagccugugugcucaccuguuaggaacgagaguggcaacagcaguggggaggagugcucggcuccugcaccugucucgauggcagagcccacaggcuuggcugacagacgugggaugaaggaaagagaagccucucacucuucccacagcauuguagugcgauuucaugcagaaguccaagcagguuccaggacaauuguguaagaagcuauggacaagaacgucuaagaaaacggaaaaugacauagaggauuugcacuguagcuaagacuucacgcaaggcuguggcagcugaaagcauguucuggugcuggggcugcguggcagagccaggagcccaggauccagcgcacugggcaccgaccugggaccuggucaucuuugcguguggaaaagauggcauuuccaguuauugacaggugaaugcuggccuuuuagggaaaaaaaaauauuagaauuccauacagaauaaagaaugaagaugagagguuaaagguuuuucuaaggcaugaagagcugugggggcagccugcccuuguucuuuuugucguguguccuucacaugcaguaacucuguucacgccucacaaaaacccuaugagguggagaccugccaucaacccuuccugcacgggugccacugaggccccaagguuaaaucauuucccagaguguaucagcagaggcacagccacagagacacguccgcacagagagcuuuccagaucaccaguaacagcgugagaucauggugcagaaggucaugaggaggauggcaacgagcgagacacagccgguuggugcucacaaggacauugguagaucugacugagggccaggucggcuaggccuucccaggugacaggagcccagugccggccuuggugcacacagcgcguccuugugcuuucucaggagagcuucacuggggacacucugugauguuuuuggagggucauuugguaauguguucaggagccaaaaaauaugcauaauauucagucuuacaauuacauuuuuugaauuuaucucaaggaaaucccagggaucugugugaagcugcacaugcugcugcugcucagugcgggacuguuuauaauauuuguaacucaaauguccagaagaacuguacacucugugcauguuuucaguaaguucauauuuguaagaaaaaguggguguguugagagacaaauuuuuguguacauuuaccuggaaacaagcaguaguacacauaugcaugcaugaagugguguuuuccugaguguuaagauugugaauguuuuauuaugaucauuucuacuuuuucuauuggaaaauacuuuguguaauuaaaacaugaagauggagcuaccaucaaaauggugagcaauagagcacuguuccuccugggguggccuggugggccugagggacucagguggugaugaggaguggccuugagucccuuuccuuuccaugggacaguggggacgagagcuagagugaugaggcagguuaagugugugccuaccucccuguggcuggagcacuguuguggccaccccgggacccccugagccuggugucgcccuggcuugcuggucccagccuagggagugggccccuaugggcagagggugagguggcugugcuggcacugcagcucaggcacacacacacuggaguguuccaaugggugaucagguuggauggagccuugaaauuaagucagugauguaauuuuuauaaucuguuucacuuuaaaacaaaaaucuuugcacaccugguccaaguuuucuccccuuucuuccuguugcugccaugaugaaagcagaagggaccacccuccagggagagcagcaggaagggagaugcggguaggggcccugggucagcaggggcggucaguccggaggugcacccccauuuauuccucguucuggaagagauuucuagucacaugcauguggcuccugugccacaugugucaugaggugcccagguggguuuggauuuggaugagggcaucuuugaggaugcaggggcuuugucauacccugugggccccguguacaccccuggggcagauguggccucuaacaggggagggugcguggaucucuaagccggggaggaaagcagauugcagacuugccgaagugggagcugucugcucuuguguuuucuuuaggggcaggagaauuuugcccagcagucccucguggcucccuccacaccacugacccuuacgcauccaagguuggagcccuggcagguaaagggugagcaaggugcaguugccugugagcagcuguggaggggccuuuccuguuguacacuuccugugagggucucagaccccuugcagacucuggacaucacuuccuagaggggccugggcuccuuuaguccugugaguaaagcuuugguuuugaugacugucucagggaaagguagaaaggugcuugguggcagugaacuuccugcugcagaagugggugugaccccagugcuggagaaugggcugugagccgaguuucccgcaccugcaugagugagcgccaugguccuucuccacagagcguccugcugucacuuugguuuguguuaacuuugacgccuuucuuguuucuuacucugcuuuccugcauggagcacacagccccggcucccuuucagucugcauggcagacaccuggccucugcagguccaguucauucuguguccccuuucggucgucccuauguugccgucaggugauugagggugaaggucggccuuggcagcccaguggaaagucccuugacuccuggccgucaguggcaggucuccagccuuugggaggaggaaacuucuauuuaacaaagaaauggaauugacuuugccacacacagccagagcgaugauuuguagagccaaccugcugagacauucaaagcaucagucguagggucaggaccgccaggugagguguggcuccaccugcagcagccuggggcagguugccuagccucuggcuuuagcauccccuucugugaaauggggaaagugaugggaccuggcuuuguagggugguugugaggaccuacagggguuuuugcaaaauacuuagcccagggcugacuaaaagauucagagacgcugggcaugguggcacacaccuguaguuccagguacucgagaggccgaggcgggaggaucacuugagcccaggaauuaaaguccagccugggcaacauagugagaccuuauuucuuaauaaaaaaagguaaaagcuuugguaauaguuuuaaacauauauuuuguucauuacaucuucuucuguacauucaacauuuugucagaacaaaguaagagaaagaguggcagggcuuuguguguaugugguuucagagcugcugaccucuaggaugggguccugcuacauuuacucuucugaggccuccggagcuggccuuggcugcccuaugccauacccugugcuaugugccgugccuguggaccugcccugccugcgugcugccccgucccgucuccccaggcaguuccugcaccuccugccguguggaugcuggccguugcugucugacucgcauucuuggagacacugacccaggcuccucucagcgcuuccagccagguuuggcagugggaacauuagggggagauuagaggguguguggagcgaggcagggccucacuugcucugcuuccgugggaguuucauggcgauggccgucuacccucauggcuguggccccaguucuuccuggguggccccugcuguaguucugcuauacgcugucccuguucuggacucuggugacgccacaccuucccuagucccuccagcccuagggguggcagccccacgacgugcuggucucuggugcuugcuucuuagugcauggccgugccaugcccuggugccugcccgggaugccuguguggaaugcccagaguguucuaggcaggguccccucugugauuagcuccucaaggguggugucugugucacagacacuuugggguccugucaguggccucucgaggcucccaggguacccuguacuuucucaccccuuguugcucaucuauuguggguuugucugugugcugcaaaaugcacggcuguacugagcgcaccagccagcagcuguaagcuccaugugcagggccaccaucuggccgagcaccugccauguggugaagauacaguacauacuuguugaaugggugaugaaacuugcgcagaccucaaauaaaagcuaauaauuuaauguauaaagcuaacauacccugguucuaaaacuugacaaaggugugauaacuauugaagacauacggugugcccugcacaguucuaagcccagcacaucuacaucuauuaccccauuaguccucgcaacaauccugugagguguagguccucguguccccaccuuucuggaugagaaagcugaggcaggaagaguucagccagggcugcauagcugguaggggcaggggcagcggcaggauugaacccaaggccggcugcccucagagcuguuacugagccuguuggccacgugguaugcaggaacacugugucucaccuccagcaggugaagcaggcaugggaaucccaagugaaauaccagcacauggacagcgggcgagggugauguggggcgaggcagccugucagcaugauuugccacagcaaaugccgcaagagacgugcaggguccacagaggccgaacagggcaguugaugacauucaucaccugcuacugauuugaaaacaucacaaauaugaaucaacuaggaacccagauuucccuaauacuagagagcagccagcugucaguggcauuuucaguggagagauguuggcauccccccaaagcuggaggaaugguaaaccaaaccauuggcgcaaucuauuugacacuuuuauggaagucucuauuuuuaaagaagcagaaucaaauagaaaggagagaaugaugauuacuuaaugacaaagucauugucaggcuuagaaaacccaggggaaucaacucaagcaauuagaaauaagaaggaucaauagauagcuaauugcacaguacauauuuguauauauaaaauuaauagauuuuccaauaagaauaauugugaaaaacugaccuuauucauaaugacaguaaaaguaauaaaauaugccaggcucacucaugacaagugugcucugaauggguaagguccuguguagggucugccagcuagagaugcccaauucuuguucacuuacauacuuuauucaguuccuguaaaaucccagaguaacuuaaacaccugucuacuuuaaguucaucugggaagguagcuuggugagaauacccaugaaggcugugagaugggaggaggcagucggguacucagggccugccagaugcccuggaggagagagugccccugcagaacaaaggaccugucgugugagcagcacaucccuaagcaaagggugagcacucagcacaggcagggcuggucauguggguuuacucuggaagagaucauuguggguuccuuaugcuuucuccccuguagcuucaccacccaagaaaaacuacuuacaguguuucaguguuaaacugaaugaaaccuacacaaaugugaaaucugaaaccuacacaaaugacuuguuuuugaaaaaugauaaacauuuuuaucugcuuuuuguucuuaauaugaauauuuuuccuuguggauaaguauauuaacauauuauaucuuuauaagagcuguguugaacuaaccaugucagggaccuagugaguuaagccccagugaccucugaucuuccacccuugggagaauugggaaaauagucacuuaccuccuguucaagugaggaucucaguagaggaagcucgcaugacccccugugguuaucaagggaggggccugagccucaucugugcagauccuuucucggggcaccuggcuggcucugaacucuguccuguggcaggcacugcggugcuacugguguggggauggcaugcuguuugagccaggcccagugcuguugaccucaccuaauucucgucauggcacggugaggugaaagcaguguggccaucuccauucaccgcagaugaugggagcugagucacauagcuggaucguccagcucccaagccggggcccuugaccacuuugcuauuuaccaucauaccuagauaggacucuuccuuaaggaguccuuccuugcuucccaggagguugcuugguguuggauuuauacugcuccucuccccacuccugcagauucuccagcacaagcaagcauuuuggauaaugauugaaaauauugaagcaaaauguaguucgguguuguuaccuuguucuauaaggguuugugguuguccauugugagagaggaauuugauuuuucuugugacugcuuuauuaauuaaauugaucauauugcauuugaugccauggcgcccuuuacuagugaggacccagggcuucaugguuaucgugaggacgugguguggaccccauuuguuugcuuuggcauguccuuaagcaucccuagauaaacauacuugcuuaguuaacccaggaaguuuaugauuaacuuucagccaucuuaaauguucacgacauaccaccagacuucaggguguaccgucagggauucuaggacagaacacccugcucaggccugggggacaacucagcaacuggggcuuggccccuccuccccuggcugcccuguucucucacagcuguuggccuggaccccugcauccuuuccagguucaucuuccaggugcaguccuugcuggaacggacucucugagaagggguguccgagcucaucuguggcagguucucccccucacccacagcuguccuucugcuugccaaaaaacggggaggcugcaacucuccaccagacuucuacugcaguguguugccuuggagugcacacaaaaacaggauauccuuccagagcaccaaacccaggggcaguuccaaauacugguuucagggaagcauccuguagaauaauaccgacauuaaaacuuuaaugagccgggcuugccagcuuacccuuccugugcagagaugugucuagggguggacgcugagauguucugcuugagguacaucagagaggggauguggggcauggauggacaucucucguagaaaguccucaccuuugccagcccucugcuguugucaaagaauguauuacuuuucaggaaugagcccuauguauguauaagcgugagcaauucuuuucagcuauugacuuuuuaucccuagacgaguuguuagcugggaagaaaaauaccuucugaugcaaauuaguggugguguuucuucucaguguaacuggugucuacaggacuaccugagacacugaauuaaaugugcggauugaaaagaaauuccugugauuuuuuuucauauuguaugcugauacagaaguugaaaccaauuuagcuugucaugagauauucucguuacagccuaucuuuuuuccuguuguaaaaguaauacaaguaaauuguuaauaaagauagaaucauuuuaguuacugguuuagguauaaaaggaaaguguaaccaugucuagcaacauuaguggaauuauuucugauuuugcacccaauucugauuuucccaugauucgaauggcacauacauucuagcacacauuuugcaaaggaauauuaggauucagucauauuucuugcuuuguagguaacuuagagcguggcguacacauuuggcauugaaucaugaugaauggcucaguuuuaucuuguuuauguuauaaaacuugauaauaaauacuugauauacaucauuuaaaaucuugccugcuuuuaaaagaaaucuggagagauacacuauucacugccugccuuaauuuauucuacagugguuuucauauuauuauuauuuuuuuuuuuugagagggagucucgcucugucacccaggcuggagugcaguggcaugaucucggcucacugcaagcucugccuccuggguucaugccauucuccugccucagccucccgaguagcugggacuacaggcacccgccaccaccacuggcuaauuuuuuguauuuuuaguagagacgagguuucaccguguuagccaggauggucucgaucuccugaccuuguaaucugcccgccuuggccucccaaagcgcugggauuacaggcgugagccacugcgcccggccaauauuucuaauauaauaacauguuucaguauuuuuauuugaauuuaaaaaugaagccaggccuuuuauuagaaagcaagcguaaugcgacuguucuggcugcagcaccggcccugcugcuggggcuucgugggcaggcaguucccccucacuugaauaaacucaaccugcagcugcaaaguugugaugacacaugagcaucuuauuuuaaaaaaguuuuuaauugacaagaauagaugcugaccaugucuaauucuagcaagaaguaauauuuagacacaaauacaugaacuaacuggggaagaaaaccaccagucagucccacuccucuugaaaagcauuuuuaauauaauuuugcuuuuaauaucauaauuaucuaucaaaguuucugauauauuuuguuuugauuuguuuugcauuacuaauaauugcaguuguaacaguucaaaccaaaaauguuaaugccuagaaguuaaauaaaaguuaaguuuauguacauauuuuuauaugcuagggugauaaaagacuugaaagcauagaaaugcauucagguaaaauucuggagguaagugggauaguauacaagcucacggaggauauaggcacgcuucauuuuuugcaguugacuuuuuuuuugcuuuuuacaaauugaagguuuguggcaaaccuguauccagcaagucuguuggcaccauuuuuccaacagcauguucucacuucaugucuaugucgguauuuguuagcaauaaaguauuuuuaaauuaagguaugcauuguuuuagacauaauguuauugcagacuuaauagacugcaguacuaggaacugaugugaaguuuccucaaggaggggugaguaaguuuugugccccaggcaccucucuugccccagacccagcccugcucuucugucugaagcaaguagagcaauuagaaaaagagaaaccaggcguggagaacagucagagaugauccagagcgaggguugcuggguuuucuggaacacugauggaugaacagaaaggaaguauuuuguaauggaagugcaucucccugcagugagggggaacugaaucuguguuacccagaaaccuccugguuagcauuugcacuucaaagaaaaagagcccugaggcacccagaaaagacagcaggcugugccuaaguacagaggacccaagguuugugcacccaguuggcuugccugcugagugugaagcucuccgggacccagggcacugcggaagacaggaagggaucuggagugaggugagcaggucagggagacagcauaugcagggcaagucagcucucaccccaugggcugcucagaaccuuccugucaaacagccucguaaaaacagccugccuugggcagcagggucacccaauugaauacuuuuauuaggaauaacuuauaugauagucauuguacaguuguuuuuuugaagccguucauagcuggaucccacacauccaggcagggaugugugggcagagcagugacagugccuaaacuccuuggcacucgccagucacuguucuaaguuuugaucacauauuuccuaugaaauccucuccaaaaccuuccgagguugggacuagcauucccauuuuacagguagauaaugcugaggcccagagcuugaguuccuuuuccagaucccuggagcagaguggguggcgggucagggugagccuagccggggucucugcagugcacgcucuaggcuaccuuugggcccuuuugaagcagcucuuggguuuguuauggguguuaagauuuuuucuuuuuucuuugugcuuuacuucauuucuuaagaagcacauauuuguaaaacccauggaguagugacuuggaaaggagcuggacagaggcagcaguccacccacaggugggguauggagaccgcccgcuuccuuccuauuccaugaugcuguggcucugggcuguuggcuguccucaguugcgcuugggauuccugccagccagcagcugcuggaguuagaggauucugcucuccaagaauuugcagcuugugucugauuaccguaccgucuggcaaaaaaauacguaugauguuuuuacauuuuuaaaaucaaaauccugauguuuuuuuguucguaugguuguuuguuucaaccucuuaacucuugauuuuuucuguuaagugauuuuacgucucuuagcugugcagaaugacaauuaaugggaaggcugucuuccccauagugagaccuugguaagggcagaccugacugguagauuguagauugggugugcucguuuuuauauuucauuuuaggagccucacagucuacucagagaaaaauaaaagaaggcaaaaugaguccuccccauuuccaugcaagccagaacaguugguugugugggagccucguggugcccagcggaggacggccaggaccagcuccagcagcuggggugcagugcggggcgcagggcguccagguccagcuggugcaggugagagcuggccagucacacaggccagcuguaggcggggugggagggucacgcaggucugagcagugugcggcaugcugcauccccugcccaucgcagcacccccugccugccugccccucgugcauccuccccuguagacugccccaaguccugucuccucacagcccagcuccucccuuuuucccagccuguccugcaucugcucaagcucugaguguugcugggaccgugcauccacuuccugaaccugucugugcacagcccugcgucuagccccagaguagcccgccucccugcccgaggcccccagggcuguuuugcagcaggaugagaucuguuugaggccacccugcccuucuucugcagggcuggggcaaaagggcuccgcaggccgucucagccaccccauuucuagggcggccugcuuguggcgcacuagcagccuuucuaugcugaagguggugggggucuuuucaguguuuuucuauuuucuuuccuacgaaacagagccccuccagggcaggcccaggccccucccagccuguccgggccacagauaccugcagcuguggccaguuuccaggaggucuuugagcacaccugcuucagcagcccugagcacaccugcaucuucagucucaguuugaggggcuggaauggggagggaagaugauuuggaaggauuuggggagagaagagauauacaagccggggcugucuggguuuggcccaggugugugccccucuucaccacuccacuuuguagauucccuguggcaggggaugcgguugcaggccccacggaagugcggaggguggaggugacgcuggcucugaguugggaaacaggcacguuuguggguucagaguccugggagagucucgccaaggaaacaggaccaggccuggggcucagagaggcaagaggaggggcagccugggcagaggugggcugggaagggggcagggaagaggcugcgggcagcuggggguggcccugugcugguuggaagcuagcggugagcgucagaugggggcugaagcuugucuuagagaggggcaggagcacugguccuuuguuuccagcuucugaagagguaagaacuccccaggagcaggggcagggggagggggaggaccauccaaggaaacacugccucagcuggcagggcagagguacagagucaggaccagaggcuuggcaauagggagacgguagggaagcuggugccaccggcagaacaggagcaaguaggggguauacuuuuaagagaugccugauuaaaccuggguuugaguucuuuuucugucccuuaccagcuagcguagucuugguuacuuaagcacuccgggccucaguuuugucaucuaugaaaugggaacaguagugcagaccuugacacacaggagcuucucaaacagaaggaaugagaggugcagagcagcagcaccaggagcuccgcuucggggugugaauggccaugggcggacaugcaggugcaggacaggcgaagugugggacagaugaaguuucuagccuggacugugaggggccuggcagccuccccucucaggagccccucuaccugcccugguccuuccagcuggcccguaggcaagcuggggcaugcagggaaggcccucuguggggcccgaggauuugcuggagagcacucuggguacacaagguugguggggguacagggcgugccagggcaccugcaaggaguugaggagcgugccuuaggagggaaaucaguauuugggcugacugaggggaggagcuggagagcagaagguuccaggcccagcaaaagcugcugggaucaaggugacagaaugagaaccaggugggaacagguaguacccagcccccauaaacaauuccugcuggguccucgggccucccuuggaauacagggggugggcugguucugccacgcauugcagcuggaggagacuucucaggugagacgaggaccuuugcugcacucucacagacaugugacaggccuuucuguguugccuucccaggaugaccccuccggcgaagguguccugcccucggcccgcggcccagccaccuuccuccccuuccucacuguggaccugcccgucuacguccuccaggucuggaugccuuacugcccuuuguuuuucuuauugagacucgcagagccuucgacuuccagaagccuggcuucacagcugcaggcuggucacugaggccgcguggcuugggaggcucaguggguugguugccaggaugucuugcugccuucuggagaaggugggugaguggagcucagaucugcaggacgcugcagcuccugcugguagacaaagcaggagaaguuaauaugcucuugaaaguguugugccuaggaauuccaguuaauucucugggaagagggcuggccagggcccagccugugggagaauagacucggaugaauucaguaguuugcuuacgugguuaagcuaaggauggguggcagugaaugauucagaguuugauaugaaauagcgaaagcguauagcuuaucacauuucuaacaguuugccuuacguguuuauauauuuacaauaagccaugcaaauuguguuuuaguuuuuuugcauucaaauugggcuauucagcauuucccucgcaaucaaaaccaaacuuggacagaagcacuggugggagcagagggccgggcacccaggcugcagaggggugagcuggagggcgguuuggcagcauggaucagagaacuucagaagugucugcuccauccugccuggcagcccccuccugggacugcuccugaaaaaauaagguagugacauaaucaccguagcccggagucaaauggugcaacagcaggaacacuucuuguagcaggaggagacaggcuagauggggccuccauagcccugggccacauccuggucagcugugagggcacaggcggacggacaccuaauaccugggagagugcucaccgcgugagaagugcggagaaaggguugcagaaguaaagaugauuuuguuucuguaaaaaggcauauggguauaugaacaugugaggguauacgucaaugugcagacagaacaaucuugaaaaauuuacaguacaguauugaguucauuuuucaucaaagaacauguguuuagaauaaggggagccuguaguuuugaguaagagaagucagguaucucaccacgggccuggucaguguccugcuguguggagccacaggaucccucugccuccccucccuccucccucuucaugacaaugcuugguuuugcaggaggugcuccccucaucuggaggcccugcuggaccggaggccacccaguucccaggaagcacuaucaaccugcaggaucugcagugacggcagccucggccugggcaggcccaaggccacggucuaggacacaccuucccugagacucaugacaugagccuggggagaccucauuugguuuccguucagaagaccagcguagcccuuuugagacuuuuggguacauuuaucaaaaauguuuuccuuuuguuuuaccaggaaugaguucgggcuauacucuuugaaacugccuuugugagcaaagugcuuuggcaaggcaagggucucccucagcagggcuaggugcacuacagccucuuuccccgugucccguuggaucugagcuguguagcacuuguugcauuacaaagaaaaagacuucugcaggaaauaggguagagaacaggcugucuagucagaugcagcuugaucuguggcaaaaccaaguguggucuuucagcuucaguguguuagcaucccagcaccugggaugggguuugugggcaaguugauuuugccacacuguagggcccagguggucccauugccaccgugaagccaaauucuagcccaagucugguagagcagucgggcagcuaguuuucgggggaggaugauguggugggacagaggaccucaguggccuauuacggagcccucuucccagacuaaauucauagccgagagcucggggggaugguagaguuaaaauuuaaaauaauuuucuaaauucuguauuuggauauuaguguuuaagugguaauuuggcaacaguuuauaaagugauguucugaauaccauaaauuauguguaggacugugauggcgcguguauguuuuauuauugagguugaugugcacauaauacgucaguguauauuuuuaccgagugaggucugucuuguaaaaggagacaaggugaucaccuugcccauguuuauuuguaagucugucaacuuagcaaugacacagggucacuccuaaaugacuuuuuuuuuuuuuuuugccuugugccuuuugaaguauguguucauucagaggcuguuuugauucucagacugaaucauucaaacucugcccuguguuuguuucuugaauuugggggugacaucaaguuugagugaguccucccucugucuugucucacucugaggugcuguccccaggugcuguuccacguggaagaauccacaccucgucgacaaaugggucuucuccacagaccggcgcucugucaccaacuaaaggcgaggggagaacuugcccaccuggcaggcucuuuagccccaagguggcccggaguccuccucccuccaugggaggcuuuuggccaccauggcggguggagccgcacccaccccaucuccauggggaggagagucuucccccaggaaugcccucucggccucuauuuuucucccaugugccucccugggaacgucaccgugaagugacugggacuggcacccaguguucugggcaccaagguucccugccggugaugggccuaacuccuagugcaaaugaaugaaaguuuucuuauagucaugcaccgaag

SEQ ID NO: 14788 - RNA, 4444 nt, Homo sapiens
guguggcccaggcccugcugacggagaggcuggaccaucgggcaccgugucucccaugugcaacgggcuuuuaucucucuugcaggguucuucuuugagccaacuguuuucacagacguggaagaccacauguucauagccaaggaggaguccuucgggccugucaugaucaucucucgguuugcugauggguagggaauccugcugaugucucaagggcccugacucucucccacguguuacuggggucuucaugugggcuuugggagguagucuacgggcagucaggaggagaacucaggcagggcgcaagccguggacaccccgcuugugccgccugcugagucuccacaccccugagaagagagcccagugaccuggggcuuugaguccccccugugagcaaaggcagcucccuucccuguccuugucacuugucacaugcuccagcauguuucucacagcccgcugggcucuguucuaaggucuguuaccaugcauuaaaccaccccccacacugaguggcuuggaauaaucagagauuuauuuuagucacggucuagguucaaugaggcaaacccaucucugcuccaugcagugucuggccucagcuggggugacagaguggcuauccugaugcugcugggggucuugcgggaggcuuccuccgcguggcagccucgggguugccgaggcaccugguucccuucggaggccagguggaagccaaaaggcucuuuauaaucuagcucuuuagaaucccagagcaucccuuccaccacggccuguugaugaagcaagucacccagaccaggcugggcuggaagggaaaaacuguacuccacucacaguggggccacugaggcccaugcugucacuucucaggccugccccuugucuccguagcaccuuggagcaaauugcaaaaucgugccucguccucacauuuuacuauccaacuaccaaaaaaaccccagaaauuaucaucguaugucagugguauuagaauaagagacuucacugccaccuagccaauaaauaugguuguaguaagucuccaaaucgcugaugucuggugaaugcccaaccugcggcgggcacauguggguccuucugcaugugaggacccagcggccccucucugggccccugcucccagucuguggaauaaagggcucacccgaugauccaggagccccugugguggccaccugcccaugggccucugcccuuccuccucgcucgcagcccaacccaacccaaucuugcccccggcgcugcagcccggcacauuuucuccucggaaggucuuaugcagcugggguguggagugggccgggguguggagugggccaggcucuccucugcaccucccucagggaguucuuccuggacuuucucuccagggacuuggaugccgugcugucucgggccaaugccacggaauuuggccuggcuucuggugucuucaccagggacaucaacaaggcccuguaugucagugacaagcuccaggcaggcacuguguuugucaacacguacaacaagaccgacguggccgcucccuucggaggauucaaacagucuggauuuggcaaagaucuagguaaccuacuccugccugugggguugcuuucauuuauucauucaacaaacaucuguucaaaaccacuuagggccagguccuaucucagaugcagggacguagccuugaacaugauggcugucaggguucgcuucuuacugggagggaacuugugacaaguccgugagcaagaugcuugcagaggggggucgugcugggaagaaggcaagaagaggggccuggaggagacacuccagccaggaggcacugggggccucucuggugugguggcaccugugcuacccagaccugcauagcagggaggaguuggccaugaagacccaggggcccguguuucuggcugaggguucagcagguccuugggggaaccagcuuuggucguggagcugcagagaggccagaguggugggagugggccaagggggagcaggagggaggagagaaggccugagaggcagguaggggccagauugaaggcccaugggccauggucaggggcucagguugcauccuuaguguaaagaggagccaugggaccaaauguacccccgggugaacaccacggguguugcaagucucccaguagaggugaaguuacucaggcggcagcaggcgggguccaccggcacauagcaggcggggucccccggcacacagcacaggcuccccagugcucugccugcuggguggcauggaguucugcuccggcccucucucccugggcugcuccaagccuugggccucguccugcucucucagcaggggggacuagacaggucugaugggcaagcuuggcaaggguggcuggcaagguccggggaagccauaugcugucucagaggucccaccugucucuccaggcuccugugccagcccagagaccacagggaaggucaugcugaggcugggggucaaaggcuggucacuguuuccaguuuucucuccucccccugcccccaucuuucaagcccugcagaagcccccaaggguacccaugagaggggcccaugugugcccacagggcuggacucacaugcacgcauguguaggcuggacacuccugcuuccucugucccugucggccuccucuuccugccuucucccaggccaccuuccugguguccaccaggggaauccaugaggcccauggccacccagggaaggcuguggcugccaaguccccaggacgugaucugggccccuuaugaauccuccccgaguucccucagcucccuccuaacccuaguccccauguccugcugagaggaccagcacccuccugggacaggcccacaagccaagccuuccaagcagccugccugggcagacucaggaccucagagggacggggcagugccacuccuggggccagccagagcugcuggggagcugucaggcagccccaggccucacacuugucauggggcugagaugcaccagccacauagcacugccaaggccuggggccucagggcccugcgaggcauccccuuuucccagccacagcuugaugcagacguagcugggggcagccaugagagaagagaugggccagugagucugggcaguaacgccaagucucuccacccccuuccaccugaaggggcuucccacuguccagacaaggcggugggagcuggggaagauucuuaaauggcugccucagauuggcuuuguauucuggggaguccuggcccacuauccacugccagggauaaccuggguaagauucaugaccucgcugggccucgacuucucaccuggaaguggggugagccagagcugcccccacgugguugcugaggaauaagacacuugcagccccgagcagugcccugccuguggugggagcugcugugaccuuuguggugucuuacaggagaggcggcucugaacgaguaccugcgggucaagacagugaccuucgaauacugaagaaaggucuuugugagaagaaagucccugccccucccucguggcuggggcccccucccucuugagccugggugcacagcaccucccaccuggggggcuaguggaagcccuccugccugcacaccaugucugcaucuuggacgcccucuguccagucagaagcagcccuuggcugggugaggugugccccucccagggagaauaaagcuucugaagagagaccguccacaucucugcguuucucugcuccaccuguggguguuccugggugggccuggaaguugcgcaaucaccuggguaugaugguguugcuuggccugggagagccagacaccuggggagagagacaggaggaaaugggugugggucaucucaggccccaaagagcagaagcugcgacagucagggcugcaggagguuuggaaggguaaccccugggaaacaggugggaagacggggauugagcugggugagcccuggacugggaagcagcucagacucccucagcagauggggccgggcccucgccccugcucugucagcacggccgugcucucagcugguagccagcccgagggccugcaguggagggcugggcccagcugggaaugccaggcagagcugucuuccgucugacacggugucuccuauguaccuuuauggcuucuccuuggcccagggaccugagcuauagcucucuuuccugugcccucucccuguaggagcuugcggcccuccucucugcacccacauccuauaggcaccaaacacugcaaccugaccuaccugcuguuaccucaguuuccccacauggagcucucuucuuagcaucucaucuccccacccaccuggcucugccccucugggucccacaggcccacugcaggccccucugucccuccc

SEQ ID NO: 14789 - RNA, 4444 nt, Homo sapiens
gggagggacagaggggccugcagugggccugugggacccagaggggcagagccagguggguggggagaugagaugcuaagaagagagcuccauguggggaaacugagguaacagcagguaggucagguugcaguguuuggugccuauaggaugugggugcagagaggagggccgcaagcuccuacagggagagggcacaggaaagagagcuauagcucaggucccugggccaaggagaagccauaaagguacauaggagacaccgugucagacggaagacagcucugccuggcauucccagcugggcccagcccuccacugcaggcccucgggcuggcuaccagcugagagcacggccgugcugacagagcaggggcgagggcccggccccaucugcugagggagucugagcugcuucccaguccagggcucacccagcucaauccccgucuucccaccuguuucccagggguuacccuuccaaaccuccugcagcccugacugucgcagcuucugcucuuuggggccugagaugacccacacccauuuccuccugucucucuccccaggugucuggcucucccaggccaagcaacaccaucauacccaggugauugcgcaacuuccaggcccacccaggaacacccacagguggagcagagaaacgcagagauguggacggucucucuucagaagcuuuauucucccugggaggggcacaccucacccagccaagggcugcuucugacuggacagagggcguccaagaugcagacauggugugcaggcaggagggcuuccacuagccccccaggugggaggugcugugcacccaggcucaagagggagggggccccagccacgagggaggggcagggacuuucuucucacaaagaccuuucuucaguauucgaaggucacugucuugacccgcagguacucguucagagccgccucuccuguaagacaccacaaaggucacagcagcucccaccacaggcagggcacugcucggggcugcaagugucuuauuccucagcaaccacgugggggcagcucuggcucaccccacuuccaggugagaagucgaggcccagcgaggucaugaaucuuacccagguuaucccuggcaguggauagugggccaggacuccccagaauacaaagccaaucugaggcagccauuuaagaaucuuccccagcucccaccgccuugucuggacagugggaagccccuucagguggaaggggguggagagacuuggcguuacugcccagacucacuggcccaucucuucucucauggcugcccccagcuacgucugcaucaagcuguggcugggaaaaggggaugccucgcagggcccugaggccccaggccuuggcagugcuauguggcuggugcaucucagccccaugacaagugugaggccuggggcugccugacagcuccccagcagcucuggcuggccccaggaguggcacugccccgucccucugagguccugagucugcccaggcaggcugcuuggaaggcuuggcuugugggccugucccaggagggugcugguccucucagcaggacauggggacuaggguuaggagggagcugagggaacucggggaggauucauaaggggcccagaucacguccuggggacuuggcagccacagccuucccuggguggccaugggccucauggauuccccugguggacaccaggaagguggccugggagaaggcaggaagaggaggccgacagggacagaggaagcaggaguguccagccuacacaugcgugcaugugaguccagcccugugggcacacaugggccccucucauggguacccuugggggcuucugcagggcuugaaagaugggggcagggggaggagagaaaacuggaaacagugaccagccuuugacccccagccucagcaugaccuucccuguggucucugggcuggcacaggagccuggagagacaggugggaccucugagacagcauauggcuuccccggaccuugccagccacccuugccaagcuugcccaucagaccugucuaguccccccugcugagagagcaggacgaggcccaaggcuuggagcagcccagggagagagggccggagcagaacuccaugccacccagcaggcagagcacuggggagccugugcugugugccgggggaccccgccugcuaugugccgguggaccccgccugcugccgccugaguaacuucaccucuacugggagacuugcaacacccgugguguucacccggggguacauuuggucccauggcuccucuuuacacuaaggaugcaaccugagccccugaccauggcccaugggccuucaaucuggccccuaccugccucucaggccuucucuccucccuccugcucccccuuggcccacucccaccacucuggccucucugcagcuccacgaccaaagcugguucccccaaggaccugcugaacccucagccagaaacacgggccccugggucuucauggccaacuccucccugcuaugcaggucuggguagcacaggugccaccacaccagagaggcccccagugccuccuggcuggagugucuccuccaggccccucuucuugccuucuucccagcacgaccccccucugcaagcaucuugcucacggacuugucacaaguucccucccaguaagaagcgaacccugacagccaucauguucaaggcuacgucccugcaucugagauaggaccuggcccuaagugguuuugaacagauguuuguugaaugaauaaaugaaagcaaccccacaggcaggaguagguuaccuagaucuuugccaaauccagacuguuugaauccuccgaagggagcggccacgucggucuuguuguacguguugacaaacacagugccugccuggagcuugucacugacauacagggccuuguugaugucccuggugaagacaccagaagccaggccaaauuccguggcauuggcccgagacagcacggcauccaagucccuggagagaaaguccaggaagaacucccugagggaggugcagaggagagccuggcccacuccacaccccggcccacuccacaccccagcugcauaagaccuuccgaggagaaaaugugccgggcugcagcgccgggggcaagauuggguuggguugggcugcgagcgaggaggaagggcagaggcccaugggcagguggccaccacaggggcuccuggaucaucgggugagcccuuuauuccacagacugggagcaggggcccagagaggggccgcuggguccucacaugcagaaggacccacaugugcccgccgcagguugggcauucaccagacaucagcgauuuggagacuuacuacaaccauauuuauuggcuagguggcagugaagucucuuauucuaauaccacugacauacgaugauaauuucugggguuuuuuugguaguuggauaguaaaaugugaggacgaggcacgauuuugcaauuugcuccaaggugcuacggagacaaggggcaggccugagaagugacagcaugggccucaguggccccacugugaguggaguacaguuuuucccuuccagcccagccuggucugggugacuugcuucaucaacaggccgugguggaagggaugcucugggauucuaaagagcuagauuauaaagagccuuuuggcuuccaccuggccuccgaagggaaccaggugccucggcaaccccgaggcugccacgcggaggaagccucccgcaagacccccagcagcaucaggauagccacucugucaccccagcugaggccagacacugcauggagcagagauggguuugccucauugaaccuagaccgugacuaaaauaaaucucugauuauuccaagccacucaguguggggggugguuuaaugcaugguaacagaccuuagaacagagcccagcgggcugugagaaacaugcuggagcaugugacaagugacaaggacagggaagggagcugccuuugcucacaggggggacucaaagccccaggucacugggcucucuucucagggguguggagacucagcaggcggcacaagcgggguguccacggcuugcgcccugccugaguucuccuccugacugcccguagacuaccucccaaagcccacaugaagaccccaguaacacgugggagagagucagggcccuugagacaucagcaggauucccuacccaucagcaaaccgagagaugaucaugacaggcccgaaggacuccuccuuggcuaugaacauguggucuuccacgucugugaaaacaguuggcucaaagaagaacccugcaagagagauaaaagcccguugcacaugggagacacggugcccgaugguccagccucuccgucagcagggccugggccacac

SEQ ID NO: 14790 - RNA, 6083 nt, Homo sapiens
gcaacagcagcgcacgcggaggcccaagcugcagcacucgaccuccauccugcgcaagcaggcugaggaggaggccaucaagcgcucacgcucacucuccgagagcuaugagcucuccucggaccugcaggacaagcagguaggagagcacagccccucaggccacacaugcaagcgcagggcagcucugcccaccaugugugcccccaccaggcaugguggcagaucucucccauagacuugaguuggggugcaugugggcuaaggcugagggcucugccccaguuccagcuccaccuguagcugcucucaggagccucuugccccagcuggcucuggcuggcguguaugaaggaccuggguugucuggcguuccuucuggggacuucuagagaguugucuucacaugaggccuuugccauggcccggguuccaugacccgcauggcccagaucuggggggccaugauaggugucugagcaugaggcccagugucaucgggacacacuggguacguggccggccacugagguucuaaagacccaggagagggcugagggagggagguccauugacagcauaaauaucacaagcucuggaaagaaccccaucggcagccagccaggggaggcugcuugcucuauuccuccuggcucacaccucccugcuccugugggaaauccccucauugaagacugcaccccucccccaggggccuuggcccuuagagguggcccagacccacagugugccuagggcugggcuugagggaggacaagagguagccucucaggguugagccaggagaggagaauccuggggugcagaggaaagagcgaggcccugagcggucccuggggaggccaagagcucucgcuuccaagucccuccaagugcaggugcacaguagguguuugaaugaggaucugagugacugcacagauggaugagugagggggugagugggccagugcauggacaagccgcuuagcaguuugaggcuucaagagaacccgggcucccaggcagcaguucugcaagcuugcaggggcaggcuggggagggcugucagacucuccccagcuccugggcacugagcucuagacagcuccuccagaugcccaggcagcugccucugccccugcuggccccagggcccuuucccgucuucccagacuccaugcugcagaagccccuggccuucacucccacccacacccauccuguggccccgcccgcccucugcuugcucccagaucuuccugguuauccuuuuucuuuaaaaacaauuuuuggguuguuuuuguuuguuuguguuugcugggaguauagauucaaguugcuccccuuuuuguccuuuaaggaguagaguucugggccuggugugccccaacuuccuaagggaguggugcagauacugccugggguugggggucguccacucucuugacagggaagcccccaucagccccuuccucaccuggcugucggugcugccuugcaacuuaggccggaccgacacagggcagagcaaccucuguuccuuuauccgugaugcccagauccaaaguggaccacgguuuauaguaagagaugucugcaacagagccauuuaaacagaaaggagaaagguugggacuuaauagaggccuuugaagagaauuauaugcuuacugugggccuaauaggacugcagcuauucauuuucauuccaugcauauuaucugaacgcccacuaugcaccagacacuguguugggugcccaugaccaaggcgaggccccugcucuugagcuccacuguggcacaggagcuggacaggagcaaguuagcaaugcagaggcaguugacuuccagaaaguaaugcaaacucuagggauucuaaacauuggggaaagaaauagggcagcuacgggaggcaauagcauuggguaaggcugguugggaagaccucucuaaggaggcauuagagcuggcugucccaggaagaggcaacagcugauguaaaggcugccgagugugugaaauggaaaggaaggccuggaagagguuccaaagagguaagagggaggaggcgacaucaagggccacugagcauuugaugguccacugagcuuccuggaaagcucagcaaaagugggaaugggacagauugcaugggaaucaccagaugaaaaaguagggugcccgauuccacgaggaguuuuaagucuggauaacacagaguccauuuuagugaaaggagcccaagggcuagucuccugugcucuucuggccccugacccacugugcccuccaguggcuuucugucccugaagcaggaaacuugaguggguuucagguacugucccugugucaucaagaagugacaguucugcuuugcugaagggcauucuuccggguuccucuucuguacugcucagaaguuucccuugaagggacaagugagggccggaugggggagcccuggccacggggucgacuccucuauccaggaaccaugugcccuggggcagcggcuucccuccgcugagcgucuucccuccgcugagugucuuguccuugcugagaagugggguagugaaaccccucgggagagcagaagcugcugugagguggcaugaggguauggggguccccagcacacauaguagaugagcacauguuaguagaaucucauccacugggucccgggaaacuuuucgaccgggccuggcaauaguuccaucccagaaagaagaaugacccacgguaaguuuggggacgaggaagaguagccccagguccaugugugucccccugggggaggaacugccaggggcucuggugaacaaaugcagagcccauugcugccuuccugaagucccuucgcccccaacacacacagguuugggcaggaggucucaggaaaacaggguggcugcguggucugcgagguccggagccagcaggugagaaggcccugcggggagcucuaggccugagcuggagguccucguacuugugccgcccacaaaguacagugagggaagaaaggcuuccuagaucccagccuugggccucuuaugggccccaggggcuuucuaagcuccacucacaacccaaaaaauagaaacuuucugcuuacaguuguggaagugaggucauuucuuggauggcguucaguaacagggcgagagagaaaacagacuguggccugggauuggaaaagucauuuugaucugcuccccucaagcccccccagcucuucuccuccacccagccugcugggaccacccagagccaggcagcacgcaugggcaugcaaggcccugcguggcccugagccagucucccuggugcaggccacagccuucgauuugcuggacgucuguuuggcauuauuucaguucugcgccugcagcugccugcucuccuugacagaccccucgcuccucgagggcaaggaccuccaugccucccauuccaccuccaggugugaugugaugcccagcauguaguggcaucugggaccauacaggcaggugcaacgcuuugccuggcuccuagccccacaucacaugcccacgccaccccagcaccccaagaggccuggcuuggcggagaagccaauuccuuaucuuggccgcaggaguguguucauuguccacucaggagcaaggugcagggaguggcccucaggaccguccuuggucacgggugccucaggaauucgggaggucugugugucccgcugaagcacccaggguucaccccgcccucucccugcauguagcucaccccucacaggaacgagcuguguaggccagacgagccaucuaggaauggcggugcucaugagggaaagccagcuccagagccugaaggccucuugaguauguguugagucucuucucugggccacaauuugcccaucuguagagcaagggagcuugggggcuuuacgaacuguaaaucccuucccagaaugcagcugagggucuuuccagcccagcugcccccgugcuuggcaugugccagcccuuggccucugucucccaggcucaccacagucauaggaggcaggucccagcacuaccccauuuaauagaugaggaaaccgaggaacugcaugggcucagugcuuacucugggucacccagcuaccaaggggcauagccuggauuagaacucaggcaccuggccucaaagccugcuucucagugcagcaaaccccacaggucucccugaagcucagugacccaucuggccacaagagcugccugguugaugcuguggaaaggaaaugaguccagaagccugugggccuugcugggaucuuuagccuaucucuugaacugugcauacuucuuccagggucuccaaauggguuucguuagauggcauaccucaagaugcaccagggccaggggcuucugugacccaagacacuggggacacucaacauaguguaucucacugccuuuuaaaguuucugaggcccugcaugguggcucacgccuguaaucccagcacuuugggagggcgaggcggguggaucaccugaggucaggaguucaagaccagccuggccaacauggugaaaccccaucucuacuaaaaauacaaaaauuagcugggcgugguggugggugucuguaaucccagcuacucgggagguugaggcaggaggaucgucugaacccaggaggcggagguugcagugaaccgagauugugccauugcacuccagccuaggugacagagcgagauucugucucaaaaaaaaaaaaaagaggucugagagaggaaaaacaugguugcacucauuuuaacuuggugcuucucuguccaguuugaccuugggacucauauuuugcauaagcccaccagcaucccucagcaguugcuuugaccaacuuugggaccuucccaggucgcacagccacguggcuaggaagugggaaggaguuugguaaaugucgcacugugccuacaugcagugcuguucucauucuccucucccacccgcagguggagaugcuagaacgaaaguauggggggcgccugguaacccgccaugcggcccgcaccauccagacggcguuucgccaguaccagaugaacaagaacuucgagcgcuugcgcagcuccaugucagagaaccgcaugucacgccggauugugcuguccaacaugaggaugcaguucuccuuugaggggccugagaaagugcacagcuccuacuucgaggggaagcaggucucagugacuaacgacggcucccagcugggagcccugguguccccugaguguggugaccucagcgagcccaccacccucaagucuccggcccccuccagugacuuugcggacgccaucaccgagcuggaggacgccuucucuaggcaagugaaaucacuggccgaguccaucgacgaugcccucaacugccgcagccugcacacugaggaggcaccggcccuggaugcggcgcgggcccgggacaccgaaccccagacagcccugcacggcauggaccaccgcaaacuggacgagaugacggccucguacagugaugucacccuguacaucgaugaggaggagcugucgcccccucugccccucucgcaggcaggggaccggccguccagcaccgagucggaccugcggcuacgggcugggggcgcagccccagacuacugggcccuggcccacaaagaggacaaggcugacacggacacgagcugccggagcacgccgucgcuggagcggcaggagcagcggcugcggguggagcaucugccgcugcucaccaucgagccacccagcgacagcucuguggaccuuagugaccgcucggagcgggggucacucaagaggcagagugcuuacgagcgcagccuuggcgggcagcagggcagucccaagcaugguccccacagcggcgcccccaagagccucccccgggaggagccugaguugcggccccggccccccaggccccuggacagccacuuggccaucaauggcucagccaaccggcagagcaagucugagucggacuacucagacggugacaaugacagcaucaacagcacgucc

SEQ ID NO: 14791 - RNA, 1226 nt, Homo sapiens
agcucauuaagauagcgccucgugugcaccaccagcagguccuccuccgaggccucccgcgccuccaccagcaugcugucagacagaagcuucucuucugaaaccacagagggagcauccugcuuccccacugaccucaaggccagggccagccccagacccucccacaggcugcagacuuggccuguggcagccccugccccagggguagguaggcacugcuggcuugugggccuucugagaagggguagccuccccagccacuguggacaguggccagucccucuggccagggagcaaugaacaucguacacacagcaauccccauguuucccaagccacugauagucacaaggagagcucaggugugcuagacaaccuucaggagcagguggcacaagggucagggauguugacccucagagugagaaaaacucuucuuaggaauucccccuccaccuuccccccgcccuuuuuuuuuuuuuaauucauuuaaagagacagggucuuggccagguguggugguucacgccuguaaucccagcacuuugggagguugaggcagguggauugcuugagcccaggaguucaagaccagccuagacaacauagugagaccgcaucucuacaaaauaucaaaaacaugaggugggaggaucacuuaagccagggagguugagguggcaaugagccuugauuccgccacugcacucuagccugggugaugggagugagacccugucucaauaaauaaauaaacaaauaaauaaaugcaagacaaggucuugcucuguagcccaggcuggagugcaguggcacaaccauagcucacugcacccucgaacuucugggcucaagugauccuccugccucagcauuucaaguagcuaggacuauaggugcauaccaccacccccagcuaaguuuuuuauuuuuauuuuguagagacaggaucuugcuauguugcccaagcuggucucaaacucccggccucaaguguucuccuagccuuggccucccagagugcugggauuacaggcacgagccacugcgcccggccucccuccaccuucugaugauauuacaggaggcucaguguggcauggccucgcaacaccugccugugcuuugcucaucuuccguucaaaccacuaaucagucucacagccugcaggcaauaguaaccagccuggauugaauuauacuguuguuuucauugcauuuac

SEQ ID NO: 14792 - RNA, 89989 nt, Homo sapiens
gccucugggcaguuuuguagccgggccccucaggcccucacaaugugcccaaggcugcugggcccaucuuccaggggugaucacugaggcucaggcuggcugagguggccggaccccaaccccuggcccugcccugugggcagcagugccaggucuggcacucagagguuaggccgggcgcagggagggugcgggcuccgcagcgagcgcgccgggcggccucuaggagccgggucagcgagucugggcucugagcgagcggcgccggcccggcccccucuccggcgggcggccgagaccccgccccggaggcggaggcggagucaggggagggggccgggggccggcuggucccgccucucgcgccuccgccccgccccgcgcgcacacagccaggggccgcccgggcucucgacgcgccgacggccgggcggacggacggacggacgccgagcgcagugccccgcggugagugcacgcggccccucccgcccggacucauccccgucgguccgcgccucgcagcucaggacucgggggcgcucggacgcaccgacggcucggcggacccucggacgcgccucgcgggcugcccgcgccuccacccgcgccgccgguccgaccgggucucgcucucccggucccagcgcggggacggcccgcgagcgccgcgacccaguguacagaugcgggcacagaggccggcgcggggugggggccagggguccgcgggcggguucccccaccccagguccgcagcuuccuccgcucuggguuucacuucuccccccugggccggcucccaccagucauccccucuggucccacugcccacccccaccccgaccgcaggaccuugccgccccuccaguccagagggccgggucaacccccucggggaaagaagacuagagucccuggucuaacacuacccccuccaucacccccaagucacacucaccgccacacacgcacucacacaagcagaaguuucugcacgcucugcauuggcgcgcccacccugccugucaccacauccucccucucccagccccaugcucaccccgccagcucccccaggccagaaucucucacacucaucucacguccccuuagcacacaaugcuccacacacacaugccuugcacauuggcaccccuccgaggcaugccucuagcagacaguugugucucugauaaacacaugugcccuuacugcccucugacacgcacacacguccgccacacagggguagcuaucacaugcauaucuccaucauauguaucacacaugugucucucacaugcgugugcuccucaaauaccuggaaucacaaacacugggagugccacacacugugagucucacauacgagucacagacccccacgacuucacagucccagccccccuggcacuccaugggcaguccuccccuguccuaggggguggggagccgauuuuggaggagggaggugguuccuccugacagaggcugcuuaccaugggaccuggguggcuguggggagcauggggguggcucagccucaggcugggccugacuccucaccuccgugcauccucucucccuuccccugcuccagucuccgaaauaggggugcccucccucccuuuuuugcugccacaaggaguugcccauaucagcuuugcagugaucacuugggccagucccaagcaggccugagccagcaggcguccccugacaggccaaaaagagaaaaagggaagucaaacaggaugguuugggugcuugugucuacccugaugccccugagaugcugguccgggcccucccagagggagcccugaugaauuggguggcagcugagaaguguucccucagccuggcauggauugggagcugguguguguuuguggcugauaggggcucugggccuuaacuuccccauaugccaaauggggugaagacuccccagcaggaggaagagagggagggggagcuacuccccuggggugcacccuugacuucccgcccuccccuucugcagcugagcugugugaugggggugagcaggggaugaagucaaagaaucuuauucuggaggcacaaaccugccagccccggcuguggcuggcccugcauguuuuguuuggcucucaccauguuauuauuauuuuaaaaaauuaauuagcugccugcauuuacaaauuggcaguuuucacguaaaaguccggauuuccgucuucucuugaaaagucacaaggucugguaguucaggaucugcaucuccuggcuggugcugcccacccccaacccaggggauggggcaggggcgcuguuugguccccguccccaccuggcccucucaugccuucucagcuccugccuggccugcguggccuuugugcggcugugacugcugcaugcauugggcugauuuugcuccauugcccgccucaagcauaggcccaggcugguccuccaugcauggcuggggaagcccugggcgggccuccuacccuucgaggccuuagucguugaagcaaugaguggugcccagggcccugggccacagggcaucuuugugaugguggcagacacuuccugcuaggcugugggggacggugguauggggaccccgugaagcaagagcucaugccagagagcauucuccgaggcaggcuuuauucaucacuuuucuucccagaucccgacaucccuccugcaggguggaacucuugcaccuauuuaagagacggggaaggggagguagagaaagggccucccagcaggcaagggggagagcugggguucagcccaggaucuuuucccuccaaagcaaagcucuuugccccucuuacugagccacuagugggaggacuuggucuccuuggccguggggggagugcccugagcccauccacaccucacacgcaauaggugcuucguaaaugcuuggggcaugcugaugguaagugaaacuggguucucugcagcaaauucgggccuaaggugaagauugcacagccacuugaccuccaucucuugaccucgugauccgcccgccucagucucccaaagugcugggauuacaggugugagccaccgugcccggccccuccuuuuuuuuuuuuuuuuuaaagacaggaucucguccugucucucaggcuggagugcaguggugugaucacagcucacugcagccucaaacuccugggcucaagugauccuccagccucagccucccaaguaguugggacuacagacgcacaccagccagcuaauuuucuauuuuuuguagagaugaggucucacuuuguuacucaggcugaucuugaacucuuggccucaagugauccucacucacagcaggugcaggugauugggugugaugaggagcugcugguggauucugguuuggggagggguggggucuaauugagauccuaaaggucccuucccccacacugcugcuggcagggaacaggcuggagggcagcuguggggauccaugcagcuuccaggugagagaaguuggggcuuggauuagggcaguggcagcauuggaggugagaguggucagauuuggacugacuuugcagguggggcugccaggauuucuugauggauuggaaguggagugagugaaaggggaggccagggugaggccggcuguccugcccggugguggacguaaacaccaugcauggcuucugguccuuagcagcccucugucauccaguuuccuuccccagguccccgaguguggguggugcagguguccguguggcugcaggcagcucugccuccagggcgccuucugaaugcuggggcugcagaggucuacccucccaauagaccagacagaggcgcugcuccuguaugcuacaggggcagaggggaccacagggcuguaccuccagccaggcauuauaggguggugggagcaguggguuuguggcuucaccucgggagggcugggagcugugacuggguguugugugggggcggccagggaggggcucccuggaguuggcguuccugcuuuagcagcucuaugaaacccuuugccagggagugugcccagggccuuggauucucuucaucaccccacagugcuggcaguagccucuggugugggccaaugcugugccaggggcugguguacagaggagcggaacacagggccccuuuuaaggucauccccaggggugccugcauggguugcucugaaaugcuuugucggggccauccuggaggagaacgcugaagccaugggaacugaggaggcaucuagcugagccuggguggucagggagggcuuccuggagguggcgcaggcacugugauaugaagguacaggggugaggggcaccuggggacagaagaaagccuggcuucuuucagagugggggcuuggaggaagagugggaaguaaggcuggcaaggccaacuagacccugaaaacggaggcccuccaguccuggucugcgagcgagcaacaggcagccucagggcguuccgagcagaggaggcgcggccagacugugagguugaagggucccucugcagcccagguguaggagugggccuggagaggacaaggcggcaggugggagaccugugagagugacagggccgggaaacugaggcgcagaguggggcgugcuugccugcagucacauagcgacugaggaggaagagcugggacgggagccagcuccguccaccuccagguccugccuggcgagcugcccucguguacggggcaccacugcacgcccacaccacaaacucgccucagcugggcacguccuuucccagggccccucgugggucaagccgugcgucauuuugugccauugucuucaguuauuggaauuuggaaacguugcagaaaugccucucucuccccucauauauggagauuguugcaaagcaagugcugguuuggggaaagguuauuuccuuccucgaggguggggagccuggcuuuccugagaggggcuguauuguaggcggccagugcgucccgcccaggucugugugcuggugaggaaguggugccacccaccugugccgggccagggauguggaggggagcacccaugugcucaggcagacccugccagucccaggucucacaccuugucgggcuucugguugcucaucugugaaucgggggcgccccccuggcuaugcugacauuguugcccaggaagagccuugaaacaggaggagggcucugaagugugaugaggcccagcugggcgcguggggagcaccgugggaguugagcauugccugggccugagcccccggagccugcaucaugagggauuugucuccuauccuuagcuucucaaucuggaaaaugggccuggugguaggggcccccaguaggguuggugugaaggcugaaggaugaauggagagccccaggcccacucuggggaggcggacagugcugcuggccguagcugguucuugaguguggcugagugcagccaccugugucucccguggcuucugucuucuggccacggagacaccaucaucuguguuggggccagcccuugggcuugugaucgggguaccccagugcuugauaagccucccagaguucuucccuccuuagccugggacccccauccuggcccugaauucccagccccaaccuuggucccaaguugagcuuuuagaugauccagaaaguucuguucuucuuagagucuccucaaaaugaaaacacaucgucaaaaaacauugaugagcaugcaugcgcgugcccacacacacguucucucuuucucucugucucuugucugucucugaagaucucgcucaucacuguguuuucuuagacaacuucccuaguccucguggugguugguguuggcugagcaucucaauguccucccucaucucugcuccccugcauggcuguggaaacaaauuaauuucaccguuuuggcccaugggcaucccaggggcccugauggcuguugucugauuauggggcugguagaggcagagggcuucuacggggaccugugcacuuucuuggggaauaagccagagggugucagcuuccuuucugacagagugaggaugaguuucaccaccguguuuucggcugcauccuccuaccuccuguccuugacaucauacuuaauaacuuaauguuauuuuaaaaaaucccuucccuguuuugcuuauauuuacuuuuuuuuuuuuuuuuuuuuuuaaauacugaauuuuacucugucacccaggcuggagugcaguggugcgauuccggcucacugcaaccucugccucccagguuccagugauuuuccugccucagccucccgaguagcugggacuacaggugcgugccaccacacuggguuaauuuuguauuuuuaguagagaugggguuucaccauguuggccaggcuggucucaaacuccugaccucaggugauccaccugucuuggccucccaaagugcugggauuacaggcgugagccacugugcuuggcugcuuauacuuacuuuuaaaggaaaccuuugaucacaacuguagacagaaaucaggaucacuuguccuaaaccagcaauacccauaaaaauaaauauggcacuaaaaauacagugcuuagcaucuuagccaccuuguaugcccugccacagccuugagcccgagugaguguucccuguuuuuuuuuuauuuauuuuuauuuuuauucauuuauuuauuuuuugagauggagucucgcuauguugcccaggcugaagugcaguggcgccaucucggcucacugcaagcuccgccucccagguucauaccauucuccugccucagccucccgaguagcugggacuacaggcgcccgccaccaugccuggcuaauuuuuuguauuuuuaguagagacggaguuucaccguguuagccaggauggucucgaucuccugaccuugugauccacccgccuuggccucucaaagugcugggauuacaggcgugagccacugugcccagcacccugguuuuuaaaaagaaugguuggcaagcgucugagaggugugggaggcacacccgugcugucuagagacggucuccaauagccagauugguucagagggauucgcggggacauuuccucacaagaucaccgagcguuggugcuugucccugaaaucagcuguccuuggaacagucaucucuaucccugcccaggaaguccccugugguaggggcgucacauaccucacaucuccuggggcugccuuggcauguuucgugcuaggcugggguugauggaggaggccccagcccucuagcaggaaugucuucucugagaccaagugucuggcucucagggaguggccauguccucugugcccccagcuccgugcccuaagacuguccuggcggguuccggcugcuauaacaaaugucacagaugagucggggaggagauugaagauggacauuuauuucucaguuguggaggcuggaagucuaagcccuagauuucguuccuggugagaguuuucuucccggcaugcacguggcugccuucuugcuguguccucacaagguggggggugggaagcggcggacggagagagagagagaagggaagagagggagggagggagggagagcuagugagcucuggucuuucuuucuguaaggacacuaauccacacaugggggcuccacccauguaaccucaucuaaaccuccuaauggggggccccacccccugauaccaucccacuggggucagggcuuucacauagaaauguagggaggacacagauguucagccuguaacagacugguuuaaugaacugcugaggauggaaacacuguaacaccagcugccagucccugugugaccccaaggcagggugugguggggaggccauggcuuccugugcaugggaugggaggagugaccccucuuuggcccuagacguugggguucccagggucugguugggcaucagcacaugacacuguagcccaccuaugaccugggcuuggucccccacagugacuucggaaguuggccugcccauugcuggaagcaggggccccuuugcacaggcuugucugugucugaggcuauucaggagacguaggggccccacuacauccuccuggaaggacuagugaucugucagcccugggucaaguugcagccaccaggacucccucacgccccaucuuucuuuugucucugccuuucucugugagccugguugauucucucgaaaugaggcccgccacauggcaggaaaugugcccaccuucagaacuugcuguuucuuccucugcagguggucugugcuuucuuuuauuuccacuucaagagcucagggaggagcugugaccagcccagccugggaagaacaucugcccugggccagucagcuguggcuggggagggucaggaggucaugcguugauguggccccaggcgcaugucuggagccauucccugagccuggggacugagcgaggcagccugcugcccuaggaggggucuagucuacugcagggacacauaaccccagcaacucagacauuuugggguuaagucagccaugaauacaagaaggugguucuucuuucuuuguuuucacaaaugucaggauaauuuugguuacaggugauagaaaguacaauuucagcaaaaaagucauggaacuaaaaaaauacaggguguagcuucaggcauggcuguauccagggccucugcagaugccaucaggaccgggucuccaucucuugcucugcuguucucuguguuccauacucccaggcaggcucugccgugugguggucaggugccccagcagcuccaggcucacccucgagcucagaagcucuggagcaaggcagccuccucccaggagcaucagcaugggccaugugacugggucgugugacugcucugaccugucacuguggauggggcagggacuccucucauuggccauccagcaguccacguagccugaagugugaagggggguuccccagaggagaaaggcugcagugauuagacccacugugcagaugaaagcauugcugcucagagggucacaugcuccgaggugcccagcagccuaguggcagggcuagguucaaauuugagcucugaucucugggaguccagagcuugguccugcuggcugucucccuuggcuuuggcagcaggggcugacugccuugggggccuccaaggcucuugagcccaacgguuauaccacagacugggccagaccccgcuguugguuguacacuggccgccucacuggcagcccugagaaauuccuaaauuucagggccgugcaaauaaauugggcacagcaaaggccugagggacucgcagagagacugggcugcccgcuccccuggcugcugccuccuuccagaugcugugguggccaagggagccugguucugccguaggccggccccgccugccugucuccaucgcugucugucucuggcugucugcuuggcuuucggucugugcuucucuccaucucugucuuggucucuuucugucucacuaauggaucucuuuccuugucucugucagucucugugucucucucugccugucuuuugcuggcaccacuccccccaccccgccacccaagucuaggaucucagcccuuugugagacuaaaaggcggacgcaggagugaaagugccucuguaugaaagguggacacguaccuugguuguuuaggucacuuagccagugacuagccaggugacuucagggaagccuuuucuguuucugaaggcccuucugggauacucacauucauaauucaucccauccucucugccagcccugugcucgggccauacggauuaauuaaucuaccccucuccacucacccacccauccauauacccacacacccauccauccacccgcccacccacccaucuguucacuuacccacccauccacccaccuaccuacuuuuuuagccacccauccauucacucguccauccauccauccauccauccacccauccacccacccacccacccacccacccaccuaccuacccauucauccaucuaccuacuuaucccacccucagggcuuggcuuuaaagcauggggugggauuuggguguucaggguucuaggagaguuucaggagagagggcaucgcagguugagcuaaugaugagagaaagauaagggguugggaacuagagagaguuuuccaguuuagcaggaguuggguuuguggaggacaacagagggggauggguuaggaaagcuaggugggguuaguuggugaagggcuuugaaugucuccguuaggaguuuuuucuuuauccuugggccacaggacuucagccaggggucugugaguggacugcagggagucuaugaaacucccucacauagcaguuuuagguaugugcccauaugucuguuaaggcucuugguugcaagggacagaaaaccugguccaaguuagguuaaucaaaagggguucaugucauugugaaguucaguuuuucaguuagcuucaggcauggcuggauccaggugccaggcagcuaucacuaugacccuguuucucuuucuuggcuuuuguguauuuuaugagcaggugccagccucugauggucuccacuugaugacaagauggcuucagguacccuugauguuaaaucaucuuagucuaauacaguaggaaagagagaagcuguuugcccaguguuuuaccugaggugggucuuauagucucuaauuguccugguguccaucucugagucaggugcuguugcaaggggaaugggaagugcugauuggagcuccagcagggugauagggccacagaacgaaaucuaggggcuguucuuggaaagaggcugaauaugugccagguggucagaaaccacccagugucgcugcagagcuugguucauuaugugcuuuuuuugguggagcuggguguguauuauccauagcuuuuugcacauucuccagggggccagagcugauggagaaccauucaggguuuggagcagggaugagaggugaugagcagucccuggaggcaggaucucgguccaggagcagaccauguggagcaugccuggggauuaggacuccccccgccccaggcggggcaugggugugccuccuucuagggucggguggaggguguguggagcgccagguggggaggguggugaucucagccuuggccgugggcagccucauuucucaucgcucccacccugggaguguuuccucuuugcagaggaguaacuuguggggaaggaaaauaccagcucccuucaaugccaaaagcaacauuuucuuucucaaagguugauuaaaagucacggacauuaaucuuuguaauuuuucacgugcuuauguugguaaugagauuagugauuguguauguagggucagcucuuaccuaaaauuuagggagcuuuuuauucauuucuuguuuuuucuuuuuuuuagggaggagagggaagggaggggagaaaacccuggcuguuccacuugaaagauuauuuuucccaggguuuucaugagcucacccuguugaaggaaggcccagugaccagugagcgugugaggagcauggggcaccugguacccuaagccccaccugcggccuacagcuuggucuguacuucacguguagggcuugcccuggaccugcugucucccuccuccuccuuggggucucacaccacccaccugugucaucagccucaccuguucaacagaaaggaccacagaccucuccucauccuccuggcccgguagcccuuuccucgcagccaagcuucuggucuuuugcacaucgugcuauuauuaagacauuugcccgcgaggaaaugaaggcaacuguaguuuucaagauugaagccaacuugauuacuuugcucugauaauuugugaguuucgaaucauuucccuuccuuccguuucuccugccaacaccuucucuggcuuuuguuuccuuuuucuggauuacugcaaugguucuuuuuuauuuucuuuaaaaagucucucuuucucucucugucuuuuagauacgggguuuugcucugucacccaggcuggagugcaguggugugauuauagcucaaugcagccuccaacuccugggcuccaguaauccucccgccucagccucccaaguagcuagauacagagucucuuugaagggaaaaaaacacaaacauacaaaagaguaccuaaaagucgguguagggugguagaggaaauucuuggauaaccaccaccugggcaaagcaagaggauacugcccgcccccauagguccucugauuucccuuacuggccacuagacuuugauggugacaacuccugcuugacuuucuaguucugguuccuacauuugcagucccuaaaugauguagcuuagauuucaccagguuuuguacuuuaugacuggaaucugucccagauuucucaaaaggggugucuacagucuguucuugaauucccagugugcugugaccuagugguggcccugccacccuguugggacaacauccacuaaauguaccagauguuuugcugaggucccugggccccggauucagugacugacugaucgcccucuccuuggcaucucuucuuccuugauguguguccccacccccccgccaccucuaucauuuuucuuugugcugcucacuucccagcgaccacucucuuccuccuucccugcaugccggcugcagugugucaggcugguuucugccucagggcuuuugcacauacuguuagugcugcuuaggauaccauuccccagaucuuugcauggccaccacauuuuugcaugauaucagcaaguagguugccuccuaggccuccucgucugaccauucuugccaaaggagcaugcggucugucucugucacaacgcccuuaucucuuccccccaucagaacauuggcugcaugcggguaggacuuucuuucaucuuguucgcugccauaucccagcaccugcagugggcuggccgguagcaacuguuugaugaauagcugcaaacuaaaggacucuagcucaacuuucucggccagacagaccuguucaaauccccacaccuuuuacuacuuauguggccuuggacagaucauuuacucugucugggccucaguuuccucauuuguagguauuaaaugguuaaggaaaauaaauaucccuggaaacucacaguccagugauuggcauuguguuggcacugaggaagugauaguuagacacgaacuugauuaacagcuaaaaucccuacuugaugcuuugugccaagagcaaguuuauuuuucccagugaacuagaugacuuccucuuaucagagaaggagcaccgggucacccucuaauuucccuuuuggcuuuggcugccaggaagcauacugcuaaggggaggucucaggagcagcccuuauuuccuguccaucuucagugcaguucuucuucccuuucuucucccuguucuuugguuauuuacguuuggcucuacagugcacauuugugauuauuguccuuuauuuugguaaaauauacguaacaugaaguuuacuuuuuuuuuuuuuuuuuugugacggagucuugccgugucgcccaggcuggagugcaguggagcgaucuuggcucacugcaaccuccaccuccuggguucaagcaauucucgugccucagccucccaaguagcugggauuauagguauaugccaccacaccuggcaaauuuuuguauuuuuaauagagauggcguuucaccauguuggccaggauggccucuaucuccugaccucaugauccacccgccuuggccucccaaagugcugcuguugcaggccgcgcccggcugcgauuuaccauuuuaaccugcuugagugcacagcucaguggcaucauggaaguucacguugugcagccguuaccacuaucuauuuccagaacuuuuucauuauccugaacagaaacuguguccccauuaagcaggaacuccuccugcuucccaccuccagccccugcacccaccauucuacuuucugucucugaauuugaugacuguagauaucucauagaaguggaaucacacaggauuuguccuuuggugucuggcuuauucaccuagcacagcguccucaggguucaucuguguugcagcacgggucagaaugccccuccuuucaaggcugauaauguugcauuguauggaauauuuuguuuauccauccauccauugauggucacuuggcuugauccgugugacucgagucuaucaugaauaacacuguagugaacuuggaugcgcaaauauuauuuuuaaaaaauuacuuucugggccucagguggucucaggcccacuaauaaauuaaggguagauuuuuggacaguuucuaggaucaggcugucuucccugccucugccugguguguggcugugugucugugcucaguaaacuccauggccacugugggugcccacccaggucucucaccuggaggugcacaugucucccagcggccacaggugcuggcugcugauggcucacaccugugccuucuccagcugccugcccuuugcuggcaggugucacuuccccgugaagugccugggaggucacucuccauggucuuuggccagugacugacaugccucugagugggaugcacccggggugccccccacacugcauggcuucucgugggucacuggacuccagcugagaugcagucuugcccagcucccccuggcucugccugcuuuccuuugcccuucuccugagcgcucucccccgacagaccaugcccucaagcgucccugccucggacucugcuucuggggagccccgucuaagacagugcgcagcucacauaucccucugagcacuaugggucuugcauuacugugggcguuggguuggauucugaugcagcugaccuacugaggccaacuacaccauguggcuagagguggucuccuuggaagagggugagaacucccagcaucuaucacauauagaagaggcagguccuaacccaggaaaccaagcuauucuggaggcgacccuggggcggggugguuggaggggcaggagcucccaccucauccaggccucucuccuccugguguggacaagagacgcucaggccuuggaguguucaggcugguagagaugacucaggaagcccaacgaugccaaugggaagggagugugcauccaaauuagcccagggaagcccuguugcugggccccacagcuucagugucaaguguccugacauuaaauguuaucauuuuaaacuaauuaucaaugaguaauauuggcagcuaauuuauaaagcaccaugugggccccacaaacacaucugugugugaacaggcuggguggcugguuugugccugcucucugcuuggacuugggcccgggggcagccgugugggcacagccagcgggccaggugguacugauuauggguuucuuugucacugucuugucugugagugucuuguguguuuauuucccugcugccaucccuagcagucccaguuugcaagucccaguguuuugauauagcugcuuauuauuuuuuuaaaagagauccccugcaaauauuuaaaaaauuuuaaagccauacuggcgccaaccugagacuuuguucuuaucuacaguugccucaucaaauggagguugcccaguuaaguuggaauuucagauaagugacagaugugugccaaauacuguacaggacauccuuaaaugcuagacaguucuccaucauuucucugagaugccugugcacaucccagaucuguauuugcuggaucucaucagagccagaagggucagaacuggaggugggaagaccuuuccuuccugauccagugucauauccuguggccugugugcucacuaaggugggacccccccaccuuuccacaguggcagcacuggggauguccccccagguggccuugaccuuccaguguccucgccagcccagagagguuucaucuggggccugcuguggaugaaugugaagguuaauuuaucaaaggaggcaguguugcuuuacuauaggaugcguguuuguuuuugugguagguuggggcccagcccuaucaggacagcagagcgaggagcuuguggccaggugagagaggcagcuggggccugagccacauccugaggcacuucugacucugaugugccggagcccucccuccccauccugccugccccaggugccuugugaggagugggcaggucucuaggagacucacacugugugcugagucaccugucccugcuggacacucccuggggagacccuggcugaaugucucuccgcccccacauugcccugugcacguucaagugauggcccugaguacguaaccccaggugugaacccugcugccacuuuagaauacccugguccccccacccacagcagggauuugaucaacaaagaccaaagcugugauagccccaccugccgcugguccugucuggagccugcucuugugucuccacuccgguggcaaagccuugcucacagugcuggaugcacucccagaugcuaagugcugagugccacuucaugguggcuugacguccucauugucaccuaaauguccauugucauuuuggcucuuccugugaagaaugggccgccaaauacagaggaauggcuaggcgcagaggcucacgcuugugaucccagcacuuugggaggccgagacagggugauugcuugaggcuaggaguuugagaccagucugggcagcagagcaagauccugucuccugccuauuuuuuaaugccgugauauauguuacgcacaugauacguaaagcguucaucuuuuaaaaaugccagcaguugccaacccucaccccuccuaggguugcagccugaggccagccuggacagugacuggcccgguggccuccaccugccaaccuuuccuguccccagauggcagcccggugaccaccaggggccauauggaccugguacagacgucucugagucgcacacugggcgucagaagcacagggucauggagugcaugugcugaauucucacauggguacugccuugcaaagaggcugcuccaggugacacuucggccaguggcauaagaaugauaauaauaccacuauccuaguguuugccuuccugaugggugcaagggagaggcugcagugguuuuacuuuguaucuuguuguuucuugcguccccacccgggagggcuggcuuggugcagugugacugccuggcuggccaccgcagccagucccaggggcuuuguuugcuggccaggcucugacugcugggacuguccccccgcagggaggucaggccuccuuccccaccccaucuccaggggcuucuuuuuucagguugcugaggggugggagcugucugcagaagccgggguugugggaaaacucagcuggagcucccaggaggggcauguuugauucugugacccugcaguguagagacugugcccuccugcuucucucuuguacgaguguccccagcccugcuugcuuaucucuggcgauagauagggagcucacuccuucccagcagccuggucagucccugcccuggagggaguguucuccacuuggagcugacaucugccaucuccuccaugcccccaccucccgccccacacauacacgccccauugggagcagcuguggagaugugaggacagugaggucugcuauucucccaggugagccaccccaaggggccugggcccccucaccacgugggccacucccucucgacacaucccagaugguccuuuccccuccugaguggacauacaaccaucagacagcaccaggauacucugagcugcaugcauuugggggggcccagacgacuuggggaaccugggagcucacaccccaugugacaucucaggguggccagagcucuguggcuugaaacaggaguuggaaaccugaauuuuuaugugaacguuuucaauuuaugcaugcugguaaccaauuuaaaaugagaaacccacugugugagccaaacgaaagcacuuaugggccagauaaugcuggugggcccccgacuaugaccugagguaugguggaacacguucacuggguggaugcagaaccagggcucagagagggccagggccgugccugggguugcgcagcaaauguggaaaaugcagagucaggcuugggccugauguucuuuaucauugcccugggccuggaguggggagaugggcaagccugagguuugggauugcuuaagcauggacagaaugugaugcugggggccuggggggccaaggggccaggucacccugggggcugugccggugagcagagcaaggggauggacuugguggaccgggugguggggcagggugggcugggaaggaaguucuucuggaagaaguucuaggacagcccuguguccuguggcugggguacuguccucucaggacacaacguucaugccuaggugugugaugcaccugaaggcaggagggcagggagcuugggucucaguucaccaaagauuuccuuuuguuuugagacggggucucccucuguuccccaggauggagugcaguggcacgaucucggcucacuccaaccuccgccuccgggguucaagcaguucuccugccucauccuccugaguugcugggauuacaggcacacgccaucaugccuggcuaauuuuuguauuucugguagagacaggguuucaccacguuggccaggcuggucucgaacuccugaccucaagugauccgccugucuuggccucccaaagugcugggauuacaggcgugagccaccucgccuggccaaagauuuccuuucuuaaaagacacugucagcuggcacgguggcucaugccuguaaucccagcacuguaggaggcugaggcaggagggucgcuugaggucaagaguucaagaccaaucugggcaacacagugagacccuuguuaaaaaaaauuagcuggguguaguggugugugccuguaguuccaccuacucagaaggcugaggugggaagaucgcuugagcucgggagguugaggcugcgaugagcuaugaucacacaacugugcucuagccuggacaacagagugagacccugucucuaaaaacaaacagaaagaacuguugagaguggaccugagggccucucccuugcagucuggaggguccuugcuuuugcugacugggaguaaaggcccugauucucccaggggcccauuccuaaugucaguggcuuuacggaguccuccagcuuccugagguggcaccucagugugagggcaggggcgucagcccucgaggccccagaggcucccuagcacuccgccggcccugagccuggucugggcaugggcuuccaucucccugcccguccauggcccuccaccgcagccuucccugccucggucacacaacucccccuuccaggcgcuccuggacuucugucuucuguccgcugcauccuauccaucagcaaauccuguggguccuaccuucaaaauagauccccugugccaccaucuccugccucucuucgcucacugcccugggcucucucaccugcucccugcuggcucccgugucucagcgcagugggcagcugggugggucccuugcacuggagagucccaggcuccagcgcuuacaggcacgcccagaggcccucacagcaggcuggaagcccguugcucugcaguuaccacccgugugcugauguggcucagcccugggggcccucucuguccuucaccuuucugcugcugguccggccucagccccuuggcccugccacucccugccugacgcccuccucagagaagcccuccucuuccgccggacugacacgggcuccccugacacugccacguccuccuuccgucuccuugauucccuucauuuauuucaucauggggcucaugccugccuggcguucaguucucuacagauuugcucuuggguuuauuaucugccccuccaccccugagggugucagugcugugaggacgcugggaaccugucuugcuggcugauaaaccccugguuccuagaggggcugggugcagaggaggcguuccuuuagaaauggggcaggcuuggggaccacugcugugguaacgaguccugcugucccucugucacugcccuauggggcugcgcuuuaggcugggagucggagaaggagcucuugccugugacuuuggggagcacgcugucuauaagagucagguacggccacugggucacaaguggggcuacaggcacuggggacuugggccaggguggaggagggaggaggcaugaggacuggugagaagguggcauuugaguggcuugugcaagaugagaggggagaagagcccuugggggaguucaggccuaagggccugugggagggucggguugggauggcuccugcagggccuugagugccaggcucagcugggaauccagaccuuuccuuucuggccaugggaaacuggggcgggcuguggggccguggcaugucggggccagcugcucucaggccagacuggguucccugggaaaggggaggaguggugggcagggagguggcggggcuguuccaguggagaucagagcugagacuggaguggggacagggccuagagauggaaggaagggguagagaccguggggagggaguggagacagauugcggggagaauggacaugacugggggaguuggugggguguuagggacagcaaggcaucaggaugcauuugccagugcuacuggggagggggacaggagcguccccuggggcuaagccugcagucccgagggucucagagguguguuccugaguccuagggucugcgggcuggggcuguagggggcgucuuguucuugccuagcauuuccccacugacuguauuuucuggccagcagcuguggugcguggcuggggacugagucaaggaucuggggggagggauuggucgggugugugcgugggacugugcgugugagaccgcccaggguguguacuggcacgugggcaugcugugggugagacagcguguguaacugcauagaggauuauggggcauauugccugacgugcccuggugagugugaccgaguggguguggggcugugcaugugugugugugggcacgagggcucacucagaggaccugccucagaaugcaggugaggauggaggauggaguggcccagcaaacacguguggggcugucagcgacuccaggucaacaccuguggcgcccagcgacuagacacucaccugugugugaucugacccauguguggcggagccugugugugugugugaggcagugcuuagugugcuccuggggaugagcgcaugcgugugagguggcugaggcugggccccugcccgcgugcgugccggugugcaccgugucugugugugcacacccaguacugacaggcuuccuuucugauucccccagggucuuacaggagaggggaccguccugggcuggccuggaccauggugcugcucugggagccugcaggagccuggcuugcucugggccuggcccuggcccugggccccagcguggccgcagcugccccucggcaggacugcacgggcguggagugcccgccgcuggagaacugcauugaggaggcgcuggagccgggugccugcugugccacgugugugcagcagggcugcgccugcgagggcuaccaguacuaugacugccuacaggguggcuucgugcgcggccgcgugcccgccggucaguccuauuuuguggacuucgggagcacugagugcuccugcccaccaggcggcggcaagaucagcugccaguucaugcugugcccggagcugccgcccaacugcaucgaggcuguagugguggcugacagcugcccacagugcggccaggugggcugcguccacgcgggccacaaguacgccgcuggccacacuguucaccugccgcccugccgggccugccacugcccugacgccgguggagagcucaucugcuaccagcuccccgguugccacgggaacuucucagaugccgaggagggugaccccgagcgacacuacgaagaccccuacagcuaugaccaggagguggccgagguggaagcagcaacagcccuggggggugagguccaggcgggugcaguccaggcaggcgcagggggccccccagcugcucugggaggugggagucagccacuguccaccauccaggcaccccccuggccagcuguccuccccaggcccacagcggcugcugcccugggucccccagccccagugcaggccaaagcuaggagagugaccgaggacagugaggaggaagaagaggaggaggaggagagagaggaaauggcugucacugagcagcuggcagcagguggccacagggggcuggaugggcugcccacuacagccccagcuggacccagucuuccuauccaggaggagagggcagaagcuggggcaagggcagaagcuggggcaaggccugaagagaaccucauccuggaugcccaagccacgucccgcagcacugggccggagggcgugacgcaugcaccgagccugggcaaggcugcucucgucccaacucaggccgugccuggcucucccagggacccagucaagcccagcccccacaacauccuguccacaucacugccugaugcagccuggaucccacccacccgagaagugcccaggaagccgcaaguucugccccauucccacguggaggaggacacagaccccaacucuguccauucuauccccagaaguagcccugaagguaagacccuguccugguuccuucagggcacuuugugugggaagggcagccuugggcucuggccgcugccccaggucucugccuggggcuggggaugcuggacuguggggccaggccuaggguggccaccccaggcccuugguuugggcaggaggcugugagagugcaucuucucccaggcccagcucuugggaugggaugggugggugggagugggguuccuguugugggaggugcugggcccccugguagggcugcgguaguggucaaggguccagaaggugcacaucuucagagcugggggcccugaggaggguuccugccucagcccgguaggcccccacguguccuggcaggaaaugcgaagggcggucucuucucagcugccccgguggcuggccuguggccuaggagccuagcauggccaccucugccaauuuuucaacaaaugucagccagaaagcugaauuuuaugugacaucuucccauuucuaagugucugcagcaaauccuaaucucacaagcauguguuguagaaagaagugaacucguggacagaggcgaggugggugggccauuugagcaggggcgcuggccaugcugggccaguggaggugguggggccacaccagcuguacccucacuccauggaggccccucuccgagcuggucaggcagcuucccaucaguccuuccagcagcaccgagugcuuacuacuauguacgcuguuucaccagugaggcaacuggggcucgaggguggugcuggaggcucaggucacacaaccagugagcagugggccuggaaggcccuggagccugcacuccugacccuauauccuccaagccaccugccacagaguucaauacacuccaucgggcacaucagagcaggcagccaggaccagggcacccaggcuucagauagggaccggcccaaggcugugcagaggcugguaggcggcccaggccucuucuugcccauccaugccugcucccagcagguccuccauagcccagcacagucagacaccccauuugaagaccccaugagcuguggcgagaaggggaaugguccgcugagccuaccuaagagccguccucaaagggcgcugcugcuaagcaggggccacagcccccacgaggcugaccccuuccugcuuacuuuaggagccuugaacuccugcagggggugauucugucacaagagcugggggcuugcagauccagaagccuggucuagcuuccauggggaccuggggugaugcuccuaagaccccacgcagguuugaaacccccgugggccaacacuggagaggagaggcuucaggaguccucuagcaaacagguuaaucuggguggauaacccugugcugccacagccuagggaaucugggggccucacagacccacagacauuggaaaggcccagagcuccgucagugugagaggggacagccccgcaccuggggggagcgccucaaacacaaaucagaucaugccaccuucugcccuauauggcucccuccggccggccccuccccagccucuucucacaccagucagagcuuccuuucaaucaaguucaauucccucuggcuaaggggccuuugcacgugcuguuucccccgccuggagcacccccuucucaccacugcccacuuaucaccucauccucuacauugcagcucaaguggaagcucaagacucccugcagggagccuucccugacccccaggaggagucagauccccugagugaggcucaccacuucacuccucagcucguaucacugcucagaacaucacaccucugugacugcuggggucucuaucuccuccucaaagccccaagcuccccaaggucagggucucugcuggguuuugugaacccuguacauucagcaucuuaccggcuccugugcacaugcugggcacucagaagccacugucagagggugggccgggcgugguggcucacgccuguaaucccagcacuuugggaggccaaggugggugggucaccagaggucaggaguucgagaccagccuggccaacguggugaaaccucaaaucuacuaaaaauacaaaauuagucuggcgugguggcaggcgcccguaaucccagcuacuugggcggcugaggcaggagaaucaccaccugggaggcagagguugcagugagccaagauugugccauugcacuccagccugggcgacaagagugaaacucaaaaaaaaaaaaaaaaaaaaaagggaaccacugugagagguugaagagcugaagaaggcagaagagaagccugcuuccaccacuuucugccccuguguccacaggcgguggccugagcucccuguagcccacucuccacuccuguaaacuaagagggcuguugugaggacuacgcggcucagcaaucacagagcgccgagcacggugccuaacagagucaccguguugaggggcgucugcaguggacagcagcagucauuugaguuuuaggguuucccuguuagccagagcaucacagcauucagauacuccugcccugcagaaccugcgugugugaggcccugaggaaggggccccuuuccugccaugcauuccuggggccacaggcugugcugagaggccuucugcaggucaggggcugcccccagcugcucugggaaccuccgaccuccugagggccgcccugcccgaggguuccuccguguggcccuccauugugccagcccugcgggaaaagccgcccucacgaagccccuugagugacaacagacgucagaccccuucuucccagcccagggagccgggcauguggcuuccauuaggccacaucuggacaugcucagaggcagggauggccuggccgaggcagucuggaucccuggcagggcuccagcucaaagacaggacccccagcccagccaggccuggggcacuggcuggaaaccccuucucuaggccccagggcugccauggcaacgcggcuggaggggucacuucuggccccauuaccucccuuucugcagggcccagggcugagcagggcaaagccaccuccccagcuucuccucaccaagggcugcuccaucaucuagaucccccaaggccucccccaacaacagcagccaggggcgcuaggguccaaaccccacuucccccaagaggcucaguugggcagcccgaucccccacccgcugggcuuccaucucccaccccucccaugcugcgugcacauggccgugaccagggauaaaccugccuguguacaucccuguaacgcccuccucccccauuagacucuaaacgagggcgagguugcgucugccuugcucacugucgcagccuuggcucagugagggugcucugugaguaucuguugaagauaucagcgggugggcugaggacagacggugacuaaucaucgucgcauuucuaauugcucagcaaguccucagcugaguguuggacacaaauuagcucauuuaauccucaaagcagccccaugaugcagggacuucccugcugcuuacagguggaaaaacugaggcacaaaaccauaagccgcaugcucagauucuguggguugagccagagcccaugaauucgugaugacaagugggccaugggugggcagaagggugagaguuggggugcggcuguggauguuuaucuggccaggccugagcuucuggguccccuuugaauucauccucuaccccuggguccuuaaaccuuccauucccugcacaccaaacgcugcagcugccugucccugcccuaacucuggucucugggccuuugcguuugcuggguccccugccagaucagccgucagacaagauaagggggacucaguugggggccuaacagccagcaguccucaucaaagcccacaccuaaaaaaucuauuugagaaagcucagggcagaggggaaaacuggggcuccugauaacaaagcugcucucuaggaucccacagcccagaccacagagaggccucgggcaucaagaggcaggacugggggccagggguggggcugcuucuauuucagaaacccuggaagcugcacugcaugcaccacgcuucugagccuggcugcaugcccucccuggcacacgugcacuucauuacacacuccacccacaacaugcauguuccgcuccucccccaucccagcccaccaccucccaccaccaggucccgccugugaccuggugcugcuagccacaccucuuggacugugcucugcugagaauagggagauggagccuaccuccccagcuuguugggaggaucauaucacagaaacaagagccgggcacccaggaggugcucggcaagggcgaguucugugcccugcccaccguaagcaggcuggaagcagaguuggcagggguggcagccgguaggccuggaggaacccacagagaccccaguuucacccucauugcaugugcaugggcuuugcacaugguccaugcccagcaagugcugugggaggacuugggagaugggaaaacaggauccaagcugguuaagagccuugcccaaggccacagcuaugggcagcagaaugaguagaugggaacacugcugacacugcagagccccucaugcccccuccuucaggaagccuucccagauaucacacaggccucucuuccucacagcccccagucugugaaccaaguccauacugguucaucucugccuucccagggaugccaggacaugcucagagcugacaccugaugaaggcuguagaguaaaugauaugggauugaacaagacacaggcauccaacuguggggacagaucucuagaaaccucagaagggagacaggaagaaaguagagcuggagcugggggagggggaugagugaaggcacaaagauucaggaaggcuucccaggggaggugcuaucugagcuggccaggaacaguguaagcaaaugcuuggaacagaggggagagaggucggaaugcucaggauggcaggagaacuagggugaggaggaauuacugagagaagggguggucagggggaucccccccccccggguucacucauuuauccacccaguauuuauagcgcuccaacugugugcaggcccugcuagaggcccuugggcucugcagagaauaugagagguaugguccccacccucaccucacagugcugacauucuguuggggaagaaaacaguaaacaaguccaugggaauuaucugcuguaaugucagguauugcuaagagaaauuaaagcaaggugagguggcucacaccuguaaucccagcacuuugggaggccgagguggguggauggaucaccugaggucaggaguucaagaccauccuggccaacauggugaaaccccugucucuacuaaaaauacaaaaauuagcuggguguggugguaggcaccuguaaucccagcuacucaggaggcugaggcaggagaaucgcuugaacccgggaggcagagguugcagugagccgagauugcgccaccgcacuccagccugggugacagagccagacuccgucucaaaaaaaaaaaaaaaaaaagcacagugagaggaaggguggauggacaggggaguccucccuggggcggugacccgagcagagagcugaaaggggaggagcgagccacgcgugcaccugaaagagggagcggcgagugcaaaggccccagggcaggaaggugccuggacaggaggccaguggagccgagauaagugggggagagggagggggauaggagaucugggaggucacuggggcaggcuguccagggccuguggccaccaugaggacuuuggcuucuacucugaggugagagcuacagcaggguguugaacaaaggggugacacuggccaacuuauguguuaacaggaucccuggcuaggaggaguggcagaguugguacagggcccucacaaggagcucccaaaagggaacacauccucucuguugucaguacagagacccagagcacagcugugcauagaggcucugcuggagagaaugggagcagguggcugccccagguccacagagcuccguggcuggacaggugcccugcauuugcugcaguccccuccaggccagcuccccaggucucauugccaccagcccgggggcagcuggguucaggcccucugcucaggggcaucugucagaaacagcaaguuucacccuguggcaaccuggagauacucugcauggacaucccauuucauggaagagaaaacugucaucuuggggcuguagcagggggccccagucucccaguggaggaggagggcuugugguucccaugggggaccuagagguacaagugggucuggguggcugguagcugggugcucccuguguuugccugccugggcaaaaugcgugcauuucacagccggacccaacccaucuugagggucuggggccaaggcuaggccugcgguggguuucuuuaauuuuaaaaacuaacucuguuaguuuaugcaaauaaaaccacuuuauugagauauuauuugcaugucauaaaguccccacuuugagggagcagaaucuaguggguuuuaguagauuuggaguugugcagacauccccagaaucuaaucucagagcauugucaucacuccagaaagacacccacaucuguagcagucacuuuccauucccucuuucucccaguccccgguagccaggaaucuuccuucugagucuauggauuugcauauucuggauaucccuggacucucugggaaucaugcacuaugugguuucuagugugugacucuuucacuuagcacgauguuuucaggguccauuucaugugguagcaugugucauuaauuccuuuucaugguugaauaauguuguaugaauauaccacauuucaaaaaucuguucaucuguugauggacauuauucuuccagcuuuucaguauuaugaguaaugcagcuauauauauucauguguaaguuuauuauauggacacauguuuucauucaucuugggaacauaucuaggaguggcauugcugggccacaugguaacucuguguuuaacccuuagaagaacuaccagccugaggccgggugugguggcucacgccuguaaucccagcacuuugggaggcugaggcagacagaucuccugaggucgggaguucaagaccagccugaccaacauggagaaaccccguuucuacuaaaaauaaaaaaauuagccgggugugguggugcaugccuauaaucccagcugcuugggagguugaggcaggagaaucgcuugaaccuaggaggcggagguuguggugagccacgaucacgccuuugcacuccagccugggcagcaagagugaaacuccgucucaaaaaaaagagaacuaucagacuguuuuccagagcgacugcaccauuuuacauucccaccggcagugcacaaggguuccaguuucuucacauccucaccaguuguuauagccauccuaguguguaugaaauagcaucucaucgugguuuagauugcaauucccugaugacuaaugaugcugagcauguguucaugagauugcucuagaaacuucuagaauacgcaagcacacaucccauuagccucaaagugaugacaucaucacacugucauguagucuccagagaaguccacuauacacugcacugggggagaguguaugaagaaggcaaccaauguccuaauguuaugacaaacauaauuuugaccuuauggaucccugaaagggucuuggagacccuauagggccaggaccacacuugagaaccacuggucagugcaacuacaagcauguaggugcgugcacguauuuucacaagcacuaacauaggacgcacagcguucuguucuaugccuuuuucaaauaacaauggaucuuggagcuuuucccugucacugcauggaaaguccccuuucuguguuugauggccguggugccccacagcaugcaaaccccaucuuugauuuaccgguucccuuacugauggauauucagguugguuccagucuuuugcucuuaaaaagcgaugcugcugugagcaucucuacaccaugccccaguguggaauugugaggucgaugugucugugcuuuuuuucuuuguacgcuguucauugacacauaaccacuagaaccugucagaagcacacaacucaaaugaauuuucccaagugaacacaccugugaagcugacccucagcucaugagacaagagccggcccuaggaagccuccuuugugccccuccuaggaaaccaccucucuugacuucuaauggcagagguuaguuuuccugcucuuaaacuuuuauaaaugaaugaccgugccauugcguguaucgggagggggucuuuuugauuguugcauaguguuccguugcagggaucgacccugccuagcuuguuguuccccggcugggggcauugggguuguuuccaguggaggccaugagcuuucucugccaggcuucugguccuuaugccugugcauuucaguugagaggugcuggcuggcucagcucuaggagauauggauguaauuuuuuuuuauauggacguauuuuuauagcccugguagacguuguucacuuguucgcccuggaggguguacuggauuuuacuuacaccugcagucaugagaaugucucuuuccucguucuauucaugcgacaaauauuuauugagugccucucucaccauugcaggagccggggagacagggugagcaaaacagacaagacuggagcugccagucgugggguggggauucacacagucaacaaaaugaacaucugaaaucuggcacguuagauggugaaagugcuaaagaggaaauuaagcagguucuggacuuugccagucugagagguggggagcagccucuccuggugguuuuaguuugugugugcguagcucuccacccaccucgucugaugguuccccagugagucucacuggucacacucccaccaacacugcugugggguggccuuccugccauucucgcuaaaccaauguuagucuuuccuccuuggacacaccucggccauguauaaauuacccauugucacaggaaugcaagugaggcaaccacagcuccuccguagcgcacacagugcacauuuauuauugcucccaaguccacgggccaguugggcaguccugcuaaccuggccaggcguggcugacaccugcugggccugaacgugugucuguggucaccuggcagcucagcugguccgggauggccucagccaggauggcucaugucugugccacguggucuccagcugguuagcucuggcguguucucauuguggaaacagagguccaagagaaagauuagaaacacacagguguuuaauuuaggaucuugaagauggagagcacuccuucaaugauuaagauagacuugagauggagauugagauuuuauuacuuccugggggauacguggugcaccugggggccacacacacgcggggaagucaggggcggcagguggggggugggggggaggugugggccuggggcacuggcuuucacugggguccaggauggggaacaugaaaguccgguagugguugggcacuuuaaagcaagcaggccugagauuugaaacaaaccaaugcaaaguccuuuccuggacggagguguuauuuuggaauccugcuggccuggaggucagguguggguuuggggaaggagcucucugggcugaaguagaggaaagacagcaggaauuuaucaucuaaguuagguggccaaucagacguggaggcugagguaguaugcgugccguaaaccucaacacccacagacucuugcaccugggcuccgaacuagcagggccgcugcuuuugccacauuguguuggcagccagucaagaggccagcccagggucaaggcuccuggccacgagagucacugcagaguccugcugccaugguggggauuaaggagggggagaaugcaggcggucaguucagugggugcccccgugccugaccaccaagccccagaccccgugccagugcuucacgugccuccucucauuuaguucccauagugacccuacagcaaagggauuacgagucccuucccaccguggugucaaccugugccuggccauggccuagggcgaggaaguguugagcccagcucugaacccagaucuguugacauaaaaggcaucucuguguuuucugcuuggguccuggcacagggcuccccagguuagaggcuggcucgacccuucacuagcugugugaccucaggcaaauugcuuaacuguccugggccucaagauuucucaucuguaaaaggggcuuacuguuggcuuccucccagagcuguguucucaaugggaagaaagccugcaguggacaccaggugcaggggaggccugccacagagcagagcuccacucauggcuggcgucccggaugcugugguuccaaguccugaggcccugcugagaggguggcggccuucgagcccugggcugcauccuguucacgcacccaggccaaggcagcagaugcggcuuuccugaggcugaaccaugccuaggaguccuuggccuccugagccuuccagaauccugggggccucagugagcuggaguucaggaucugugcugcgaguuucccugcgggcaaugucggcauccucuaccugccagcaccuccucgaggcuaggccaggcugugggccucuaggaccucuggccugcagcauccggggcuuugaggugaagcuucugguugagaucagaauugugugggcuggggcucuggugggaccuccacccccuuguccacuccucggccuccaugcugggaaagugggcuuggggccaaguugcagugagauugagccugcuuuggcccucagagagugaauuccugccucugccgcucguggcugugugaccucaggcaagcgacucacccucucugagccucaguuucugcaucuguacaauggggcgguccuguuagucucaggauuacugagaggagcaggcgggcuaacggcagccagcacagagugcugcuccgggccacgggcugcuugccucauccugccagagguucugcaggaacugggguggcgggggagggaugagaagagggcuuuguguucuuguuucuucaaacagauguagauguguaucuucugguggccagaaguuguccccucuggcaaaagagcagaggagccaggccuggcaggguugggcaggggccguuccgcugcuauguuugccacuccagcugccuccagaugugcagcagcguguuccucacuggcugucucccucccaugcugcacucuuguuucggccccugccaacugcgucagcaaacgcgcgagcugcgagaccccuccuucagccauacugccuggcugcaaggcuggcuucccacagacaaggggaggggcacccuccucuacugagucugcaugcggggcccucuuugccacccucacaggucacccugcaucaguggagcauuuauuaugugccaggcacuguguuaaucacuggacgcguaucaguccauuaugugucgugaccccgugaggggaugucaucauuauguccauuuuguagacgaggugacugaggcccaggcagguuaagugaauuguccaugguuccugaaaccagugaaguagacguuugccaaccccugacuuggcccccugcaccgggcacuuccaccuccugccugcugacucccugaguuugccuggcugcccagugugagcaggcauuucccuguugugggcagacugaggcuucaggacugucuggauggcuggcccucaaggggcaaagcugagcccagggcaagcuggcaggccucaggcucugcacucgccccccugccccaaccccucaggccucucccugguaccuuccuggucaaggucuaggccgguggaccuggugggacugugguuccaaguauagucaagggccacauaaggacguuuuggucagugauagaccccauauauaaaggugggauuagcagguaggcaagccugccuggcacagagggcccagaaccuggggguggaggaguagggagagagggagugagaggcuuucucuccugcuuccagccccguccucuagccugccccccucaccuuuugggugccagagauucagcaggaaccacaaaggugaagacccuuagggaugagggucccugcuguuaacuccagcgacuguggccagcuggccuuuagaaugcaugcaauggagaagcagcacuagaagucugggagugaaacagcuuguuggaaagugggggccguggggaccagagacuguaccuagaacacaagggcagucgcuccugcuguugcccuggggccguggaggccuggcaugguccaagauuuuggauuuucuacaagaagccugggaucuggaacuucauaugacagcucccaauuuguaaauauuagcaauucguucacauauuuuuaaagcacccacaaaguacacuacaggcaccugcuugcugccauagcuuggacucucccucugccaccccuccugacaccacuaggaugacacagagguccagugcugggugaggagcuggcugagagcucugcaggugcagaggaugggggcccaggagcccugacuccaacccaggcucucucugcccagaccucccaucccagcugagucagagcuggugggaucagugucauggugaggcuacauggagggcugagggcagggaccugcagguuacugugcaguaccuggaccagcaacagugggagcuccaccccuggccugcaggggagacuggugagagccgaggcuccagggaguagccguggccauagguagaggcaacugugccuguauggggaccccaggaugccacccuccaggccagccucccucaagaaagagcagggcugacggguggaaggugggucuagggcagauagggagugggcaguaggcuuuggggaggauggccgugcggguauggugguugggaaucagggacuguccgcaaugccaccacacaggcaugggcgugagaugagcagccucaagcucaucucugugugcuccucacaugcucacacgggaggaguuagagugagcucagaugcccagguagagaugccauguuggcggugggaacuugagcauggagcucagggcacaggucuaagcuagagguggaagcugaucagagaauggcugugcuucugucccuuccccaccaagcuggcccaccuggcaguuggggcuggguugguggugggugagugauggaggacgaccucacaauuccucaucugucaccguguggccccuggagccuggaugcaggagcagggaggccaagggucuugccagagguugcuuggcuggugggggcauggcugggcuuugaguggagcucucuggcuuccuggcuuugugccucacaccccccaccagccguggccaucaggauagaaguguuuccugcuuggcgugaggcuggugagcguguuacccugaccucuccuaggcaccuuugaucagugcugauugcuucacuuugagugugcagaguggccaguuauucugcaggagcaacuagacagaggaaggauguauuuuaguggggggugugcaugggggaaucagaucaaucagugccuggucaaguucuaggaaggcgggccuggugguacagucaagcgcugcauaaugacauuuccaucaaugauauacucuauaugugauggucccauacgauuauggugaagcugaaggagcugaaaaaugccuuuugccuagugacagcguagccauuacucguguuuguggugaugcugguauaagcaaaccuaccgcacugccaguaauacaaaagccuagcacaugggcugggcgugguggcuuaugccuguaaucccagcacuuugggaggccaaggcaggagaaucgcuugaacccaggaggcggagguugcaaugagccaagaucgcaccauugcacuccagccugggcaacaagagugaaacucugucucaaaaaagcaaaacaaaacaaaacaaaaagccuagcacguguaguuaguuacagugcaucauacuugauaaugaaugucuguguuaccaguuuauguauuuacuauguuuuuguuguuauuuugguaggccuagggcacuacugugcgcuaguguguuauuuggcuuucuacuuauuugaaaaauaguuaacuauaaaacagccucuggcagguccuuugggagguauccaggagaaggcauugcuaucauaggagaugacagcucccugcauguuacugccccuuaagacgucccagcgggauaagauguggagguggaaggcgguaauauugaugauccugacccuguguaggccuaggcuaguguguguguuuaugucuuaguuucuuuuuuucuuuuuucuuuuuuuugagauggauucucgcucuguccccuaggcuggagugcaguggcgugaucucagcucacugcaaccucugccuccuggguucaagcuauucuccugcuucagccuccugaguagcugggauuacaggugcccgccaccacgccaggcuaauuuuuguauuuuuaguagagacgggguuacaccauguuggucaggcuggucgugaacuccugaccucgugauccgccugccuaggccucucaaaggguugggauuacaggcaugagccaccacgccuggcguaugucuuaguuguuuuuuuuuuuuuuuuuauugaaauggagucuugcucugucacccaggcuggagugcaguggcgugaucuuggcucacugcaaccuccaccccugggguucaagcaauucucuugccucagccuccugaguagcugggacuacaggcgcauggugccaugcccagcuaauuuuuuuuuuuuuuuuuuguauuuuaguagagacggauuuuaccauguugcccaggcugguugcuaacuccugagcucaggcaauccgccugucucagccucccaaagugcugggauuaugggauggagccaccucacccggccuaugucuuaguuuuuaagaaaaaagauuuaaaaguuaaaaaaaaaaaauugaaaauaggcugggugcgguggcuuaugccuguaaucccagcacuuugggaggcugagggcggaucaccugaggucaggaguuugagaccagcuuggcccacaugguaaaaccccaucucuacuaaaaauacaaaaauuagccggucacaguggcgcagggcuguaauccuagcuacucaggaggcugagguaggagaaucgcuugagcccgagaggcggaguuuguagugagcccagauugggccacugcauuccagccggggugacacagcgagacuccgucucaaaaaaaaaaaaaaaaauaaauaaauaauuaaaaaaauaauaaaaacacauauagaguaaggauauaaagaaauauuuuucuauagcuguacaaugagggcauuuauguuuuaagguaagcguuauuacaaaaggguaaaaaauuaaaauuuauaaaguaaaaacauuacaguaagcuaagaggaauuuauuauugaagaaagaaaaauauuuuaaacuaaauuuaguguagcugaaguguccaguguuucuaaaaucugcaguagugcacaguagugcccuaggucuucaaaugcacucaccacucacucauugagucacccacggcagcauccagucugcaagcuccaugcaugguaagggcccuguaaaccaaaaauaaaauucuaaggccccccgccaccaaccaucuaacuggacuuccuucucagcaggcgcucuuaaaauuuaacuugaaagacugguucaggccaugaagggaagugggggucagagaggccucauuauaucucucacauuaacuucagcacagacuuuaagucugauaagaaacauuuuacagccuagcuaaaagcuucaucugcaugauaaaacuacaccaugcacaaccucuuaucccaacccaaacaucauuccuuucuauugaucccaggucuuuagacaaacucaaccaauugucaaccacaaaauguuuaaauuuaccuguggccuggaggcaccccccaaucuugcuuugaguuguccugccuuucuggaccaaacuaauguguuucuuaaaugugcuugauugaugucuccugccucccuaaaauguacaaaaccaagcugcacuccaaccaccuugggcacaaguggucaggacuuccugagguugugucuugggcauguauccucaaccuuggcaaaauacuuucugaauuaacugagaccugucucagauuuucugggccugcaggcccuauacaggcgaaccacuuuuuaucuuuuauaucauacucuuacugugccuuuucugugucuagcuuuguuuagauucacaaauacuuaccauuguguuccaguugccuguaguacucaguacagucauguucuggacaggugugucgccuaggagcaaggcuauaucaugcagcccagguguguaguagucuaugacacuuagguguggguaaggacacucuuauguccucacacgaugacgacaccaccuaaccacgcauuucucagaacgugaccccuucguuaagugacgcaugauuguguggggugaagggaaauggaaagcugccaggcggaggcacggggcguuugguucuggaagggccccagccuggcccuguggcuucucauugggaacccugagcuccaggucccagaccaccuuggcuuugcucuggcagagcacggcugguggcugcucccaggguaccugcugccucuucuccaggcaggacuucugagucaacgccuccccggccagcacggaucacccgaggcuuugcagaagaccacgcuggacagugcuggugccccacugccuguuuacuucuaagagaaaaaaagauccaguuuauauuaugugauauuuuuacuuugauuuuuuaucaaucauuauuuauguuucuaaaaagguauguuuacguuucucauaguaaauacuggugugggaacaccaaaauugcuauguaguuaaauaucucuuauuaaacuguacguaugaugggcuggaaauuaagcgagaaagaaaaagcaacagaauuaaaucauuuauaagauucaucuauaaguaacacaaaacaucauucuaagaaucagaauuacaucaaacuucaguuugagcagaaguauagucucuuagguaauagcaguuccuuaaauaauaaugaaagagagaauucauaguucuuucugagaagggacagugcacacuuuuagugccuugcaaguuccacacauucuuuuuaaacagaguuaaacuugucaagaauuucugugcuucuccugaaucagggcaggccagaguugugcaagauacuuuucucucuuuugcauagaguuggccccuagacaucgcaacaaaaauaacccaugaaaaugcggaugacagucgcacacaucacuggcucccuggaaggcuguggaagggugaggcuuguccauggguccucugacugcgaacauaccacuuuccagagcuuucuaaggagcagcuggaagucaaauacuauggggucucacagccccucccacccauguuguugaagcccaccaucaagcccccuuugguaacugugacucucccagccacagcucacuaacaucccaggguuccaccuggaaccccaguccacacuaagcagcugggacagacuuucaguggggcuauuugagggggaagggggcucagugaagaagggccucagccucaucauuguccagugcucucucucauuugggacacacacacacauggauauuucagucuugacacuguaucuugcaacucuaaaaaauagcgauauucucuaauauuaucacauaccaugacccuauacuucacacaauuaccaauucccuaaugccuucuaauacuccaacuauauuaaucucucucuucuucuucccaaaggguaccguauagcucguuuuauaaaagcaaugucuaaucaaggaugauuagauauuugguuuauuuuugguuguuaaugucuccugaguuuccuucuuucuuaaaguuucuauugaagcauaauguacaugcucuugagugucuuuuaauccagauuaauauaacaguacucgucuuagagcuuuuuauuagaguaaaauguauagacaguaaagcaacaagccuuaauagaacagcccagcaaguuucuucuuauguguaaacccaggcauuccacagucaagauagaaagcauuucaagcaccccagaguuuuccuggugcccuuucucaguucuuaaccccaucgcugcuggaaaccauuauuuugacuuuuaucaccaucuauuacucuugccaauuauuuuuuauuuuuuuguagagauggggucuaccuauguugcccagcugggucucaaacuccuggccucaagcaauccuccugccucgcccucccaaagugcugggauuauaggcaggagccaccaugccuggccuaacucuugccuagucuuuaauuuauuuauuuaucgagacagagucucacucuguugcccagacuggagugcagaggugccaucuuggcucacugcaaccuccgcuucccagguucaagugauucucaugccucagccucccaaguagcugggacuacaggugcccaccacgaugccuggcuaauuuuuguauuuuuaguagagacgggguuuuaccauguuggccaggcuggucuugaacuccugaccucaaaugaucuaccugccucagccucccaaaaugcugggauuacaggcgugagccaccaugcccagcccuguuuuguuuucuguucuugaauuuauuuugaaugaugggaacauacagcgugaucuugcuuguguuuggcuucuuuagcucaagguaagguauuugagacucaugcauauuggugcauauagcaguaguucauuuuuagaaaauuacuccuuaugauuccauuguaggaauaaaucauaguuuuaaaaaucaguuuuagugucgauggacauuuggguuccaugcugcacacuguugcugugagcauucucgucugcgucuuuggaagacuuaggcauccaugucuguuggauacauacugaggacuggaguugcugcaucaaagguuauguuuaauguuagcagauacugccaaaugguuuuccaaaguacauugccaauuugcaucccuaccagccaugcaugagaguuccauuugcuccacauuucugccaacucuggcgguugccauucuuuguaauuuuggccagucuggaggaugugcaguaauagcucacuguggccuuuauuugccuucucuuacaaguuaugauguugucuacauuuucauauuacucuuggcuauuuuguugucauuugccuauuuuaaaauuaaguuucuuugucuuauugauucauagggguuuuaaaaauauguucugguuaugagucucuuguuggauuccacauaggugaucucauucuaugacuugccuuuuuacucucuuaauaaaacuuucugaugaauucauugcaaauguugucaucugaggaacacaaguuccaaauuggaaugaaguaucaucuauugaucuauauauuuauguuaguacauuuuguauuaacaaauggccccuagacaucucacaugggguuucaccauguuggccaggcugcccuugaacuccugaccucaagugauccaccuaccucagccucccaacgugcugggguuacaggcgugagccaccacacccggccaauguuuucuggccucuuuuuucuguuccauuaucugucuuugcaccauuaccacuccgucuugauuacuguagccuuguaguaauuuuuaguaucugcuagugagaguuuuccagcauuguucuucuuuuucaagauuuuguguccuguuuaagaaauugaugucucucccaaggucauaaagauauuuuucuguaauauccuagauguuuuauuguuuuaccuuacacauuuagcuccuuagugcaucuggaacuuguuucuguguauggugugaguaggaaucaaaauucaguuuuuuacugauagacauucagcuggcccagcaccauguguugaaaaggccaucuuuccccuacugcguuacauuguuagcuucuccaggaauccaguggcugcaucuguauggucuguuucuggccucucuuuucuuuuuuuuuuuuuuuuuuuauuuugagccagagucucacucuugcccaggcuggagugcaguggugcaaucucagcucacugcaaccuccaccuccuguguucaagcgauccuccuucugccucagccucccgaguagcugggauuacaggugccugccaccacacccaucuaauuuuuguuuauuuaauagagacaggguuucaccauguuggccaggcugcucucgaacuccugaccucaagcaauccacccaccucagccucccaaugugcugagauuacaggcgugagccaccacacccggccaauguuuucuggccucucuuuucuguuccauuaucuaucuuugcaccauuaccacucugucuugauuacuguagccuuguaguaauuuuuaauaucugcuagugagaguuuuccagcguuguucuucuuuuucaagauuguuucagcuguucuggguccuuugcauuuccauugaaauuuggaauuagcccuuuuaaaaggcugcuagcaucucaauugguauuguauugaaucuguagcucagauuugacagaauugacaucucaauauuaaguuuccagcccaugaacaugauauaucccccuauuuauucagguuguuuuuauuuucuuuugggaguguuuugucauuuuuaguguagaguucuuguauaucuuuaauuagauguauucuuagcuaauugauguuuuuaauacuauugcaaauuguauugauuuuaacccuuuauuuucuaaguauuucuggcuuauauuaguuugcuuuggcaacaguuuauuuagcucauucugugaguugggaauuugggcugggcucugcugaugggggccagguguggcugagcucgcucagguguuuguggucagcugggagcucagcugggagauagcuggucugggauggccucugcugggaugguugucuaugcucucucauccuccaucagcccagcccggacuacagagucccaggagagacagcagaagccacaaggccccuuuggauuucacaugugccauauccuguuguccagggcaacauagucacgaggucagcccagauucaacagguggggaaauagaugccacuucucaaugggaggaacugcaaagcauugaggugauuucugcagucaucacagauaggauggcaauauucacacugaauuuagcagccaccucuggaggguuggaucuucauuggaguccugcacauguuaacuacccgggcauggguuaaaguuaaucugcacacucacauugugauauaaacauaaggaaauguuuucaaguuugucucugguagacaacagccugggcuuuggggacaggcagagcugcauuccaaucucaguacagucacuuucuucaccuuuaaggggaagguaauuggcugggcgcaguggcucauaccuguaaucccagcacuuuaggaggcugagguggguggaucacgaggucaggaguucaaggccagcuuggccagcauggugaaaccccgucucuacuaaaaauacaaaaauuagccgggcgugguggugugccccuguagucccagcuacucgggaggcugaggcgggagaauugcuugaaccugagaggcagagguuacagugagcugagaucgcgccacugcauuccagccugggcgacagagugagacucuaucucaaaaaaaaaaaaaaaaaaaguggaagauaauugccccuagccugcaggguuguggggagaauuaagugggugacauauucagaaguccccagcacgggcggcugaauuaagugggugacauauucagaaguccccagcgugggcggcuguaaccauuagcaaguaugaauucuucuucucucagcccuggaagcagccggucuuaagccaguguaccucgucuuccucugccccugacacugcaagcuuuuauaacacucauuuuaccuccacuucagaguugagcugaguuacaguugacaagcugguaucuuguaaaauguauagacuuuuaagugaacauuuucccaguucuuuucugugguugucucuuuagauuuuggagccauuauauuuucuucccaggcccaggagucaagcauuuuuucuggagacuuuuggaaagcucguagaccccaguggguggguaggauacugagggugcgguuaaacccacccuccuugacguuugggggcugcuuguugaaacaugggcagaguuccgucgcucagagacccacuugcccgggcuugaugggcuggggguggugcugggcagggcagaggucccugcuaugaugggcuucucucuggauggagcagaggucccugcugugaugggcuucuuucugggcggggcagaggucccugcugugaugggcuucucucugugcucagacccugucucucaccauuccugggcucaggggaccugcagcuugggcagcuuugauuccuguccuggggauuggggauaaccucacaaaauaagccugucguuuaaacccuguauguuuaaacccuugggcacaucacucugccucccugggucuugguuuucccagcugggugguggcuguuacuaaagugauccuggcuccgugggcucuggagggagggggagcccuagcccccgaccugggcccaggaaacagcuuuugccaggcuucucaagcuggcagagcugaauggucaagcuggcuuucaggugacacucagcuggggacacagagggaccccagagcccgggcucccagguccagacccuaugcaggauggugcacagcugagagccugcugugagagugggcuuggggaaggggccagagggguggcagggagggccuugcuucccuuggaagaacugaugaagauggggacuugaacuuccguucccuucuuuccuuucuuugaugcuuggcucaggagccugcacucuggagccaugcagcuggggugagauccugcggcugccccggcuggguguguggucuggggcaagcugugccuucucuuuccacagcugucugcuggucugcaaaaugggggcugaggcugggacguuccuucuagagccagagggaagauaccgugggugcaggguggggucuagcaggcagcucugccaagccugagauccggccgguuggcuggacuggccaggcugggguguccagacaguaaacacccacagaggagaaggugaugugagggccacagaaagcaguggggaugcagaagccggugcugagggggcuggcuggggcugcucugccugcugaggaaggcaucccucaggcugaguugggugagcucaggcagagcccgcugccuggccgcuccugcuguuucuuagccauccccugcugguuucugugaucccggggaggaaggcagacccagguucagaaacccuuucugucuguccauuuuacaguccucauaaaaaaaaacucaaggcgccuccacagaccuucagguaacccucccacccugucccuccacacccccaggagaacaccaaggcuggcgggaacaucagggcugcagccuucugugugcuguuugcucaggccccacaaauauccuguccaaacaggggccuggcggagauggcccugucaccacccuccugccagguguggaaacuucucugcagcauuuucaaagccggaauucuuuaaggcuuuaaugucaagggacugggacuggcuagagcggucaugaccucugcacuggauuguucagggaacccauuguccuaugaucaaaggagcuuagaauccucagaaaauggguaauaccugcauaagauaagaaacaaauacaaauuacaaaagggguaaacagucaguuuccuuccucccuccccagggcugaguccuuccccaagauagccacaguuaccaguuucuuggguauccuuccagaaauaauccaugcauauccauguaucuuuuuaggaagacaaaugguagcuuauuagagauacuauucaggauugacccuuaaaaaauucuucauaguacauguggaaauucuuucauguaagugcaugcagaucuaacgcuuuuuaacagcugcauacgauuagauggauauagcaucaguuuugcuuuguuuugagguaaggucuugcucugucuccaggcuggagggcaguggcgugaucacugcucccugcagccuagaccuccugggcucaaggcauccuccugccucagccucccaaguaguggggaccacaggugcaugccaccaugccuggcuaauuuuuaaaauuuuguugggagauggaggcucacuguguuaccuaggcuggucagcaucaguuauuuaaucacugcccugcaggugggauuuagguuguuucuggaucuuugcugucacaaaugcaggugcaucagaaucugugaugcuccuguuuguguucaugggagcaucucaucuaucagcagauuagaucccuacaaggagaauugcagggucacaaauuuuuuacacugcaaugcauuuuuauuauuuuuuaaaucacauaacaugacauuuuccauuuuuaguugugcucuuccaaggcauaaauuacauccaccucguugugcagcugucaccaccauccaccuccagaaauuuuucaucuucucaaacugaaacucugucuccauuaaacccuaacucccuauauccccacucccagcccuuggcacccaccauuccauuuucugucucuaugaauugacuacucuaaggaccccauacaaguggaaucauagucuuuauccuuguguaucuggcuuguuucacuuaccuugauuuuauuuuuaaaauuuauuauuuaaauuuaaaaaauaaauuaguuuuuuauuuauuauuuaaauuuaaaaaauaaauuuguuuauuuauuuauuuauuuauuuuagauaaggucuugcucuguugcccaggcugaagugcgguggcacgaucauagcucaaugcagccuugaccuccugggcuuaagugauccuccucccuuagccucccaaguagcugggacuauaggcacacaccaucaugccuggcuaauuuuuaaauuuuuuguagagauggagucuggcuguguuucccaggcuggucuugaacuccuggccucaagcaacccuccugcuucagccucccaaaaugcugguauuauaggugugagccacuacaucuggccuggaucuauuuuuaaaagacucuuuuagucuuuagucuuagaguuuucugaucauacuaccuuuuucaguacugucuuuguuugggaggagagcaguucaggaaguguccacaugggcagcaggacagaaaccauagggucgccccugacaccccacuccaguuaccaccguccugauggcagucagcaagaguucccuccuuuuccuuauaauuuuacccccgaacaaucuugcuucauucuucucuguuguugagucucacaugaaaggcugugugcaguauuccccugugaccugccucuuucccuggugcaguguuggugugcuccuuguggguuauugcacgugguggcagugagguggcuggcaucauguggucacacugcagccuauggacccuuucucucauuugugggcacuuggaaaccaccuggagaccaccagaauacucagggucguggguguggcgccuucugcuuuaccaggggacagugagugguuuuccagaguggaccugcucugugccacuuggcgugggaacagcaggguuccugcugggcaaggguugugcucacccugcugccaggcccggagcccugaugcugugaagucaaccguggcaguguguucugaagcugggauguugcugggccaugucacugccaaccccaggaggccagagagaaucucugaguugaggcugggcugucagagugggagagcaccugcgucucucuuuccacagugcugcugagaaccggcagguggggaaggcauugcucccccucggccugagcuccugcaaagcagcaaaguggacagaaauggagaauucucgaaaagccagaggaaagaggaggcaggguaggcguggcugaaggcugcaccagcuucuacugcugaagggaugguugcuaauccuuccauggauuugucugccccuuuguuaauuaacuuggaaaguagucaccaagcgucuuuuaugugccaggagacaggaggcuguguuuacugaguaccagcuauuugccaugcaaugagucuuacguucccacuugugaaauuuggguggggagaguuacuugcccauuuuacaagcaaggaaauggaggcucagaagccgagugacucgcccaagugccccagccagugagugguagcccaaccacacaccugugcuuccagugguggaaggacaugccugugcucaucuugugacccugguagcaucugcuacauagaagugguguaaggggagguggccaguaaggauuugcauucuuccuugucauuucccuaaggcugugccccugggcucccucucuuaaacucuuagaaccucuuuuuacgccucuggggcagggagaucaucccaccgaccucuuguuguugaugugagcuuuacaugagaugauauacaccaagagccugaaguauuucacccagccccagauuuuaccagggaccuggucugugcugugugcugggcacuggagacccugaaaugauuaggcugauucuuggcccaugagacccucccaaucuggugauugggacagccugccacccgacagggacaucauggucgaaggacaugagugaagucagaggagggagcugcuuuuccugggugcuagacagagccugcuggacgcacagacaggcagggagucacauuuggacuggcucaugagggauggguaguuggauacucgccaguuggccaagguagaagaagggcauccuagcauggaacagcgugugcaaaggcguagaacaagagaagguguauguggcugggagcugagucugggcugugcugugaaggcccugagucucacuccagagagaggcacuuuauccuguggggcaguggcuuuucugugggaucuguggagccccaaggcuccccaagaugacucagggauguggaaggccagggcauugugaggacgaccagguaagaugaugugaugaggguugaguaggaguuaguuuagauauggaaguuagggagacccucucugaggaggagagacccccagaaagagaaggagccugucccauagagagugggggcagcagauggcacagggagagguggaagauuccaggcaggcagcauggcaaaugccaaggccuuggggcaggacugagucugaggagcuccugaguagagagagugagugggagagugaguuagagaaaggaggucaggaggggaagugggcaggaccccaccguguaggacuuuguaaggaaaguggagaccacggggggucauaggcgcaggagugauccaaucugauuuguauuuguggacagucauucuauagcccugugggugaugggcuggagggugacagaaguggaagcaaggagggcaggagggggugguggaggaggagguggcugguggacugagaugccuuuggagguggcccugugagugauagacuggagggaggcgggggaugagggauuggccugggagcguccugaggaugguagggccuuuguugacacaggaagacccagggaggggguggcuugggaaaauccggagcugagcaaauuccagcuggggaagugccagggagacaucuggggugguuucuuggccagcugugggcaugugcaugugacauggggggcgggggcaagaggaagguggcauuggaagcuuagagaugagaucagccaggccagcguguguuggagaagagaagaagccccaggguugagacuccaaaagucuggugcucaggaaguuaaaaaacacgacagagagagagagagagagagagagagagcgagagagagagagagcgauagagagagagagagagcgccaggcaggggcuggggaccugugagagguggucucagaaggagaccuagaggagaggaggugacugcugggcggagccuuggagaaucaggguggagggcgggggccucuggacaugagaugaggguacucacucaucgugcugggcuuugccuggcucugccucccacauuuuggauggcaccuggcaaugcuacucauggcaccugcacaauuuccccuccugcugcaacuggguggcccucccagcauaagggucacagcuccugagcuuuguuugagaaggaagguggccaggagagaauggggggaauccuggcaccugaucaaggaggagcaggcagagagcgccauucaacacccacgaaagcagagccaccucucgagcuggugaugguuagagucccagagacgaccuucaggaucggcugcauuaggucaccugugcaacagacauggggacgcucaggccuggagaagggagaguaagaggggaaauugaagcuugcgacuucuuuuuuaauuuuguacacuuuuuuuuuuuuuuuugagacggagucuugcucuugucacccaggcuggagugcaguggcgccaucuuggcucacugcaaccuccgccucacggguucaagugauucuccugccucagccucccaaguagcugggauuacaggugcccaccaccaugcccagcuaauuuuuguacuuuuaguagagauggguuuucgccauguuggccagguuggucucaaacuccugaccucaggugauccgcccaccucggccucccaaagugcugggauuacaggcgugagccacugcaccuggccauuuguacacauuuauggggcagguacaugugaaauugugacguguaugugauucacagugaucacaucaggguguugaggguguccaucaccugacuaccgugcauuuuuguuaaggguagucacucugcuugggauuucuaacuccccagcucaucugugaaauaggaaugcugacaguucucacucuuaguaacugugagguuccugugcugggacccugccuggcugguugcuagcgcugcuauauuucagcuguuacuguuauccucauugggcaucccacugaugucaucuggcuaagagccagggaccauaaucucuguaaggcaaucuuggaagagguuuagggaggaaggauucgguccuguagaagaauguugugagucugagcugugcagaagagaggauaagccgccugggcagaguugccuccugucaccagaaguauucaaauaaggagagucucccacaugcccagaguguaacaagaggggacgagacauugaaugguggcgucacucucagugaccacagagacugaagucaggacucuggcauccugggagguggaggcaggacucugccuggcaccuugugcuccugaguccugggacagacaugucugagccauguuccauucagauggugagcacugaucccggccuccgacacagcaccucucaguugcccagggucuccuagauucauucagcaaauacucauugaacacccaccaugugccagggggcugagauauggcuaugaggaagauagauaagagacccuacccucugggagcugacauugcaaaggaggaaacagaggacugagaaaguaaacucauccacaagaggcucucacagugcugacugcugugagaggguuauuuauuuguuucuuugagacaaggucuuugucacccaaguugaagugcaguggcacaagcauggcucacugaagccuccaucuccugggcucaagcaaucccuuccccucaggcuccugaauagcuggaaaugcaggcauguaccaccaugccugguuaaauuuuuucuuuuuaagagacagucacacuauguuucucaggcuggucucaaacuacuggccucaagugauccuccugcuucagccucccagaguucugggauuacaggcuauggauuuuauuucugaagaagauucucuuuuuucuaaaauuaucucuguaaauuuuauucuaauccugccuuuauagauuuggaaguuacuuucguguauggugugaugugggucccagcaucauaaauucuuucccugcaaaguuugaaugccaccuucaucauauauucaauucccguaugcacauaggucuguuucugaagucuuuucucuuccauugagcgccuugucuucuuguuuuaauuauuagaacuuugaaguguauucugauaccguuagagaaagucuaccuucucuguucuuauuuuucagaaauguucucggguauucuuaagcauuucguuuuuuggaugaauuuuagaauuaacacgacaaauucugugacaguuacacuuugcuuugguuggaaucgcauugaaguuguagaguaaguagaggagaauugacaucuuuaagguacauauuagauacaugguauguauuuugaauaaaguguauguuauacccauuagacaaucaaauuuucgucuucaugugaaucaagcauguucacuguagauuuauuucuagguuuguuucucuuuugaaugggaauuuuuuccuauuaacuuuucuauuuaauuguuauggggguauaggaaagccacuaauuugaguguguuguuuuuguuuuuggcuauuguauuauagucauuauuguuaauuguauuaauucuaauacuuugugaguuuugagucucuuggauugucuaggaagaugaaaccauaacaucugccaauaacgacuguuguuucuucuuucuauuauuucuuuggcccuuuuuucuuucuuucuuucuuuuuuuuuuuccccaagacgagucuugcucugucgcccaggcuggagugcaguggugcgaucuuggcucacugcaaccuccgccuccuggguucaagcaauuuuugucccucagccucccaaguagcugggauuacaggugcgcgccaccaagccuggcuaauuuuuuuguauuuuuagcagagacgagguuucauuauguuggcuaggcuggucuugaacuccugaccucgugauccgcauuccucagccucucaaagugcugggauuacaggugugagccacuacgccuggccuccuuuuuucuuucuuuuuuuuuaaguuuuuuuuuuuuuaauuauacuuuaaguucuaggguacaugugcauaaugugcagguuuguuacauauguauacaugugccauguuggugugcugcaccuguuaacuugucauuuacauuagguauuucuccuaaugcuauccuuccccccuccccccaccccacgacaggccccagugugugauguuccccauccuguguccaagugugcucauuguucaauucccaccuaugagugagaacaugcaguguugguuuucuguccuugcaauaauuugcucagaaugaugguuuccagcuucauccaugucccuacaaaggacaugaacucauccuuuuuuauggcugcauaguagucccugguguauaugugccacauuuucuuaauccagucuaucauugauggacguuuggguugguuccaagucuuugcuauugugaauagugcugcaguaaauauacgugugcaugugucuuuauagcagcaugauuuauaauccuuuggguauauacccaguaaugggauggcugggucaaaugguauuucuaguucuagaucccugagcaaucgccauacugucuuccacaaugguugaacuaguuuacagucccaccaacaguguaaaagcguuccuauuucuccacauccucuccagcaccuguuguuuccugacuuuuuaaugaucaccauucugacuggugugagaugguauuucauugugguuuugauuugcauuucucugauggccagugaugaugagcauuuuuucaugugucuguuggcugcauaaaugucuucuuuugagaagugucuguucauauccuucgcccacuuuuugaugggguuguuugauuuuuucuuguaaauuuaaguucuuuguagauucuggauauuagcccuuugucagauggguagauugcaaaaauuuucucccauucuguagguucccuguucacucugaugguaguuucuuuugcugugcagaagcucuuuaguuuaauuagaucccauuugucaauuuuggcuuuuguuacccuugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguguaagguguaaggaagggauccaguuucagcuuucuacauauggcuagccaguuuucccagcaccguuuauuaaauagggaaucguuuucccauuucuuguuuuugucagguuugucaaagaucagaugguuguagaugugugguauuauuucugagccggccuccuuuuuucuuguuuuacugcauuugcuaguaucuccaggacaaugcuauauaguagcauggcccgugggcauuauuuuuguaauauuuaauaauucagugggggaugugucuaauguucccccauugaguaugauguuugcuaugugcuucugguagacaccaguucucauuccucucagugccucagagcagaacaguaacagguugugauggaagcuguuuucccuguuuuacagaaaaggaaugaaaacuuaggaaagcuugguaacuugccgugccugcuaaggcaacgcagccgaugacccucagugagcucuugcuccgguuggagugugcaggugccguccuucacggcaucuaucccucagcccugugcccuuacgugaacugcucaggacauuuagagggcuuugugggccuuagcaccuacacagccauucaguccucauacagagaaggacacugagucuggagggaggagaagcggcugucagugguaacgcugagauguggacccaggcccaucaggcucagaggcacucaucuguuacuuguugcccucagcacgaaugucuaggcauucuguauaaacuugacuuaggaaugucacuuuagaccucaggggcaaacgcuuggguuaauuacacgucucauuucuuggcauggcucuuauuauccucuuugcaaggcucuuguuuuauuuauuuauuaauauuuuauuuccuuucaucuucuuucuccauucccauccaccaccuccaucugcauagcugacaguuucaucucaucaguguguuuuuugcugucauguguucuugcaaaguaugcauuguuauuuuaugugugauaguuuaaauuuguauaguagaacugauuuggcuucuuccuuuucucccuuagugcuguguuccuccacacuucuguguguugguguguccagcucaugcugcuguguguguauccagucuauuguuucugacagcuccugcauguagcauggccccagauuuuccucauccucccccccagugauggacacccaggcuguccgcaaccccuuuccacaaauaacacuugacaugggcauccuuguacugguuguguuacgggcugucgugaggacuucccuggcacagacaccaggagcagagcgucuggguccuugauguugcgugugcuuaacuguauaaguggugccacaucucuccagcuggccgcagucuccucucccacccuagacacauggacaugcagcaguguagaggaauacagcacuaagggagaaaaggggguccccaccucuguguggcauuucucacucuuacucauauuucuaguuuaauggauauuuuauuauuauuuuuugagacagagucucauucugucacccaggcuggagugcaguggcuccaucucagcucacugcaaccuccaaccccccuccccaucccugggcucaagccauccucccaccccagcuucccgaguagcuaggcuaacuuuuuguggaguuggagauucgccauguuguccaggcuggucucgaacuccugagcucaagugaugaacccaccuuagccucccaaaaugcugggauacaggcgugaaccaccacaucuggccuaaggaguauuuuacuuuggaguucuuuuuucucuuguuaauuuucaggaguuuauuauguuuuguagauggcaauuccuugucaguuuuggacauuccagaaacauuucuuaauaugucagcagucuauuauauguguacauggaguucuuuguuauacauauuggaauuuugagguaaucaaauucauuaauuuuuguaaccuauagccugugccuuugaguuuuaagacauucuccccuaccuuugacuccuuccagccuccccagucacaaauacaguugaaccuugaacaacucaggagugaggggugcugacccgacuaacagucaagaauccacauguaacuuuugacuccucaaaaacuuaacuaauagcugacuguugacaggaagccuuacugauagcacaaauagucaauuaacacauauuuuauauguuauauauauuauauacuguauuuuuuuuuugagauggaguuucacucuuauugcccaggcugaagagcaguggaaugaucucagcucaccacaaccuccgccucccagguuccagugauucuccugccucagccucccgaguagcuggguuuacaggcaugcgccaccaugccuggcugauuuuuuguauuuuuaguagagacggaguuucuccauguuggucaggcuggucucaaacuccugaacucaggugauccuccugccuaggccucccaaagugcugggauuacaggcaugagccaccgugcccggcugacuauauucuguauucuuuucuuguuguuguuuguuuguuuguuuuuuccccgggacggagucuugcucugucacccaggcuggagugcaguggcacaaucucggcucacuacaaccucugccucccagguucgagcaauucuccugccucagccuccugaguagcugggauuacaggugccugccaccgugccuggcuaauuuuuguauuuuuaguagagacaggguuucacccuguuggccaggcuggucuugaacuccugaccucgugaucugcccgccucagccucucaaagugcugggauaacaggcaugagccaccgcacccagccuauauucuguauucuuaaaguaagcuugagaaaaaaaaauguuauuaagaaaaucguaagagaaaauauguuuacuauucaugcaguggaaguggaccaucauaaaggucuucauccucacugucuucaggcugaguaggcuuaggagggggaggaggaggaggggcuggucuugcugucuuagggguugcagagguggaagaaacugcuguguuguuccaggggucaaguguguauucaacauaaaacuuccgugaauuuccuggaugagcuuaaacuucccuugcugccacugcugcuguuuucguaucucuugcccugucuuagcaucuuagguuggguuccuuagaagcagagccugaguuggggggucuugugcauguguugguucauuuggggagaccucucaggagaaacucugaggagugagggaugagagguggacaaagcuguggcccacgugaggucugacccugugggagcucuagagugugaguggcccccauagaacuggcugcuuugagagugggggcugagcucuggccccauguuaaccuguuaugggcugggcuccucccagcccccauagggaggacuccaccucgcagacaguucaccaaagacaguuguguugugagcuguuagcgaccagcaugcacagcagcagggguggaugaguuugccugcccaguaaaggagaccuggacaggccccugcauaucugcuggacuuggugacuuaugaauggugacucugccucauguugcuauccacaggcuccaccaaggaccugaucgagacuugcugcgcagccggacagcagugggccauugacaaugacgagugccuggagaucccugagaguggcacugaggacaacgucugcagguagggugggcucccuggagcaggcggagcugcccauuugccuucuccagaacccugcuugccuaggaccccaggcuccaggcagcccggagagagugcaccuucacaugccucuggggcaugagggugauuggguguggcugccgugcgccaucuggccaggcuuucuccagggguggaaaguccaagacugguccuaggaacaaaccagccacauaaauugguagcuggccuagugagcaagauccgaggaauguacaauuugaaacaaguuuuaaaggagugcuguccccuaggaauagucgggugcuccccucaccacauucugcaguugcugccgcacucaugccacucaggcuuucucuccucugcccucuuccuuucucugcuuugcuacccuugggucuucaggaggcuggccucucacugugcucccuugcugcugugcugguuguuucuucugacucugauaccacagcaaagcaauccuuuauccccaugccuucccuuuuccaggcccaggagagcucuuggucagcugcucaugcuuuguuuuuuuccagggaccccgucuaaccuacucauuuuuccaaauaagaaagauuaaguucagagaggcagugugauucacucaaaacuacacagcucacuggcagcauggcugggauuagaccccauguuucccaauguccagaccacucugcuuccuauaaaaaaaauuuauguucuaaccuugucuuucccuucagccauucuaccaauauggggcaacuuaggaguuagagcaugcagcacugggaccccuggaguuuggggcuaagcgguccuagugcaugcuugcauccgucuuguggacgugucccacuucagggggugcugagcccugucccccguaauccccgccgcccuguccuggcucuggucucugcagcugauuugucagccaccucugccccaggcagcccaacagugacuggcaggcagugaccagggacccggaggcugugcuccuccaggcugaccugccagccuuuucugggauuaggucucucuguccuccccgaccguuguggggguggggacucugaugccaaccccucucucucagaggucaugaacacacaucuccgagucuagugggacccaggccugcaucugcaugguuaagccaagaaaugaaacccaugcaacccaguggagguugugccggcucugccaccugcaccggcucccuugcuguggaccuugggcagagcuucccuccucugagccucacucacuuuccacucugggaggaugaggugggcgacugggggcuaaguuacccccucuguuucaggacagcccagaggcacugcugugucuccuacuugcaggagaagagcugcauggccggcguccugggagccaaggagggugagaccuguggggcugaggacaacgacagcugcggcaucucccuguacaaggcaagccugaccuguggccuucaaggcagggugggguggggcggggcgggaggcuggccugggccugaagguccucguggcccaagaaguuaggcuguccuuggggcuccuccugggagugacccucacgccugggguggaaggacucuuaaucugcgcagaaaacaucaucaguuauuauacugaccaauuaauucacagaauauuuguagagcaccacugugugcccugggcaucagggauguagcagugaguaacacagauggcaauucccgcccucccagggauuucuuucuggccaggaagacagaggaagaucacgaugaauauuuuagcaccuggcgugguugcaggcgauugugcuaaggagaaaaacuuaaggagaggugggauaaguagugucagggcuggggagggacugcaguaucagcugacaguggccagggacagccucacugaggaggggacauuugugcaaugcccggggugggggaugucugugaaaugcuuucaggcagagugcagcacaugcaaaggcccuggggucagagccugcuuggcaugucuaggcuguguggcuggagugcaucgagugacagggggcagguggagcugagcccagagagaugucagggcuccuggccaucaucggaaggacugugguuugacugugggugagguggaccccauggggaguuugagggucucuucuggcaguuguggggaccgguuauugaggguguuucucucacaugggaggugggauugggaugggguaaaaccccaccaggcaacaguggugcagagaacagugugaacuaacacacaggcgaggacguugggaaauggggugugugguccaguggucuggcagcaguagagacaggccaccgggaguccucaggcuggaccauaaaggacaguaaaugcugagagcuuucggcuucaagcagugucuguaaagccgugggagggauuugcagcaggagaucaguuugucuacuagagcucaugguggccacuggcggacagggugucaguuuggcuacaaguaauggaaaacuuccuggaacacugguuuuucucucauaugcugcaggcuggaggaaggcagggcugaguuagaggagugagaggcuccauggucaucaggaauggggcacaggcauaguggucuugcccugccagcucucauuugccaccucuugguccaggaugaacuccagaaaggggcaggagagcccccuuguuuuaaauuauuauuauuauuauuauuauuauuauuuugagacagagucucugucacccaggcuggagugcagugguacgaucucgucucacugcaacuccaccucccggguucaagcaauucuccugccucagccucccgaguagcugggauuacaggcaccugccacuacgcccagcuaauuuuuuuguguuuuuaguagagcauacgccaccaugcuugguuuuguauuuuuacuagagaugggguuucaccacauuggccagguuggucucgaacuccugaccucaaaugaucuacccaccuuggccucccaaagugcugggauuacaggcaugagccacugcguccagcugaaauuaguuuugaucauggugaaauacacaugauguaaaauugaucgucugaaccauuuguaagcgcacagcucaguggcaugaagcacauucacacuguugcgcagccgucaccaccaagcacccaaggaacuuucuuaucuucucaagcugaaacuguucccauuaaacacuaacucccauucccucucccuguagcuccugguaaccaccauuccgcuuucugucucuguggguuugacuccucuagggaacucauguaaguggaauuauacaguguuugaucuuuugugucuggcuuauuucacuuagcauaaugucuucaagguucauccaugccauguguagcaaauguaaguguuuccuuccuuucugaggugcaauaauauuccauuguguggacagaccacauuuucuguaucuguccauucaucgauggacacuuggguugcuuccaccuuuuggcuauugcgaauaguaaugcugcugugaacaugagcagaagaagagcucccuuuuuugagggcagacuguaguucugcuuagauuucauuggcuggagcuucaucuccuggcuacaucuagcugcaaggaagacuagggaauguagugucuuuauucugggaggucaggugccccagugaacaugagaaaaaagggaaacagacauugggauggauagcuggcugucuacagcagaggugagggcaaacuaugacaguggcacaguuucaggaaaccuuccagaagggaccucauccugacugaggagcgggagagggaauugaagaagcccaaggucucaagccugggugauggugacagagaccgcuggaugguucuggcauuugggagaggauuuugacuucaauuuuggucaucuuggggucaauuuuuuccuuaaaacaacuaguauuagugagaggacccuguugacagggucuagaaacguuuagaauccccuuuucugucuuuauguuugacccuggacuaguucucuuuucuuuucuuuuuucuuuuauuuuccuuuucuuuucuuuuauuuuccuuucuuucuuucuuucuuucuuucuuucuuucuuucuuucuuucuuuucuuucuuuuucuuucugucugucugucucucugucugucugucugucuuucuuucuugacggagucucgcucugucacccaggcuggagugcagugaugccaucucagcucacugcaagcuccgccucccagguucaugccauucuccugccucagccucccgaguaggugggacuacaggugcccgccaccacgcccggcugauuuuuuuguauuuuuaguagagacgggguuucacuguuuuagccaggauggucucgaucuccugaccucgugauccacccaccucggccucccaaagugcugggauuacaggcaugagccaccaugcccggccaguucucuuuucuuagccucagcuuuucuaucuauaaaaugaggauaauaauccaugucuuuuugggugguuguggggaucagagauaaugcaaacuaaguguuaaguaugugaugggccuucauuagugggaaguguucaacacugagagaugcaagaauagaguaucaguuagcuguugcuggguaacauaccauccaaaaccuaguggccuguugcuggcuuaaugcaugaauuuguggucagcugaguacuucugcugaccugagccacgcucagcugauccugggggcgggggugagugcuugcuuauguggcugcugucagcugacggcuccacuggagcuagaugaccuaggauggccuuggcugggaugacuuguuucugcucccugcagugucucaacccccagcaggcuagcaugggccuguucaguuaugaugugcagaguuccaagaaaauaaauagaagcauucaaggucuuuugaggccuaggcuaagaacuggcacaccaucauguguaucucauucuauuggccaaagcaagacagaaggcacaaccaagagguugggaaauacacacuuucucuuaauagaagcagcugcaauaucacauugcaaagacagugaacacagaaaagauugaauaauuguugccguuauugcaaccaaaauacuacuguauuuuaaaauaaauaaaaccaauuuauuuuugaagaaaagcagccugggcuagcguagaucuacaucuuuaggaaccuagucuucuauuuuuauguuuaauuaucuuuaacuuguagcuuccaucuucagggucacuucauggcccaaguuggcugcuaaagcuccagccaucacauaugugcuccaagaaggagaaagagggggagcaaaaacgauguacuugauucaaguagagucauccccaguuuaaagcccuccugaaggcuccgcugagugaaucuaacugcaaaggccccugggaaaugccaucuuuuaacugacuugaauagaauugggguuugcuaguaaacaugaggggauaaugaguguggcugggggguuauaguuccuucaacuaaaggccauuuacuuguuaucuguuucaaaagacuuacauuaguccuaccugugccagacuugggaaauagaggcagaggaccccucugcccugggagagcgcauagucuggcagaggagauaagauaauggugaauucaucuccauuuaucagucccuccccugagccuagcuccaggcuggggccagagauugggcagugauaacugucucucccugcagcaaugcugugacugcuguggccugggccuccgcgugcgggccgagggccagucgugugaguccaauccuaaccugggcuaucccugcaaucaugucaugcucuccugcugugagggugaagagccucucauaguaccugagguucgccgaccuccagagcccgcagcugcaccacggagaggugagugcugcucuucccuggcugcggcauauagggcgaaggcugguugaccucuggccuucuguggggacccuggguccaucaucaccuguggcuugagacacaaguucugcucuaaacagaguucugaggauggugauuucauuguuuucuguggacuacccacuccaccaacuuaaccaccaacuaccacccaucacccuuucacuguccacucaccacccuccccucucuuugucuauacaucuuccucccugucuacuuugucuauacaucuuccucccuacccacuuaucaguuugcucuuuuuccauccauugcacuugucucccacccauccucccauccucuuguccaucucuccauccauucauucauucacucccucauucauccucuaucccaucaucuguccauccauccauccauccauccauccauccacccauccacccaccuacccacccaauuauccauccauccauccauccauccauccauccauccaccuacccacccauccacccauucacucacccacccauccaucuauccauccauucauucauccauguaucuaucuaccuauccacuauccacucauccauccguuuguuuauccauccauccauccaucccucauccauccauccauuuauccaucuaccuacccauccauucauucauucaucuguccaucuguccaucuauccaucugucugaucaucuauucaucuauccauccauccauccauccauccauccauccauccauccacccacccauccgucuguucauccaucugcuuauccauccauccauccauccauccauccauccauccauccauccauccaugcauccauccucguuguccuuggugucacccccuucuucuucccuucuugugcuguagccacuguuccagcugccauguccagucccuguccccuagccagggcugucuccuggacccaugaccauuagccuccucugugccuggugggucugcaggagccugaugagggugccccagugagucagcagauguccuuuuuguacaugggccuugguggcccuggggcuggugccgugagaguccuggcaggccugcuuuguugguguccacauguucagccucaacugguuggggaccagauguccagguagguuccagaaccaccagcccaguuuuuucgcuguuccuauggaccgucaucuggggccccuguggauuuguccugggcacuucauggagugggaauuaaagccacagaugagguccugguaucaagauuaaacucuuggccucuggagucaggcagacuugguuggaauccuaguuccuuugcuuaccuggggcaggucacacagaaggaaggcuccuucucagagccuucacuguggcaucugucaaauggucuuguauucuuuaccuuguucagugcaaggaugaaugauaggaugccugucaagggcuuuuggcagugccuagugaugcauucagcauugccaccacuguugcuguuaccguugccgugcuucagcagcucagagggggaagaugaggcccagagaagggcaggaucuugccccaggcacaugccgggucuuuggcacagccaggacuggacaccuuggcucuaaugacucccacuucugccccagccuuccugaugcccugaguuuuaucuagacccagucagccuugguuccgauugacccagaucucugucacuauaaugcaagauggcagaagucugugcauagggguuaagaugccugcuguccacaggugccagggcucaggagauccuacaggaagagcucauauccugugugguacaggugggagaacagauaccuggaucucccaucagggugaggcagaggcaggggugaguguguggggguuggaccaggccagaccugggcagaucaaccagaacagauguaccaaccacccuugccaauccaauguggguacagagaguaaguccaguccaaggaagugcuacuugcugagauuggcucuaaggggaaugguugaguacuggugugaaggccagguuaguacccagaagagucuggcugaagguagaguuugggaggaaguccggcuucaaaagucaaaggcagguggguggaagggaguaggugggcaacagagccaggcacgauccuggccagagauccaugcuuccuccugugaggaagaugcuggugagggugagcugagccugaauccuggagguacugucuagccuguggugugcuaggaggagcccuggguccaggucuguccgccgccugccugcagugcugagucucugcgggaccagaccgccagccaucauggcccugccuggaggcaccggcugggacugauugggcugcagcuuaauguaaacacccuccauaugaaacacguuccucauacgugacuucaugcagcuacucucucugugggcucugcugccuggguggggugggaaggaggcccugggcuggcacagagcuuagaggggcuguaggccucccccugaaguccuggcugcaugcuuuccccacaguugucauacaaagagcuucccaaggcagcucagccucaggagccuucuuuuccacucucaccugcuccccagcacaacccugggagauggguuuauuccagaaucuggaggcacagagaggccuagugcugcccaaguugacccagcuagggaaggcccaggucaguggucacaucugauccaauagagcccagauuuggagcccuuucugcugcuaaggaugauccuccuugaugucacugaggucaggggucugaauccauuguaacacuuuagugagagcuucuuuguggaucugacccuguccuauuguagaggacucagugaugaagacuuggaccuggcucugauggguucauucuuacugcuugaggucuguucauucauuugcccauccauucaucaauccauccauccauccauccauccauccauccaucuauccauccauccauccauccaucuaccuaccuaccaguccauccauccgucuguucaucugucuguccacccauccaucuacccauccacucauccacucuuucaucuacccauucauccauccauucagccccacacccauucauccauccauucacguauccauccaccuacccauccuuccauucacucauccacccauccacccacucacccauccaucuauccaucuacucauccauucaucuacccauccaucuauccauccacccacccauccauccauucagccaaauacucauucauccgucuacccauguauccaucuauccacccauccuuccaucuacccauccauccuccuucauucauccacccauccaguuacaacccauccacccauccauccauccauccauccauccauccauccauccauccacccauccacccacccauucauucacccacccaucuacccacccauccacccacccauccaucuaaccauccauccauccauccauccauccauccauccauucauccaccccccccacccccccacccauucauucaccuacccauccacccacccauccaucuacccauccacccacccauccacucacucacccauccauccacccauccaucuacccauccaucuauacccauccgucuaucuauuuaccugcccacccacccaucuauccauccaucuauccacccauccacccacccacccauccauccauccugcuucauccauccuugcugucugcugggcacacagaggucuugaugaggaccugcacuaguuucccaaagcugguugucucagccaccuacucugaccaagcuggcucugucuugagcucuaaccccuguccuaguuucagaggcagagauggcgggccgagaggcccugucacugggcacagaggccgagcugccgaacagccugccgggcgaugaccaggaugagugccuucuccucccgggagagcugugccagcaccuuugcaucaauacuguggguucuuaccacugugccugcuuuccuggcuucucacugcaggacgauggccgcacuugccgcccagguaagggcccugauggccagggcaggggcuaugggaagggcugaucuugccaggggguguggcauuccuggggugcacacugugggguccuucacuuccuguuaccccacaaguuggaacccacagaagccugaagcuuccagugaugggggauuugugaggcaggaaaaauagaagcuuucuuccuggggcuccaucugcagggaccuggccccagcaccuugucccauauucgagcgcagggacaggcucaggccacagaggcucucaccaaaacccagcuaucuccccagugcugggcccauggugauccugagggauuuccucccagucacuggucccagaauugauugguuuuuaauccagacacucuuuuuccuuuccccccucucuucuuccuugccuccuuuccuucuacccccucugcccccaguagcugagauugaucuuucccaagguauaugcacacuccaaaccucauuuuccucuccugugaaauggggugggggauuaaaugucagugcccugugugagaagggcaggugccuggaagugccugaggccuggcugaagaccugagaccucccugcaacccccacucugcucuacccaugacagagggucacccuccacagccggaagccccacaggagccugcacugaagucagaauuuucccagguggccucuaacaccaucccgcugccacugccgcagcccaauaccugcaaagguaagcaguguggguggugucuccaggacagggcccaggguccagggggugggucugggcugcuugcagguggugagcugucuggugcuggguaugugcaagauggccccuccaaagggugugcuucuguuuuggggaugaugggcuuacccugggcugagugaggagcugaggaagucacuggggagaugugguguggggacagccuagggccuggugugugaccccaaaccagccaguuagcugcuuuuugucuccauucuuguaacguugagguagucaaauccugguuugccgaccuguuguggaggcuguguucagcgcuguguagaaaguccucuucuuuguuguucuucuccucauucccuuccccugcuuuuuucccugcccccuucccuuucucuucuuccuucucucuucuccuccaucuccccauuguucuugcugucacgcaaggcaugggcugggauccgaguggugggggagguagacccagaacgucguccccgacgccagacgguguuggagcagacuuaauggaugaaccugugaaaaggaccaggaguggcguuccuugucucccagcaucccugccuucuaggggccuuguuucugugucucacuaguagguuagagccagggauggggaaugagccaguguggaccaaggccagggccugguggucucugauuucugugugguuuccuccagacaauggacccugcaagcaggugugcagcacuguugggggcucagccauaugcuccuguuuucccggcuaugccaucauggcggauggcguguccugugaaggugagugccuuggggugcccuccuaccugugcaaaccugaguuggccugugaugggggccuccagguggggguggcugagacuuaaaacuugcugaguuugugcaggaagagucuuggcugcuaugaugagcaccccuaguggagcagguuaaacagucacucccucucaccguacgugcgguguauacaugcacuccagggugggccugcaguguggcugcauaggaauggggcccgggcuccucacauggugucgcuccgcauuucccggagcagugcuucuccugccgagugugcaccugagucccuggaggccugggucaaacaggcaguccugagauucugccgaauccccaaagaucgagucaauaggucugggugggugggccugagaauuugugcuucuaacaaggugauacggaugcugcugguccgcggacaccaccuccacucaccuugcccuugaggguugcccuggucugugcagccauguccaggccuggguggagagggggaaggggaagcaaugccgguuguuuuaagggcagccagaaguguccccgauggggagugggagggaggcuggacagcaggaaugccuggcugaaucuguucccaaaugaaggacacuggugaugauuagcuguccaaggaucacauaccuuccacccccguggccccgccuaggucugggucuugucuuuguggggccucugugggccaggaccccccacuguaaaaugaggccauuggauccagcaccugcuggguugguucccacagugaauggcuucugaagaaccaagcugagaggucucaagacucuaccuccugccugggggcaggacagaaauggaguaugcagagucuaggaaguauggcaguucuggcucagagaugagacccuggugggugucugggggagaacagagucaagucugccugggugaauacccacaucccucccagaagcugaaagcccguguccauccccagccgagacuguucugauguggacaaacaccguccuacgagcccagagaggacaguagacuugcccaggguacaugacguggcagugaccggcaggccuuccucuccgaugcugggggcagcucucagguccagguggugcuggguucucugggccccgccccccaucucccagggcccugaagauguaagagcugcaucuuuucuggggcaggccuccuuugggcccagcccugugaggccccucugccugugcugcucaugcagccuagcccaugucugcgcauccccaggacccccucccuccucuggaagcccuggcagugaaagcugggguccagguugcaaugggcauucagagaggcaccugcucugcggaggagcgcugcucaacucugcugcauuggaaauaaucaagugaguuccaaacguguugagcacaagaaugauuaaaacacuuccagauuuuagguuucucuuggugugaaaucugcauacaaggggcccacaccccuguccccuuuuggauggagcacagacacucaguguccuggagccccugugggcccuucccugguuuauguggcuggccugguccccuaaguacuggacuuugcaagcucucgggggcaugguucucuuggcgcccguggaugugggaaguaucgagugcguacgggaggcagccucugguccuguccccacugugaccgugggcagccacccacccucucugagucucaccucaccaccguccuuacuggggcaguggggaccagcucugcacacucacacuugggcccaaggcccagcuacacacagucaggcggggaggccccagacaggccccugccccuugcugggucucauucuccugucacuggaugcuccguggcagcccaugucccucuaacaguccuucuguuuuuccuccugcggcugccacuagaccaagacgagugccugaugggugcucacgauuguagccggcgacaguucugugugaacacccugggauccuucuacugugucaaccacacagugcucugugccgauggcuauauccucaaugcgcacaggaagugcguggguaagccagggccccgccugccgcccgccgucacagcucuccgcucugcuccacgccaagcccaccacacuguggccacaugccaaagggccugcccuuugcaugugagcucucagcacagccggcaucuccgugcucuaugucgugcccuuguguccuggcgucuugucccgcuuggcugccagcuccacccggaggcugcuuuccccagggacgugucuaugugucagggaacuggauguguggccugguggaucagggaccccaccugggcugcaggaaaaugagggggucagacaugcugggagcaggauaggauguguggggucuggaggcaggaggccuagccaagcaggacccccagaagcuccguggccuuggaugaaugacucgucuucccccagcugugguuuucucaucuguaguaaggaggcuguugauccucuuuugacgauugugugacauguaugugggguagcacagagccugggcaccgugagcaugcuacaacagcuacgugccuuccccagggucccccgcagagcugguggauggaggaugggguccagcagagcccgccucgcauaccagcuuggcguuccuuugcuaugugaccuugagcagcggagcucuccucucugagccugccuuuccuccccucugaccguggggccagaggacugggugagggcucauacccggcaccuggccugcacaucgcccggguuggugcucagugaugccucuuccuucuccucucuuaggccccaugugggccaggcgccguggcucugggagugcucugugcguacaugucugcagccucugauguuuucagagaacuguaaacccuuguguccuccaguuuguggucccaaacggagauagacccaaaguagcugggacucagggcagacggugguaaaugccaucacagagacacgcgcagagggcgaggucauuccagcugguggcaucggguuagcauuuggaaaucaguaagggcaugcagcguagaaggaacagcucaaauaaagguauagaaguaggaucagaaccuagugcguucagggcaugugaccagagccccguuugucuucucugugcuuggggaccauguccagccuggacauauccccuuccuuccucgccuuucaccacugggcacacgggcccauggugcugggcugaaugccugcugcagacauguuugcccuaggccucuagccguuggcacaacaugcgccuccugacccugcuugccagcagccggccagcucuuccugucuggguuggguccguguguguacgucugggaaggcggaucccaccagggcccacgagcaccccucccaugaugcccugcccucucgcggugccugaguacgcaggcuugucuagcugccuggagauaaaacauacuaaaagggauccccaggcagcugcaaaguggguucugggaaugaaagagcaagggcacauuccauucagcaaaauugaugagcucacaugcauuccuuucuuucuuucccuccuuguucauccuguacaaacccgucagcaccucuucauccuuccaugccccucgcacacguguucaucccgucguguuaguaccugccgcgcguucuuuccgucauuuguacguccacaaauguccacugggcucuccugcaguucauuuguuugcucugcacuuguuuauuaacccaggcaggugagaugcgaggcuuaugcuaggaucaagaguguggccuuugcagccagccugccugccugugcugaaauccuggcucuuucaauuuuuaaucauaagaccuuaaaccaguugguuaaacucucugagccucaguuuccucaucugugaaugagauaacagcaccuaccucaaagagucauuguggggauuaaaugaauuaguccauuuaaagaaguugcuacucuugugacaucauuguuaugauucaaccaauguuucacugaggcaaccugcagagguaguaagcuccccaucacuggagguauguaaaucaaagugggacaguauugggugugaccugugccaaggacuccccuguguuuaccauuugccuuuuguggucuguacuuugaagacugucuugggcacagggaaaaguguugcaggugguccaggcugcaagaugugagggaggcagccccccagcucugagccccccaugaaguggugcugcagcagugcuugaaugauggguacaaggguacagcucugggccgggcacucuggcuuccguucuugaucugccacauggcuguccgugugacucugguccagucacagcacuaccgggaggcugauuuccuccucugagaaauggggcuugcagaacgauguccucuaaaccaccugacccuggugagccuccgcucauggugcugcuguuguuaccauaauuccuccaggcugugggaggcucuuggguuaugggcauuucugggguccugggaauggucucccucuguaaguccagccuguaaaucagaaaucuuuaucuugcccagccaagccuuccuuggaaaccacuggcccagaacuuucccuuucccuccuccccauucccagccauccccgggucugccuggccuggacacuguuugguucaccugugaguuugggagggucucuuuccccagggccuuggccuccaccucuccaccugguccucuagucauccuuguagacucagcucgaaugucaccacuccugagaaguggcucugaugguccagaccacagcaggcaguucucuggccagagcccccaagccuccaccugccuguccuugagggccggggcuggggccgacacacccacuuggucacaggagccuagcacagaguuauguguguggaauggauggauaagcaggggacuagugcaccugaccgccgccacaaggugcagcaccaggaggggguagaugggucagccuuccacacuggcuuagcgcuggccuuggggcgguuucugaguugguggccucuguggccccugggcaguuccugaguugguggcuucuguggccacuguggcccgggggugguuucugaguugguggccucuguggccccagggcaguuucugaguugguggccucuguggccccggggcaguuucugaguugguggccucuguggccuggggugguuucugaguugguggccucuguggcccgggggugguuucugaguugguggccucuguggcccuggggcaguuucugaguugguggccucuguggcccgggggugguuucugaguugguggccucuguggccugggggugguuucugaguugguggccucuguggcccggggacaguuucugagccucuguggcuccccaccucccuuaugcguccucucucuccuucacuggcuucuccucuccccaacugcuuaucccuggaaucucccaggagcugguccuuggccuccucuccgugugaucucuccccuggguggccucagccaucugaccauucucaaguuaguauucccacucagaccccuugugugaacuccaaggcauguccucagcugccucuucacccucaaacucucauggccagcagggcucccaccuuccccugcagccuacaccucacagccggcccucacugccaccuguccagcugcuuggccagaagcucugggccccucuuccugccucaccuucaucucauccaucaguggguuuuguugguuccagcuucacaauacuucagaaucuagccacuucucccagcccauugaagguaguccgagccacugaaucuccugccuggauccucaccccuauucuccagccccugccagggauccuugcuccaaauaaauaagaccacuuucucuucugcuuggaacucucuauggcucccuccauuccuccugcucacccucuuucucccuucccuccccugcagcacacccaccuccuggugggcccuugaaccugcacagcuggcuuccuucucagggccuuuacaucccugacgccucugccuggacugucugcauggcccagucugucaucuugucacaucuuugcucagaugucuucuuuucugagaauccaucccugacccaucccgcccagcgccccccgcuguaccugggcacucccugucuccugcguccugcucuguuuuauccauagcacucaucaccaccuccauuuauguuuguuuauguauuuauuguguccucuccccuugagugucugccccacaagggcagggauuucugucuuggucacugauguacacccagugccaagaacagugcuuggugcauagcaggugcucaauaaaucuuuguugaaugaagggauguuugggugccgagacaucagccacaucuccgaauggugagcucccugagggcagggccuggagcucucucccuccugguggcccaaggucugcuggcugcacucagccacuguccuggggacucugcagccucugauggccucgcucucccugcagacaucaacgagugugugacggaccugcacacgugcagccggggcgagcacugugugaacacacugggcuccuuccacugcuacaaggcacucaccugugagccaggcuaugcccucaaggauggcgagugcgaaggugagaagggcccagaaggaccaacuggaggccccgccccauggccaguuuugccccgccccucccuggucccaccccuguccugcccuggccacccuuaggccuggccacgccccucuccauccccuccuuucuagcaagcuccccuuaguuggguuuccugcuggugggaagaccccacaauggugguguuuggggcggagaugggagucugaggcagggugagggcaggcuagguccaccccggcuuugcuccugccugcuggugucugggugccaguuaucccccuugcuguggccugguuuguacauugagguggagcccacagaggguucacucugucccuuuuacuggaaaauucuagccuucuaaucagagggagggguuucauccaacccuuucaacaaguacguccugagcugcucuuaugugccugccggguccuggguaccagggauccaggguggggugcuguggcccuucucugaccuugugguuggggcagcgggguccacacaggcaaacagagauggcagagugacugggggcugggggccccuguaagugguggguucaaggaggccccuggaggaggugacguuggaguugagaccugaaugagaagcuccuggggaggguguucaggcagagggggcagcgugccaaggccuguuggguguggggaggaagcacucuuggcauguuccagaaacagaaagacagucuccgggguuggagccuucuugcuaccugugcuaccucccuaaagugugaacacaugaccuuaccuuagagauuuaggcacacgguggggauauccccacuuccgcccccugcaagugugggacagcggcuaacaaagcaggcuugggagccagucccccggguucugguccugguccagugcuccccagcaguagagccuugucucugccucagcuucccuccuuguaagauggggcuugucaugacaucuacuucuuacggcugugugggguuuaaggaaauaaauccaucucaggugcucagaacaauggugggaccaaagagaagcgcaguaaacauggucacguuguuauuacuccugggacaaaggccaugccggcaacaauguggcugugccagcuucccagggagaucuuuguggccaucagggucaugggucugagggcggggaugugugggcagggcugcugaguguaaaggcaggaccugccccccagcccuugacacccagccucuccgcugcagacguggaugagugugcgaugggcacgcacaccugccagccgggcuucuugugccagaacaccaagggcuccuucuacugccaggccaggcagcgcugcauggauggcuuccugcaggauccugaaggcaacugugugggugagcgggggcugcagggcuggggaucaucagccuagggcucuacuggaggcauugugggggcuuuuagggcuuuagagaccagggaggccuggcuugcugcuccauuccucucccagcccccuugucccuaccugugaaugggcaugucaaguguucaacccugggggcaccacuguccccaaaguguagcugcuccuauuaccuugagcugugaaaccuuggcugaguuauuauucaguggccucugugaagcuaucugugggguuggacuggauacgaaugaguaucccuuuuuuuuaaccagucagcaguggcuaugugauagaucaugaccuggcacagacaucuacacacauccaggaagaacugcaauaccaguguccccacacaguacugcaugugacacccacugaaauuucccauuuucagagaaugcuagugagaccuccuagagugauuccaugccguacucgaggguugagacuuaacaguuuuacagaugccggccuaguccccaagugggucugagauucuacccgcucugcgccccccaucaacuccuuccaaaaaaggguuugcuuagucucugugccucuaaaacuucuuguuaaugugcugugcuucccuggcagcuagaccccuggcacgugguugguguaguuauccuagcacucagccucgaucccgcccugccuccagcugcucuguugggcagaugugagagggcguagggccagccaucaggugcuuggguucugggagguguaucccuuggguaguggggcacagggguaggacagucuggcccugcaacucugaccagggcaggucuggagcccaggaccgacccccucccaguguggcccugggaggggcuggggccugggaggacaccaugccgggcucccugucaccuacaccugccucugcagacaucaacgagugcacgucacuguccgagccaugucggccaggcuucagcugcaucaacacggugggcuccuacacaugccagaggaacccgcugaucugcgcgcgcggcuaccacgccagcgaugaugggaccaaguguguggguaaggccagccgccuccgcccugccagccagcccggccugcccgcuuccccaccccugggagguguguguggagggagccccaggccucaagguacccugcucaccccccacagacgugaaugagugugagacaggugugcaccgcugcggugagggccaagugugccacaaccucccuggcuccuaccgcugugacugcaaagccggcuuucagcgggaugccuuuggccggggcugcaucgguagguaggcugguggccaggaccccuggggaacaccuggcugguccccugcccucugugcacuccaccuccccaugcccagcaccuccacugccugaguggggcccaccugcuggaguccacaaggucgccuuccagcuggccucauccuccugcugggccugccaggaccuggcucuggcccccgcccccaccuucucagucccuccugucucaucucugugccucugccccucuuacucuggucuuuccugcuucccucggucucugucaccaucucuucuugucuguugcuuugccugugucugucccucuggccucuuccucucgccuuccuccaauacccuugcugccuccccgccaccuggucucuuugccucucucuuucccuguccuggccucucccugucuuuccuucugggucccucucccacuuagccuccccuucggcccuggauggcccuuggggguggagggagcuggcuuuagggccaccuacccuguaccugcugccugcccucccacagacgugaaugagugcugggccucgccaggccgccugugccagcacacgugugagaacacacucggcuccuaccgcuguuccugcgccuccggguuccugcuagcagcggacggcaagcgcugugaagguaggcuggcccucaucucugacccuaugccgccugguaucuguagugggcagacccgccguggaaggcccagagccuucugugacccuucacccuuacaccuucacccucacaccuucacccaugcuggcccuuccuuccuccucugucuggcccaacccucucuggccuccacucucaccuuccuucuguuguuuucugcccugaauuccccugcugagguccuggggcuccagcucccucaguccagagaggcugggucucugugucaucuguacccacaaauaggguaucugaggcauccaagguccguguaccuaccugugcgggacgcgccuguggcugagggaggggcuguaacauuauucccauguguguucauggugcuguuggccccagcucaguggggacugguguggaguaaggccaccaggcugcucagugagggggcgaggggccaagccagaaggccauggggucuuggccccauuuaccuggcacggucuuucccagccccuccccagccuggaggcaauuuccucauuuucuccuggugaggugaguuggcugagaccccugggaggccauggaucccuucccagucaccaggccuggcaggagagcuggcccucgcauaggucaaccccaguccaggccggggagcuuggugggccuggcugucagacagcauuuggaugggcucuccaaggcagacuugggcccugccaugacugccugcuggugucccugcagacgugaaugagugugaggcccagcgcugcagccaggagugugccaacaucuauggcuccuaccagugcuacugccgccagggcuaccagcuggcugaggaugggcacaccugcacagguaccucuccccuguccaagggcccccuuccagagagucacuccuuucccuugugccaggcuccccgagagucccugcugggccauggacacagaaagguuuuagcaucagaucugaguucaagccccagcccugcaguuuccuggcugugugaccuugggcagauugccucuccacucugaccucagguuccuccucuguaaaaugggaagaaugguccugacuucagggggaugaagaccuaaguuuacauaggugcccaugacuggcaucugauuguccccucagcugguaguagcagucacggagcagcccuagggcauaagcacuggagugggaguccuguuuugcuucguggccuugggcaacucucuucuacucucucaguccacuugucuucauuuaaaaaaugggccccuaagcucuauggcugugacagggacaggcugacugucaguggcugggcucuguggguggacgagguucaccaggggcugaaccucucucugacagacaucgacgagugugcucaaggcgccggcauccucugcaccuuccgcugucucaacgugccagggagcuaccagugugcaugcccugagcagggcuacaccaugacggccaacgggagguccugcaagggugagcaaguccccccacacgcccccgccuccaucagggccuugggcaggcuccaagcaggcacagaaaagcucacacagcuugcgugcacuuggagcccccacacccagugaauaaaugcaggauggccaaugcuaccaguggccauguuaacugagguugugccugggaugaagaacgugacagucuugcugcugcucaauccagcuuagaaucuuccaggcuugugcucagcucuggacccugcccugagaguggaacagagauacuaugggguguuucuacggaggcacgaagccugcccagugaggagacggcagaagagccgcaggggucccaggcagugucccgagucucugcaguguuaugcagggacaaggggaucaggcaggucuguggacccagagaguagggcgggauccuggggaguagagaagggugucauggggaggcuuuucccaacccuggugcagaagggcauucuccucaucagagcuguguagagcugggaggggcugcacaaugggagggucccccacuccccugcuauugaggauguacaagagcugggcagucaccuguggaauuugcaagagaggggacugugucccuggauagagaccguguucugugguauuuaauguuccuccucugcuagagagucguacuucuaaguucagugccauuugccaccggauucugggccugguaagccaccagggcaaggugaggggccaggacacagaaggggucauugccccaggagaaccaaccacucagccccauggccucuuggccucucgcucccucggccccucggucccuuggcgccgcagagcucagaccuccuccugacuucaguggccaggucuuccucacacauggagcugagaaccuggaguucccuggggugcagcuuucggggugugaccaggguccuggcccagccuugggcauuuucuuggcccgcaaaagcagaggggucagaguuagcucccagaaggguuuggaguuagcucagcacagugcaggcuggugguugcuaccugucaguggauccugagaucaagucgauagacuucagccagcugccuguguucuccuuuccauuagcauagaacagaaagcagcauagggcagaguggaguggcguggcauggggcaggucagagugcagugugacccuagguuccagcccuuauguguguaccuagucccaaugcacaaggaguccuuuguguggguggaugcaaacguaucagagucguaaguuaagucagaagaccaugagaagacccuauaaaucacugacugggaggccugcucggcccacagaagcuggcuuacuuaggucuugcuggcugcaaagcccucuucuuguuaauuaaaaaaaaaaagucgguauggacuccguaaaagguaaggauucuauucaccgugugcucagcucggcaggaaauauggcuuuauccuucuagauugugauuucacaugugacaccaaggcccuguuccuccugguggcagaacacaaguguggccacuucaaggaagccccaucagacacugcagugacauuugcucuuggaggaguuucaggaugcaaaccugucugcauugaggacagacucucccuggcuguuuauuuucugaccuacaccaaacaccuugggggugcucaggacaccuggaugcccacaugugccuggcuagccacuagagagggcuucccgggaccuggcauaugcccaucgugggugcaccugacccuagcgcuucucuccugcccgggcuugcccgccaccccgucucugcauccucuucuugggguggcugcuccucugccccgacgacuugcucuguguugaagaacuggcgaggccagguccccucugcaggcccccagugugccaccagccccaccaggagguuggggcaagguagagccccacaccugcacaucugccgcccucgcuugcucuccagaccuuccuucuggaagagccuucugacucacauggugggcaagggcacagugggggcugccggcuccccggccucauccauuucacaggucacuccauguagccacuucugcagcuccugaccuucagagcuaagaggcuguccucuucuccuguucuggcuugggccaaacccugaggucucucggcucaaacaggguggggggaggcuggcuugggggaaagaauguguuggauaauguccccguuagccuuuagccucucuccaauaguuaaaaaagaaaaggacaggaaaauccgaaggaauuuagacucagcccucucaccuggcaugcacacuccaugaagguagggcccuaucuguccggcucaccagcaucuagagcaaugcccagcacauaguaggugcucauuggacaguugaccccaugacugagcugagugggaaccacugcucauguuugcaugcauuucccuccagucuuucccuuagcagauauaaacacacugcaaacacacacacacacacacacacacacacacacacacacacagcugaaagucacucugagucccggucguuucuguguaguaagagcccaucucugcaugccacucgauggggcaggccagcuuugagcagcacucucggucuugccccugagcuguugugggcuucugggccucaaguccuucagaagcccuuggaagccucucuuccggggcugaauuuugcaggacuccccuguuucguccuuuuugcucugucacccacuuuugcacaucugaguugcggcugacccuggcugucucugaugaggcugugauggcagcccuggauacggggccuaguccagcucccacguuagccugcgcucuccaggggccuggcagcgccgaugggcgaggcccuggggcguuagggaagaccugcgacugaccgccucccgcgagcuuggugaggccaggcuguagccgcucacccuucuuggcccuucccuucugggcaucuccaucagcagcagcccagagccaaagcaaaaagcucccacguccuuccugccccacccacauaagcuccagggucacuggagcgggccaccgggggcauaggccaaggagcaggaggaggcccucuccauguggaguccacgagugaauaaucagcagccugggaccacccgguugggcucuacccugccuggccucuugccguguuuucucccacucacuucugcgccacccuggggccuauuuuacggagggagggaagugaggccuggagagguaaauagaugugagcugacccgcuacaagagagccuggcagccaagagcccagagucugaggcgguccggggguauugaguccuggcguugcccuggcagcuaugugacccugggcacauuuguggacaccugcaccugccccgugggguuggcgugggugcagagucccucaagcaucacagggaugucaggcaguaaacucuggaggcaggcugacuauugguauuauuacuauuauguuguuguuauuguuaggagucagcuuggcaucaugacugggucccagauuuuggcaucaggcaugccugacuugcugccccgcucgcugcugugugaucuugagcaaggcuuugccccucucugagccuccacacccuccucugucugaggaagccagugacccucgcugcacagggcuggugugaggacugagugaggacaaauuccuaaauggugucaauauggaggauuggaaaacaaaaacugaagcccucugugguugccccuggaacacccccugccccuaccccacgggacuuucuggaggccuccugaggcggcccucucugggcugagcagcucauccucaaaguuucucaagaacccauuucuaagaccuuuuguccuccagggugccuguggguuacacacacacacacacacacacacccacacacaccccuaccccaccccugcuucucugagcuuucgugaaugguaucuauucauaugucuguugacguuuauauguguauguuucuuugucccaaaugggccuucuguguguuuguuucugugcaccuguggaggugugcgugugcucacgugugugcugaaccuaugugccuguuggaguugcacauguauguuugcuucugaauguacaggaagcgugagcacgucuguugcucaugggggacauugacucauagcuuugcgucucggagucgggacuugcaagugaugggucuuggacuuccauccagcaagaaguauugagcgcugcuccaugcaggcacuccacugggcacuggggacagcaugggaaugagaaagacaaacaccccugcccuccuggagcccagguugaggggggacgguagaaacauacaaaacaugcagccauaccaaacagccucgguguguugcagagcauggagccauaggaggaugauaaaauggggugggauggagggugauggggcaggaggaccacuguagaguggucagggaggccauccuggagggggugacucaagaucugagaguuaaaagaugagaagccuccagcaguaggaaaagcuggggauagcguuccagcagcagcaaaggcccuggguaggauaagggucaggcuauuggggcagcccaaggauguccagcaggacuguggccucuguggaagagaaggagcuuagagaggccagagagccuugcacuguguggcuuggcauccaggggagggagcugggcuuuauucuggagcgcgagaagccuugggagggcaugacaugaggugauugacacuuuagagccaggcccccugcugcggggugccgagcaggugagauggggcaugugugugcagggaggcacgcgggcuauucucacagguccggcugccguggggcccaggccuuucaugcaggcuggggaguuucaggcugggucccccagcuguggggacccugccauugccccucuucucccccagacguggaugagugugcacuggguacccacaacuguuccgaggcugagaccugccacaacauccaggguagcuuccgcugccugcgcuucgaguguccucccaacuauguccaagucuccaaaacgugaguguccccaccccagucccagucccagggagccuguccugguccuguacuauccagggagaggcugagagaugggcgccugccuugaucaccucccucucgucccagccccugacugcugggucugugggcuaggugaccaaaacaaauauaaguagcuuuuagagaguucaggguugagagaaggaaggggaaaagacacacagaaaacaccagcccucuuccucauacacacacaugguaguuacugcugugugaccaguuaucccaaccaacauuuagcaccagaauacaacagauacuuacucuuugucacgcagugucugagggcuaggagccugggagugguguagcuagguggucuggcucaggaucucaggggcugccuguccggggugcgggauccugccacugcucauggggcucugggcaggaggccucagcuccgcaucacaugagccccuccacaaggcugcuugugacaugccacuccccagcucaguguaucagaagugccagcggcagccccuuaaccucacuuaaccucagaacugacagaccgcuacucugccaccagccacacggcccggcacuugggagggacccugggagggacacugggugcacugggaagaagggagaaggaggaggaagggaaggggagagggaaaaggaaggagaaaggaagaaugggaggauggcaggagggaggaagaaaggagcauggggacagguaagagcuguuaacgagccuggccagugccaugcuaaacucacccauuccagugagccggugaagguuuuauuaaccucaucucgcaggcaaggaaacugagacccaggggacguaaggggacuugccugaggcuucccggccauuagggagagagcuggcccuugauccugccgcugagcugugccaucuguguccccgucuggggaugaggggggugggcgagcugugggugacccggccuauccucccugcaggaagugcgagcgcaccacgugccaugacuuccuggagugccagaacucgccagcgcgcaucacgcacuaccagcucaacuuccagacgggccuccuggugccugcgcauaucuuccgcauuggccccgcgccagccuucacgggggacaccaucgcccugaacaucaucaagggcaaugaggagggcuacuuuggcacgcgcaggcucaaugccuacacggguguggucuaccugcagcgggccgugcuggagccccgggacuuugcccuggacguggagaugaagcucuggaggcagggcuccgucaccaccuuccuggccaagaugcacaucuucuucaccaccuuugcccugugaggugccagcacgggccaccugcggguguggcgcagcccagggcucacacugcgugggagggacugggucacuauugugguuuuuacuauaacuuuguaaauuaacuuaauuuugcugacuugacuccuguggcuucuggaccccuccucugccccgcaggaggaaguuccacggcagguggugcguucccacgcaggcaccaaguggaagcuugcacggugggccacggccguggcgggugcccugugggugaggcugggugaugaccugaggaccagagacacgcgaccauguuggggcucuuggacuccucuggaugacccguccccaaaguugacauuccauuucauguuccacugugauuaauucuuuucuuuuuuaaaaaaucauuuuaaaguuuuuuguuuaacuauaaaguaguacauguacauuauauaaaaaaaaguucaacuaguaugaaaggguuauaaaguaacagaggaaaacgccucuuggucccuuuacuuuuguaaaguguucagaguuugacaacguuguccagaugucacagggcucuauggccuggccagcaugucaauucauugaugaagaccuugauguccuucucaacgagccccgaaccugaaguucacuuugggaugagggcaccccagugugaucagucacugaccaggcucuuuauucugcuuuuaccacuucagcuuucccuccuccuuccuccucccuccucccuccucugccuuccccccaugaagaccuccacugauggccugucacuuggauguuguccagaacuuguccuggccccug

SEQ ID NO: 14793 - RNA, 89989 nt, Homo sapiens
caggggccaggacaaguucuggacaacauccaagugacaggccaucaguggaggucuucauggggggaaggcagaggagggaggagggaggaggaaggaggagggaaagcugaagugguaaaagcagaauaaagagccuggucagugacugaucacacuggggugcccucaucccaaagugaacuucagguucggggcucguugagaaggacaucaaggucuucaucaaugaauugacaugcuggccaggccauagagcccugugacaucuggacaacguugucaaacucugaacacuuuacaaaaguaaagggaccaagaggcguuuuccucuguuacuuuauaacccuuucauacuaguugaacuuuuuuuuauauaauguacauguacuacuuuauaguuaaacaaaaaacuuuaaaaugauuuuuuaaaaaagaaaagaauuaaucacaguggaacaugaaauggaaugucaacuuuggggacgggucauccagaggaguccaagagccccaacauggucgcgugucucugguccucaggucaucacccagccucacccacagggcacccgccacggccguggcccaccgugcaagcuuccacuuggugccugcgugggaacgcaccaccugccguggaacuuccuccugcggggcagaggagggguccagaagccacaggagucaagucagcaaaauuaaguuaauuuacaaaguuauaguaaaaaccacaauagugacccagucccucccacgcagugugagcccugggcugcgccacacccgcagguggcccgugcuggcaccucacagggcaaagguggugaagaagaugugcaucuuggccaggaagguggugacggagcccugccuccagagcuucaucuccacguccagggcaaagucccggggcuccagcacggcccgcugcagguagaccacacccguguaggcauugagccugcgcgugccaaaguagcccuccucauugcccuugaugauguucagggcgauggugucccccgugaaggcuggcgcggggccaaugcggaagauaugcgcaggcaccaggaggcccgucuggaaguugagcugguagugcgugaugcgcgcuggcgaguucuggcacuccaggaagucauggcacguggugcgcucgcacuuccugcagggaggauaggccgggucacccacagcucgcccaccccccucauccccagacggggacacagauggcacagcucagcggcaggaucaagggccagcucucucccuaauggccgggaagccucaggcaaguccccuuacguccccugggucucaguuuccuugccugcgagaugagguuaauaaaaccuucaccggcucacuggaaugggugaguuuagcauggcacuggccaggcucguuaacagcucuuaccuguccccaugcuccuuucuuccucccuccugccauccucccauucuuccuuucuccuuccuuuucccucuccccuucccuuccuccuccuucucccuucuucccagugcacccagugucccucccagggucccucccaagugccgggccguguggcugguggcagaguagcggucugucaguucugagguuaagugagguuaaggggcugccgcuggcacuucugauacacugagcuggggaguggcaugucacaagcagccuuguggaggggcucaugugaugcggagcugaggccuccugcccagagccccaugagcaguggcaggaucccgcaccccggacaggcagccccugagauccugagccagaccaccuagcuacaccacucccaggcuccuagcccucagacacugcgugacaaagaguaaguaucuguuguauucuggugcuaaauguugguugggauaacuggucacacagcaguaacuaccauguguguguaugaggaagagggcugguguuuucugugugucuuuuccccuuccuucucucaacccugaacucucuaaaagcuacuuauauuuguuuuggucaccuagcccacagacccagcagucaggggcugggacgagagggaggugaucaaggcaggcgcccaucucucagccucucccuggauaguacaggaccaggacaggcucccugggacugggacugggguggggacacucacguuuuggagacuuggacauaguugggaggacacucgaagcgcaggcagcggaagcuacccuggauguuguggcaggucucagccucggaacaguuguggguacccagugcacacucauccacgucugggggagaagaggggcaauggcaggguccccacagcugggggacccagccugaaacuccccagccugcaugaaaggccugggccccacggcagccggaccugugagaauagcccgcgugccucccugcacacacaugccccaucucaccugcucggcaccccgcagcagggggccuggcucuaaagugucaaucaccucaugucaugcccucccaaggcuucucgcgcuccagaauaaagcccagcucccuccccuggaugccaagccacacagugcaaggcucucuggccucucuaagcuccuucucuuccacagaggccacaguccugcuggacauccuugggcugccccaauagccugacccuuauccuacccagggccuuugcugcugcuggaacgcuauccccagcuuuuccuacugcuggaggcuucucaucuuuuaacucucagaucuugagucacccccuccaggauggccucccugaccacucuacagugguccuccugccccaucacccuccaucccaccccauuuuaucauccuccuauggcuccaugcucugcaacacaccgaggcuguuugguauggcugcauguuuuguauguuucuaccguccccccucaaccugggcuccaggagggcagggguguuugucuuucucauucccaugcuguccccagugcccaguggagugccugcauggagcagcgcucaauacuucuugcuggauggaaguccaagacccaucacuugcaagucccgacuccgagacgcaaagcuaugagucaaugucccccaugagcaacagacgugcucacgcuuccuguacauucagaagcaaacauacaugugcaacuccaacaggcacauagguucagcacacacgugagcacacgcacaccuccacaggugcacagaaacaaacacacagaaggcccauuugggacaaagaaacauacacauauaaacgucaacagacauaugaauagauaccauucacgaaagcucagagaagcaggggugggguagggguguguguggguguguguguguguguguguguguaacccacaggcacccuggaggacaaaaggucuuagaaauggguucuugagaaacuuugaggaugagcugcucagcccagagagggccgccucaggaggccuccagaaagucccgugggguaggggcaggggguguuccaggggcaaccacagagggcuucaguuuuuguuuuccaauccuccauauugacaccauuuaggaauuuguccucacucaguccucacaccagcccugugcagcgagggucacuggcuuccucagacagaggaggguguggaggcucagagaggggcaaagccuugcucaagaucacacagcagcgagcggggcagcaagucaggcaugccugaugccaaaaucugggacccagucaugaugccaagcugacuccuaacaauaacaacaacauaauaguaauaauaccaauagucagccugccuccagaguuuacugccugacaucccugugaugcuugagggacucugcacccacgccaaccccacggggcaggugcagguguccacaaaugugcccagggucacauagcugccagggcaacgccaggacucaauacccccggaccgccucagacucugggcucuuggcugccaggcucucuuguagcgggucagcucacaucuauuuaccucuccaggccucacuucccucccuccguaaaauaggccccaggguggcgcagaagugagugggagaaaacacggcaagaggccaggcaggguagagcccaaccggguggucccaggcugcugauuauucacucguggacuccacauggagagggccuccuccugcuccuuggccuaugcccccgguggcccgcuccagugacccuggagcuuauguggguggggcaggaaggacgugggagcuuuuugcuuuggcucugggcugcugcugauggagaugcccagaagggaagggccaagaagggugagcggcuacagccuggccucaccaagcucgcgggaggcggucagucgcaggucuucccuaacgccccagggccucgcccaucggcgcugccaggccccuggagagcgcaggcuaacgugggagcuggacuaggccccguauccagggcugccaucacagccucaucagagacagccagggucagccgcaacucagaugugcaaaagugggugacagagcaaaaaggacgaaacaggggaguccugcaaaauucagccccggaagagaggcuuccaagggcuucugaaggacuugaggcccagaagcccacaacagcucaggggcaagaccgagagugcugcucaaagcuggccugccccaucgaguggcaugcagagaugggcucuuacuacacagaaacgaccgggacucagagugacuuucagcuguguguguguguguguguguguguguguguguguguguguuugcaguguguuuauaucugcuaagggaaagacuggagggaaaugcaugcaaacaugagcagugguucccacucagcucagucauggggucaacuguccaaugagcaccuacuaugugcugggcauugcucuagaugcuggugagccggacagauagggcccuaccuucauggagugugcaugccaggugagagggcugagucuaaauuccuucggauuuuccuguccuuuucuuuuuuaacuauuggagagaggcuaaaggcuaacggggacauuauccaacacauucuuucccccaagccagccuccccccacccuguuugagccgagagaccucaggguuuggcccaagccagaacaggagaagaggacagccucuuagcucugaaggucaggagcugcagaaguggcuacauggagugaccugugaaauggaugaggccggggagccggcagcccccacugugcccuugcccaccaugugagucagaaggcucuuccagaaggaaggucuggagagcaagcgagggcggcagaugugcagguguggggcucuaccuugccccaaccuccugguggggcugguggcacacugggggccugcagaggggaccuggccucgccaguucuucaacacagagcaagucgucggggcagaggagcagccaccccaagaagaggaugcagagacgggguggcgggcaagcccgggcaggagagaagcgcuagggucaggugcacccacgaugggcauaugccaggucccgggaagcccucucuaguggcuagccaggcacaugugggcauccagguguccugagcacccccaagguguuugguguaggucagaaaauaaacagccagggagagucuguccucaaugcagacagguuugcauccugaaacuccuccaagagcaaaugucacugcagugucugauggggcuuccuugaaguggccacacuuguguucugccaccaggaggaacagggccuuggugucacaugugaaaucacaaucuagaaggauaaagccauauuuccugccgagcugagcacacggugaauagaauccuuaccuuuuacggaguccauaccgacuuuuuuuuuuuaauuaacaagaagagggcuuugcagccagcaagaccuaaguaagccagcuucugugggccgagcaggccucccagucagugauuuauagggucuucucauggucuucugacuuaacuuacgacucugauacguuugcauccacccacacaaaggacuccuugugcauugggacuagguacacacauaagggcuggaaccuagggucacacugcacucugaccugccccaugccacgccacuccacucugcccuaugcugcuuucuguucuaugcuaauggaaaggagaacacaggcagcuggcugaagucuaucgacuugaucucaggauccacugacagguagcaaccaccagccugcacugugcugagcuaacuccaaacccuucugggagcuaacucugaccccucugcuuuugcgggccaagaaaaugcccaaggcugggccaggacccuggucacaccccgaaagcugcaccccagggaacuccagguucucagcuccaugugugaggaagaccuggccacugaagucaggaggaggucugagcucugcggcgccaagggaccgaggggccgagggagcgagaggccaagaggccauggggcugagugguugguucuccuggggcaaugaccccuucuguguccuggccccucaccuugcccugguggcuuaccaggcccagaauccgguggcaaauggcacugaacuuagaaguacgacucucuagcagaggaggaacauuaaauaccacagaacacggucucuauccagggacacaguccccucucuugcaaauuccacaggugacugcccagcucuuguacauccucaauagcaggggagugggggacccucccauugugcagccccucccagcucuacacagcucugaugaggagaaugcccuucugcaccaggguugggaaaagccuccccaugacacccuucucuacuccccaggaucccgcccuacucucuggguccacagaccugccugauccccuugucccugcauaacacugcagagacucgggacacugccugggaccccugcggcucuucugccgucuccucacugggcaggcuucgugccuccguagaaacaccccauaguaucucuguuccacucucagggcaggguccagagcugagcacaagccuggaagauucuaagcuggauugagcagcagcaagacugucacguucuucaucccaggcacaaccucaguuaacauggccacugguagcauuggccauccugcauuuauucacugggugugggggcuccaagugcacgcaagcugugugagcuuuucugugccugcuuggagccugcccaaggcccugauggaggcgggggcguguggggggacuugcucacccuugcaggaccucccguuggccgucaugguguagcccugcucagggcaugcacacugguagcucccuggcacguugagacagcggaaggugcagaggaugccggcgccuugagcacacucgucgaugucugucagagagagguucagccccuggugaaccucguccacccacagagcccagccacugacagucagccugucccugucacagccauagagcuuaggggcccauuuuuuaaaugaagacaaguggacugagagaguagaagagaguugcccaaggccacgaagcaaaacaggacucccacuccagugcuuaugcccuagggcugcuccgugacugcuacuaccagcugaggggacaaucagaugccagucaugggcaccuauguaaacuuaggucuucaucccccugaagucaggaccauucuucccauuuuacagaggaggaaccugaggucagaguggagaggcaaucugcccaaggucacacagccaggaaacugcagggcuggggcuugaacucagaucugaugcuaaaaccuuucuguguccauggcccagcagggacucucggggagccuggcacaagggaaaggagugacucucuggaagggggcccuuggacaggggagagguaccugugcaggugugcccauccucagccagcugguagcccuggcggcaguagcacugguaggagccauagauguuggcacacuccuggcugcagcgcugggccucacacucauucacgucugcagggacaccagcaggcagucauggcagggcccaagucugccuuggagagcccauccaaaugcugucugacagccaggcccaccaagcuccccggccuggacugggguugaccuaugcgagggccagcucuccugccaggccuggugacugggaagggauccauggccucccaggggucucagccaacucaccucaccaggagaaaaugaggaaauugccuccaggcuggggaggggcugggaaagaccgugccagguaaauggggccaagaccccauggccuucuggcuuggccccucgcccccucacugagcagccugguggccuuacuccacaccaguccccacugagcuggggccaacagcaccaugaacacacaugggaauaauguuacagccccucccucagccacaggcgcgucccgcacagguagguacacggaccuuggaugccucagauacccuauuuguggguacagaugacacagagacccagccucucuggacugagggagcuggagccccaggaccucagcaggggaauucagggcagaaaacaacagaaggaaggugagaguggaggccagagaggguugggccagacagaggaggaaggaagggccagcaugggugaaggugugagggugaagguguaagggugaagggucacagaaggcucugggccuuccacggcgggucugcccacuacagauaccaggcggcauagggucagagaugagggccagccuaccuucacagcgcuugccguccgcugcuagcaggaacccggaggcgcaggaacagcgguaggagccgaguguguucucacacgugugcuggcacaggcggccuggcgaggcccagcacucauucacgucugugggagggcaggcagcagguacaggguagguggcccuaaagccagcucccuccacccccaagggccauccagggccgaaggggaggcuaagugggagagggacccagaaggaaagacagggagaggccaggacagggaaagagagaggcaaagagaccagguggcggggaggcagcaaggguauuggaggaaggcgagaggaagaggccagagggacagacacaggcaaagcaacagacaagaagagauggugacagagaccgagggaagcaggaaagaccagaguaagaggggcagaggcacagagaugagacaggagggacugagaaggugggggcgggggccagagccagguccuggcaggcccagcaggaggaugaggccagcuggaaggcgaccuuguggacuccagcaggugggccccacucaggcaguggaggugcugggcauggggagguggagugcacagagggcaggggaccagccagguguuccccagggguccuggccaccagccuaccuaccgaugcagccccggccaaaggcaucccgcugaaagccggcuuugcagucacagcgguaggagccagggagguuguggcacacuuggcccucaccgcagcggugcacaccugucucacacucauucacgucuguggggggugagcaggguaccuugaggccuggggcucccuccacacacaccucccagggguggggaagcgggcaggccgggcuggcuggcagggcggaggcggcuggccuuacccacacacuuggucccaucaucgcuggcgugguagccgcgcgcgcagaucagcggguuccucuggcauguguaggagcccaccguguugaugcagcugaagccuggccgacauggcucggacagugacgugcacucguugaugucugcagaggcagguguaggugacagggagcccggcaugguguccucccaggccccagccccucccagggccacacugggagggggucgguccugggcuccagaccugcccuggucagaguugcagggccagacuguccuaccccugugccccacuacccaagggauacaccucccagaacccaagcaccugauggcuggcccuacgcccucucacaucugcccaacagagcagcuggaggcagggcgggaucgaggcugagugcuaggauaacuacaccaaccacgugccaggggucuagcugccagggaagcacagcacauuaacaagaaguuuuagaggcacagagacuaagcaaacccuuuuuuggaaggaguugauggggggcgcagagcggguagaaucucagacccacuuggggacuaggccggcaucuguaaaacuguuaagucucaacccucgaguacggcauggaaucacucuaggaggucucacuagcauucucugaaaaugggaaauuucagugggugucacaugcaguacuguguggggacacugguauugcaguucuuccuggauguguguagaugucugugccaggucaugaucuaucacauagccacugcugacugguuaaaaaaaagggauacucauucguauccaguccaaccccacagauagcuucacagaggccacugaauaauaacucagccaagguuucacagcucaagguaauaggagcagcuacacuuuggggacaguggugcccccaggguugaacacuugacaugcccauucacagguagggacaagggggcugggagaggaauggagcagcaagccaggccucccuggucucuaaagcccuaaaagcccccacaaugccuccaguagagcccuaggcugaugauccccagcccugcagcccccgcucacccacacaguugccuucaggauccugcaggaagccauccaugcagcgcugccuggccuggcaguagaaggagcccuugguguucuggcacaagaagcccggcuggcaggugugcgugcccaucgcacacucauccacgucugcagcggagaggcugggugucaagggcuggggggcagguccugccuuuacacucagcagcccugcccacacauccccgcccucagacccaugacccugauggccacaaagaucucccugggaagcuggcacagccacauuguugccggcauggccuuugucccaggaguaauaacaacgugaccauguuuacugcgcuucucuuuggucccaccauuguucugagcaccugagauggauuuauuuccuuaaaccccacacagccguaagaaguagaugucaugacaagccccaucuuacaaggagggaagcugaggcagagacaaggcucuacugcuggggagcacuggaccaggaccagaacccgggggacuggcucccaagccugcuuuguuagccgcugucccacacuugcagggggcggaaguggggauauccccaccgugugccuaaaucucuaagguaaggucauguguucacacuuuagggagguagcacagguagcaagaaggcuccaaccccggagacugucuuucuguuucuggaacaugccaagagugcuuccuccccacacccaacaggccuuggcacgcugcccccucugccugaacacccuccccaggagcuucucauucaggucucaacuccaacgucaccuccuccaggggccuccuugaacccaccacuuacaggggcccccagcccccagucacucugccaucucuguuugccuguguggaccccgcugccccaaccacaaggucagagaagggccacagcaccccacccuggaucccugguacccaggacccggcaggcacauaagagcagcucaggacguacuuguugaaaggguuggaugaaaccccucccucugauuagaaggcuagaauuuuccaguaaaagggacagagugaacccucugugggcuccaccucaauguacaaaccaggccacagcaagggggauaacuggcacccagacaccagcaggcaggagcaaagccgggguggaccuagccugcccucacccugccucagacucccaucuccgccccaaacaccaccauuguggggucuucccaccagcaggaaacccaacuaaggggagcuugcuagaaaggaggggauggagaggggcguggccaggccuaaggguggccagggcaggacaggggugggaccagggaggggcggggcaaaacuggccauggggcggggccuccaguugguccuucugggcccuucucaccuucgcacucgccauccuugagggcauagccuggcucacaggugagugccuuguagcaguggaaggagcccaguguguucacacagugcucgccccggcugcacgugugcagguccgucacacacucguugaugucugcagggagagcgaggccaucagaggcugcagaguccccaggacaguggcugagugcagccagcagaccuugggccaccaggagggagagagcuccaggcccugcccucagggagcucaccauucggagauguggcugaugucucggcacccaaacaucccuucauucaacaaagauuuauugagcaccugcuaugcaccaagcacuguucuuggcacuggguguacaucagugaccaagacagaaaucccugcccuuguggggcagacacucaaggggagaggacacaauaaauacauaaacaaacauaaauggagguggugaugagugcuauggauaaaacagagcaggacgcaggagacagggagugcccagguacagcggggggcgcugggcgggaugggucagggauggauucucagaaaagaagacaucugagcaaagaugugacaagaugacagacugggccaugcagacaguccaggcagaggcgucagggauguaaaggcccugagaaggaagccagcugugcagguucaagggcccaccaggaggugggugugcugcaggggagggaagggagaaagagggugagcaggaggaauggagggagccauagagaguuccaagcagaagagaaaguggucuuauuuauuuggagcaaggaucccuggcaggggcuggagaauaggggugaggauccaggcaggagauucaguggcucggacuaccuucaaugggcugggagaaguggcuagauucugaaguauugugaagcuggaaccaacaaaacccacugauggaugagaugaaggugaggcaggaagaggggcccagagcuucuggccaagcagcuggacagguggcagugagggccggcugugagguguaggcugcaggggaaggugggagcccugcuggccaugagaguuugagggugaagaggcagcugaggacaugccuuggaguucacacaaggggucugagugggaauacuaacuugagaauggucagauggcugaggccacccaggggagagaucacacggagaggaggccaaggaccagcuccugggagauuccagggauaagcaguuggggagaggagaagccagugaaggagagagaggacgcauaagggagguggggagccacagaggcucagaaacuguccccgggccacagaggccaccaacucagaaaccacccccaggccacagaggccaccaacucagaaaccacccccgggccacagaggccaccaacucagaaacugccccagggccacagaggccaccaacucagaaaccacccccgggccacagaggccaccaacucagaaaccaccccaggccacagaggccaccaacucagaaacugccccggggccacagaggccaccaacucagaaacugcccuggggccacagaggccaccaacucagaaaccacccccgggccacaguggccacagaagccaccaacucaggaacugcccaggggccacagaggccaccaacucagaaaccgccccaaggccagcgcuaagccaguguggaaggcugacccaucuacccccuccuggugcugcaccuuguggcggcggucaggugcacuaguccccugcuuauccauccauuccacacacauaacucugugcuaggcuccugugaccaagugggugugucggccccagccccggcccucaaggacaggcagguggaggcuugggggcucuggccagagaacugccugcuguggucuggaccaucagagccacuucucaggaguggugacauucgagcugagucuacaaggaugacuagaggaccagguggagagguggaggccaaggcccuggggaaagagacccucccaaacucacaggugaaccaaacaguguccaggccaggcagacccggggauggcugggaauggggaggagggaaagggaaaguucugggccagugguuuccaaggaaggcuuggcugggcaagauaaagauuucugauuuacaggcuggacuuacagagggagaccauucccaggaccccagaaaugcccauaacccaagagccucccacagccuggaggaauuaugguaacaacagcagcaccaugagcggaggcucaccagggucaggugguuuagaggacaucguucugcaagccccauuucucagaggaggaaaucagccucccgguagugcugugacuggaccagagucacacggacagccauguggcagaucaagaacggaagccagagugcccggcccagagcuguacccuuguacccaucauucaagcacugcugcagcaccacuucauggggggcucagagcuggggggcugccucccucacaucuugcagccuggaccaccugcaacacuuuucccugugcccaagacagucuucaaaguacagaccacaaaaggcaaaugguaaacacaggggaguccuuggcacaggucacacccaauacugucccacuuugauuuacauaccuccagugauggggagcuuacuaccucugcagguugccucagugaaacauugguugaaucauaacaaugaugucacaagaguagcaacuucuuuaaauggacuaauucauuuaauccccacaaugacucuuugagguaggugcuguuaucucauucacagaugaggaaacugaggcucagagaguuuaaccaacugguuuaaggucuuaugauuaaaaauugaaagagccaggauuucagcacaggcaggcaggcuggcugcaaaggccacacucuugauccuagcauaagccucgcaucucaccugccuggguuaauaaacaagugcagagcaaacaaaugaacugcaggagagcccaguggacauuuguggacguacaaaugacggaaagaacgcgcggcagguacuaacacgacgggaugaacacgugugcgaggggcauggaaggaugaagaggugcugacggguuuguacaggaugaacaaggagggaaagaaagaaaggaaugcaugugagcucaucaauuuugcugaauggaaugugcccuugcucuuucauucccagaacccacuuugcagcugccuggggaucccuuuuaguauguuuuaucuccaggcagcuagacaagccugcguacucaggcaccgcgagagggcagggcaucaugggaggggugcucgugggcccuggugggauccgccuucccagacguacacacacggacccaacccagacaggaagagcuggccggcugcuggcaagcagggucaggaggcgcauguugugccaacggcuagaggccuagggcaaacaugucugcagcaggcauucagcccagcaccaugggcccgugugcccaguggugaaaggcgaggaaggaaggggauauguccaggcuggacaugguccccaagcacagagaagacaaacggggcucuggucacaugcccugaacgcacuagguucugauccuacuucuauaccuuuauuugagcuguuccuucuacgcugcaugcccuuacugauuuccaaaugcuaacccgaugccaccagcuggaaugaccucgcccucugcgcgugucucugugauggcauuuaccaccgucugcccugagucccagcuacuuugggucuaucuccguuugggaccacaaacuggaggacacaaggguuuacaguucucugaaaacaucagaggcugcagacauguacgcacagagcacucccagagccacggcgccuggcccacauggggccuaagagaggagaaggaagaggcaucacugagcaccaacccgggcgaugugcaggccaggugccggguaugagcccucacccaguccucuggccccacggucagaggggaggaaaggcaggcucagagaggagagcuccgcugcucaaggucacauagcaaaggaacgccaagcugguaugcgaggcgggcucugcuggaccccauccuccauccaccagcucugcgggggacccuggggaaggcacguagcuguuguagcaugcucacggugcccaggcucugugcuaccccacauacaugucacacaaucgucaaaagaggaucaacagccuccuuacuacagaugagaaaaccacagcugggggaagacgagucauucauccaaggccacggagcuucuggggguccugcuuggcuaggccuccugccuccagaccccacacauccuauccugcucccagcaugucugacccccucauuuuccugcagcccagguggggucccugauccaccaggccacacauccaguucccugacacauagacacgucccuggggaaagcagccuccggguggagcuggcagccaagcgggacaagacgccaggacacaagggcacgacauagagcacggagaugccggcugugcugagagcucacaugcaaagggcaggcccuuuggcauguggccacaguguggugggcuuggcguggagcagagcggagagcugugacggcgggcggcaggcggggcccuggcuuacccacgcacuuccugugcgcauugaggauauagccaucggcacagagcacugugugguugacacaguagaaggaucccaggguguucacacagaacugucgccggcuacaaucgugagcacccaucaggcacucgucuuggucuaguggcagccgcaggaggaaaaacagaaggacuguuagagggacaugggcugccacggagcauccagugacaggagaaugagacccagcaaggggcaggggccugucuggggccuccccgccugacuguguguagcugggccuugggcccaagugugagugugcagagcugguccccacugccccaguaaggacgguggugaggugagacucagagaggguggguggcugcccacggucacaguggggacaggaccagaggcugccucccguacgcacucgauacuucccacauccacgggcgccaagagaaccaugcccccgagagcuugcaaaguccaguacuuaggggaccaggccagccacauaaaccagggaagggcccacaggggcuccaggacacugagugucugugcuccauccaaaaggggacaggggugugggccccuuguaugcagauuucacaccaagagaaaccuaaaaucuggaaguguuuuaaucauucuugugcucaacacguuuggaacucacuugauuauuuccaaugcagcagaguugagcagcgcuccuccgcagagcaggugccucucugaaugcccauugcaaccuggaccccagcuuucacugccagggcuuccagaggagggaggggguccuggggaugcgcagacaugggcuaggcugcaugagcagcacaggcagaggggccucacagggcugggcccaaaggaggccugccccagaaaagaugcagcucuuacaucuucagggcccugggagauggggggcggggcccagagaacccagcaccaccuggaccugagagcugcccccagcaucggagaggaaggccugccggucacugccacgucauguacccugggcaagucuacuguccucucugggcucguaggacgguguuuguccacaucagaacagucucggcuggggauggacacgggcuuucagcuucugggagggauguggguauucacccaggcagacuugacucuguucucccccagacacccaccagggucucaucucugagccagaacugccauacuuccuagacucugcauacuccauuucuguccugcccccaggcaggagguagagucuugagaccucucagcuugguucuucagaagccauucacugugggaaccaacccagcaggugcuggauccaauggccucauuuuacagugggggguccuggcccacagaggccccacaaagacaagacccagaccuaggcggggccacggggguggaagguaugugauccuuggacagcuaaucaucaccaguguccuucauuugggaacagauucagccaggcauuccugcuguccagccucccucccacuccccaucggggacacuucuggcugcccuuaaaacaaccggcauugcuuccccuucccccucuccacccaggccuggacauggcugcacagaccagggcaacccucaagggcaaggugaguggaggugguguccgcggaccagcagcauccguaucaccuuguuagaagcacaaauucucaggcccacccacccagaccuauugacucgaucuuuggggauucggcagaaucucaggacugccuguuugacccaggccuccagggacucaggugcacacucggcaggagaagcacugcuccgggaaaugcggagcgacaccaugugaggagcccgggccccauuccuaugcagccacacugcaggcccacccuggagugcauguauacaccgcacguacggugagagggagugacuguuuaaccugcuccacuaggggugcucaucauagcagccaagacucuuccugcacaaacucagcaaguuuuaagucucagccacccccaccuggaggcccccaucacaggccaacucagguuugcacagguaggagggcaccccaaggcacucaccuucacaggacacgccauccgccaugauggcauagccgggaaaacaggagcauauggcugagcccccaacagugcugcacaccugcuugcaggguccauugucuggaggaaaccacacagaaaucagagaccaccaggcccuggccuugguccacacuggcucauuccccaucccuggcucuaaccuacuagugagacacagaaacaaggccccuagaaggcagggaugcugggagacaaggaacgccacuccugguccuuuucacagguucauccauuaagucugcuccaacaccgucuggcgucggggacgacguucugggucuaccucccccaccacucggaucccagcccaugccuugcgugacagcaagaacaauggggagauggaggagaagagagaaggaagaagagaaagggaagggggcagggaaaaaagcaggggaagggaaugaggagaagaacaacaaagaagaggacuuucuacacagcgcugaacacagccuccacaacaggucggcaaaccaggauuugacuaccucaacguuacaagaauggagacaaaaagcagcuaacuggcugguuuggggucacacaccaggcccuaggcuguccccacaccacaucuccccagugacuuccucagcuccucacucagcccaggguaagcccaucauccccaaaacagaagcacacccuuuggaggggccaucuugcacauacccagcaccagacagcucaccaccugcaagcagcccagacccacccccuggacccugggcccuguccuggagacaccacccacacugcuuaccuuugcagguauugggcugcggcaguggcagcgggaugguguuagaggccaccugggaaaauucugacuucagugcaggcuccuguggggcuuccggcuguggagggugacccucugucauggguagagcagaguggggguugcagggaggucucaggucuucagccaggccucaggcacuuccaggcaccugcccuucucacacagggcacugacauuuaaucccccaccccauuucacaggagaggaaaaugagguuuggagugugcauauaccuugggaaagaucaaucucagcuacugggggcagaggggguagaaggaaaggaggcaaggaagaagagaggggggaaaggaaaaagagugucuggauuaaaaaccaaucaauucugggaccagugacugggaggaaaucccucaggaucaccaugggcccagcacuggggagauagcuggguuuuggugagagccucuguggccugagccugucccugcgcucgaauaugggacaaggugcuggggccaggucccugcagauggagccccaggaagaaagcuucuauuuuuccugccucacaaaucccccaucacuggaagcuucaggcuucuguggguuccaacuugugggguaacaggaagugaaggaccccacagugugcaccccaggaaugccacacccccuggcaagaucagcccuucccauagccccugcccuggccaucagggcccuuaccugggcggcaagugcggccaucguccugcagugagaagccaggaaagcaggcacagugguaagaacccacaguauugaugcaaaggugcuggcacagcucucccgggaggagaaggcacucauccuggucaucgcccggcaggcuguucggcagcucggccucugugcccagugacagggccucucggcccgccaucucugccucugaaacuaggacagggguuagagcucaagacagagccagcuuggucagaguagguggcugagacaaccagcuuugggaaacuagugcagguccucaucaagaccucugugugcccagcagacagcaaggauggaugaagcaggauggauggauggguggguggguggauggguggauagauggauggauagaugggugggugggcagguaaauagauagacggauggguauagauggauggguagauggauggguggauggaugggugagugaguggauggguggguggauggguagauggauggguggguggauggguaggugaaugaaugggugggggggugggggggguggaugaauggauggauggauggauggauggauggauggaugguuagauggauggguggguggauggguggguagaugggugggugaaugaauggguggguggauggguggauggauggauggauggauggauggauggauggauggauggguggauggguuguaacuggauggguggaugaaugaaggaggauggauggguagauggaaggauggguggauagauggauacauggguagacggaugaaugaguauuuggcugaauggauggauggguggguggauggauagauggauggguagaugaauggaugaguagauggauagauggaugggugaguggguggauggguggaugagugaauggaaggauggguagguggauggauacgugaauggauggaugaauggguguggggcugaauggauggaugaauggguagaugaaagaguggaugaguggauggguagauggauggguggacagacagaugaacagacggauggauggacugguagguagguagauggauggauggauggauggauagauggauggauggauggauggauggauggauggauugaugaauggaugggcaaaugaaugaacagaccucaagcaguaagaaugaacccaucagagccagguccaagucuucaucacugaguccucuacaauaggacagggucagauccacaaagaagcucucacuaaaguguuacaauggauucagaccccugaccucagugacaucaaggaggaucauccuuagcagcagaaagggcuccaaaucugggcucuauuggaucagaugugaccacugaccugggccuucccuagcugggucaacuugggcagcacuaggccucucugugccuccagauucuggaauaaacccaucucccaggguugugcuggggagcaggugagaguggaaaagaaggcuccugaggcugagcugccuugggaagcucuuuguaugacaacuguggggaaagcaugcagccaggacuucagggggaggccuacagccccucuaagcucugugccagcccagggccuccuucccaccccacccaggcagcagagcccacagagagaguagcugcaugaagucacguaugaggaacguguuucauauggaggguguuuacauuaagcugcagcccaaucagucccagccggugccuccaggcagggccaugauggcuggcggucuggucccgcagagacucagcacugcaggcaggcggcggacagaccuggacccagggcuccuccuagcacaccacaggcuagacaguaccuccaggauucaggcucagcucacccucaccagcaucuuccucacaggaggaagcauggaucucuggccaggaucgugccuggcucuguugcccaccuacucccuuccacccaccugccuuugacuuuugaagccggacuuccucccaaacucuaccuucagccagacucuucuggguacuaaccuggccuucacaccaguacucaaccauuccccuuagagccaaucucagcaaguagcacuuccuuggacuggacuuacucucuguacccacauuggauuggcaagggugguugguacaucuguucugguugaucugcccaggucuggccugguccaacccccacacacucaccccugccucugccucacccugaugggagauccagguaucuguucucccaccuguaccacacaggauaugagcucuuccuguaggaucuccugagcccuggcaccuguggacagcaggcaucuuaaccccuaugcacagacuucugccaucuugcauuauagugacagagaucugggucaaucggaaccaaggcugacugggucuagauaaaacucagggcaucaggaaggcuggggcagaagugggagucauuagagccaagguguccaguccuggcugugccaaagacccggcaugugccuggggcaagauccugcccuucucugggccucaucuucccccucugagcugcugaagcacggcaacgguaacagcaacagugguggcaaugcugaaugcaucacuaggcacugccaaaagcccuugacaggcauccuaucauucauccuugcacugaacaagguaaagaauacaagaccauuugacagaugccacagugaaggcucugagaaggagccuuccuucugugugaccugccccagguaagcaaaggaacuaggauuccaaccaagucugccugacuccagaggccaagaguuuaaucuugauaccaggaccucaucuguggcuuuaauucccacuccaugaagugcccaggacaaauccacaggggccccagaugacgguccauaggaacagcgaaaaaacugggcuggugguucuggaaccuaccuggacaucugguccccaaccaguugaggcugaacauguggacaccaacaaagcaggccugccaggacucucacggcaccagccccagggccaccaaggcccauguacaaaaaggacaucugcugacucacuggggcacccucaucaggcuccugcagacccaccaggcacagaggaggcuaauggucauggguccaggagacagcccuggcuaggggacagggacuggacauggcagcuggaacaguggcuacagcacaagaagggaagaagaagggggugacaccaaggacaacgaggauggaugcauggauggauggauggauggauggauggauggauggauggauggauggauaagcagauggaugaacagacggauggguggguggauggauggauggauggauggauggauggauggauggauagaugaauagaugaucagacagauggauagauggacagauggacagaugaaugaaugaauggauggguagguagauggauaaauggauggauggaugagggauggauggauggauggauaaacaaacggauggaugaguggauaguggauagguagauagauacauggaugaaugaauggauggauagauggaugggugggugagugaauggguggauggguggguagguggauggauggauggauggauggauggauggauggauaauuggguggguagguggguggauggguggauggauggauggauggauggauggauggacagaugaugggauagaggaugaaugagggagugaaugaaugaauggauggagagauggacaagaggaugggaggaugggugggagacaagugcaauggauggaaaaagagcaaacugauaaguggguagggaggaagauguauagacaaaguagacagggaggaagauguauagacaaagagaggggaggguggugaguggacagugaaagggugaugggugguaguuggugguuaaguugguggaguggguaguccacagaaaacaaugaaaucaccauccucagaacucuguuuagagcagaacuugugucucaagccacaggugaugauggacccaggguccccacagaaggccagaggucaaccagccuucgcccuauaugccgcagccagggaagagcagcacucaccucuccguggugcagcugcgggcucuggaggucggcgaaccucagguacuaugagaggcucuucacccucacagcaggagagcaugacaugauugcagggauagcccagguuaggauuggacucacacgacuggcccucggcccgcacgcggaggcccaggccacagcagucacagcauugcugcagggagagacaguuaucacugcccaaucucuggccccagccuggagcuaggcucaggggagggacugauaaauggagaugaauucaccauuaucuuaucuccucugccagacuaugcgcucucccagggcagagggguccucugccucuauuucccaagucuggcacagguaggacuaauguaagucuuuugaaacagauaacaaguaaauggccuuuaguugaaggaacuauaaccccccagccacacucauuauccccucauguuuacuagcaaaccccaauucuauucaagucaguuaaaagauggcauuucccaggggccuuugcaguuagauucacucagcggagccuucaggagggcuuuaaacuggggaugacucuacuugaaucaaguacaucguuuuugcucccccucuuucuccuucuuggagcacauaugugauggcuggagcuuuagcagccaacuugggccaugaagugacccugaagauggaagcuacaaguuaaagauaauuaaacauaaaaauagaagacuagguuccuaaagauguagaucuacgcuagcccaggcugcuuuucuucaaaaauaaauugguuuuauuuauuuuaaaauacaguaguauuuugguugcaauaacggcaacaauuauucaaucuuuucuguguucacugucuuugcaaugugauauugcagcugcuucuauuaagagaaaguguguauuucccaaccucuugguugugccuucugucuugcuuuggccaauagaaugagauacacaugauggugugccaguucuuagccuaggccucaaaagaccuugaaugcuucuauuuauuuucuuggaacucugcacaucauaacugaacaggcccaugcuagccugcuggggguugagacacugcagggagcagaaacaagucaucccagccaaggccauccuaggucaucuagcuccaguggagccgucagcugacagcagccacauaagcaagcacucacccccgcccccaggaucagcugagcguggcucaggucagcagaaguacucagcugaccacaaauucaugcauuaagccagcaacaggccacuagguuuuggaugguauguuacccagcaacagcuaacugauacucuauucuugcaucucucaguguugaacacuucccacuaaugaaggcccaucacauacuuaacacuuaguuugcauuaucucugauccccacaaccacccaaaaagacauggauuauuauccucauuuuauagauagaaaagcugaggcuaagaaaagagaacuggccgggcaugguggcucaugccuguaaucccagcacuuugggaggccgagguggguggaucacgaggucaggagaucgagaccauccuggcuaaaacagugaaaccccgucucuacuaaaaauacaaaaaaaucagccgggcgugguggcgggcaccuguagucccaccuacucgggaggcugaggcaggagaauggcaugaaccugggaggcggagcuugcagugagcugagauggcaucacugcacuccagccugggugacagagcgagacuccgucaagaaagaaagacagacagacagacagagagacagacagacagaaagaaaaagaaagaaaagaaagaaagaaagaaagaaagaaagaaagaaagaaagaaagaaaggaaaauaaaagaaaagaaaaggaaaauaaaagaaaaaagaaaagaaaagagaacuaguccagggucaaacauaaagacagaaaaggggauucuaaacguuucuagacccugucaacaggguccucucacuaauacuaguuguuuuaaggaaaaaauugaccccaagaugaccaaaauugaagucaaaauccucucccaaaugccagaaccauccagcggucucugucaccaucacccaggcuugagaccuugggcuucuucaauucccucucccgcuccucagucaggaugaggucccuucuggaagguuuccugaaacugugccacugucauaguuugcccucaccucugcuguagacagccagcuauccaucccaaugucuguuucccuuuuuucucauguucacuggggcaccugaccucccagaauaaagacacuacauucccuagucuuccuugcagcuagauguagccaggagaugaagcuccagccaaugaaaucuaagcagaacuacagucugcccucaaaaaagggagcucuucuucugcucauguucacagcagcauuacuauucgcaauagccaaaagguggaagcaacccaaguguccaucgaugaauggacagauacagaaaauguggucuguccacacaauggaauauuauugcaccucagaaaggaaggaaacacuuacauuugcuacacauggcauggaugaaccuugaagacauuaugcuaagugaaauaagccagacacaaaagaucaaacacuguauaauuccacuuacaugaguucccuagaggagucaaacccacagagacagaaagcggaauggugguuaccaggagcuacagggagagggaaugggaguuaguguuuaaugggaacaguuucagcuugagaagauaagaaaguuccuugggugcuugguggugacggcugcgcaacagugugaaugugcuucaugccacugagcugugcgcuuacaaaugguucagacgaucaauuuuacaucauguguauuucaccaugaucaaaacuaauuucagcuggacgcaguggcucaugccuguaaucccagcacuuugggaggccaagguggguagaucauuugaggucaggaguucgagaccaaccuggccaauguggugaaaccccaucucuaguaaaaauacaaaaccaagcaugguggcguaugcucuacuaaaaacacaaaaaaauuagcugggcguaguggcaggugccuguaaucccagcuacucgggaggcugaggcaggagaauugcuugaacccgggagguggaguugcagugagacgagaucguaccacugcacuccagccugggugacagagacucugucucaaaauaauaauaauaauaauaauaauaauaauuuaaaacaagggggcucuccugccccuuucuggaguucauccuggaccaagagguggcaaaugagagcuggcagggcaagaccacuaugccugugccccauuccugaugaccauggagccucucacuccucuaacucagcccugccuuccuccagccugcagcauaugagagaaaaaccaguguuccaggaaguuuuccauuacuuguagccaaacugacacccuguccgccaguggccaccaugagcucuaguagacaaacugaucuccugcugcaaaucccucccacggcuuuacagacacugcuugaagccgaaagcucucagcauuuacuguccuuuaugguccagccugaggacucccgguggccugucucuacugcugccagaccacuggaccacacaccccauuucccaacguccucgccuguguguuaguucacacuguucucugcaccacuguugccuggugggguuuuaccccaucccaaucccaccucccaugugagagaaacacccucaauaaccgguccccacaacugccagaagagacccucaaacuccccaugggguccaccucacccacagucaaaccacaguccuuccgaugauggccaggagcccugacaucucucugggcucagcuccaccugcccccugucacucgaugcacuccagccacacagccuagacaugccaagcaggcucugaccccagggccuuugcaugugcugcacucugccugaaagcauuucacagacaucccccaccccgggcauugcacaaauguccccuccucagugaggcugucccuggccacugucagcugauacugcagucccuccccagcccugacacuacuuaucccaccucuccuuaaguuuuucuccuuagcacaaucgccugcaaccacgccaggugcuaaaauauucaucgugaucuuccucugucuuccuggccagaaagaaaucccugggagggcgggaauugccaucuguguuacucacugcuacaucccugaugcccagggcacacaguggugcucuacaaauauucugugaauuaauuggucaguauaauaacugaugauguuuucugcgcagauuaagaguccuuccaccccaggcgugagggucacucccaggaggagccccaaggacagccuaacuucuugggccacgaggaccuucaggcccaggccagccucccgccccgccccaccccacccugccuugaaggccacaggucaggcuugccuuguacagggagaugccgcagcugucguuguccucagccccacaggucucacccuccuuggcucccaggacgccggccaugcagcucuucuccugcaaguaggagacacagcagugccucugggcuguccugaaacagaggggguaacuuagcccccagucgcccaccucauccucccagaguggaaagugagugaggcucagaggagggaagcucugcccaagguccacagcaagggagccggugcagguggcagagccggcacaaccuccacuggguugcauggguuucauuucuuggcuuaaccaugcagaugcaggccugggucccacuagacucggagauguguguucaugaccucugagagagagggguuggcaucagaguccccacccccacaacggucggggaggacagagagaccuaaucccagaaaaggcuggcaggucagccuggaggagcacagccuccgggucccuggucacugccugccagucacuguugggcugccuggggcagagguggcugacaaaucagcugcagagaccagagccaggacagggcggcggggauuacgggggacagggcucagcacccccugaagugggacacguccacaagacggaugcaagcaugcacuaggaccgcuuagccccaaacuccaggggucccagugcugcaugcucuaacuccuaaguugccccauauugguagaauggcugaagggaaagacaagguuagaacauaaauuuuuuuuauaggaagcagaguggucuggacauugggaaacauggggucuaaucccagccaugcugccagugagcuguguaguuuugagugaaucacacugccucucugaacuuaaucuuucuuauuuggaaaaaugaguagguuagacggggucccuggaaaaaaacaaagcaugagcagcugaccaagagcucuccugggccuggaaaagggaaggcauggggauaaaggauugcuuugcugugguaucagagucagaagaaacaaccagcacagcagcaagggagcacagugagaggccagccuccugaagacccaaggguagcaaagcagagaaaggaagagggcagaggagagaaagccugaguggcaugagugcggcagcaacugcagaauguggugaggggagcacccgacuauuccuaggggacagcacuccuuuaaaacuuguuucaaauuguacauuccucggaucuugcucacuaggccagcuaccaauuuauguggcugguuuguuccuaggaccagucuuggacuuuccaccccuggagaaagccuggccagauggcgcacggcagccacacccaaucacccucaugccccagaggcaugugaaggugcacucucuccgggcugccuggagccugggguccuaggcaagcaggguucuggagaaggcaaaugggcagcuccgccugcuccagggagcccacccuaccugcagacguuguccucagugccacucucagggaucuccaggcacucgucauugucaauggcccacugcuguccggcugcgcagcaagucucgaucagguccuugguggagccuguggauagcaacaugaggcagagucaccauucauaagucaccaaguccagcagauaugcaggggccuguccaggucuccuuuacugggcaggcaaacucauccaccccugcugcugugcaugcuggucgcuaacagcucacaacacaacugucuuuggugaacugucugcgagguggaguccucccuaugggggcugggaggagcccagcccauaacagguuaacauggggccagagcucagcccccacucucaaagcagccaguucuaugggggccacucacacucuagagcucccacagggucagaccucacgugggccacagcuuuguccaccucucaucccucacuccucagaguuucuccugagaggucuccccaaaugaaccaacacaugcacaagaccccccaacucaggcucugcuucuaaggaacccaaccuaagaugcuaagacagggcaagagauacgaaaacagcagcaguggcagcaagggaaguuuaagcucauccaggaaauucacggaaguuuuauguugaauacacacuugaccccuggaacaacacagcaguuucuuccaccucugcaaccccuaagacagcaagaccagccccuccuccuccucccccuccuaagccuacucagccugaagacagugaggaugaagaccuuuaugaugguccacuuccacugcaugaauaguaaacauauuuucucuuacgauuuucuuaauaacauuuuuuuuucucaagcuuacuuuaagaauacagaauauaggcugggugcgguggcucaugccuguuaucccagcacuuugagaggcugaggcgggcagaucacgaggucaggaguucaagaccagccuggccaacagggugaaacccugucucuacuaaaaauacaaaaauuagccaggcacgguggcaggcaccuguaaucccagcuacucaggaggcugaggcaggagaauugcucgaaccugggaggcagagguuguagugagccgagauugugccacugcacuccagccugggugacagagcaagacuccgucccggggaaaaaacaaacaaacaaacaacaacaagaaaagaauacagaauauagucagccgggcacgguggcucaugccuguaaucccagcacuuugggaggccuaggcaggaggaucaccugaguucaggaguuugagaccagccugaccaacauggagaaacuccgucucuacuaaaaauacaaaaaaucagccaggcaugguggcgcaugccuguaaacccagcuacucgggaggcugaggcaggagaaucacuggaaccugggaggcggagguuguggugagcugagaucauuccacugcucuucagccugggcaauaagagugaaacuccaucucaaaaaaaaaauacaguauauaauauauauaacauauaaaauauguguuaauugacuauuugugcuaucaguaaggcuuccugucaacagucagcuauuaguuaaguuuuugaggagucaaaaguuacauguggauucuugacuguuagucgggucagcaccccucacuccugaguuguucaagguucaacuguauuugugacuggggaggcuggaaggagucaaagguaggggagaaugucuuaaaacucaaaggcacaggcuauagguuacaaaaauuaaugaauuugauuaccucaaaauuccaauauguauaacaaagaacuccauguacacauauaauagacugcugacauauuaagaaauguuucuggaauguccaaaacugacaaggaauugccaucuacaaaacauaauaaacuccugaaaauuaacaagagaaaaaagaacuccaaaguaaaauacuccuuaggccagauguggugguucacgccuguaucccagcauuuugggaggcuaagguggguucaucacuugagcucaggaguucgagaccagccuggacaacauggcgaaucuccaacuccacaaaaaguuagccuagcuacucgggaagcuggggugggaggauggcuugagcccagggauggggagggggguuggagguugcagugagcugagauggagccacugcacuccagccugggugacagaaugagacucugucucaaaaaauaauaauaaaauauccauuaaacuagaaauaugaguaagagugagaaaugccacacagagguggggacccccuuuucucccuuagugcuguauuccucuacacugcugcauguccaugugucuagggugggagaggagacugcggccagcuggagagauguggcaccacuuauacaguuaagcacacgcaacaucaaggacccagacgcucugcuccuggugucugugccagggaaguccucacgacagcccguaacacaaccaguacaaggaugcccaugucaaguguuauuuguggaaagggguugcggacagccuggguguccaucacugggggggaggaugaggaaaaucuggggccaugcuacaugcaggagcugucagaaacaauagacuggauacacacacagcagcaugagcuggacacaccaacacacagaaguguggaggaacacagcacuaagggagaaaaggaagaagccaaaucaguucuacuauacaaauuuaaacuaucacacauaaaauaacaaugcauacuuugcaagaacacaugacagcaaaaaacacacugaugagaugaaacugucagcuaugcagauggaggugguggaugggaauggagaaagaagaugaaaggaaauaaaauauuaauaaauaaauaaaacaagagccuugcaaagaggauaauaagagccaugccaagaaaugagacguguaauuaacccaagcguuugccccugaggucuaaagugacauuccuaagucaaguuuauacagaaugccuagacauucgugcugagggcaacaaguaacagaugagugccucugagccugaugggccuggguccacaucucagcguuaccacugacagccgcuucuccucccuccagacucaguguccuucucuguaugaggacugaauggcuguguaggugcuaaggcccacaaagcccucuaaauguccugagcaguucacguaagggcacagggcugagggauagaugccgugaaggacggcaccugcacacuccaaccggagcaagagcucacugagggucaucggcugcguugccuuagcaggcacggcaaguuaccaagcuuuccuaaguuuucauuccuuuucuguaaaacagggaaaacagcuuccaucacaaccuguuacuguucugcucugaggcacugagaggaaugagaacuggugucuaccagaagcacauagcaaacaucauacucaaugggggaacauuagacacaucccccacugaauuauuaaauauuacaaaaauaaugcccacgggccaugcuacuauauagcauuguccuggagauacuagcaaaugcaguaaaacaagaaaaaaggaggccggcucagaaauaauaccacacaucuacaaccaucugaucuuugacaaaccugacaaaaacaagaaaugggaaaacgauucccuauuuaauaaacggugcugggaaaacuggcuagccauauguagaaagcugaaacuggaucccuuccuuacaccuuacacaaaaauuaauucaagauggauuaaagacuuaaauguuagaccuaaaaccauaaaaacccuagaagaaaaccuaggcaauaccauucaggacauaggcaugggcaaggacuucaugucuaaaacaccaaaagcaaggguaacaaaagccaaaauugacaaaugggaucuaauuaaacuaaagagcuucugcacagcaaaagaaacuaccaucagagugaacagggaaccuacagaaugggagaaaauuuuugcaaucuacccaucugacaaagggcuaauauccagaaucuacaaagaacuuaaauuuacaagaaaaaaucaaacaaccccaucaaaaagugggcgaaggauaugaacagacacuucucaaaagaagacauuuaugcagccaacagacacaugaaaaaaugcucaucaucacuggccaucagagaaaugcaaaucaaaaccacaaugaaauaccaucucacaccagucagaauggugaucauuaaaaagucaggaaacaacaggugcuggagaggauguggagaaauaggaacgcuuuuacacuguuggugggacuguaaacuaguucaaccauuguggaagacaguauggcgauugcucagggaucuagaacuagaaauaccauuugacccagccaucccauuacuggguauauacccaaaggauuauaaaucaugcugcuauaaagacacaugcacacguauauuuacugcagcacuauucacaauagcaaagacuuggaaccaacccaaacguccaucaaugauagacuggauuaagaaaauguggcacauauacaccagggacuacuaugcagccauaaaaaaggaugaguucauguccuuuguagggacauggaugaagcuggaaaccaucauucugagcaaauuauugcaaggacagaaaaccaacacugcauguucucacucauaggugggaauugaacaaugagcacacuuggacacaggauggggaacaucacacacuggggccugucgugggguggggggaggggggaaggauagcauuaggagaaauaccuaauguaaaugacaaguuaacaggugcagcacaccaacauggcacauguauacauauguaacaaaccugcacauuaugcacauguacccuagaacuuaaaguauaauuaaaaaaaaaaaaacuuaaaaaaaaagaaagaaaaaaggaggccaggcguaguggcucacaccuguaaucccagcacuuugagaggcugaggaaugcggaucacgaggucaggaguucaagaccagccuagccaacauaaugaaaccucgucucugcuaaaaauacaaaaaaauuagccaggcuugguggcgcgcaccuguaaucccagcuacuugggaggcugagggacaaaaauugcuugaacccaggaggcggagguugcagugagccaagaucgcaccacugcacuccagccugggcgacagagcaagacucgucuuggggaaaaaaaaaaagaaagaaagaaagaaaaaagggccaaagaaauaauagaaagaagaaacaacagucguuauuggcagauguuaugguuucaucuuccuagacaauccaagagacucaaaacucacaaaguauuagaauuaauacaauuaacaauaaugacuauaauacaauagccaaaaacaaaaacaacacacucaaauuaguggcuuuccuauacccccauaacaauuaaauagaaaaguuaauaggaaaaaauucccauucaaaagagaaacaaaccuagaaauaaaucuacagugaacaugcuugauucacaugaagacgaaaauuugauugucuaauggguauaacauacacuuuauucaaaauacauaccauguaucuaauauguaccuuaaagaugucaauucuccucuacuuacucuacaacuucaaugcgauuccaaccaaagcaaaguguaacugucacagaauuugucguguuaauucuaaaauucauccaaaaaacgaaaugcuuaagaauacccgagaacauuucugaaaaauaagaacagagaagguagacuuucucuaacgguaucagaauacacuucaaaguucuaauaauuaaaacaagaagacaaggcgcucaauggaagagaaaagacuucagaaacagaccuaugugcauacgggaauugaauauaugaugaagguggcauucaaacuuugcagggaaagaauuuaugaugcugggacccacaucacaccauacacgaaaguaacuuccaaaucuauaaaggcaggauuagaauaaaauuuacagagauaauuuuagaaaaaagagaaucuucuucagaaauaaaauccauagccuguaaucccagaacucugggaggcugaagcaggaggaucacuugaggccaguaguuugagaccagccugagaaacauagugugacugucucuuaaaaagaaaaaauuuaaccaggcauggugguacaugccugcauuuccagcuauucaggagccugaggggaagggauugcuugagcccaggagauggaggcuucagugagccaugcuugugccacugcacuucaacuugggugacaaagaccuugucucaaagaaacaaauaaauaacccucucacagcagucagcacugugagagccucuuguggaugaguuuacuuucucaguccucuguuuccuccuuugcaaugucagcucccagaggguagggucucuuaucuaucuuccucauagccauaucucagcccccuggcacaugguggguguucaaugaguauuugcugaaugaaucuaggagacccugggcaacugagaggugcugugucggaggccgggaucagugcucaccaucugaauggaacauggcucagacaugucugucccaggacucaggagcacaaggugccaggcagaguccugccuccaccucccaggaugccagaguccugacuucagucucuguggucacugagagugacgccaccauucaaugucucguccccucuuguuacacucugggcaugugggagacucuccuuauuugaauacuucuggugacaggaggcaacucugcccaggcggcuuauccucucuucugcacagcucagacucacaacauucuucuacaggaccgaauccuuccucccuaaaccucuuccaagauugccuuacagagauuauggucccuggcucuuagccagaugacaucagugggaugcccaaugaggauaacaguaacagcugaaauauagcagcgcuagcaaccagccaggcagggucccagcacaggaaccucacaguuacuaagagugagaacugucagcauuccuauuucacagaugagcuggggaguuagaaaucccaagcagagugacuacccuuaacaaaaaugcacgguagucaggugauggacacccucaacacccugaugugaucacugugaaucacauacacgucacaauuucacauguaccugccccauaaauguguacaaauggccaggugcaguggcucacgccuguaaucccagcacuuugggaggccgaggugggcggaucaccugaggucaggaguuugagaccaaccuggccaacauggcgaaaacccaucucuacuaaaaguacaaaaauuagcugggcaugguggugggcaccuguaaucccagcuacuugggaggcugaggcaggagaaucacuugaacccgugaggcggagguugcagugagccaagauggcgccacugcacuccagccugggugacaagagcaagacuccgucucaaaaaaaaaaaaaaaaguguacaaaauuaaaaaagaagucgcaagcuucaauuuccccucuuacucucccuucuccaggccugagcguccccaugucuguugcacaggugaccuaaugcagccgauccugaaggucgucucugggacucuaaccaucaccagcucgagagguggcucugcuuucguggguguugaauggcgcucucugccugcuccuccuugaucaggugccaggauuccccccauucucuccuggccaccuuccuucucaaacaaagcucaggagcugugacccuuaugcugggagggccacccaguugcagcaggaggggaaauugugcaggugccaugaguagcauugccaggugccauccaaaaugugggaggcagagccaggcaaagcccagcacgaugagugaguacccucaucucauguccagaggcccccgcccuccacccugauucuccaaggcuccgcccagcagucaccuccucuccucuaggucuccuucugagaccaccucucacagguccccagccccugccuggcgcucucucucucucucuaucgcucucucucucucucgcucucucucucucucucucucucucucugucguguuuuuuaacuuccugagcaccagacuuuuggagucucaacccuggggcuucuucucuucuccaacacacgcuggccuggcugaucucaucucuaagcuuccaaugccaccuuccucuugcccccgccccccaugucacaugcacaugcccacagcuggccaagaaaccaccccagaugucucccuggcacuuccccagcuggaauuugcucagcuccggauuuucccaagccacccccucccugggucuuccugugucaacaaaggcccuaccauccucaggacgcucccaggccaaucccucaucccccgccucccuccagucuaucacucacagggccaccuccaaaggcaucucaguccaccagccaccuccuccuccaccacccccuccugcccuccuugcuuccacuucugucacccuccagcccaucacccacagggcuauagaaugacuguccacaaauacaaaucagauuggaucacuccugcgccuaugaccccccguggucuccacuuuccuuacaaaguccuacacggugggguccugcccacuuccccuccugaccuccuuucucuaacucacucucccacucacucucucuacucaggagcuccucagacucaguccugccccaaggccuuggcauuugccaugcugccugccuggaaucuuccaccucucccugugccaucugcugcccccacucucuaugggacaggcuccuucucuuucugggggucucuccuccucagagagggucucccuaacuuccauaucuaaacuaacuccuacucaacccucaucacaucaucuuaccuggucguccucacaaugcccuggccuuccacaucccugagucaucuuggggagccuuggggcuccacagaucccacagaaaagccacugccccacaggauaaagugccucucucuggagugagacucagggccuucacagcacagcccagacucagcucccagccacauacaccuucucuuguucuacgccuuugcacacgcuguuccaugcuaggaugcccuucuucuaccuuggccaacuggcgaguauccaacuacccaucccucaugagccaguccaaaugugacucccugccugucugugcguccagcaggcucugucuagcacccaggaaaagcagcucccuccucugacuucacucauguccuucgaccaugaugucccugucggguggcaggcugucccaaucaccagauugggagggucucaugggccaagaaucagccuaaucauuucagggucuccagugcccagcacacagcacagaccaggucccugguaaaaucuggggcugggugaaauacuucaggcucuugguguauaucaucucauguaaagcucacaucaacaacaagaggucggugggaugaucucccugccccagaggcguaaaaagagguucuaagaguuuaagagagggagcccaggggcacagccuuagggaaaugacaaggaagaaugcaaauccuuacuggccaccuccccuuacaccacuucuauguagcagaugcuaccagggucacaagaugagcacaggcauguccuuccaccacuggaagcacaggugugugguugggcuaccacucacuggcuggggcacuugggcgagucacucggcuucugagccuccauuuccuugcuuguaaaaugggcaaguaacucuccccacccaaauuucacaagugggaacguaagacucauugcauggcaaauagcugguacucaguaaacacagccuccugucuccuggcacauaaaagacgcuuggugacuacuuuccaaguuaauuaacaaaggggcagacaaauccauggaaggauuagcaaccaucccuucagcaguagaagcuggugcagccuucagccacgccuacccugccuccucuuuccucuggcuuuucgagaauucuccauuucuguccacuuugcugcuuugcaggagcucaggccgagggggagcaaugccuuccccaccugccgguucucagcagcacuguggaaagagagacgcaggugcucucccacucugacagcccagccucaacucagagauucucucuggccuccugggguuggcagugacauggcccagcaacaucccagcuucagaacacacugccacgguugacuucacagcaucagggcuccgggccuggcagcagggugagcacaacccuugcccagcaggaacccugcuguucccacgccaaguggcacagagcagguccacucuggaaaaccacucacuguccccugguaaagcagaaggcgccacacccacgacccugaguauucugguggucuccaggugguuuccaagugcccacaaaugagagaaaggguccauaggcugcagugugaccacaugaugccagccaccucacugccaccacgugcaauaacccacaaggagcacaccaacacugcaccagggaaagaggcaggucacaggggaauacugcacacagccuuucaugugagacucaacaacagagaagaaugaagcaagauuguucggggguaaaauuauaaggaaaaggagggaacucuugcugacugccaucaggacggugguaacuggaguggggugucaggggcgacccuaugguuucuguccugcugcccauguggacacuuccugaacugcucuccucccaaacaaagacaguacugaaaaagguaguaugaucagaaaacucuaagacuaaagacuaaaagagucuuuuaaaaauagauccaggccagauguaguggcucacaccuauaauaccagcauuuugggaggcugaagcaggaggguugcuugaggccaggaguucaagaccagccugggaaacacagccagacuccaucucuacaaaaaauuuaaaaauuagccaggcaugauggugugugccuauagucccagcuacuugggaggcuaagggaggaggaucacuuaagcccaggaggucaaggcugcauugagcuaugaucgugccaccgcacuucagccugggcaacagagcaagaccuuaucuaaaauaaauaaauaaauaaauaaacaaauuuauuuuuuaaauuuaaauaauaaauaaaaaacuaauuuauuuuuuaaauuuaaauaauaaauuuuaaaaauaaaaucaagguaagugaaacaagccagauacacaaggauaaagacuaugauuccacuuguaugggguccuuagaguagucaauucauagagacagaaaauggaauggugggugccaagggcugggaguggggauauagggaguuaggguuuaauggagacagaguuucaguuugagaagaugaaaaauuucuggagguggaugguggugacagcugcacaacgagguggauguaauuuaugccuuggaagagcacaacuaaaaauggaaaaugucauguuaugugauuuaaaaaauaauaaaaaugcauugcaguguaaaaaauuugugacccugcaauucuccuuguagggaucuaaucugcugauagaugagaugcucccaugaacacaaacaggagcaucacagauucugaugcaccugcauuugugacagcaaagauccagaaacaaccuaaaucccaccugcagggcagugauuaaauaacugaugcugaccagccuagguaacacagugagccuccaucucccaacaaaauuuuaaaaauuagccaggcaugguggcaugcaccugugguccccacuacuugggaggcugaggcaggaggaugccuugagcccaggaggucuaggcugcagggagcagugaucacgccacugcccuccagccuggagacagagcaagaccuuaccucaaaacaaagcaaaacugaugcuauauccaucuaaucguaugcagcuguuaaaaagcguuagaucugcaugcacuuacaugaaagaauuuccacauguacuaugaagaauuuuuuaagggucaauccugaauaguaucucuaauaagcuaccauuugucuuccuaaaaagauacauggauaugcauggauuauuucuggaaggauacccaagaaacugguaacuguggcuaucuuggggaaggacucagcccuggggagggaggaaggaaacugacuguuuaccccuuuuguaauuuguauuuguuucuuaucuuaugcagguauuacccauuuucugaggauucuaagcuccuuugaucauaggacaauggguucccugaacaauccagugcagaggucaugaccgcucuagccagucccagucccuugacauuaaagccuuaaagaauuccggcuuugaaaaugcugcagagaaguuuccacaccuggcaggaggguggugacagggccaucuccgccaggccccuguuuggacaggauauuuguggggccugagcaaacagcacacagaaggcugcagcccugauguucccgccagccuugguguucuccuggggguguggagggacagggugggaggguuaccugaaggucuguggaggcgccuugaguuuuuuuuuaugaggacuguaaaauggacagacagaaaggguuucugaaccugggucugccuuccuccccgggaucacagaaaccagcaggggauggcuaagaaacagcaggagcggccaggcagcgggcucugccugagcucacccaacucagccugagggaugccuuccucagcaggcagagcagccccagccagcccccucagcaccggcuucugcauccccacugcuuucuguggcccucacaucaccuucuccucuguggguguuuacugucuggacaccccagccuggccaguccagccaaccggccggaucucaggcuuggcagagcugccugcuagaccccacccugcacccacgguaucuucccucuggcucuagaaggaacgucccagccucagcccccauuuugcagaccagcagacagcuguggaaagagaaggcacagcuugccccagaccacacacccagccggggcagccgcaggaucucaccccagcugcauggcuccagagugcaggcuccugagccaagcaucaaagaaaggaaagaagggaacggaaguucaaguccccaucuucaucaguucuuccaagggaagcaaggcccucccugccaccccucuggccccuuccccaagcccacucucacagcaggcucucagcugugcaccauccugcauagggucuggaccugggagcccgggcucuggggucccucuguguccccagcugagugucaccugaaagccagcuugaccauucagcucugccagcuugagaagccuggcaaaagcuguuuccugggcccaggucgggggcuagggcucccccucccuccagagcccacggagccaggaucacuuuaguaacagccaccacccagcugggaaaaccaagacccagggaggcagagugaugugcccaaggguuuaaacauacaggguuuaaacgacaggcuuauuuugugagguuauccccaauccccaggacaggaaucaaagcugcccaagcugcagguccccugagcccaggaauggugagagacagggucugagcacagagagaagcccaucacagcagggaccucugccccgcccagaaagaagcccaucacagcagggaccucugcuccauccagagagaagcccaucauagcagggaccucugcccugcccagcaccacccccagcccaucaagcccgggcaagugggucucugagcgacggaacucugcccauguuucaacaagcagcccccaaacgucaaggaggguggguuuaaccgcacccucaguauccuacccacccacuggggucuacgagcuuuccaaaagucuccagaaaaaaugcuugacuccugggccugggaagaaaauauaauggcuccaaaaucuaaagagacaaccacagaaaagaacugggaaaauguucacuuaaaagucuauacauuuuacaagauaccagcuugucaacuguaacucagcucaacucugaaguggagguaaaaugaguguuauaaaagcuugcagugucaggggcagaggaagacgagguacacuggcuuaagaccggcugcuuccagggcugagagaagaagaauucauacuugcuaaugguuacagccgcccacgcuggggacuucugaauaugucacccacuuaauucagccgcccgugcuggggacuucugaauaugucacccacuuaauucuccccacaacccugcaggcuaggggcaauuaucuuccacuuuuuuuuuuuuuuuuuuugagauagagucucacucugucgcccaggcuggaaugcaguggcgcgaucucagcucacuguaaccucugccucucagguucaagcaauucucccgccucagccucccgaguagcugggacuacaggggcacaccaccacgcccggcuaauuuuuguauuuuuaguagagacgggguuucaccaugcuggccaagcuggccuugaacuccugaccucgugauccacccaccucagccuccuaaagugcugggauuacagguaugagccacugcgcccagccaauuaccuuccccuuaaaggugaagaaagugacuguacugagauuggaaugcagcucugccuguccccaaagcccaggcuguugucuaccagagacaaacuugaaaacauuuccuuauguuuauaucacaaugugagugugcagauuaacuuuaacccaugcccggguaguuaacaugugcaggacuccaaugaagauccaacccuccagagguggcugcuaaauucagugugaauauugccauccuaucugugaugacugcagaaaucaccucaaugcuuugcaguuccucccauugagaaguggcaucuauuuccccaccuguugaaucugggcugaccucgugacuauguugcccuggacaacaggauauggcacaugugaaauccaaaggggccuuguggcuucugcugucucuccugggacucuguaguccgggcugggcugauggaggaugagagagcauagacaaccaucccagcagaggccaucccagaccagcuaucucccagcugagcucccagcugaccacaaacaccugagcgagcucagccacaccuggcccccaucagcagagcccagcccaaauucccaacucacagaaugagcuaaauaaacuguugccaaagcaaacuaauauaagccagaaauacuuagaaaauaaaggguuaaaaucaauacaauuugcaauaguauuaaaaacaucaauuagcuaagaauacaucuaauuaaagauauacaagaacucuacacuaaaaaugacaaaacacucccaaaagaaaauaaaaacaaccugaauaaauagggggauauaucauguucaugggcuggaaacuuaauauugagaugucaauucugucaaaucugagcuacagauucaauacaauaccaauugagaugcuagcagccuuuuaaaagggcuaauuccaaauuucaauggaaaugcaaaggacccagaacagcugaaacaaucuugaaaaagaagaacaacgcuggaaaacucucacuagcagauauuaaaaauuacuacaaggcuacaguaaucaagacagagugguaauggugcaaagauagauaauggaacagaaaagagaggccagaaaacauuggccgggugugguggcucacgccuguaaucucagcacauugggaggcugagguggguggauugcuugaggucaggaguucgagagcagccuggccaacauggugaaacccugucucuauuaaauaaacaaaaauuagaugggugugguggcaggcaccuguaaucccagcuacucgggaggcugaggcagaaggaggaucgcuugaacacaggagguggagguugcagugagcugagauugcaccacugcacuccagccugggcaagagugagacucuggcucaaaauaaaaaaaaaaaaaaaaaaagaaaagagaggccagaaacagaccauacagaugcagccacuggauuccuggagaagcuaacaauguaacgcaguaggggaaagauggccuuuucaacacauggugcugggccagcugaaugucuaucaguaaaaaacugaauuuugauuccuacucacaccauacacagaaacaaguuccagaugcacuaaggagcuaaauguguaagguaaaacaauaaaacaucuaggauauuacagaaaaauaucuuuaugaccuugggagagacaucaauuucuuaaacaggacacaaaaucuugaaaaagaagaacaaugcuggaaaacucucacuagcagauacuaaaaauuacuacaaggcuacaguaaucaagacggagugguaauggugcaaagacagauaauggaacagaaaaaagaggccagaaaacauuggccgggugugguggcucacgccuguaaccccagcacguugggaggcugagguagguggaucacuugaggucaggaguucaagggcagccuggccaacauggugaaaccccaugugagaugucuaggggccauuuguuaauacaaaauguacuaacauaaauauauagaucaauagaugauacuucauuccaauuuggaacuuguguuccucagaugacaacauuugcaaugaauucaucagaaaguuuuauuaagagaguaaaaaggcaagucauagaaugagaucaccuauguggaauccaacaagagacucauaaccagaacauauuuuuaaaaccccuaugaaucaauaagacaaagaaacuuaauuuuaaaauaggcaaaugacaacaaaauagccaagaguaauaugaaaauguagacaacaucauaacuuguaagagaaggcaaauaaaggccacagugagcuauuacugcacauccuccagacuggccaaaauuacaaagaauggcaaccgccagaguuggcagaaauguggagcaaauggaacucucaugcauggcugguagggaugcaaauuggcaauguacuuuggaaaaccauuuggcaguaucugcuaacauuaaacauaaccuuugaugcagcaacuccaguccucaguauguauccaacagacauggaugccuaagucuuccaaagacgcagacgagaaugcucacagcaacagugugcagcauggaacccaaauguccaucgacacuaaaacugauuuuuaaaacuaugauuuauuccuacaauggaaucauaaggaguaauuuucuaaaaaugaacuacugcuauaugcaccaauaugcaugagucucaaauaccuuaccuugagcuaaagaagccaaacacaagcaagaucacgcuguauguucccaucauucaaaauaaauucaagaacagaaaacaaaacagggcugggcaugguggcucacgccuguaaucccagcauuuugggaggcugaggcagguagaucauuugaggucaggaguucaagaccagccuggccaacaugguaaaaccccgucucuacuaaaaauacaaaaauuagccaggcaucguggugggcaccuguagucccagcuacuugggaggcugaggcaugagaaucacuugaaccugggaagcggagguugcagugagccaagauggcaccucugcacuccagucugggcaacagagugagacucugucucgauaaauaaauaaauuaaagacuaggcaagaguuaggccaggcaugguggcuccugccuauaaucccagcacuuugggagggcgaggcaggaggauugcuugaggccaggaguuugagacccagcugggcaacauagguagaccccaucucuacaaaaaaauaaaaaauaauuggcaagaguaauagauggugauaaaagucaaaauaaugguuuccagcagcgaugggguuaagaacugagaaagggcaccaggaaaacucuggggugcuugaaaugcuuucuaucuugacuguggaaugccuggguuuacacauaagaagaaacuugcugggcuguucuauuaaggcuuguugcuuuacugucuauacauuuuacucuaauaaaaagcucuaagacgaguacuguuauauuaaucuggauuaaaagacacucaagagcauguacauuaugcuucaauagaaacuuuaagaaagaaggaaacucaggagacauuaacaaccaaaaauaaaccaaauaucuaaucauccuugauuagacauugcuuuuauaaaacgagcuauacgguacccuuugggaagaagaagagagagauuaauauaguuggaguauuagaaggcauuagggaauugguaauugugugaaguauagggucaugguaugugauaauauuagagaauaucgcuauuuuuuagaguugcaagauacagugucaagacugaaauauccaugugugugugugucccaaaugagagagagcacuggacaaugaugaggcugaggcccuucuucacugagcccccuucccccucaaauagccccacugaaagucugucccagcugcuuaguguggacugggguuccagguggaacccugggauguuagugagcuguggcugggagagucacaguuaccaaagggggcuugauggugggcuucaacaacaugggugggaggggcugugagaccccauaguauuugacuuccagcugcuccuuagaaagcucuggaaagugguauguucgcagucagaggacccauggacaagccucacccuuccacagccuuccagggagccagugaugugugcgacugucauccgcauuuucauggguuauuuuuguugcgaugucuaggggccaacucuaugcaaaagagagaaaaguaucuugcacaacucuggccugcccugauucaggagaagcacagaaauucuugacaaguuuaacucuguuuaaaaagaauguguggaacuugcaaggcacuaaaagugugcacugucccuucucagaaagaacuaugaauucucucuuucauuauuauuuaaggaacugcuauuaccuaagagacuauacuucugcucaaacugaaguuugauguaauucugauucuuagaaugauguuuuguguuacuuauagaugaaucuuauaaaugauuuaauucuguugcuuuuucuuucucgcuuaauuuccagcccaucauacguacaguuuaauaagagauauuuaacuacauagcaauuuugguguucccacaccaguauuuacuaugagaaacguaaacauaccuuuuuagaaacauaaauaaugauugauaaaaaaucaaaguaaaaauaucacauaauauaaacuggaucuuuuuuucucuuagaaguaaacaggcaguggggcaccagcacuguccagcguggucuucugcaaagccucgggugauccgugcuggccggggaggcguugacucagaaguccugccuggagaagaggcagcagguacccugggagcagccaccagccgugcucugccagagcaaagccaagguggucugggaccuggagcucaggguucccaaugagaagccacagggccaggcuggggcccuuccagaaccaaacgccccgugccuccgccuggcagcuuuccauuucccuucaccccacacaaucaugcgucacuuaacgaaggggucacguucugagaaaugcgugguuagguggugucgucaucgugugaggacauaagaguguccuuacccacaccuaagugucauagacuacuacacaccugggcugcaugauauagccuugcuccuaggcgacacaccuguccagaacaugacuguacugaguacuacaggcaacuggaacacaaugguaaguauuugugaaucuaaacaaagcuagacacagaaaaggcacaguaagaguaugauauaaaagauaaaaagugguucgccuguauagggccugcaggcccagaaaaucugagacaggucucaguuaauucagaaaguauuuugccaagguugaggauacaugcccaagacacaaccucaggaaguccugaccacuugugcccaaggugguuggagugcagcuugguuuuguacauuuuagggaggcaggagacaucaaucaagcacauuuaagaaacacauuaguuugguccagaaaggcaggacaacucaaagcaagauuggggggugccuccaggccacagguaaauuuaaacauuuugugguugacaauugguugaguuugucuaaagaccugggaucaauagaaaggaaugauguuuggguugggauaagagguugugcaugguguaguuuuaucaugcagaugaagcuuuuagcuaggcuguaaaauguuucuuaucagacuuaaagucugugcugaaguuaaugugagagauauaaugaggccucucugacccccacuucccuucauggccugaaccagucuuucaaguuaaauuuuaagagcgccugcugagaaggaaguccaguuagaugguugguggcggggggccuuagaauuuuauuuuugguuuacagggcccuuaccaugcauggagcuugcagacuggaugcugccgugggugacucaaugagugaguggugagugcauuugaagaccuagggcacuacugugcacuacugcagauuuuagaaacacuggacacuucagcuacacuaaauuuaguuuaaaauauuuuucuuucuucaauaauaaauuccucuuagcuuacuguaauguuuuuacuuuauaaauuuuaauuuuuuacccuuuuguaauaacgcuuaccuuaaaacauaaaugcccucauuguacagcuauagaaaaauauuucuuuauauccuuacucuauauguguuuuuauuauuuuuuuaauuauuuauuuauuuuuuuuuuuuuuuuugagacggagucucgcugugucaccccggcuggaaugcaguggcccaaucugggcucacuacaaacuccgccucucgggcucaagcgauucuccuaccucagccuccugaguagcuaggauuacagcccugcgccacugugaccggcuaauuuuuguauuuuuaguagagaugggguuuuaccaugugggccaagcuggucucaaacuccugaccucaggugauccgcccucagccucccaaagugcugggauuacaggcauaagccaccgcacccagccuauuuucaauuuuuuuuuuuuaacuuuuaaaucuuuuuucuuaaaaacuaagacauaggccgggugagguggcuccaucccauaaucccagcacuuugggaggcugagacaggcggauugccugagcucaggaguuagcaaccagccugggcaacaugguaaaauccgucucuacuaaaauacaaaaaaaaaaaaaaaaaauuagcugggcauggcaccaugcgccuguagucccagcuacucaggaggcugaggcaagagaauugcuugaaccccagggguggagguugcagugagccaagaucacgccacugcacuccagccugggugacagagcaagacuccauuucaauaaaaaaaaaaaaaaaaacaacuaagacauacgccaggcgugguggcucaugccuguaaucccaacccuuugagaggccuaggcaggcggaucacgaggucaggaguucacgaccagccugaccaacaugguguaaccccgucucuacuaaaaauacaaaaauuagccuggcgugguggcgggcaccuguaaucccagcuacucaggaggcugaagcaggagaauagcuugaacccaggaggcagagguugcagugagcugagaucacgccacugcacuccagccuaggggacagagcgagaauccaucucaaaaaaaagaaaaaagaaaaaaagaaacuaagacauaaacacacacacuagccuaggccuacacagggucaggaucaucaauauuaccgccuuccaccuccacaucuuaucccgcugggacgucuuaaggggcaguaacaugcagggagcugucaucuccuaugauagcaaugccuucuccuggauaccucccaaaggaccugccagaggcuguuuuauaguuaacuauuuuucaaauaaguagaaagccaaauaacacacuagcgcacaguagugcccuaggccuaccaaaauaacaacaaaaacauaguaaauacauaaacugguaacacagacauucauuaucaaguaugaugcacuguaacuaacuacacgugcuaggcuuuuuguuuuguuuuguuuugcuuuuuugagacagaguuucacucuuguugcccaggcuggagugcaauggugcgaucuuggcucauugcaaccuccgccuccuggguucaagcgauucuccugccuuggccucccaaagugcugggauuacaggcauaagccaccacgcccagcccaugugcuaggcuuuuguauuacuggcagugcgguagguuugcuuauaccagcaucaccacaaacacgaguaauggcuacgcugucacuaggcaaaaggcauuuuucagcuccuucagcuucaccauaaucguaugggaccaucacauauagaguauaucauugauggaaaugucauuaugcagcgcuugacuguaccaccaggcccgccuuccuagaacuugaccaggcacugauugaucugauucccccaugcacaccccccacuaaaauacauccuuccucugucuaguugcuccugcagaauaacuggccacucugcacacucaaagugaagcaaucagcacugaucaaaggugccuaggagaggucaggguaacacgcucaccagccucacgccaagcaggaaacacuucuauccugauggccacggcugguggggggugugaggcacaaagccaggaagccagagagcuccacucaaagcccagccaugcccccaccagccaagcaaccucuggcaagacccuuggccucccugcuccugcauccaggcuccaggggccacacggugacagaugaggaauugugaggucguccuccaucacucacccaccaccaacccagccccaacugccaggugggccagcuugguggggaagggacagaagcacagccauucucugaucagcuuccaccucuagcuuagaccugugcccugagcuccaugcucaaguucccaccgccaacauggcaucucuaccugggcaucugagcucacucuaacuccucccgugugagcaugugaggagcacacagagaugagcuugaggcugcucaucucacgcccaugccugugugguggcauugcggacagucccugauucccaaccaccauacccgcacggccauccuccccaaagccuacugcccacucccuaucugcccuagacccaccuuccacccgucagcccugcucuuucuugagggaggcuggccuggaggguggcauccugggguccccauacaggcacaguugccucuaccuauggccacggcuacucccuggagccucggcucucaccagucuccccugcaggccagggguggagcucccacuguugcugguccagguacugcacaguaaccugcaggucccugcccucagcccuccauguagccucaccaugacacugaucccaccagcucugacucagcugggaugggaggucugggcagagagagccuggguuggagucagggcuccugggcccccauccucugcaccugcagagcucucagccagcuccucacccagcacuggaccucugugucauccuaguggugucaggagggguggcagagggagaguccaagcuauggcagcaagcaggugccuguaguguacuuugugggugcuuuaaaaauaugugaacgaauugcuaauauuuacaaauugggagcugucauaugaaguuccagaucccaggcuucuuguagaaaauccaaaaucuuggaccaugccaggccuccacggccccagggcaacagcaggagcgacugcccuuguguucuagguacagucucugguccccacggcccccacuuuccaacaagcuguuucacucccagacuucuagugcugcuucuccauugcaugcauucuaaaggccagcuggccacagucgcuggaguuaacagcagggacccucaucccuaagggucuucaccuuugugguuccugcugaaucucuggcacccaaaaggugaggggggcaggcuagaggacggggcuggaagcaggagagaaagccucucacucccucucucccuacuccuccacccccagguucugggcccucugugccaggcaggcuugccuaccugcuaaucccaccuuuauauauggggucuaucacugaccaaaacguccuuauguggcccuugacuauacuuggaaccacagucccaccagguccaccggccuagaccuugaccaggaagguaccagggagaggccugagggguuggggcaggggggcgagugcagagccugaggccugccagcuugcccugggcucagcuuugccccuugagggccagccauccagacaguccugaagccucagucugcccacaacagggaaaugccugcucacacugggcagccaggcaaacucagggagucagcaggcaggagguggaagugcccggugcagggggccaagucagggguuggcaaacgucuacuucacugguuucaggaaccauggacaauucacuuaaccugccugggccucagucaccucgucuacaaaauggacauaaugaugacauccccucacggggucacgacacauaauggacugauacgcguccagugauuaacacagugccuggcacauaauaaaugcuccacugaugcagggugaccugugaggguggcaaagagggccccgcaugcagacucaguagaggagggugccccuccccuugucugugggaagccagccuugcagccaggcaguauggcugaaggaggggucucgcagcucgcgcguuugcugacgcaguuggcaggggccgaaacaagagugcagcaugggagggagacagccagugaggaacacgcugcugcacaucuggaggcagcuggaguggcaaacauagcagcggaacggccccugcccaacccugccaggccuggcuccucugcucuuuugccagaggggacaacuucuggccaccagaagauacacaucuacaucuguuugaagaaacaagaacacaaagcccucuucucaucccucccccgccaccccaguuccugcagaaccucuggcaggaugaggcaagcagcccguggcccggagcagcacucugugcuggcugccguuagcccgccugcuccucucaguaauccugagacuaacaggaccgccccauuguacagaugcagaaacugaggcucagagagggugagucgcuugccugaggucacacagccacgagcggcagaggcaggaauucacucucugagggccaaagcaggcucaaucucacugcaacuuggccccaagcccacuuucccagcauggaggccgaggaguggacaaggggguggaggucccaccagagccccagcccacacaauucugaucucaaccagaagcuucaccucaaagccccggaugcugcaggccagagguccuagaggcccacagccuggccuagccucgaggaggugcuggcagguagaggaugccgacauugcccgcagggaaacucgcagcacagauccugaacuccagcucacugaggcccccaggauucuggaaggcucaggaggccaaggacuccuaggcaugguucagccucaggaaagccgcaucugcugccuuggccugggugcgugaacaggaugcagcccagggcucgaaggccgccacccucucagcagggccucaggacuuggaaccacagcauccgggacgccagccaugaguggagcucugcucuguggcaggccuccccugcaccugguguccacugcaggcuuucuucccauugagaacacagcucugggaggaagccaacaguaagccccuuuuacagaugagaaaucuugaggcccaggacaguuaagcaauuugccugaggucacacagcuagugaagggucgagccagccucuaaccuggggagcccugugccaggacccaagcagaaaacacagagaugccuuuuaugucaacagaucuggguucagagcugggcucaacacuuccucgcccuaggccauggccaggcacagguugacaccacggugggaagggacucguaaucccuuugcuguagggucacuaugggaacuaaaugagaggaggcacgugaagcacuggcacggggucuggggcuugguggucaggcacgggggcacccacugaacugaccgccugcauucucccccuccuuaauccccaccauggcagcaggacucugcagugacucucguggccaggagccuugacccugggcuggccucuugacuggcugccaacacaauguggcaaaagcagcggcccugcuaguucggagcccaggugcaagagucuguggguguugagguuuacggcacgcauacuaccucagccuccacgucugauuggccaccuaacuuagaugauaaauuccugcugucuuuccucuacuucagcccagagagcuccuuccccaaacccacaccugaccuccaggccagcaggauuccaaaauaacaccuccguccaggaaaggacuuugcauugguuuguuucaaaucucaggccugcuugcuuuaaagugcccaaccacuaccggacuuucauguuccccauccuggaccccagugaaagccagugccccaggcccacaccucccccccaccccccaccugccgccccugacuuccccgcguguguguggcccccaggugcaccacguaucccccaggaaguaauaaaaucucaaucuccaucucaagucuaucuuaaucauugaaggagugcucuccaucuucaagauccuaaauuaaacaccuguguguuucuaaucuuucucuuggaccucuguuuccacaaugagaacacgccagagcuaaccagcuggagaccacguggcacagacaugagccauccuggcugaggccaucccggaccagcugagcugccaggugaccacagacacacguucaggcccagcaggugucagccacgccuggccagguuagcaggacugcccaacuggcccguggacuugggagcaauaauaaaugugcacugugugcgcuacggaggagcugugguugccucacuugcauuccugugacaauggguaauuuauacauggccgagguguguccaaggaggaaagacuaacauugguuuagcgagaauggcaggaaggccaccccacagcaguguuggugggagugugaccagugagacucacuggggaaccaucagacgagguggguggagagcuacgcacacacaaacuaaaaccaccaggagaggcugcuccccaccucucagacuggcaaaguccagaaccugcuuaauuuccucuuuagcacuuucaccaucuaacgugccagauuucagauguucauuuuguugacugugugaauccccaccccacgacuggcagcuccagucuugucuguuuugcucacccugucuccccggcuccugcaauggugagagaggcacucaauaaauauuugucgcaugaauagaacgaggaaagagacauucucaugacugcagguguaaguaaaauccaguacacccuccagggcgaacaagugaacaacgucuaccagggcuauaaaaauacguccauauaaaaaaaaauuacauccauaucuccuagagcugagccagccagcaccucucaacugaaaugcacaggcauaaggaccagaagccuggcagagaaagcucauggccuccacuggaaacaaccccaaugcccccagccggggaacaacaagcuaggcagggucgaucccugcaacggaacacuaugcaacaaucaaaaagacccccucccgauacacgcaauggcacggucauucauuuauaaaaguuuaagagcaggaaaacuaaccucugccauuagaagucaagagaggugguuuccuaggaggggcacaaaggaggcuuccuagggccggcucuugucucaugagcugagggucagcuucacagguguguucacuugggaaaauucauuugaguugugugcuucugacagguucuagugguuaugugucaaugaacagcguacaaagaaaaaaagcacagacacaucgaccucacaauuccacacuggggcaugguguagagaugcucacagcagcaucgcuuuuuaagagcaaaagacuggaaccaaccugaauauccaucaguaagggaaccgguaaaucaaagaugggguuugcaugcuguggggcaccacggccaucaaacacagaaaggggacuuuccaugcagugacagggaaaagcuccaagauccauuguuauuugaaaaaggcauagaacagaacgcugugcguccuauguuagugcuugugaaaauacgugcacgcaccuacaugcuuguaguugcacugaccagugguucucaagugugguccuggcccuauagggucuccaagacccuuucagggauccauaaggucaaaauuauguuugucauaacauuaggacauugguugccuucuucauacacucucccccagugcaguguauaguggacuucucuggagacuacaugacagugugaugaugucaucacuuugaggcuaaugggaugugugcuugcguauucuagaaguuucuagagcaaucucaugaacacaugcucagcaucauuagucaucagggaauugcaaucuaaaccacgaugagaugcuauuucauacacacuaggauggcuauaacaacuggugaggaugugaagaaacuggaacccuugugcacugccggugggaauguaaaauggugcagucgcucuggaaaacagucugauaguucucuuuuuuuugagacggaguuucacucuugcugcccaggcuggagugcaaaggcgugaucguggcucaccacaaccuccgccuccuagguucaagcgauucuccugccucaaccucccaagcagcugggauuauaggcaugcaccaccacacccggcuaauuuuuuuauuuuuaguagaaacgggguuucuccauguuggucaggcuggucuugaacucccgaccucaggagaucugucugccucagccucccaaagugcugggauuacaggcgugagccaccacacccggccucaggcugguaguucuucuaaggguuaaacacagaguuaccauguggcccagcaaugccacuccuagauauguucccaagaugaaugaaaacauguguccauauaauaaacuuacacaugaauauauauagcugcauuacucauaauacugaaaagcuggaagaauaauguccaucaacagaugaacagauuuuugaaaugugguauauucauacaacauuauucaaccaugaaaaggaauuaaugacacaugcuaccacaugaaauggacccugaaaacaucgugcuaagugaaagagucacacacuagaaaccacauagugcaugauucccagagaguccagggauauccagaauaugcaaauccauagacucagaaggaagauuccuggcuaccggggacugggagaaagagggaauggaaagugacugcuacagaugugggugucuuucuggagugaugacaaugcucugagauuagauucuggggaugucugcacaacuccaaaucuacuaaaacccacuagauucugcucccucaaaguggggacuuuaugacaugcaaauaauaucucaauaaagugguuuuauuugcauaaacuaacagaguuaguuuuuaaaauuaaagaaacccaccgcaggccuagccuuggccccagacccucaagauggguuggguccggcugugaaaugcacgcauuuugcccaggcaggcaaacacagggagcacccagcuaccagccacccagacccacuuguaccucuaggucccccaugggaaccacaagcccuccuccuccacugggagacuggggcccccugcuacagccccaagaugacaguuuucucuuccaugaaaugggauguccaugcagaguaucuccagguugccacagggugaaacuugcuguuucugacagaugccccugagcagagggccugaacccagcugcccccgggcugguggcaaugagaccuggggagcuggccuggaggggacugcagcaaaugcagggcaccuguccagccacggagcucuguggaccuggggcagccaccugcucccauucucuccagcagagccucuaugcacagcugugcucugggucucuguacugacaacagagaggauguguucccuuuugggagcuccuugugagggcccuguaccaacucugccacuccuccuagccagggauccuguuaacacauaaguuggccagugucaccccuuuguucaacacccugcuguagcucucaccucagaguagaagccaaaguccucaugguggccacaggcccuggacagccugccccagugaccucccagaucuccuaucccccucccucucccccacuuaucucggcuccacuggccuccuguccaggcaccuuccugcccuggggccuuugcacucgccgcucccucuuucaggugcacgcguggcucgcuccuccccuuucagcucucugcucgggucaccgccccagggaggacuccccuguccauccacccuuccucucacugugcuuuuuuuuuuuuuuuuuuugagacggagucuggcucugucacccaggcuggagugcgguggcgcaaucucggcucacugcaaccucugccucccggguucaagcgauucuccugccucagccuccugaguagcugggauuacaggugccuaccaccacacccagcuaauuuuuguauuuuuaguagagacagggguuucaccauguuggccaggauggucuugaacuccugaccucaggugauccauccacccaccucggccucccaaagugcugggauuacaggugugagccaccucaccuugcuuuaauuucucuuagcaauaccugacauuacagcagauaauucccauggacuuguuuacuguuuucuuccccaacagaaugucagcacugugaggugaggguggggaccauaccucucauauucucugcagagcccaagggccucuagcagggccugcacacaguuggagcgcuauaaauacuggguggauaaaugagugaacccgggggggggggaucccccugaccaccccuucucucaguaauuccuccucacccuaguucuccugccauccugagcauuccgaccucucuccccucuguuccaagcauuugcuuacacuguuccuggccagcucagauagcaccuccccugggaagccuuccugaaucuuugugccuucacucaucccccucccccagcuccagcucuacuuucuuccugucucccuucugagguuucuagagaucuguccccacaguuggaugccugugucuuguucaaucccauaucauuuacucuacagccuucaucaggugucagcucugagcauguccuggcaucccugggaaggcagagaugaaccaguauggacuugguucacagacugggggcugugaggaagagaggccugugugauaucugggaaggcuuccugaaggagggggcaugaggggcucugcagugucagcaguguucccaucuacucauucugcugcccauagcuguggccuugggcaaggcucuuaaccagcuuggauccuguuuucccaucucccaaguccucccacagcacuugcugggcauggaccaugugcaaagcccaugcacaugcaaugagggugaaacuggggucucuguggguuccuccaggccuaccggcugccaccccugccaacucugcuuccagccugcuuacggugggcagggcacagaacucgcccuugccgagcaccuccugggugcccggcucuuguuucugugauaugauccucccaacaagcuggggagguaggcuccaucucccuauucucagcagagcacaguccaagagguguggcuagcagcaccaggucacaggcgggaccugguggugggagguggugggcugggaugggggaggagcggaacaugcauguuguggguggaguguguaaugaagugcacgugugccagggagggcaugcagccaggcucagaagcguggugcaugcagugcagcuuccaggguuucugaaauagaagcagccccaccccuggcccccaguccugccucuugaugcccgaggccucucuguggucugggcugugggauccuagagagcagcuuuguuaucaggagccccaguuuuccccucugcccugagcuuucucaaauagauuuuuuaggugugggcuuugaugaggacugcuggcuguuaggcccccaacugagucccccuuaucuugucugacggcugaucuggcaggggacccagcaaacgcaaaggcccagagaccagaguuagggcagggacaggcagcugcagcguuuggugugcagggaauggaagguuuaaggacccagggguagaggaugaauucaaaggggacccagaagcucaggccuggccagauaaacauccacagccgcaccccaacucucacccuucugcccacccauggcccacuugucaucacgaauucaugggcucuggcucaacccacagaaucugagcaugcggcuuaugguuuugugccucaguuuuuccaccuguaagcagcagggaagucccugcaucauggggcugcuuugaggauuaaaugagcuaauuuguguccaacacucagcugaggacuugcugagcaauuagaaaugcgacgaugauuagucaccgucuguccucagcccacccgcugauaucuucaacagauacucacagagcacccucacugagccaaggcugcgacagugagcaaggcagacgcaaccucgcccucguuuagagucuaaugggggaggagggcguuacagggauguacacaggcagguuuaucccuggucacggccaugugcacgcagcaugggaggggugggagauggaagcccagcgggugggggaucgggcugcccaacugagccucuugggggaagugggguuuggacccuagcgccccuggcugcuguuguugggggaggccuugggggaucuagaugauggagcagcccuuggugaggagaagcuggggagguggcuuugcccugcucagcccugggcccugcagaaagggagguaauggggccagaagugaccccuccagccgcguugccauggcagcccuggggccuagagaagggguuuccagccagugccccaggccuggcugggcuggggguccugucuuugagcuggagcccugccagggauccagacugccucggccaggccaucccugccucugagcauguccagauguggccuaauggaagccacaugcccggcucccugggcugggaagaaggggucugacgucuguugucacucaaggggcuucgugagggcggcuuuucccgcagggcuggcacaauggagggccacacggaggaacccucgggcagggcggcccucaggaggucggagguucccagagcagcugggggcagccccugaccugcagaaggccucucagcacagccuguggccccaggaaugcauggcaggaaaggggccccuuccucagggccucacacacgcagguucugcagggcaggaguaucugaaugcugugaugcucuggcuaacagggaaacccuaaaacucaaaugacugcugcuguccacugcagacgccccucaacacggugacucuguuaggcaccgugcucggcgcucugugauugcugagccgcguaguccucacaacagcccucuuaguuuacaggaguggagagugggcuacagggagcucaggccaccgccuguggacacaggggcagaaagugguggaagcaggcuucucuucugccuucuucagcucuucaaccucucacagugguucccuuuuuuuuuuuuuuuuuuuuuugaguuucacucuugucgcccaggcuggagugcaauggcacaaucuuggcucacugcaaccucugccucccagguggugauucuccugccucagccgcccaaguagcugggauuacgggcgccugccaccacgccagacuaauuuuguauuuuuaguagauuugagguuucaccacguuggccaggcuggucucgaacuccugaccucuggugacccacccaccuuggccucccaaagugcugggauuacaggcgugagccaccacgcccggcccacccucugacaguggcuucugagugcccagcaugugcacaggagccgguaagaugcugaauguacaggguucacaaaacccagcagagacccugaccuuggggagcuuggggcuuugaggaggagauagagaccccagcagucacagaggugugauguucugagcagugauacgagcugaggagugaaguggugagccucacucaggggaucugacuccuccugggggucagggaaggcucccugcagggagucuugagcuuccacuugagcugcaauguagaggaugaggugauaagugggcaguggugagaagggggugcuccaggcgggggaaacagcacgugcaaaggccccuuagccagagggaauugaacuugauugaaaggaagcucugacuggugugagaagaggcuggggaggggccggccggagggagccauauagggcagaagguggcaugaucugauuuguguuugaggcgcuccccccaggugcggggcuguccccucucacacugacggagcucugggccuuuccaaugucugugggucugugaggcccccagauucccuaggcuguggcagcacaggguuauccacccagauuaaccuguuugcuagaggacuccugaagccucuccucuccaguguuggcccacggggguuucaaaccugcguggggucuuaggagcaucaccccagguccccauggaagcuagaccaggcuucuggaucugcaagcccccagcucuugugacagaaucacccccugcaggaguucaaggcuccuaaaguaagcaggaaggggucagccucgugggggcuguggccccugcuuagcagcagcgcccuuugaggacggcucuuagguaggcucagcggaccauuccccuucucgccacagcucauggggucuucaaauggggugucugacugugcugggcuauggaggaccugcugggagcaggcauggaugggcaagaagaggccugggccgccuaccagccucugcacagccuugggccggucccuaucugaagccugggugcccugguccuggcugccugcucugaugugcccgauggaguguauugaacucuguggcagguggcuuggaggauauagggucaggagugcaggcuccagggccuuccaggcccacugcucacugguugugugaccugagccuccagcaccacccucgagccccaguugccucacuggugaaacagcguacauaguaguaagcacucggugcugcuggaaggacugaugggaagcugccugaccagcucggagaggggccuccauggagugaggguacagcugguguggccccaccaccuccacuggcccagcauggccagcgccccugcucaaauggcccacccaccucgccucuguccacgaguucacuucuuucuacaacacaugcuugugagauuaggauuugcugcagacacuuagaaaugggaagaugucacauaaaauucagcuuucuggcugacauuuguugaaaaauuggcagagguggccaugcuaggcuccuaggccacaggccagccaccggggcagcugagaagagaccgcccuucgcauuuccugccaggacacgugggggccuaccgggcugaggcaggaacccuccucagggcccccagcucugaagaugugcaccuucuggacccuugaccacuaccgcagcccuaccagggggcccagcaccucccacaacaggaaccccacucccacccacccaucccaucccaagagcugggccugggagaagaugcacucucacagccuccugcccaaaccaagggccugggguggccacccuaggccuggccccacaguccagcauccccagccccaggcagagaccuggggcagcggccagagcccaaggcugcccuucccacacaaagugcccugaaggaaccaggacagggucuuaccuucagggcuacuucuggggauagaauggacagaguuggggucuguguccuccuccacgugggaauggggcagaacuugcggcuuccugggcacuucucgggugggugggauccaggcugcaucaggcagugauguggacaggauguugugggggcugggcuugacugggucccugggagagccaggcacggccugaguugggacgagagcagccuugcccaggcucggugcaugcgucacgcccuccggcccagugcugcgggacguggcuugggcauccaggaugagguucucuucaggccuugccccagcuucugcccuugccccagcuucugcccucuccuccuggauaggaagacuggguccagcuggggcuguagugggcagcccauccagcccccuguggccaccugcugccagcugcucagugacagccauuuccucucucuccuccuccuccucuucuuccuccucacuguccucggucacucuccuagcuuuggccugcacuggggcugggggacccagggcagcagccgcugugggccuggggaggacagcuggccaggggggugccuggaugguggacaguggcugacucccaccucccagagcagcuggggggcccccugcgccugccuggacugcacccgccuggaccucaccccccagggcuguugcugcuuccaccucggccaccuccuggucauagcuguaggggucuucguagugucgcucggggucacccuccucggcaucugagaaguucccguggcaaccggggagcugguagcagaugagcucuccaccggcgucagggcaguggcaggcccggcagggcggcaggugaacaguguggccagcggcguacuuguggcccgcguggacgcagcccaccuggccgcacugugggcagcugucagccaccacuacagccucgaugcaguugggcggcagcuccgggcacagcaugaacuggcagcugaucuugccgccgccuggugggcaggagcacucagugcucccgaaguccacaaaauaggacugaccggcgggcacgcggccgcgcacgaagccacccuguaggcagucauaguacugguagcccucgcaggcgcagcccugcugcacacacguggcacagcaggcacccggcuccagcgccuccucaaugcaguucuccagcggcgggcacuccacgcccgugcaguccugccgaggggcagcugcggccacgcuggggcccagggccagggccaggcccagagcaagccaggcuccugcaggcucccagagcagcaccaugguccaggccagcccaggacgguccccucuccuguaagacccugggggaaucagaaaggaagccugucaguacugggugugcacacacagacacggugcacaccggcacgcacgcgggcaggggcccagccucagccaccucacacgcaugcgcucauccccaggagcacacuaagcacugccucacacacacacacaggcuccgccacacaugggucagaucacacacaggugagugucuagucgcugggcgccacagguguugaccuggagucgcugacagccccacacguguuugcugggccacuccauccuccauccucaccugcauucugaggcagguccucugagugagcccucgugcccacacacacacaugcacagccccacacccacucggucacacucaccagggcacgucaggcaauaugccccauaauccucuaugcaguuacacacgcugucucacccacagcaugcccacgugccaguacacacccugggcggucucacacgcacagucccacgcacacacccgaccaaucccuccccccagauccuugacucaguccccagccacgcaccacagcugcuggccagaaaauacagucaguggggaaaugcuaggcaagaacaagacgcccccuacagccccagcccgcagacccuaggacucaggaacacaccucugagacccucgggacugcaggcuuagccccaggggacgcuccugucccccuccccaguagcacuggcaaaugcauccugaugccuugcugucccuaacaccccaccaacucccccagucauguccauucuccccgcaaucugucuccacucccuccccacggucucuaccccuuccuuccaucucuaggcccuguccccacuccagucucagcucugaucuccacuggaacagccccgccaccucccugcccaccacuccuccccuuucccagggaacccagucuggccugagagcagcuggccccgacaugccacggccccacagcccgccccaguuucccauggccagaaaggaaaggucuggauucccagcugagccuggcacucaaggcccugcaggagccaucccaacccgacccucccacaggcccuuaggccugaacucccccaagggcucuucuccccucucaucuugcacaagccacucaaaugccaccuucucaccaguccucaugccuccucccuccuccacccuggcccaaguccccagugccuguagccccacuugugacccaguggccguaccugacucuuauagacagcgugcuccccaaagucacaggcaagagcuccuucuccgacucccagccuaaagcgcagccccauagggcagugacagagggacagcaggacucguuaccacagcagugguccccaagccugccccauuucuaaaggaacgccuccucugcacccagccccucuaggaaccagggguuuaucagccagcaagacagguucccagcguccucacagcacugacacccucagggguggaggggcagauaauaaacccaagagcaaaucuguagagaacugaacgccaggcaggcaugagccccaugaugaaauaaaugaagggaaucaaggagacggaaggaggacguggcagugucaggggagcccgugucaguccggcggaagaggagggcuucucugaggagggcgucaggcagggaguggcagggccaaggggcugaggccggaccagcagcagaaaggugaaggacagagagggcccccagggcugagccacaucagcacacgggugguaacugcagagcaacgggcuuccagccugcugugagggccucugggcgugccuguaagcgcuggagccugggacucuccagugcaagggacccacccagcugcccacugcgcugagacacgggagccagcagggagcaggugagagagcccagggcagugagcgaagagaggcaggagaugguggcacaggggaucuauuuugaagguaggacccacaggauuugcugauggauaggaugcagcggacagaagacagaaguccaggagcgccuggaagggggaguugugugaccgaggcagggaaggcugcgguggagggccauggacgggcagggagauggaagcccaugcccagaccaggcucagggccggcggagugcuagggagccucuggggccucgagggcugacgccccugcccucacacugaggugccaccucaggaagcuggaggacuccguaaagccacugacauuaggaaugggccccugggagaaucagggccuuuacucccagucagcaaaagcaaggacccuccagacugcaagggagaggcccucagguccacucucaacaguucuuucuguuuguuuuuagagacagggucucacucuguuguccaggcuagagcacaguugugugaucauagcucaucgcagccucaaccucccgagcucaagcgaucuucccaccucagccuucugaguagguggaacuacaggcacacaccacuacacccagcuaauuuuuuuuaacaagggucucacuguguugcccagauuggucuugaacucuugaccucaagcgacccuccugccucagccuccuacagugcugggauuacaggcaugagccaccgugccagcugacagugucuuuuaagaaaggaaaucuuuggccaggcgagguggcucacgccuguaaucccagcacuuugggaggccaagacaggcggaucacuugaggucaggaguucgagaccagccuggccaacguggugaaacccugucucuaccagaaauacaaaaauuagccaggcaugauggcgugugccuguaaucccagcaacucaggaggaugaggcaggagaacugcuugaaccccggaggcggagguuggagugagccgagaucgugccacugcacuccauccuggggaacagagggagaccccgucucaaaacaaaaggaaaucuuuggugaacugagacccaagcucccugcccuccugccuucaggugcaucacacaccuaggcaugaacguuguguccugagaggacaguaccccagccacaggacacagggcuguccuagaacuucuuccagaagaacuuccuucccagcccacccugccccaccacccgguccaccaaguccauccccuugcucugcucaccggcacagcccccagggugaccuggccccuuggccccccaggcccccagcaucacauucuguccaugcuuaagcaaucccaaaccucaggcuugcccaucuccccacuccaggcccagggcaaugauaaagaacaucaggcccaagccugacucugcauuuuccacauuugcugcgcaaccccaggcacggcccuggcccucucugagcccugguucugcauccacccagugaacguguuccaccauaccucaggucauagucgggggcccaccagcauuaucuggcccauaagugcuuucguuuggcucacacaguggguuucucauuuuaaauugguuaccagcaugcauaaauugaaaacguucacauaaaaauucagguuuccaacuccuguuucaagccacagagcucuggccacccugagaugucacauggggugugagcucccagguuccccaagucgucugggcccccccaaaugcaugcagcucagaguauccuggugcugucugaugguuguauguccacucaggaggggaaaggaccaucugggaugugucgagagggaguggcccacguggugagggggcccaggccccuugggguggcucaccugggagaauagcagaccucacuguccucacaucuccacagcugcucccaauggggcguguauguguggggcgggaggugggggcauggaggagauggcagaugucagcuccaaguggagaacacucccuccagggcagggacugaccaggcugcugggaaggagugagcucccuaucuaucgccagagauaagcaagcagggcuggggacacucguacaagagagaagcaggagggcacagucucuacacugcagggucacagaaucaaacaugccccuccugggagcuccagcugaguuuucccacaaccccggcuucugcagacagcucccaccccucagcaaccugaaaaaagaagccccuggagaugggguggggaaggaggccugaccucccugcggggggacagucccagcagucagagccuggccagcaaacaaagccccugggacuggcugcgguggccagccaggcagucacacugcaccaagccagcccucccggguggggacgcaagaaacaacaagauacaaaguaaaaccacugcagccucucccuugcacccaucaggaaggcaaacacuaggauagugguauuauuaucauucuuaugccacuggccgaagugucaccuggagcagccucuuugcaaggcaguacccaugugagaauucagcacaugcacuccaugacccugugcuucugacgcccagugugcgacucagagacgucuguaccagguccauauggccccugguggucaccgggcugccaucuggggacaggaaagguuggcagguggaggccaccgggccagucacuguccaggcuggccucaggcugcaacccuaggaggggugaggguuggcaacugcuggcauuuuuaaaagaugaacgcuuuacguaucaugugcguaacauauaucacggcauuaaaaaauaggcaggagacaggaucuugcucugcugcccagacuggucucaaacuccuagccucaagcaaucacccugucucggccucccaaagugcugggaucacaagcgugagccucugcgccuagccauuccucuguauuuggcggcccauucuucacaggaagagccaaaaugacaauggacauuuaggugacaaugaggacgucaagccaccaugaaguggcacucagcacuuagcaucugggagugcauccagcacugugagcaaggcuuugccaccggaguggagacacaagagcaggcuccagacaggaccagcggcagguggggcuaucacagcuuuggucuuuguugaucaaaucccugcuguggguggggggaccaggguauucuaaaguggcagcaggguucacaccugggguuacguacucagggccaucacuugaacgugcacagggcaaugugggggcggagagacauucagccagggucuccccagggaguguccagcagggacaggugacucagcacacagugugagucuccuagagaccugcccacuccucacaaggcaccuggggcaggcaggauggggagggagggcuccggcacaucagagucagaagugccucaggauguggcucaggccccagcugccucucucaccuggccacaagcuccucgcucugcuguccugauagggcugggccccaaccuaccacaaaaacaaacacgcauccuauaguaaagcaacacugccuccuuugauaaauuaaccuucacauucauccacagcaggccccagaugaaaccucucugggcuggcgaggacacuggaaggucaaggccaccuggggggacauccccagugcugccacuguggaaaggugggggggucccaccuuagugagcacacaggccacaggauaugacacuggaucaggaaggaaaggucuucccaccuccaguucugacccuucuggcucugaugagauccagcaaauacagaucugggaugugcacaggcaucucagagaaaugauggagaacugucuagcauuuaaggauguccuguacaguauuuggcacacaucugucacuuaucugaaauuccaacuuaacugggcaaccuccauuugaugaggcaacuguagauaagaacaaagucucagguuggcgccaguauggcuuuaaaauuuuuuaaauauuugcaggggaucucuuuuaaaaaaauaauaagcagcuauaucaaaacacugggacuugcaaacugggacugcuagggauggcagcagggaaauaaacacacaagacacucacagacaagacagugacaaagaaacccauaaucaguaccaccuggcccgcuggcugugcccacacggcugcccccgggcccaaguccaagcagagagcaggcacaaaccagccacccagccuguucacacacagauguguuuguggggcccacauggugcuuuauaaauuagcugccaauauuacucauugauaauuaguuuaaaaugauaacauuuaaugucaggacacuugacacugaagcuguggggcccagcaacagggcuucccugggcuaauuuggaugcacacucccuucccauuggcaucguugggcuuccugagucaucucuaccagccugaacacuccaaggccugagcgucucuuguccacaccaggaggagagaggccuggaugaggugggagcuccugccccuccaaccaccccgccccagggucgccuccagaauagcuugguuuccuggguuaggaccugccucuucuauaugugauagaugcugggaguucucacccucuuccaaggagaccaccucuagccacaugguguaguuggccucaguaggucagcugcaucagaauccaacccaacgcccacaguaaugcaagacccauagugcucagagggauaugugagcugcgcacugucuuagacggggcuccccagaagcagaguccgaggcagggacgcuugagggcauggucugucgggggagagcgcucaggagaagggcaaaggaaagcaggcagagccagggggagcugggcaagacugcaucucagcuggaguccagugacccacgagaagccaugcaguguggggggcaccccgggugcaucccacucagaggcaugucagucacuggccaaagaccauggagagugaccucccaggcacuucacggggaagugacaccugccagcaaagggcaggcagcuggagaaggcacaggugugagccaucagcagccagcaccuguggccgcugggagacaugugcaccuccaggugagagaccugggugggcacccacaguggccauggaguuuacugagcacagacacacagccacacaccaggcagaggcagggaagacagccugauccuagaaacuguccaaaaaucuacccuuaauuuauuagugggccugagaccaccugaggcccagaaaguaauuuuuuaaaaauaauauuugcgcauccaaguucacuacaguguuauucaugauagacucgagucacacggaucaagccaagugaccaucaauggauggauggauaaacaaaauauuccauacaaugcaacauuaucagccuugaaaggaggggcauucugacccgugcugcaacacagaugaacccugaggacgcugugcuaggugaauaagccagacaccaaaggacaaauccugugugauuccacuucuaugagauaucuacagucaucaaauucagagacagaaaguagaauggugggugcaggggcuggaggugggaagcaggaggaguuccugcuuaauggggacacaguuucuguucaggauaaugaaaaaguucuggaaauagauagugguaacggcugcacaacgugaacuuccaugaugccacugagcugugcacucaagcagguuaaaaugguaaaucgcagccgggcgcggccugcaacagcagcacuuugggaggccaaggcggguggaucaugaggucaggagauagaggccauccuggccaacauggugaaacgccaucucuauuaaaaauacaaaaauuugccaggugugguggcauauaccuauaaucccagcuacuugggaggcugaggcacgagaauugcuugaacccaggagguggagguugcagugagccaagaucgcuccacugcacuccagccugggcgacacggcaagacuccgucacaaaaaaaaaaaaaaaaaaguaaacuucauguuacguauauuuuaccaaaauaaaggacaauaaucacaaaugugcacuguagagccaaacguaaauaaccaaagaacagggagaagaaagggaagaagaacugcacugaagauggacaggaaauaagggcugcuccugagaccuccccuuagcaguaugcuuccuggcagccaaagccaaaagggaaauuagagggugacccggugcuccuucucugauaagaggaagucaucuaguucacugggaaaaauaaacuugcucuuggcacaaagcaucaaguagggauuuuagcuguuaaucaaguucgugucuaacuaucacuuccucagugccaacacaaugccaaucacuggacugugaguuuccagggauauuuauuuuccuuaaccauuuaauaccuacaaaugaggaaacugaggcccagacagaguaaaugaucuguccaaggccacauaaguaguaaaagguguggggauuugaacaggucugucuggccgagaaaguugagcuagaguccuuuaguuugcagcuauucaucaaacaguugcuaccggccagcccacugcaggugcugggauauggcagcgaacaagaugaaagaaaguccuacccgcaugcagccaauguucugauggggggaagagauaagggcguugugacagagacagaccgcaugcuccuuuggcaagaauggucagacgaggaggccuaggaggcaaccuacuugcugauaucaugcaaaaaugugguggccaugcaaagaucuggggaaugguauccuaagcagcacuaacaguaugugcaaaagcccugaggcagaaaccagccugacacacugcagccggcaugcagggaaggaggaagagaguggucgcugggaagugagcagcacaaagaaaaaugauagagguggcggggggguggggacacacaucaaggaagaagagaugccaaggagagggcgaucagucagucacugaauccggggcccagggaccucagcaaaacaucugguacauuuaguggauguugucccaacaggguggcagggccaccacuaggucacagcacacugggaauucaagaacagacuguagacaccccuuuugagaaaucugggacagauuccagucauaaaguacaaaaccuggugaaaucuaagcuacaucauuuagggacugcaaauguaggaaccagaacuagaaagucaagcaggaguugucaccaucaaagucuaguggccaguaagggaaaucagaggaccuaugggggcgggcaguauccucuugcuuugcccagguggugguuauccaagaauuuccucuaccacccuacaccgacuuuuagguacucuuuuguauguuuguguuuuuuucccuucaaagagacucuguaucuagcuacuugggaggcugaggcgggaggauuacuggagcccaggaguuggaggcugcauugagcuauaaucacaccacugcacuccagccugggugacagagcaaaaccccguaucuaaaagacagagagagaaagagagacuuuuuaaagaaaauaaaaaagaaccauugcaguaauccagaaaaaggaaacaaaagccagagaagguguuggcaggagaaacggaaggaagggaaaugauucgaaacucacaaauuaucagagcaaaguaaucaaguuggcuucaaucuugaaaacuacaguugccuucauuuccucgcgggcaaaugucuuaauaauagcacgaugugcaaaagaccagaagcuuggcugcgaggaaagggcuaccgggccaggaggaugaggagaggucugugguccuuucuguugaacaggugaggcugaugacacagguggguggugugagaccccaaggaggaggagggagacagcagguccagggcaagcccuacacgugaaguacagaccaagcuguaggccgcagguggggcuuaggguaccaggugccccaugcuccucacacgcucacuggucacugggccuuccuucaacagggugagcucaugaaaacccugggaaaaauaaucuuucaaguggaacagccaggguuuucuccccucccuucccucuccucccuaaaaaaaagaaaaaacaagaaaugaauaaaaagcucccuaaauuuuagguaagagcugacccuacauacacaaucacuaaucucauuaccaacauaagcacgugaaaaauuacaaagauuaauguccgugacuuuuaaucaaccuuugagaaagaaaauguugcuuuuggcauugaagggagcugguauuuuccuuccccacaaguuacuccucugcaaagaggaaacacucccagggugggagcgaugagaaaugaggcugcccacggccaaggcugagaucaccacccuccccaccuggcgcuccacacacccuccacccgacccuagaaggaggcacacccaugccccgccuggggcggggggaguccuaauccccaggcaugcuccacauggucugcuccuggaccgagauccugccuccagggacugcucaucaccucucaucccugcuccaaacccugaaugguucuccaucagcucuggcccccuggagaaugugcaaaaagcuauggauaauacacacccagcuccaccaaaaaaagcacauaaugaaccaagcucugcagcgacacugggugguuucugaccaccuggcacauauucagccucuuuccaagaacagccccuagauuucguucuguggcccuaucacccugcuggagcuccaaucagcacuucccauuccccuugcaacagcaccugacucagagauggacaccaggacaauuagagacuauaagacccaccucagguaaaacacugggcaaacagcuucucucuuuccuacuguauuagacuaagaugauuuaacaucaaggguaccugaagccaucuugucaucaaguggagaccaucagaggcuggcaccugcucauaaaauacacaaaagccaagaaagagaaacagggucauagugauagcugccuggcaccuggauccagccaugccugaagcuaacugaaaaacugaacuucacaaugacaugaaccccuuuugauuaaccuaacuuggaccagguuuucugucccuugcaaccaagagccuuaacagacauaugggcacauaccuaaaacugcuaugugagggaguuucauagacucccugcaguccacucacagaccccuggcugaaguccuguggcccaaggauaaagaaaaaacuccuaacggagacauucaaagcccuucaccaacuaaccccaccuagcuuuccuaacccaucccccucuguuguccuccacaaacccaacuccugcuaaacuggaaaacucucucuaguucccaaccccuuaucuuucucucaucauuagcucaaccugcgaugcccucucuccugaaacucuccuagaacccugaacacccaaaucccaccccaugcuuuaaagccaagcccugagggugggauaaguagguagauggaugaauggguagguagguggguggguggguggguggguggguggauggguggauggauggauggauggauggacgagugaauggauggguggcuaaaaaaguagguagguggguggauggguggguaagugaacagaugggugggugggcggguggauggauggguguguggguauauggaugggugggugaguggagagggguagauuaauuaauccguauggcccgagcacagggcuggcagagaggaugggaugaauuaugaaugugaguaucccagaagggccuucagaaacagaaaaggcuucccugaagucaccuggcuagucacuggcuaagugaccuaaacaaccaagguacguguccaccuuucauacagaggcacuuucacuccugcguccgccuuuuagucucacaaagggcugagauccuagacuuggguggcgggguggggggaguggugccagcaaaagacaggcagagagagacacagagacugacagagacaaggaaagagauccauuagugagacagaaagagaccaagacagagauggagagaagcacagaccgaaagccaagcagacagccagagacagacagcgauggagacaggcaggcggggccggccuacggcagaaccaggcucccuuggccaccacagcaucuggaaggaggcagcagccaggggagcgggcagcccagucucucugcgagucccucaggccuuugcugugcccaauuuauuugcacggcccugaaauuuaggaauuucucagggcugccagugaggcggccaguguacaaccaacagcggggucuggcccagucugugguauaaccguugggcucaagagccuuggaggcccccaaggcagucagccccugcugccaaagccaagggagacagccagcaggaccaagcucuggacucccagagaucagagcucaaauuugaaccuagcccugccacuaggcugcugggcaccucggagcaugugacccucugagcagcaaugcuuucaucugcacagugggucuaaucacugcagccuuucuccucuggggaaccccccuucacacuucaggcuacguggacugcuggauggccaaugagaggagucccugccccauccacagugacaggucagagcagucacacgacccagucacauggcccaugcugaugcuccugggaggaggcugccuugcuccagagcuucugagcucgagggugagccuggagcugcuggggcaccugaccaccacacggcagagccugccugggaguauggaacacagagaacagcagagcaagagauggagacccgguccugauggcaucugcagaggcccuggauacagccaugccugaagcuacacccuguauuuuuuuaguuccaugacuuuuuugcugaaauuguacuuucuaucaccuguaaccaaaauuauccugacauuugugaaaacaaagaaagaagaaccaccuucuuguauucauggcugacuuaaccccaaaaugucugaguugcugggguuaugugucccugcaguagacuagaccccuccuagggcagcaggcugccucgcucaguccccaggcucagggaauggcuccagacaugcgccuggggccacaucaacgcaugaccuccugacccuccccagccacagcugacuggcccagggcagauguucuucccaggcugggcuggucacagcuccucccugagcucuugaaguggaaauaaaagaaagcacagaccaccugcagaggaagaaacagcaaguucugaaggugggcacauuuccugccauguggcgggccucauuucgagagaaucaaccaggcucacagagaaaggcagagacaaaagaaagauggggcgugagggaguccugguggcugcaacuugacccagggcugacagaucacuaguccuuccaggaggauguaguggggccccuacgucuccugaauagccucagacacagacaagccugugcaaaggggccccugcuuccagcaaugggcaggccaacuuccgaagucacugugggggaccaagcccaggucauaggugggcuacagugucaugugcugaugcccaaccagacccugggaaccccaacgucuagggccaaagaggggucacuccucccaucccaugcacaggaagccauggccuccccaccacacccugccuuggggucacacagggacuggcagcugguguuacaguguuuccauccucagcaguucauuaaaccagucuguuacaggcugaacaucuguguccucccuacauuucuaugugaaagcccugaccccagugggaugguaucaggggguggggccccccauuaggagguuuagaugagguuacauggguggagcccccauguguggauuaguguccuuacagaaagaaagaccagagcucacuagcucucccucccucccucccucucuucccuucucucucucucuccguccgccgcuucccaccccccaccuugugaggacacagcaagaaggcagccacgugcaugccgggaagaaaacucucaccaggaacgaaaucuagggcuuagacuuccagccuccacaacugagaaauaaauguccaucuucaaucuccuccccgacucaucugugacauuuguuauagcagccggaacccgccaggacagucuuagggcacggagcugggggcacagaggacauggccacucccugagagccagacacuuggucucagagaagacauuccugcuagagggcuggggccuccuccaucaaccccagccuagcacgaaacaugccaaggcagccccaggagaugugagguaugugacgccccuaccacaggggacuuccugggcagggauagagaugacuguuccaaggacagcugauuucagggacaagcaccaacgcucggugaucuugugaggaaauguccccgcgaaucccucugaaccaaucuggcuauuggagaccgucucuagacagcacgggugugccucccacaccucucagacgcuugccaaccauucuuuuuaaaaaccagggugcugggcacaguggcucacgccuguaaucccagcacuuugagaggccaaggcggguggaucacaaggucaggagaucgagaccauccuggcuaacacggugaaacuccgucucuacuaaaaauacaaaaaauuagccaggcaugguggcgggcgccuguagucccagcuacucgggaggcugaggcaggagaaugguaugaaccugggaggcggagcuugcagugagccgagauggcgccacugcacuucagccugggcaacauagcgagacuccaucucaaaaaauaaauaaaugaauaaaaauaaaaauaaauaaaaaaaaaacagggaacacucacucgggcucaaggcuguggcagggcauacaagguggcuaagaugcuaagcacuguauuuuuagugccauauuuauuuuuauggguauugcugguuuaggacaagugauccugauuucugucuacaguugugaucaaagguuuccuuuaaaaguaaguauaagcagccaagcacaguggcucacgccuguaaucccagcacuuugggaggccaagacagguggaucaccugaggucaggaguuugagaccagccuggccaacauggugaaaccccaucucuacuaaaaauacaaaauuaacccagugugguggcacgcaccuguagucccagcuacucgggaggcugaggcaggaaaaucacuggaaccugggaggcagagguugcagugagccggaaucgcaccacugcacuccagccugggugacagaguaaaauucaguauuuaaaaaaaaaaaaaaaaaaaaaaguaaauauaagcaaaacagggaagggauuuuuuaaaauaacauuaaguuauuaaguaugaugucaaggacaggagguaggaggaugcagccgaaaacacgguggugaaacucauccucacucugucagaaaggaagcugacacccucuggcuuauuccccaagaaagugcacagguccccguagaagcccucugccucuaccagccccauaaucagacaacagccaucagggccccugggaugcccaugggccaaaacggugaaauuaauuuguuuccacagccaugcaggggagcagagaugagggaggacauugagaugcucagccaacaccaaccaccacgaggacuagggaaguugucuaagaaaacacagugaugagcgagaucuucagagacagacaagagacagagagaaagagagaacgugugugugggcacgcgcaugcaugcucaucaauguuuuuugacgauguguuuucauuuugaggagacucuaagaagaacagaacuuucuggaucaucuaaaagcucaacuugggaccaagguuggggcugggaauucagggccaggaugggggucccaggcuaaggagggaagaacucugggaggcuuaucaagcacugggguaccccgaucacaagcccaagggcuggccccaacacagaugauggugucuccguggccagaagacagaagccacgggagacacagguggcugcacucagccacacucaagaaccagcuacggccagcagcacuguccgccuccccagagugggccuggggcucuccauucauccuucagccuucacaccaacccuacugggggccccuaccaccaggcccauuuuccagauugagaagcuaaggauaggagacaaaucccucaugaugcaggcuccgggggcucaggcccaggcaaugcucaacucccacggugcuccccacgcgcccagcugggccucaucacacuucagagcccuccuccuguuucaaggcucuuccugggcaacaaugucagcauagccaggggggcgcccccgauucacagaugagcaaccagaagcccgacaaggugugagaccugggacuggcagggucugccugagcacaugggugcuccccuccacaucccuggcccggcacagguggguggcaccacuuccucaccagcacacagaccugggcgggacgcacuggccgccuacaauacagccccucucaggaaagccaggcuccccacccucgaggaaggaaauaaccuuuccccaaaccagcacuugcuuugcaacaaucuccauauaugaggggagagagaggcauuucugcaacguuuccaaauuccaauaacugaagacaauggcacaaaaugacgcacggcuugacccacgaggggcccugggaaaggacgugcccagcugaggcgaguuuguggugugggcgugcaguggugccccguacacgagggcagcucgccaggcaggaccuggagguggacggagcuggcucccgucccagcucuuccuccucagucgcuaugugacugcaggcaagcacgccccacucugcgccucaguuucccggcccugucacucucacaggucucccaccugccgccuuguccucuccaggcccacuccuacaccugggcugcagagggacccuucaaccucacagucuggccgcgccuccucugcucggaacgcccugaggcugccuguugcucgcucgcagaccaggacuggagggccuccguuuucagggucuaguuggccuugccagccuuacuucccacucuuccuccaagcccccacucugaaagaagccaggcuuucuucuguccccaggugccccucaccccuguaccuucauaucacagugccugcgccaccuccaggaagcccucccugaccacccaggcucagcuagaugccuccucaguucccauggcuucagcguucuccuccaggauggccccgacaaagcauuucagagcaacccaugcaggcaccccuggggaugaccuuaaaaggggcccuguguuccgcuccucuguacaccagccccuggcacagcauuggcccacaccagaggcuacugccagcacuguggggugaugaagagaauccaaggcccugggcacacucccuggcaaaggguuucauagagcugcuaaagcaggaacgccaacuccagggagccccucccuggccgcccccacacaacacccagucacagcucccagcccucccgaggugaagccacaaacccacugcucccaccacccuauaaugccuggcuggagguacagcccugugguccccucugccccuguagcauacaggagcagcgccucugucuggucuauugggaggguagaccucugcagccccagcauucagaaggcgcccuggaggcagagcugccugcagccacacggacaccugcaccacccacacucggggaccuggggaaggaaacuggaugacagagggcugcuaaggaccagaagccaugcaugguguuuacguccaccaccgggcaggacagccggccucacccuggccuccccuuucacucacuccacuuccaauccaucaagaaauccuggcagccccaccugcaaagucaguccaaaucugaccacucucaccuccaaugcugccacugcccuaauccaagccccaacuucucucaccuggaagcugcauggauccccacagcugcccuccagccuguucccugccagcagcagugugggggaagggaccuuuaggaucucaauuagaccccaccccuccccaaaccagaauccaccagcagcuccucaucacacccaaucaccugcaccugcugugagugaggaucacuugaggccaagaguucaagaucagccugaguaacaaagugagaccucaucucuacaaaaaauagaaaauuagcuggcuggugugcgucuguagucccaacuacuugggaggcugaggcuggaggaucacuugagcccaggaguuugaggcugcagugagcugugaucacaccacugcacuccagccugagagacaggacgagauccugucuuuaaaaaaaaaaaaaaaaaggaggggccgggcacgguggcucacaccuguaaucccagcacuuugggagacugaggcgggcggaucacgaggucaagagauggaggucaaguggcugugcaaucuucaccuuaggcccgaauuugcugcagagaacccaguuucacuuaccaucagcaugccccaagcauuuacgaagcaccuauugcgugugagguguggaugggcucagggcacuccccccacggccaaggagaccaaguccucccacuaguggcucaguaagaggggcaaagagcuuugcuuuggagggaaaagauccugggcugaaccccagcucucccccuugccugcugggaggcccuuucucuaccuccccuuccccgucucuuaaauaggugcaagaguuccacccugcaggagggaugucgggaucugggaagaaaagugaugaauaaagccugccucggagaaugcucucuggcaugagcucuugcuucacgggguccccauaccaccgucccccacagccuagcaggaagugucugccaccaucacaaagaugcccuguggcccagggcccugggcaccacucauugcuucaacgacuaaggccucgaaggguaggaggcccgcccagggcuuccccagccaugcauggaggaccagccugggccuaugcuugaggcgggcaauggagcaaaaucagcccaaugcaugcagcagucacagccgcacaaaggccacgcaggccaggcaggagcugagaaggcaugagagggccagguggggacggggaccaaacagcgccccugccccauccccuggguugggggugggcagcaccagccaggagaugcagauccugaacuaccagaccuugugacuuuucaagagaagacggaaauccggacuuuuacgugaaaacugccaauuuguaaaugcaggcagcuaauuaauuuuuuaaaauaauaauaacauggugagagccaaacaaaacaugcagggccagccacagccggggcuggcagguuugugccuccagaauaagauucuuugacuucauccccugcucacccccaucacacagcucagcugcagaaggggagggcgggaagucaagggugcaccccaggggaguagcucccccucccucucuuccuccugcuggggagucuucaccccauuuggcauauggggaaguuaaggcccagagccccuaucagccacaaacacacaccagcucccaauccaugccaggcugagggaacacuucucagcugccacccaauucaucagggcucccucugggagggcccggaccagcaucucaggggcaucaggguagacacaagcacccaaaccauccuguuugacuucccuuuuucucuuuuuggccugucaggggacgccugcuggcucaggccugcuugggacuggcccaagugaucacugcaaagcugauaugggcaacuccuuguggcagcaaaaaagggagggagggcaccccuauuucggagacuggagcaggggaagggagagaggaugcacggaggugaggagucaggcccagccugaggcugagccacccccaugcuccccacagccacccaggucccaugguaagcagccucugucaggaggaaccaccucccuccuccaaaaucggcuccccacccccuaggacaggggaggacugcccauggagugccaggggggcugggacugugaagucgugggggucugugacucguaugugagacucacaguguguggcacucccaguguuugugauuccagguauuugaggagcacacgcaugugagagacacaugugugauacauaugauggagauaugcaugugauagcuaccccuguguggcggacgugugugcgugucagagggcaguaagggcacauguguuuaucagagacacaacugucugcuagaggcaugccucggaggggugccaaugugcaaggcauguguguguggagcauugugugcuaaggggacgugagaugagugugagagauucuggccugggggagcuggcggggugagcauggggcugggagagggaggauguggugacaggcagggugggcgcgccaaugcagagcgugcagaaacuucugcuugugugagugcguguguggcggugagugugacuugggggugauggaggggguaguguuagaccagggacucuagucuucuuuccccgaggggguugacccggcccucuggacuggaggggcggcaagguccugcggucggggugggggugggcagugggaccagaggggaugacuggugggagccggcccaggggggagaagugaaacccagagcggaggaagcugcggaccuggggugggggaacccgcccgcggaccccuggcccccaccccgcgccggccucugugcccgcaucuguacacugggucgcggcgcucgcgggccguccccgcgcugggaccgggagagcgagacccggucggaccggcggcgcggguggaggcgcgggcagcccgcgaggcgcguccgaggguccgccgagccgucggugcguccgagcgcccccgaguccugagcugcgaggcgcggaccgacggggaugaguccgggcgggaggggccgcgugcacucaccgcggggcacugcgcucggcguccguccguccguccgcccggccgucggcgcgucgagagcccgggcggccccuggcugugugcgcgcggggcggggcggaggcgcgagaggcgggaccagccggcccccggcccccuccccugacuccgccuccgccuccggggcggggucucggccgcccgccggagagggggccgggccggcgccgcucgcucagagcccagacucgcugacccggcuccuagaggccgcccggcgcgcucgcugcggagcccgcacccucccugcgcccggccuaaccucugagugccagaccuggcacugcugcccacagggcagggccagggguugggguccggccaccucagccagccugagccucagugaucaccccuggaagaugggcccagcagccuugggcacauugugagggccugaggggcccggcuacaaaacugcccagaggc

SEQ ID NO: 14794 - RNA, 524 nt, Homo sapiens
gauggcgccgaaagcgaagaaggaagcuccugccccuccuaaagccgaagccaaagagaaugcuuuaaaggccaagaaggcaguguugaaagguguccacagccacaaaaaaaaagaagauccgcacaucacccaccuuccggcgguccaagacccugcgacuccagagacagcccaaauauccucggaagagcgcccccaggagaaacaagcuugaccacuaugcuaucaucaaguuuacgcugaccacugagucgccaugaagaagauggaagacaacaacacacuuguguucauuguggauguuaaagucaacaagcaccagauuaaacaggcugugaagaagcucuaugacaaugauguggccaagggcaacacccugauucggccugauggagagaagaagguauauguucgacuggcuccugauuaugaugcuuuggauguugccaacaaaauugggaucaucuaaacugaguccagcugccuaauucuaaauauauauauaucuuuucaccauaaaa

SEQ ID NO: 14795 - RNA, 1323 nt, Homo sapiens
aaauguaagccaagauuuuucucucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagcc

SEQ ID NO: 14796 - RNA, 18684 nt, Homo sapiens
caugcgcagaaacacugggcacagggggagguaacugcaguaagucccgcuuggcccuggaguccacgcggauuuucgaagcuggggcuggcaagaggccgcuggacaccacgcuccagucgucagcccacuuccuagcugaacagcgcgaggcggcggcagcgagccgggucccaccauggccgcgaaugugaguauccccgggccagccgggccacacccaggcuuccccgucgcccuggggcuuuuccccgggguccucuagguccauuucgccgccuggagcuccuccgugcggcuaggcccgcaucucccucugcucgccgugucugugccuucgccagcucaucccucugcucaucucgcggccuguccaggcuucuuuuguccguguuccuuggcucgccucguccucggcguucgugcggaggcggacucggagguguugcucccguacugggaucugcuuguacgccucuccgcggccccuccuugcauucccaguucccuccuguaccuuggggcccugaaacuugcgcauuaugagagcuggacgcgaccucagagagggcgccagucccuugggagggaggaaggcgauccagcccaaguggagcuguccagcaauggacagacagggcuguccaggcgggcagagagcucuccgcccuagggagucucuguaaaccgagucugugaugcuccaaaaagcuuaggcugggcugggagcgaaggaguugggggagagggagcauuucucuacugucggggccccuccucccccuagcaaggauuugguuggaggaggccuggcugagggcuguucccucaaggccucuucucccugcaacuagccuuucucgggaaacuauuuaagcccaacauucauucaacaagcagcgccuccuaccagggcgcugggugugggagaagcuggugacucaccucuccccuccucugugaaagugcuucuagggcccgcuuaggagcccagccagccccagacacacccucccuccugcuuugguagaguguccuagcagcucuccccuugccugucacacccuauuuccagacaccgccucuguccccaagcguccucucugccucccacaccccuugagaggccagggugugcaucacccacagcccuaguacacuuugucucggguuaguaucauccacacucccaggacauuucgggcccacaggaggguuagaagccuugaauguuguaccuagaaaagccucagagguauucggagagacucaggcucggccaggcgagagggcagucaggagaccagccugucuguaguauguggacucuuugucugcucccaucacuaccaccaccauauuuuacagauggggaacuucccuagcaggggaaggcacuugcccaagcucucguggccggcuuggcaugcugugacacggaaauaugcugaaaagggcaggcuuuggaguuagggagaccugggggcaauccagauucuuccacccaguagcuguguggcuuucaucucuccagguuuauguagccucauggaucaguuacugugauauuuaagggagacugcuuagcacagugccugaugugugguagguacuuaauacuugaaaacaagccuguccuugcaggguagcacaaauggucccaguggauagagaucaucuuggguacauugagaccugaccccucaccaaggaauauacaugcauuugaguauucucugcugccaagcauuuuuugauucauccaguagcugaguacacauuuacagcagccacuaggcugggugaggaagaagauagcgggauggagcagggaggcaacaaaauucucaaucaguacagcagcagcaguaccuguggugaagguacuauuccccucuccacuuuauaagugaguaaacagaaucagagagguagagcaauuuacccaggcuuacacagcaagcgauuggugaaccuaggcaucaaauccaguucuguccauuuccagggccuaugugucagccucuguucccaccacucauugcucauuucuucuaaguccugagugcuaggacugggaggggaugugucacuggggauguccgucugugugugcguguguguguguguuuauauaauguguguauacauguaauacauacuauauguauauauaaauauguguggauauauagauccuuuaugauccuccauguuuacugggaauuuugguucagaaugugggcuggguuugucaugucacugcccaccucaccccuccccuagccugaggggcacccuccuguaccucucuuccuucccuccaaggccgucuuugagccccuuaucuugaugcuggcugaggggaggcccaagaggaagacacgccuuauuuuccuauugcugccugcagcuggcucccaacauucagcucacauuguagcccaagagauggggagcacagacuggaaugaguaaugggagaguagccuccagucugcccggauuugaauccuaacucuuccucuuagaagcugugugaucugggaagaugacguaacccugagcccgauuuucuuaucggugaaauggggucguuaugacaucccgcucuuugggcuugccugugggcuggccugugauagacccgguguguuugccauugucaucauugugauggucaccugccccuauguggugauucacucaccuaauguuuccaaauggcauggaaagucaagacgacuucuggauucauggacaucuggucacuggaggccuuggcuggugguacucaaagacaaucagaaugcgacaucagcuuuguucaagcagagauucugagucaaaucacuccucuggcccccaauaccaggauggggccugucuuagcugggccccacuuuacaucuuugugacuuuugucagcucacccccagccuggugccagcccaguaucaguuguagggaaaucugguaacauuucuacuagcuaacacguguccagugcuuaccacgcccuaggcccugagcuacccaauaacuguguucuuugguucucaccacaacccuaugcacagaggaaauggaaggcacaaaguggugaaguugcuugcccaagaccccguagcugguauguggcagagcauaaaugcaaacccaguucuucuggcuccagaauccugcccuagacgaugacacuuuugaucagcaguggaugcaccccaaaucaugccucuguuauugaccaaagccugauccacucacccuugaguuugaggcccacugugaaccugcccagaaaugccuaccuccaagcccuuucuuccuccacugcucccacccagccaaagcagacaggcagcugcucccccagaaccacuuccuacuuccucaucacugcugauacgguucucccuuuagggaugcucuuccccuaagaucugccucuaagauuccacucaagggagccuccuugauaccccagguggaaggggucacuccuugagcaccaaguccacccccaucacaggacccucugugugaccuucuaguauuguuuaugguugugaccucacugcccuaagacugucuacuucugaccccacaagggcuagcacugcccucagaaagcucagccacuguuugcugaauuuaauuaaaaauacaucucuaauaaccucuuuguaaaauagcuuggcaguuucauaaaaaguuaaacguacaucuucuucacgagccagcaguuguacuccuagguauauuccuacgggaaaugaaagcacaugucugcauaaagguucauguaugaauauucacagcagcauuauucauaacagccaaaaccuggaagcugucaagauacccauccacugacgaaugauucagcacacugugguauagucauaaauggaauacuacucagccaugaaaaggaacaaauuccugauaaacaccacaacaugaaugaauugcaaaagcagugcucugaguccaagaagcugggcagaaaggaguuggugcccugauuccauuuuucucaaguuguagaagaaacaaacuaaucuacgguaggagaaauucaaauucagauucuccccauccccaccaguuaccucugguugguggagagggggagaauuggcaggaaaggggcacaaagaaacuuuuuggggugauggaaauauuuuguaccuugcuuuagauguuggucagauggaauauacguuuguggaaaccugccaaacuguacauugaauaucuguguguuuuuaccacauacaguuaaaacuaaaaaaaaaaaaaaaaaaaaaaaaaaauugaguauaaauaaauagcaaauuuaauuuauuuuuaaaaacuaguuuucauucuguuacuguuucuuuuucuucaguauuccaguaccaguacccggagagaacaugucaaaguuaaaaccagcucccagccaggcuuccuggaacggcugagcgagaccucgggugggauguuuguggggcucauggccuuccugcucuccuucuaccuaauuuucaccaaugagguaaaaugucuggggucuuccugugcagagugagaguccccaccaugucagagagcaaaggcgaugaacccggaggcuggauuugguaaucaagggccuagauuuuaaaaagagaaaggaggauacugaguuaaucacaguucuuuccauugugauccaucccacagcugaugugagcaggaaggggaguagaucaguucacacaccugaauauccagggguuagcaccugccucaggcguaguuggauccagguguucaugcugggucaccaggaaucuccauuucuucaucuuuugccuguuuuucucuauuaugguguuuuucuugggcaggcacuucaucugugauggcaaauguggccccagcaacuggccuacauccaaccacuuagcccagggaagagaaaaaccaucuguuucucuuccuuucuuucuuuuccuuucuuuccccucccucccucccucccuuccuuuguuccuuucuuccuuccuuccuuugucucucucuuucucucuuucuuguuuguuuguuucuuucuuucucucccucucucuuucuuuuucuccuuuuuuuuaauagggccucaugaugcaacaguauauuucuaaaucaauuuagcagcaguuacagggccaucucucaguguccuggcuuggcucuccguccucugaaucagucuccguguccagggcgcacucacauguucugacuggcaaggucugggucccauaaucugaccaggguucagauagacucagguaaaccacaugggcugaguaggagagaggagagccaggcauggaggcucaagccuguaaccccagcacuuugggaggccaaggaggcaggaucgcuugaggucagaaguucgaaagcagccugggcaacauagcaagaccccauuucuacaaaaaacuuaaacauaaaaauaaaauuaaaaaaaagaaggcagagaaaaauggggagaaagggacaggcaggcagaaacaucagcuguucccaccacuggggcagugcuaagauuggugggggcuagugggaaccaauggggcaguaggaagaagucucccugggaaagcaggaaucuggguuccaguccuuacucuccacuugcuagaccucaguuuuccaacuguacgguggggagaugggucucagcgcucccggaggccccauccuacccuaauacuuugcaacaagcacagucaugcugagccaccccugagcuguugaaauccccacuccccuuugcucccagggccgcgcauugaagacggcaaccucauuggcugaggggcucucgcuuguggugucucccgacagcauccacaguguggcuccggagaaugaaggaaggcuggugcacaucauuggcgccuuacggacauccaagguagguuuggcaggggaugcugaccugccaguggcucggggcucauccuggauguugucuggcugaggauuugaaagcaugggccuuggagauggucacacaugggagugauucccgacuuuaccacucagcagcuguguggacuugucuauccugagucucagugucuucguguauaaaauggggacgguaaugguuacaagcuuguggccagccuugaggauuuggugagauuagguaacuaacgccuugguacaguggcuggcacucagggaggugcucucaugacucugaugaccauguguguccagugcaaggccacaaaacuacccugggcaccagagcuuuccuguuauuugaacacccuguacgcuguuggcaccaugccauugggccaugcagcccaggccuguacugugagggucacagucacaggcacuguguguaaagaaccugggacagggaguguccucgauucuccccugcaaagcaguguagggcucuccacccuuguccccuucucuauuucuuccucuuccaguccagcuuccccugagccaggcuuucugggcugacgugaauguuauccuuuauuuuuuugguuucuuugauucuguuugaagcuuuugucugauccaaacuaugggguccaucuuccggcugugaaacugcggaggcacguggagauguaccaauggguagaaacugaggaguccaggugagcuguuggggugaaaacucuguugggguaaaggaggagugaaguguaggugucaggauaacaugcagaugucuuucauuuugauaccuuugaaacucaaguauaacaucuuccuaucagaaaagugugaaaugauccccaaauuaauagccagugauuuggaaguggcaaaaauccagugaagaguggcuccaggaggaaagggggauugaguugcucccacaucugggaaguuccagagaugcacaagcuugaagcaugacuuggagcaggccugaaacacugucauuaggaucagcaugucaaccccgagaccccacugcaucucucuguguucagccuucccaucagcuguguuggucccaucuuugcucuacuuacagcuuaucguuucugacaggagucccagggcagguucucauugaucagggcuggggucaccuggagcuggggguggguucagccccaccugaaucauauggacugugaccgacagguggggagguggugggaggagcaggagaagggcagcuucaagaggccccccgcagggcuguccuggagcagaggaugcagccagaucucugagcccaaagggcagggcugggccccuugguguaaggccagugcgggcagauuucagcucaggaugggagagcgcuuuccuccagguagcgccuuggagggcaggagcuggcugucugucaggagugagugcccugucuuggggcugguguagagaaggcaucugccguaucuggggagucugaucugguagcccugagguugcuuccugcucagaugcuuagagauuagacugccuggggcgacgaggcuaacccccguggcugcuuugcuuucccugcagggaguacaccgaggaugggcaggugaagaaggagacgagguauuccuacagugagugcugggccccuuacguggucucugcccauggugggggcccacagugguggcuggacagcagggcuguugguggggccaugggaaggauucagcaccaggcaucaggaucccugggugcaagucuucagagcccugcuuucccacccauccauugaggcucccugacccaccccuuuggcugugagauaggaggagcugggcuggugggucucagccgcgugccacuccuacccgggcucugaguugauuccucucccugagcagacacugaauggaggucagaaaucaucaacagcaaaaacuucgaccgagagauuggccacaaaaaccccaggugagagccaggcccaaggccugagugcagcuuugucuacacuggcaggucuccagccucaguuucuucaucugaauaacaggauugaguuaauccugccucguggguugaaaaugugggacauggguuugagaccaagcccugugcugggcaccaggaacacagagacuugucuccccugaccccagacaagcuccccgcaaacaagucacaaauauaaggccugcacuaagcgucuaaggggauuugcacacacggggccggggaagcauuuuguuaaugguuugccaugggugggaggacaaucaggacaggcuuuccagaggcagcggcauuuguucaggcuucucaggauuucagcagagggagguuagcuccacggcaugccaguggugaggcgggcauaacacuuggguguggcuagagagcaggccuuguucagcaauggucugggcugugccaguaagaugguugggauggaaugcucugggaggggcuagugagggguguaaaguccaugcaagauacaucugacagcaguggguggggcaggacaggcuggcaggggucuaggcaagaggguaggaagcuccggggaacaggagacagagugagggugcucagcccaggggagggggcacagggccccuggggguggacaggacaagaugucugcugcgccugggcuaaucuggacuugcaggaacccccggguggggacccugcccagcacaaacaacccaaagggacccgggcagcucccacaccggugcccaucucugacagcuuccucucucccacagugccauggcaguggagucauucauggcaacagcccccuuuguccaaauuggcagguuuuuccucucgucagguaagucucaggccucuccagaggagcucgugccagaagcacaaggccccccuagggccggagcucccaguacucagccuucagagggcuaaaggcacaggaucagucugcaccuuucccagcaccaugcuuugggggccaggggaaggcgaauccccaggaagcaagggcugacguagaaacccccaccccacuccauccuaccagguuccucugaaaucuggguuguuccagagaaugacucaggcaugcauccucacccugcugcgugccggugucugcugaguagacucugcugagacaguccuuccucaagcagacuccggcuaguaguagacaugugguggcucagugcucucagccuagggcucccccucucugaguuccaccugucccaggaaggcacuagcuuaucacaggcaucccccauugacuccaaagagaagcuugcaagggauaagguggcaccaugggccagaguaacccuggggcucuguuccugggccugacccaugaaggugggagaggauaccaagggcccagauaguccuggggaggcuggaugauccugggccuggccuggccgcuuucugugugcuuuguugcuggauggugccugugugccagcugggccugcccucaaguagcucucaacccaggaggugagucaggcuuggacguggauggccguaaccuugauggaagggaaaagggcuaaggccacucccagugcuguggucacucugacuuggugggagagggcacagggaaagcuuccuggaggagauggucuaacccaggggaagccguggacgagacagagucagaaagaggcacugcaggugggagugccacgugugcaggcuccaggggugcaguggaagggggucaggccagggacuuugcagauugagguuuucaccugguccccuggguuucuaaccacucugguccccucaggccucaucgacaaagucgacaacuucaagucccugagccuauccaagcuggaggacccucauguggacaucauucgccguggagacuuuuucuaccacagcgaaaaucccaaguauccagaggugugcggagaggccugggcucuccaaauaggagggucagggcgcuaggaucagguuccugcgccaggcagauucaguucagucgcaugcacagcugcacuuggccaagugcagcugagugggagaggcccucugggugacggcacagccugggcacggguguggaggugggagaagagccugaggggcguagccgaggcauccuggaccugggccugggccagcuacuccguuccucacucucccugcuucucuuccacccccaggugggagacuugcgugucuccuuuuccuaugcuggacugagcggcgaugacccugaccugggcccagcucacgugguaaccuggcuucccaggggcagacacuaagucagagccucacgacuuuccuggacacagacaccuuggucaaugucaggagcgcuuggacccccuuuucccuggggaaaggcacacucucgcacacacucucagccaggcacgcuucugagcaguuucagagcucccauguccccacagccauccauggaccccacguuaagaagggcagcucaaaaggggucucauagucgcaccuuaugacagguguuccagucacacacagacccucuccccaagcccguuuugaucugucaauaauuggucuugcguuccuggccuaugugcaguccugccccauccccugcucugcgcacugcccaagagcuuugaaugccuggagcuuugaauggagcagcucagccagagcugcagagguggaugcaucccagauggauguauagagagagaagccccaggguuucugugcucacuuccccagccggcacccagucccgggagggugggccauggcucucgugggcgugucucccgcuggucaccccucagcucuaacaccagguccucugaccaggucacugugauugcccggcagcggggugaccagcuagucccauucuccaccaagucuggggauaccuuacugcuccugcaccacggggacuucucagcagaggugagugcugugcccuacucguacgguggaggaacaagcauguccuuccuuccuuccagugguuauuuaauaagaucacacuaccaggggucauagccagugaaugaggcaagaagaagaaauagcggaauguugaguaugccucaucaaaguguuugaccaggaguguuucagauuccagauuuuuuuggauuugcagguauuuguauauacauaaugagaucucuuggggaugagaaccaagucuaaacacagaaucuauuuauguuucauguauacuuuguacacaucgccugaaggugauuuuauacaaugcaacccgucacauggggucaagugugggauuuccacuaguggcgucauguuggcauucagaaaguuuuggauuuuggagcacuucagcauuuggguuuuuggauuguggaugcugagucugucaugaacccucagugugcaggacugugcuaggcacuaaacucacugugccucacagacuguccgguagaggagugagagugacagaaacucguaaguacugaugcaucgugccgaguguuggaaagaggagaacaggugcucugauaccaguggacgucagaguagaacauccguuucugcagugaucaagcagggccucugacaagugaguuuugcugacgagaagggguuaacccuagaagaaucagugaucagucaguuccagcaagaacagcccagucugggcacgaaaggguucaccuucuaagggggcacccggagugcuguggccacagcccagagcggggagagggagugggugggggggcuccaccaaagucuguguccuuccagaacauuaggagggcggggaaggguuuugggccucagcuaccugaguaucccucucccauuguaaauagggagggcuaugccuaccccgggucccaaggagaaggggugccaagaugugcugauuaguucaguucugugccuuaaaaguuagccugucuucucuaggcaggcaauccuucucugcagcagaagaauugagucuuuaguuuuucuguuguugaugaacacagguaucccugguggggcacucuauaccugcccuaaccaggacugcugggguuuucauuccagaguggccagaaagggucaaggcagcagacaggcaucagggguuagcugugaccuuuuguuccuauuauuagauccucagcagccaucugucccauuagccuccagcuugugguggugcuugggccucaccaacuccugguaccuggccagggcuaggguguggucaggcuguugcccaggagcccaguuaccaaccucaggguagggcugccaccucccagccuagaaggccaugagucacccuuccaccagcagcugaggguccccagcgaguuucuaaaauuaggaggcccaguccaggccuugcucucucucccagggcugaggcccagcucacgcagccgccccuccagagaggaguggauggggcccauggcuuagguaaugccccagaaaggaaggcccugcagugcagaugcucaggcggccuccuuacccccugggucuccugcugcuuagcagccccaaagcccugucuucccccagcccagcccccacccccacacaaggucuggggucucugccaaguagaaaaaaggcccagagccaggcaggcagcucagggcaaaagucaggaugccccgauuccagucccaggggcaggagaguacagcugcccaagcaggcacacugcagacggcccuggcacugccucccaccugcuacaggaccuugagcuggugcugaucucucagccuguuuccucauuugugaaggggaagauguuuaaguacuauuaguaauagucacaucaucccuaacugguuuggucauugaggauuauucauucauucagcaaguuuucauugaacaccagguacuucacagacaugcucccugcucuuggaaauguagcguuuaguuaacugcuugaggugagaccuugggcacaugacuuauucucucagagccucaguuucaucaucuguaaaguggagguaaguauuccuaccucacugagugaauuugagaauuaaauaauacuuguaaaacacuuaggacaguaucaaauaaauggugagugauaaaugugaccuguuuuuguuguuacggacucugagagagggcccgauucagaucagagggucagggaaagcccucugaagaaaugggguucaagcaaagcucaaaagaauauguaggaagcuggccaggcaugacugcaggcaaucguuguaggcagagcaaacccacgcgcagauacacaggcgagaggacacuugaccuggacuggggacagcagccagcagggucagggcacuggcagcagggucgguguccgggggguguggcagggcucuggcaggugacuguguggagaacacagagugggugauagaagcagggccagugaggcuccugcgggcagacagugguaagagacucgggaauauguggccuggacuggauggggugguaggggaggagcgagccaugucuuucccauagaugugagugggugggugggugugccaugugcugagauggagaaggcgccagugucagcacuagacaggcugagaugucaaguggaaaugucaaggaggugguggagguggugggagcugcagggcugugaggcccgggagagggccagagcugcagcuuuaaauuggagggucacggcauguggaggccaaggaagcagaugggauguccggggagagaguauggacugaagcagcuaaagaauugcagcaucuaauggacaggaagaggggcagcgacagcgauggagccugagaaggagggugcaguguccccaagccauguggagagguucugagauuaaacagaucacacacauagcgcagagcaugcugcccagcagacauccuccaaccugcucagggguggugggcaggguccugcucauuccaggugagaccgugggcugagggcuccaggugcuggcaggcucugagcugaggaaggcccguacguuccacagagaucucaugccuugcccugugcucugccagaugggcagaaggacuuagcccuauaggaggcuugcccccacuccgucuggccuguucagaaauggccaacagcucccgaguugguacagcccccucaggaccugcccugccgacuggguacgccacuggcccucagcauccugaccugcccccaccuuguccugcaggagguguuucauagagaacuaaggagcaacuccaugaagaccuggggccugcgggcagcuggcuggauggccauguucaugggccucaaccuuaugacacggauccucuacaccuuggguagguguuggggugggucacugcccucccuccugcacccugaaagggccuccucugccugucgcaucaucucagcccuuccagccugaugggauggcccuugugcagauaccaggcauuuggcucaucucuguguccccgcuccauagccuugggaugagggagcagaggaaggcaggcuugagggcaggagcugccaggggccaggcuggguggggccaacucuggggcacuggucucacuccacagccugaagguucguccaucugcuggcucgaucauuugcucauuccuuugauccacaauugaauaccacaugggagccugccagaccugcauuugaaaucugucacguccaagcucuggaugcuuggccguucccuucccaucucagcuucagucaccucaccccuuacaugcagaguuuuaugaaauguggcaaauaggaaacacccaaaacucucaugcuuccuuccucacuccaaaaccugggcuagauuugggcagccagcaagucuggagcaugaaggagaguucugggccacuccuugaccugagguuggcaccagugagcccaguaggagaccuguggcccagcgugguucgggaucugagugcccagggugacuaagugcguucugggcccaggaggaugggguuccucggaggacucuccauccaagccuuucccuggugugugucccuuccagucacaugauugcaucagucuucucugggugccaacagaaaccucuuccccacucagcaugcacaagucagaagaggucuggcugcacaucuugggcugucugagcuggggggaccaccuccuuuguuuacaguugggaaaacaggcccgggaagggaaggacucucccugagccuuucuuuggacagcugaauugugcucagaaagaccagugacguggugggcacauuagcgagagaugagcauuuaaacggaauccucuuucuugccugugugacccuggggagaccaguucccuucuggagccuugguuuccucgugucugucucagugggcccuucuuuggaucucugaugucugugaucccaauucacucuacgucuggaaugcgccagacucaggacagacuuagaguguggagggacccccaggguggguggggagaguugggagcgcagcagggaagcacacaguuccccaugcguuugauaaauaccaacguguguaagacuccacagcuagagacagacaagacuuagagcaacagcucagagcccaggcucugggcccauacggucuugaguucaaauccugguucuggcacuuucuaacaggaggacugguggugaguuucuuaauucccugagucucagugacccuguggguaaaauggaguuaagaagaguaccuaccuuacagggugggcaugagugcuucaugagauggugcacauggugccuaacacaggcaacguucagaaacaugaacuuugcuuauuauaagggcugaguagcagugcuguaugggaacagaucaggaugaggccagguaguggcuugcagggugugcugcaggcaugguggggcaccagggcuugcucugcaaacccagugauuccagaccauugguggccuccugggaacugagcgaagauucccugaguggacaucagcuauggaaugccaaccuggagaggucacacaaggcaagaauaggguaauuccucaugaauuuagcuggauucugggcuuuauccuauuggaccaauagucugugagauucuugaggagaggccaaugcuuaggcuaauuuauuuccucuagcaccugcugguucagugcugggcacauaaaucauuaguaacagccugcugcaugaaugaaccaacaccucuaggaauggcugagaggcccaaauaggcaccuucaggaggcuccacccacagccucuuguaugagugugcaggacccagguuauuucuagcauuacaggcaaaugucuuuauacuggccucagacuacucuccacauaaaguauuaaaguuuacaaagcacugcuacauccucuccccuggaucaggguagaguggguggcuuaggcaaugugcccaaccacgcagcucauagcagaggcuccugugcucccuuagcuuucagaacgaagcuccuugccuuccacccacugauccucuccccuccucaugcauguagcaacaugggcccauccucaucuagggacaggagagaucugcugagcuggugagguguagagcagguggcaccucaucaccuuucuccuuuccacaguggacugguuuccuguuuuccgagaccuggucaacauuggccugaaagccuuugccuucuguguggccaccucgcugacccugcugaccguggcggcuggcuggcucuucuaccgaccccugugggcccuccucauugccggccuggcccuugugcccauccuuguugcucggacacgggugccagccaaaaaguuggagugaaaagacccuggcacccgcccgacaccugcgugagcccuaggauccagguccucucucaccucugacccagcuccaugccagagcaggagccccggucaauuuuggacucugcacucccucuccucuucaggggccagacuuggcagcaugugcaccagguugguguucaccagcucaugucuuccccacaucucuucuugccaguaagcagcuuuggugggcagcagcagcucaugaauggcaagcugacagcuucuccugcuguuuccuuccucucuuggacugaguggguacggccagccacucagcccauuggcagcugacaacgcagacacgcucuacggaggccugcugauaaagggcucagccuugccgugugcugcuucucaucacugcacacaagugccaugcuuugccaccaccaccaagcacaucugugauccugaagggcggccguuagucauuacugcugaguccugggucaccagcagacacacugggcauggaccccucaaagcaggcacacccaaaacacaagucuguggcuagaaccugaugugguguuuaaaagagaagaaacacugaagauguccugaggagaaaagcuggacauauacugggcuucacacuuaucuuauggcuuggcagaaucuuuguagugugugggaucucugaaggcccuauuuaaguuuuucuucguuacuuugcugcuucauguguacuuuccuaccccaagaggaaguuuucugaaauaagauuuaaaaacaaaacaaaaaaaacacuuaauauuucagacuguuacaggaaacacccuuuagucugucaguugaauucagagcacugaaagguguuaaauugggguaugugguuugauugauaaaaaguuaccucucaguauuuugugucacugagaagcuuuacaauggaugcuuuugaaacaaguaucagcaaaaggauuuguuuucacucugggaggagaggguggagaaagcacuugcuuucauccucuggcaucggaaacuccccuaugcacuugaagaugguuuaaaagauuaaagaaacgauuaagagaaaagguuggaagcuuuauacuaaaugggcuccuucauggugacgccccgucaaccacaaucaagaacugaggccugaggcugguuguacaaugcccacgccugccuggcugcuuucaccugggagugcuuucgaugugggcaccugggcuuccuagggcugcuucugagugguucuuucacguguuguguccauagcuuuagucuuccuaaauaagauccacccacaccuaagucacagaauuucuaaguuccccaacuacucucacacccuuuuaaagauaaaguauguuguaaccaggaugucuuaaaugauucuuuguguaccuuuucugucauauucagaaaccguuuugugccugcugggaguaauuccuuuagcaauuaaguauuugguagcugaauaaggggucagaacuucugaaaccagagaucuguaaucaucucuauuggccuggggugccugugcuauaaaugaguuucuucacaugaaaaacacagccagcccaagaugacuuaucuggguuuaggauucaauaguauucacuaacugcuuauuacaugagcaauuucaucaaaucuccaaacucuuaaaggaugcuuucggaaaacacgcuguauaccuagaugaugacuaaaugcaaaauccuugggcuuugguuuuuuucuaguaaggauuuuaaauaacugccgacuucaaaaguguucuuaaaacgaaagauaauguuaagaaaaauuugaaagcuuuggaaaaccaaauuuguaauaucauuguauuuuuuauuaaaaguuuuguaauaaauuucuaaauuaucuucuggugugggacuuuaa

SEQ ID NO: 14797 - RNA, 894 nt, Homo sapiens
ccauggcccucaauucacucugccugacuuugaaggccauguaaagggacccacugcagggcaucuggucuguggcucuggcuucucucacugggcucgguguuuuggagacaaacuccgcugcucccuugguuuggagccucucguagccgguuccuuuucaccugugaguugcaguccuuccaucuguuuuuccauucuauugauagauacaaccagggcuguuuccguuuuggacuguaugaauaccacugccauucacaagucuuugggugaacaaauauuuucauuucuuucuggccaauuaccugagcgugcaauugcuggcucauaguguuguguuuaaucuuacaauaaauuuauaaccuuaucagaaacugccagaguagcugggugugguggugugccuauagccccgguuacuuaggaggcugaggugcgaggaucacuggagcccaggaguucaaggccaguuugggcaacacagcauuuuuuagagacuuugucucagaaaaaaaaagagaaaaaagaaagaaaagaaaagaagagaaacuaccaaauuguuugcugcaauggcuauaugccauagagagucccaggaguggagaugggcugucggggaggagaggaagccagggaggaaagcauccccugcagucacccagaagggagagaacauggccuggccuggggugucugugaagcuggagagcaucugucugcagugcuagugaaugaauaaauguacuguggguccccgguccccugcagagcugucuccaguacugacaccuucccugucuguccaguucuggggcaguuuugcugugcccacugagggagaagaggaagugagcccaggcacuugccacccacagaccacauccugcaagg

SEQ ID NO: 14798 - RNA, 86805 nt, Homo sapiens
gcccccggcccggccgagcugguauuuuuccacccagcaggaugggugaugcugagagcugccugcucagacaacagacacgcgaggucaggaagaagccgcuuauaaauuaccgcuuccuucgcgccgccgccaacgccgagccccgaggaccgcaagcccagaggacaagcugcgccaagagggagugcuggagcuguucacccagcgggucagagagcgagccgggcaggccagcccccggccggcggaacccuggcacagccugagcagaugcugcgggcggcgccgcagccaccccagguaccggagggaccgggagcugggcgcgcagccggcgcugcccgccgucugcagccccuccccauccccgcgucgccgcagucccggccuccuccccuccgcgugcgcccauccggcgccccuuucaccaccgcggaagggaccgagagucgccugcucagucccgcuggcggggcuguuauuguuuccccggcaaaagggcuccggcucuuggugcgggcggcaggagaguguguguguguguguguguguguguguguguguguguguguguguggcauaucugugugccugucuccgucaggaugccuacaugugccuccguaucccugugucuguguuucugagggugacuguuucaccguguccccagcagcgugcacauguguguuccggugcaugucuguuauucucugcgugcugggcugugugugugugccucucugugugugauaccugagugugcugucuuuggaugugugcucuuguguguccccguuugugucugcaugaaucuguguguggggggcugcgucuuccaggcccuggcuaggugcacgugcgugucccugagugugguugugucuccaggucccugguugugggcacucguguguccucggcuguacccaagagggugucccuggugccuagaggguccaauggccagagcugguucuccagggccggcgcugaguggggagaggugauagggcagcguggcuccauaggugcaugcacuccauagguggugugcagguggcagcgccagcguccagcaguccugaguggugggaccaaggcccggaggggcagccaagggguaguggacagccggcagggccagcaggacacuucccccuccagacuauuucucuuccuucuguggguuccucuuuugaguaggagauucucgucccccucccacuagggaagccacacagagagaauuccagggaccuccuccuacagccucaaagcuucagccuggacuucagccuggacuggagaggagaccugugggcagcucucccaggcagggaggugugugccggguagggccaccggccuggcuauuuuggucacuguugggccucugccagaucccggcauccccaggaccagccccaaaagcuugggaggcagccugggcccccguuuccugucuggggaaauaaaucagcucaguaauugcccagacacuugaauggagggucuucgggcugagguuuacuggcgcauggcuccauuuggacuucacuaaauuggcccccgcuuuggcacagcugacguucaaguaaaugucacugaggagaucuuuuuaaaauuucuuuuuaauuuuuuguuggcuagaagggaggggaucuuguccagagucuccuagccagaaggaguuuauuuuuaugagagagagagcgggugagugcuuagcaaccaccugccucccucucgaccagggagucacccagggauuguggggugggcaugaggagguggggugggggaggaauuucaucaagaugguguuggagaggauccaaagggggccuagcacggcuaagaacccccaacagggugggacugguagaauggugggagguguuaggccuggcucagcccccaguugaccuugggcaacccuuuuucugccucaguuuccuuaccuguaaaauggguggggcagacugguuauagaguaaaccagggaccagagguaggagcuuguccccagggaacugauuuaaguccuaugcuuuguuuuaaugggugggugaccuugguugauucccuugguuucuuugagccucggcuuggcugccugggcagcaaggacaccagugccggccucacuacguccuugaggggauugagggagaugaggcugaauaagcuuguaguaagcuguaaagccgggcucggcuguagagcugcugauuagagggugucacgagguccugggucacugugguguauggcaagggccaaggugcauucuggaggcuuuguccuuuggggacacccuuguacuaacccauggcucagcugcaaucauccuccccugccuccuucccgucaccucaaccuguggugauuggaccacaucugcuuuucagagucuggaggccuggugagcaguacccauuuuauagauggacaaacugagagccaccuaagggacuuugccuugacuggacaaaauuaaguuucaaaagguuuucccuagcucagcugugaguuuuggccccauggggcuuuggucacugauauccucgggaguugaaauugaaccggggccuggggaaaaugaggaacaaaggugucccaguccuuagggcaggaaagugagccuaugggacccauuugcaccuugcuucugucccuaguuacucauucucccuuccuugugccuuccccugagcccugcuacccauucugcugcaggggucagcccuccacaaggcaguccgggcucuggggacucuguuuucuaaccugaacuuguccgccugucaguuugucaaaggauuugggagguguacuucucugaaagucuuuccaaaaguccugaaugauaagaaacuugugagucauugaacacauucccguauauagaaaaagcugagaaguaaauuauaagggcuccccagaaugcagcuuagcugcagccagagggggucugccugggaauugggguuggccugaaaucccagggccacccuggcagguacaugcugauuccccacuucugcagaaggucaugagcaagagucagauucuuuggggcugcaucucauuuuccuguguuugccaacuuggccagagcguucguuugaauuuauggguucugggcaggagcuguggaucuggaaaugccuaaggaagccuucaagugagaaugagagcgcuuuuuuaaugugcuucauuuaguugauuaauagaccuugguuaaggucagcucugggcuggcacuggguucaagguagaguguuggcuuucuaggagcuccugucccagagguagaagcaugugguaacugcaauggccauuaccauccguaggauacagugaagaagacccaaggagcagcugagugugcagugagggugggguagugggcaggaggcacuuucgcuuccuagaggacacagugucggaguugccauugucuguggguggagaaacaggaugggcuggcauucuccacagggggcagaguagccacaagggcacaguggcgugaaauagccaagcauguuuguagaacagguuccccggguccuagcuggagagaggaauaggagccagaugguggggaggggggcguuuuauuuuuucacauauaaaaauagagacagggucuuacuauguugcccaggauggucucaagcuccugggcucaggcaaucuucucgccucagccucccaaguguugauuauaggugugagccaccgugccagccggagggccuugaaugcuguguaaguggguuugggcuuucuccugauggcagcaggagucauacuggguuuaaggauaguggggcagaagccagucaagccuggagcccaggagaacccugauggugaguaaggaacggaacugggguccaggagacggagagucaccgagccacuaagcauuuucuguaccaaugagucuugcccugaacucuuucuguaaacaugggggugaaggccuggacaugcuauuuaaccgguacacaggccauuaacuugcuggcuuugaccucccuggagcacacagcccuagugucucuaggugaguuaugccaguccuggacaggucugcggaguuuccuuuccugccuuaccuggucagaggcuucauuuggaaaccugggcagaggcugaugccaagggugggaguuaggguuacgagagggaaagcagagagagugaggaauugcuguucuguuucuaaagcuccagcguuguguggccaaccacccuucucuuggaaaaaccaacauacaaauaauaaaccaccugaaacaaaagaguggggagggaaugaugggggaggcaggugggcugcccuaacuguggucagguaucagaauugccugggauacuuaaaaacaaacaaacaaacauauucagacucccaggcccagccuggacauacugaaucagaaccuccagggggauggagccugggaaucuguauuuuuaaaguuuuucuugugguuuuuuuuuuugagacagggucugacuucguugcccaggcuggagugcaguggugccaucacaguucacugcagccucgaucuccugggcucaagugauccucccaccucagccuuccaaguagcugggacuacaggcaugcaccaccacuccaggcuaauuuuuguauuuuuuguacggaggagguuucaccauguugccugggcuggucuugaacuccugagcucaagcgauccucccaccuuagaugauuuuuaaaaaauguuuuuuaaauugaguuaugauuuacaugcaguaauaugcaaagauucuguuacgguuugaugaguuuugacaaauguauacaccuguguaaccaccacccaaaucaagauauagaacauuuccagcaccucagaaaguugucuugugcuccucaccucacaagacagccacuuucuccguuuucuuuuucuuuuuuuuuuuuuuugagacagagucuuauucuguuucccaggcuggagugcaguggcaugaucucuacugcagccucgaccuccccagucucagaugauccucccaccucacuucccaaguagcugggacuacaggcgcacgccaccacaccuggcuaguuucuuuuguauuucuuguagagacaggguuuugcuguguugccaggcuggugucaaacuacuaggcuuaaacgauccacccuugcgggccucccagagugcugggauuacaggcaugccccaccauaccaggcccacuuucugauuucugucaccauaaauuaguuuugccagucuaaauccucauauaaauggacuuauuuaguguauacucuuuuguccauuuuuuucugccucacauugcugggauccaucugugcuguugaguauaucaggaguugauuuuuuuuuuuaucgcugaguagucucccauuguauggauguuccacaaugcguucauccaugcuguugauggacauuuggguuguuuccagcuggggggcagcuauuacuaauaaagcuucuaugugcauauuucuguacaaguguuuuuguggacauauauuuuccuuucucuaggacuagagcugcuggguuauaagguaguagauauguguuaacuuuuugagaaacugguaaaccauucacuuuuaauuauaaaaguaauauaccucaagcaauacgaaacugcauaaacuaaaaagugauccuuucggaucauuauaaaaaaguacaaucugaucuucagucuguccaccugccugauugacagucuaucauaucucuuucuuuuuuuuuuuuugagacagagucuugcucugucacccaggcuggagugcaguggcuugaccucagcucacugcaaccuccgccucccagguucaagcgauucuccugccucagccuucugaguagcugggacuaccggcacgugccauuaugccuggcuaauuuuuguauuuuuaguagagacaggguuucaccauguuggccaggcuggucucuaacuccugaccucaagugauccgccugccuuggccuucgaaaaugcugggcagucuaucauaucucuuuuuaauauaagguuauacauuucccucugcauacagcuuaaacuuuauccaggugugcauauggacauagacuccuuuuuguuacuuacuggaucaguuuucacuugaguuuugauuuccucuuugauccaggcauuauuugggaucuguuuggaagcuagcuguaguuuuguuuuguuuuuuuuuuguuuguuuguuuuugggacggagucucgcucugucgcccaggcuggagugcaguggcgugaucucagcucacugcaagcuccgccuccuggguucaggccauucuccugccucagccucccaaguagcugggacuacaggcacccgcuaccacgcccagcuaauuuuuuuuguauuuuuaguagagacagaguuucaccauguuagccaggauggucucgaucuccugaccuggugaucugcccgccucggccucccaaagugcugggauuacuggcgugagccaccacgccuggccaguuuuguuuuguuuugaacaaaaaugacaugguacuguucuugguucugccacuuggucuaucccaauagcaggccauguggacugcaugucagaacacacggaucugccaggccauuccaaacagccagccugcauuugggagccacugacuuugcguguccugucugaucacccccagugcugccagcucaguaaaugaaauacccccacccaggacuugccccggagggugcagaggagccggcugagccgauucagcauucugagaagggaaggaacucauauuuauugagcauccacggugcuuuaucccccuuccugucucagagaugaguucaucagaaaaauggguggccccagcccacacucagcuaggaaaggguggaaggagcgcuggacccagaguccaccggaugccucagcccauccucgucccacugaccgcacggcaaacguucaugagugccuacugugugccaggcacagggccagggccaagagggcagggaggaauacacagcaccugugcucaaggagggaggggagaucccuaucaggaggagguuagugaacagucuaagaugguuuaugccaaggcaggccaaggauccagucugggaacgccgccucaggucugagggagagcagccccaggcuguggaguguggggacuuugggguugugggaucauccaguuaaccuucucugcccacccacuuuauggaugaggacgcugaggcccaaaggaggcacuuaucaacacaggaagauaaagccaucaaaagagccauuguuggccaggcacacuggcucacgucuguaaucccagcacuuugggaggcccaggcgggcggaucacgaggucaggaguucgagaccagccuggccaauauggugaaaccccauuucuacuaaaaauacaaaaauuagucaggugcaguggugggcaccuguaaucccagcugcuugggaggcugaggcaggagaaucacuugggcagagguugcagugagccaacaucucgcuacugcccuccauccuaugcgacagagugagacuccaucucaaaaaaaaaaaaaaaaaaaaagccauuguucacagauguggcucccugugcuccccccucccagccgcacccaucauucauugcuugugugaacccccccuugacagggagggauuuaaggaaaggguuaaugccuccaccucaaaccuucggugauauuguucaugacucucacauccugguuuugucacaagucacuggaaagugggugggagggcaaaacuguaucaauugcaaagacuccuuacaguuuggcugcucaggagacacccccagagcccaggaugggguuccuggaaagcucaagaaggagcguggugagcagcucuggccacugcauggaauagaacguggaagguagggagagggcugguggucuccaggagaaggguugggcuggcaauggaaggcuuccucccucagcagguaucugagcaggccuaggcuggaaggcagagggcugagcccucaggguucugcucacaucggguccuugccgacccagaggcucaggaccacuucucugcguggucccuccucaugcuggggugcccugagaggcucuuccuuuccaggacuuuucuuugcacauaaaugccaagugacucacugucauguuccaguggaaaguccuuaacccaaggcugccaguugcuugguuggagguggaggagugugguuggccagcgauuucagcagagucaugcuuacugagugaagggugccggaagggggagguccuaagggacauccucucuugccccaaggcuagucagcaccaugagggaagacucaggucaugauuucaaggacauucauuccuucagagaugacaccugguguuuccucugcagguggacaucacaccagcccaagacaacagccuccucacuagccucugugccuccuggauaccucucuguaccaucuggggaccagcucucugcaugucacucucuugcucaaaagccuucagugguggcucccuagugcuuugugaaaucaaguccaaccuccuuagccuggcauuggaggcccuucacgaucuggcucuuggccagcguucacgcucaccuaccacaacuucuuuccuuguuuguagucuggcugguuucugcuccuagcuagaccaagcguccagcucucucagcccugcccaugcuggucccucagcccgcaaggcccuuccucccaucacuccuuauucccacucuuaaggggcgagcuuggagcugccugcucugggaagcauuccuugagccucuuaacagugccuggcacguaguaagcacucaaaaaagaugacgugaguuaaaguggacuucagcucgcccugcucugagccuugugguccuuuccucuggccugagcucggaccuuuauggucuuaccuuauacccaugcacuugacuggggacacaucaaggggagggauggaugcuccagcauccagccuagggguguggcacacaguuguugcucaacauacaaaucaagagagccuaauuccuucuacucugaaaugggaaccuaugguuugaacaucugaguggcuccaggcuuggaaauuauauucaccugucaccauccaucaauccauccauccaucucacaaauauucacuuguuccaggcccuguccuaggcccuggggauguggcuggugaacaagacagaccaaacuguacccucauggagcugucugucuggcagggcuauggacgucagacaaaagauuacacaugcauggcuaaugcccuuuuaaaaucaaaggcccugcaucaggcacugcaacaccaggcuuagaauaccccuguccucuggcuugcucugugaccuaagugaguccuuucuccucccuggcccuguaagggguggcccagauagguuuuguguuuaagggaaauaccuucugaauaaagggaggaaagaccauucuauccauuguggaagcgcgugccaccacacggggugcuguuccugcgggacuccuuuaaggaugcagucauccucuuggugguuuuucaagauguccuagcccuggcucugaaaggaggugucccgauuuggggacaggaguuccagaguuacucugagcagagcuguagcaacaggcuuuuaguaaagaacguugccucgaggaacaauaauguggauuccucuucugccacugguagaauaucaauuagaacagacuuuuaaaaaaagaaaagcaaaaacucguccaggugugguggcucacgccuguaaucccaguauuuugggagacugaggcagguggauugcuugagcucaggaguucgagaccagccugggcaacauggcaaaaccccaucucuaaaaaaaugcaaaaauucgccgggugugguggcacgcaccuguagucccagcuauuugggaggaugagccugguaggcagagauuguacugagcugagaucgugccaccgcacuccagccugggugacaacagugagacagcaggccuaaguggggccuggggcccugaauuucuaaccaaaucccaggcacuguggacggugcuggucuggggaccacucuuugagucaaggagauaaauagugcaguugugagccuccuauacauuaaaagccagauccugugcuucgucaacuccucuucuuaauccucaccaaagacaccacuauucccauuuugcacaugaagacccgaggcccugcugagggcagguaacuugcccaaggucacacagcugggagccugccggcauucgugcugggccagcgccaccuuggaaagguugcuguuggggaagccuuucacuacugaacaguguccucgcuccaaaagccacaggaggcuuuucaaggcagccaagucggauguaaaucaggggagagcccagggcuagccaggcugcugacagcagggcggccugggucacuguguccggacaaggcccacagcgggauuuggggcuggcaugaugccugggagugggggagccacuggggaugcucugggcgccuggaaaaccagccuggagccugcuggagcccaaggaagcaccuuagccucugacagccucccccauuauuuaaauacauuccagggaacacagcuggcuggaaggggcagugaugggaccacaggagcugggaccugcugcuuccguuguuuaaaggcugguucaucccugcagccacgcaggcauucuccguaaucgccgucugcuuugaggacagagaggucguggucuucugcuggcuggggcuuuauuuuugcacugagcaccuguccucagcaaacugggaaaaguagaacacguagugacucugaguccucaaaaugcugucccuggcccagcaguaugggcaucacgugggagccugcagaaugcagaaccucaggccccaccccagaccuucucauuuagaccuugggggcagggcuccgcauucuggguuuucaagagcccuccaggcaauucugcuuuguauuuaacuuugggaagggcugaugaccucucuggcugugugccuggggccggggguggggcugggggaagggucaggccuaauccuugcccgugauaacuagagugccagggcugcgggaaccucagguguucugucaucugcauccuuccucuuuuuuauaaugggaggagugugucagagacaugcauaaaauuacgcagcaaguucaaggcaggguauaggucuggauucuuaucuugcaaauggcagaaaucaguucaaacagacuucaguuuuauuuuuuuuauuuauuuauuuuugagaugagucuuucugugucucccaggcaugagucaccacacccggccuaaacugacauuaaaaauaaaaaagaacauuuacugacucuuuuaacuuaaaagccuggggccauacuucagccuggggcugaguccaggugcugaaagaugucaucgggacucaguuuccuucucucugucucccggcuccgggucucucuaugccugcuucauucuccauggaugcccuagcugcucaccaguguagugccgcccccugccccaauguagccaucucaaccaagaaagagccuuguuuuuccccaauauuuuuggcaaaaguccuagucaucacuguuuuugaccaggcuggucaagugccuaucuuugagccaaucaagacagcccccucugauuggcuagggcuggcucacgugcccaccuaggaggaggagguggggucaguccaucuagaccccuugggcugagagcaggccuaugugggucuccuccuggaacagguuuaagcuguccccagaaggggcaugggugccagcaggcuagacauauggacuuuagugcuauucuuuuuuuuuucuuuuuuuuuaagagacagggucucacucugucacccuggcuggacugcagugguacgaucacugcucgcugcaaccucaaacuucugggcucaagcaguccucccaccucagccucccaagugggugggacuacaggcaugugccaccauacccagcuaauuuuuaaauuuuauuuuuuuguagagacaggucucccuguguugcucagguuggucuugaacucuugggcucaugagccuucugccucagccuccaagagugcugggauugcagacaugagcacaccuagccuuuagugccauucuuauccuccucucugagaugggcuggccucuuguaauugguaagguuuugcccuaugcagaauuaugcuguccuuccucugauucucuuaaccucgugcuuuaaacaggcugccuucaucuuucacuuuaucccacuucccuguguauggucuaggauagcaagguuuacguugcuacuuccaccacccaaacccacagcagacaucacuaauccagcccagacuucacagagccuagaaugaagccuugauggccucucaugugcccagccucuagccggugguuccaggccucaugagcucagggaccuuggcucugucauccacugcugagcuucaugugcccagugcagugccuggcacaguaagugcaccauaaguuguugacugacuguuccuacuccacagugccuuguacccagugggugccagugugagccuguugaauguggaggcccuaacaaagcaaugagaucaucuaauuugggggacagggagcucuguaggcugccgggacuggcauuuacugacacuggcaagugcgccucugggucugggaaggaggcugccagggcagggcuacagcuacagcaaggaaagggguccuggaggccucugucugcucucccagacccacccucccaugcccucucccccugagacacccacugcccauuucugcugaucccaguuuaacaguucauugaaaauaucucauuugagaagaaaugauuuccugacuuuguacacuuagauuccaggaauccaggagagccuuccagccucagggcaaggagcuuugcugguaggaggaggugaucugcccccagcugccuauuucccaaacugagcuucuacugaaaaagacaacagaacccccccgcuccaaaaaaagucuucuggguuagucacguccgggacugcuuggcucagcaaagcucagcagauuuccuaggcacagugauucucgccccugaacugguuggugaauaccacaucccccaaggaucuucucugaggccccucacucuggcccuggugugucccugcgccccuugggaauagucaggcuaugugacugagcugguggggcgcucaggagugugggcuuucuguggcuagggcuguggaacagcuuacccauuugcagcugaaaccuuguuccccucugaccaagggcaaugugaugguucuugcugcugacuaaguuuuggggacccugcauccaagagaggggcgugugugagugagugggagugcaugugugagugugugucccaugugggucuguguguggcugugaacauguguguggcugacacaggcaaguguguggggcugggagucugcauaugauuacacuugugucugugcgucugcaugugagcuuguguuggcaugugugaguaugcaugugugagccucagcguccuggccuuccaagggguuuggucagccccuccccagcacacacgucuggugguuacaaguggguggacaauuaggggcccugugcacagucugccucugaccagaucucuuucuuccgucuucgcuuccucucuuugcaauagauccagaaccagaaccacagcccuucugaggagcucccaaacguaagugaccuuggaccuccaggugggaugggugucucacacguugugcagugacccaagguggggggcucaggagcuccgugucucccccaggcucuaggaggacaagacgggaccccugaggcccacagaccuuguccacaccucaccuccagguggcagauccccuggccuggcuuggccacucugugccugcuugguccccagccagucugugccagagggcacagggacgcccugcaaaugggccaagcacugguuuuggagauccagccugugcccuguccuggcucugcugcagaguagccuggggcaagucugccguggggaggaugcccucacugaguugauucugaggauuggggucugagcuuggcucugucucuguuaaagguuuguuuuuguuuugagacagggucacacucugucgccuacgcuggggugcaguggugucaucagggcucacugcagccucgaucuccccagguucaggugauccucccaccccagccucccuagcagcuggcacuacaggcgcgugccgccgugcccagcuuauuuuuguauuuuuuggaguaacgggguuucacgauguugucaagggcacaguggcucacgccuccaaucccugcacuuugggaggccaaggcaggaggauugcuugaggccaggagcucgagaccagcgugggcaacauaaugagccccaucucagcaaaaauuaaaaauaauauaaauaaaauuauaaauaaacaaguaaaauggaaaaccuuugcuaaaguugcaagaguauuacaguggccucgcauuaugcccuucguugagauuuucccauggguaacauuugccacauucgcuucaucucuuucucacuaauauguuaaauaaaaacagucacgugaacauucuuccauuuuugcugaaucauuggggaguaaauugcaggcaugaugccccuucaccucaauccuucaggccuuucauaagagcaaggccaggccgggcgccguggcucacgccugggaucccagcacuuugggaggccaaggugggcagaucacgaggucaggagaucgagaccauccuggcuaacacggugaaacccugucucuacuaaaaaacacaaaaaauuagccagacgugguggcgggcgccuguaguuccagcuacucgggaggcugaggcaggagaauggcgugaacccgggggauggagcuugcagcgagccgcgaucgugccacugcacuccagccugggcgacgcagcgagacuccgucucgaaaaaaaaaaaaaaaaagagcaaggccauucucuuauauaacccuagcacaguuaucuaccccaggacacugauuuaacauugacgugauucuguuaucuguggaucuuaauggcauugcacugauugucucaguguuuacagcagccuuauuuuucuuuuaguucaggaucgucauuauguuuuuaaaaaggguuuaagggaugucuccuucgcugauuaagacauugccugcucuaggggcuuucagagucuuauuuaauccucagcguucauuaaauacauuuuacaaugggauguggccugcgugugcauguacacaaacacacacgucaaacucaaacccugaaauugaaguuucucagaucauccucguacucgccaucugcugugcucuggucugcucugucuuccuuuaguaaaaaagauggccuugaccccuuacauugaugucaagacccacuguggacucugcuuuggaauuagaaaacccuggcuuccugggcagaaauuucuaagggggaagguuaagcucccacugguccaggguucggauugguuggagugggguccccugugaagccgggacuaggcaagcguuuguuuguggcccagagcuccucaaccugcugcugcuagcagcuggaccaaguccuuccuuuucaucaagcucagcuggccuagguugcuuggucacaagcagccccaccccauggagacauauucuuugugcugugacaucgggcagggguguguacccagccagccacugggcaggcauggaggugaccuacucgacgucagccuccacaggcgucaucauaauaguuauagacgucaauaauaaugauugcuaccgcuuccuggacucagcaugcucauauacugccgagagguuuacuguguuaacucugucaacccaaagaagugggugugcucuuacucuuuuugaaaaaauaugagaaauucauugagcgcuuauugcacaucaggcacugcuaaacacgucacagacucaugcacagccuccucaggagccuugugaggugggcgcugaugucaucccuauuguacagaucagaaaacugaggcuuggagagaugaauugauuguuuccaagacuacacagcugggaaggauuugaaccugauugagcugacucuagcccacuuccucaggcugggaacggccucugggcccagccccuuccccuucccccgggacuuccuccugguuaaugaguagucaaagcaccugggaaaugaggcuccugcugccgugaggcuggaaugugaguucugcuuccagauagagucuugugcaaggggcccugccugggaugggcuguuacaggcaguaaacagagguugccaauguuccucuuuuugaggcuugcugauguauuugcgcuugggagcccauuuuauagaaaaggcugagaggcagauuugcccucagacuuaucugaugcuccuccaagcagcccucuuggcuuaacacuuucugaaagggcuccucggcccccugacauggcaggggugucuagaggaacaggguggaagaacagaccuugucagcucugaagucugagcacugcuaggugugcgcccuccucacugggcacgucacuugagggcucugaccuucagguucucaucugagaaggggcaugaugcggacaugggaauguguguuaguuguucagcagagccugaacuauuaauggaccagcccaaaaaaguauugcugacagggggcaacccauguaguggaguccauggagcuggggagucaggcagucccuaguucaaaucucuguuccagcccugccggcuucgugaccuggaggagucacagaacuacccugagccucagguaacccaccccugaaauggagcaauaguggcacccaggaggguuagaaagacggugauacugggauuuuggggugggggugaccucaucacuuuguaagcacagugagguuaagugugcaaaaggccuagcacaucagugccaagcaccccacaugcaauuucucauuuuaucccccaaggugagcccccccuagagcaacuccccacccccucagcuauggggcugaguccagaaaucagauucacccucccggugccuggggcagcuuaaggaagaaagaagauucuuaacagggagacccucucugggcuuguggugagaucucccacggggugucugcccccaugccccgcacccauuguaaacuggugcauauaggaguguugauauaacaggcccaugacuuccaguguugucagaaaaggccaccucaggccuguucaacagaagugccaaccucaacauucgcuuccuagaaggcucaagaccguaauaaaaugauauuuauuauuuacucugguuauaaaagucauacauuuuugaacaggcacaguggcucacgccuguaaucccagcaguuugggaggcugaggcggguggaucacuugaggucagaaguucaagaccagccuggccaacauggcaaaaccccaucucuacuaaaaauacaaaaauuagcugugcgugauggugcgcaccuguaguuccagcuacucuggaggcugaggcaagagaaaacaagcugcuggauuuggcccaguggccaguuugcugaccuuguuguaagccaugauuuguuugacuaaagcaguguuuauuuaauuaaucccauagugaugggaaauuggcugguuacaguuucucuuguaaaccacucugcuuuuuuuuuuuuuuuuuuugagacagagucuugcucugucacccaggcuggagagcaguggugugaucauagcucgcuacagccuugaccuuccaaacucaagccuuccucccaccucagccuccugaguaccugggauuacaugcaugccuccaugccuggcuaauuauuuuuuuuagagacugggucucacuauguugcccaggcugguuucaaacuucugggcucaagugauccuucugacuuggccuuccaaaguucugggauuacaggcaugagccaccgcgcccagccucuauuuucaauuguuguaaaagacaaauaacuuaaagcugaccaucuuaaccccuugaaaguguacaauucagucaugguaaguagauuuaaaguguugugccgccaauuucccgaacuuuuuugucuggcaaagcugaagccagugaacuucuuuugagugggcgucuuuacacguuggucuaagcaagaagugggcuugcuggucgaauggggugcacguguuugagaugcugcauacguguugaugaaucauugaccccgcagggguugcccucauuuucacucuggccuaauaucagugacagcccuggggcauggagauggagggguggcaccucccuggggagcuccugccuucgggacuuuaggaaacgggauuuaaaacaauucaucccagagaagcagcccccagucugccagccuuucucauuugggggagaugagaaaaagccgguaagcaaaaaauagcucugaguacugggccagacucgagguugaaaaacauacuccauccucuagagauguacuguuaggaccugagcucaggggucccgugagccugagugugaaugucauucaguuucuacccugcucugugacucugagcacaucguuuaaccucgcugugggcuucaguguccucugucaaaacgggccugauguagaagcucccuucucugguugugagggucagggaagaaaaauggugaaaguuagcaguucuaacugugaacguuagcucagaacggcacauagcaguucuucaauaaaugaaguuaacaucguuauugcucguaguauugugauuauguuuggugccucuaucucagagaagucugaauauaugcauaguaaucgcaucugcagcccucuacaguuugcacgguuuuuccagcuuugauaccuacaucaucuuguaggguaguuacuacugccccccauuuacaggugagaaaacuggggcucaggaaggcagugagaaacuggaagucagccacgugucaggacaggagccuggauuuagcccacaucuuuggcuuugguuuugcacacagcugcugcugggagcuggggccagggcaggcaggugccuccucucuggccucagccucgugggaaagcuugggccucagguggagugaggaugucuugggugcaucuucucgucucggcucuuggacccagcaggggucggagggggauuucuuaagggagggggcuuuuucagaaauggacagggacuuucgggaccauggcugcccaccucagugaagucugaggggaguuccuggaaggcauuuccaucuguccauguguucuaagucaguggacaauuaaguccagaaaccuccuggacuuaaaaagcaagcaccgccaggaucccuggggcugcagacagccucggggguuuuggagggcuggcuccucaggcacccaugaaggaagguguccuggggucaguauucagacccaaaugcccgcagggacccucagggugccuuuaucuacucaugucuccacacacuugcuggcagagcugggacaagucacuaacccucugugugaccucugauucgccauggaaaaaagagugaauagaauaaaucauuuauucccaggguagguucuugggguggcagugccgagcuugggugagucuccaccccuucgauuuaggagccgaugcccuggugcggaucucuccucugagcugagcguccuccacuaagucaggcacagagcacgugcagcauagggccgguguccaggccccaccccagcuuggccgcuuaguggcucaccuucugggggccugcaugcaggccaccuuggcuuccugucauugcuucucacccccacccuccucccagccagagguagaguugcaucccugcucuucagccuuucaauuccuagccccagcuuggcucccaccuccaaaucccuacccucacuccucuugcucuguggggucccaccugggccauuguguugcaaaggacucacgccuccuaccuccuuugcuaccucugucacaaggagggggcuagguucucauuuauauuuucuggguugaguuuuccugagagcuucugcuagucucacagccccucaagucucuucugggcauccugccaguccuggacaaggguucccagacaagggucugucucuugucccuuaaguuacuggggacccagagagaccagauucugaugaggaauccaagacuggguccacaucaaugagaaggaagccaggauugauuagcagugucugucaagggggcaaggugggaagagguggcauguguguuguccacaugacacccuuaguaaugggcauuugcuuuggaaaaacuguagaggaacccagaggacuucaaaaggacucuacagccagcaggcaagaggugucuucuggauaggaagaaggggacgaagugccucuggaaggacagacaguguguccaggggagggagcccugcugugccaggccuucucaugccucggugugaucucacaccugggaugagugugagacacucacacaugaauguugugagacaacauucauucacuuaguaaauauugagcaaccacuauacaccaggcacagugcaguugguaaagagccaggaggcuggaccuugucucagguggguagaaggaagcuguuugugacugugggcucaugagccugucugccuccaccuuuucauccacuuuccucauaauaagccuccugaggcucagagaaguacagugaccugcucaaggucacacagcaccuugagaccucaggccucugcuccucucagaaccaccuuccuguuuuggugcugucaagagaauaguauuuggugcuacuucuuugggcaaguccaucuucugccugggccucaguugccccaucuguaaaaugggcccuaugauaacuacuggguuagcaagugcauguaggagaaagcaucuugguauuuugaaaauaccaaaugugucuuauuaauuaauauuggucauaauucaggggugauuuauucacauuuaacaauccagacauucagugaagucucucacccuaaaggagacaaaaucagggaguguggccuucugugggccaagcgaucccuguguggccgagucuggaagucucauggcuggguucuggaccugcaggaugauucuggggagaagggucgucccagcuuaaggucauggagucaagaccuuuuguuuuccuuuggccuuucuaguccauuugagaaagucaccuuuucaaaccccugccagcucugccuaguacuggaaaggccccagcaagaguguuugacguuaggggaaguuuggggaaaaaucucuaagcauauaaacauugagaauugaaagucugaucagucauccaaaaguuauggacuuuugcugugguucaggccccagcuggggcuagggacccugaaaugagcugcccucuguccagccugggagcuugugugggaagaugcuacaaaucaggacccugucagggauggggagggccucuugaaggugcuuugggcacgcaaaguuaaaaaaaaaaaaaagcucccugaggucuugaauaucaaaaauaugccaguugggcaccagacagugagggcauucccaguaggggaaacagcccguggaaaggccugguagagaguggaagccuguagaagcccuaaggagugcagcguggcugggguguccugcucugggcaauggggaggggagaggagcugccugggguagggggugggguugggucuggcucaguggccucggaucuguucagagugguuggucuugauucacucuggggaaccagccagaaacaggaauccuuauuucaugguuccaacugccccuuaaagguagugcuuguuguuuugacaacuggcuccugaacagacaaacccugccuucaaccaaacaccgcugcaggagaaucacaggcacggccacaagucuccagaggaaacccacucuaacgaggugucuaacccaguuugcugacucacgugguuuugggagcccgugaagugcauugggagggaggggacggggacacggcgcuauugaaggaagcucggucgaagccgccuguuugacacacaacaccggcuggagaaaccguucagcugguauuuucccaguguggcagaucuggagcccagggguguuuguuucugccucucucugcacuuagcuggaugcuaagaaggggcggagucaaggucaaguguugguugaacgaaggcacgccaugaaagauggcuaaucuuucuugggcacagaguauccuguuucuccugagagcaaauccaauuguguauucgaggcacuuccuuguaccuuccuuguguaauucacgacgaugacccauuuuacagaugaugcaacugagccccccagggggaagugacauuccugaggucaccacuugcagcugggaaggggugcaguguuagguuccaacuaaaacauaggugaugcagcauaggcaaaggguggaacuaggcaaaccuuauuugggaaacagagucccgcaggagcugccugcacugggaauacagagcccaagcagcagaggcagggagggccccuccucuccacacacauugucgggaggaauuauguagaacucggccaucugggggucagcaggaacugcuugaccaaauaaauagaugagucaauuaaaaaggacggauuucuuggcuauauauaguuguggccuaaaucucagguauccuugcccccaaggaguaaagggaaccguuuucagauggcccaggcuguacaugggagaauaagcugauuacacccggggcugcagugggugacacacuuugcaggagugaaaggaagcucuaaggaggugaggggugggugggggacucggggcagggaggguggaaggcaacaauugcguuuccaaaaaugguguggguugggagacuacccaugguccuuccccucaucaguuucauugagauuggucacaccccuggauaucagccacuuaauuucucuggccagucugaauuuaaauggcuaaacauuucuucccuagccugcggggucaguaguuaguaaucacggcagguaugcaugacucucaccaauuaugaguauaauuaaaugggaagaugccuugcaagcauugagcacugggccucgcgcagccagggcuguuagcugcugcucuuaugauugaggccagcugccacccgguccgugaaaauacuuuugaucugggcugauucaagagaccuggauucuaauccuugaguuaauuugaaaaauaauuccccugccuccugcugguuucaguuucccccugugucagguugagggggagagacuuccugguaucuaaggucacagccaggcggugccccagagcgcagugguuaccgauccagacuccaguccaccacuuccuggcugugcaaccucggucaagucgcuuauugauucugagccguaguuccucaucuccauuugggguaaguccccccccagccaucccaaaggguggcugguuaaggauuggguaaaauacugcguccaccugcugauccccaaacugcacaugcaagccugcagcccagggagcugggauuggccacgagguuggaggauuuugcauacauuuaaagcauuucgagugugcuuuuaagccccauuagacucuaagaugcuacacagucucgcuacuuucggacuaauuaggagaaaaguaagcagcuguaaucagugaaaaaugauuuaaggaaagaaaaaaauauuuagccugauuaaaacauuucuauuagcuagaauuauguaaagugcccgucacagugccagacagacaaugucagcugcaguuauuauuucaguuauacaagaacagguggaauuaggagaaccaaggguugcuaugacaauaagccgggacccuccucaucccuaccugggaggagggcuggcccugcccuagagcuuccugcggucuuggugaggaagaagaaacuucugggccggcuucccaggggaaggugcaccugaggaugagcaggaauguguccuucagggccugggaauggcagggccucccagaaacggcguggcgauggggguucugugauaaaggaaccccucucuggcuuuaguucugcugcagagcguucuuaugugguguacuuuccuggaaaacacagccucccagcacccugcgcugugcuggaaggagcauugugaccucaugcucagguacucugaggcacagagacccugggugcugggugucuuccgcacucucuggcugcuucugugccucagaguagaagcccuuugggaagaccuaagagccaaccacaauaauugcagcuguccugaguccugcuacaggcaggcagcucuuccagauuagccccagcaugaguagauguuccccuucacaccuggaguuuuaacguacacuucucugggcaccuggcccuguccugagaaauuaaccuggugggaucgccauccacccugugaggucgaugccauuaucagccauguuuuacaggugaggaaaccgaggcacagagcauaugcugcccacgguugcagagcugggguuugagccccaucagccuggcuucagagcuuccuggcuagccccgccuuccuucccaggccucugucugcuuacuauaugugaacucugggcaucaaguuguugggcugaucugucauucaauaaugccuaaaggagggguccccggugcccaaggaccuucagccaggagcugugggguuucaaagcugccauguugaggggucccagugucugacuucugcaguugcagccauccugggggccaccagcaagguaacauuccucuccugaagguuuucucuccagcugcccaaggugucccaggggccagcagguggagagaagcugccuggccacccugcuccaaggagcugcccugcucuucccuccuguggguuguugggguugcucugcagguccacagcaaaguccuuuucuacucucgaguccaguucccagccccuguaacuuccaucuccccagcuuagcaggugccaccaucccaagggccagaaggguacucaguacuuugcauggggaacugcaggcccugaucuggcccucggcuccuccacucugcuuucugcccugagaugcuccccuaacuguauccuaagggcuaggggagggaggugauggcagguuuucacaucugugcucagauccccagggacccaccaacacaggggacccacauugcucagcaagaauauugauggggaccccaggaucccccagucacaugcacugcagaagaggaggcuggccccugagaggccugggagagagacaguuggaauagaagggagggggcagcuaggaggaggcccagcuguuagggugacacccugaaucucagaagcgguuggccaguguuugagcccuggucuuggcccuguaagaugaucuguaaagcacucggcgggcauggugcccaagagaugcucagcagggccucggcucagagcccaggcugcccaugaguugaggaagaaugccggucaauuuugucaucauccugauagcuugaacuuucuaagugccugcuguaugccaggcacuguucuaagcaguccauacauguuugguucuuuaaucucucaacagccucacaacuuagguacuguuauuacucccauucuauauuugaggaaccugaagcagagacagguuuauuuaugguguacaacuuucucuccuggggagggugccuuugcugagagaggggcccugugugcaggugugugggagggacauuugggacccugcaccuccaggcugcugagucuccugagagcaguucugaaccacaguccagagcagggcaagccucaccuuggucaagcaaugucaccagagccuccgcuggccuuuccugccauuguucccuaugccuggggaggugguguuuaagggacagguguuucugcuguuggggaagucccaccugcugccuccacuggagaaagugacuccucucugcugggugacagugaggggagccccuaagucccaggcaaugugccuugcagcucauuccuguccuuagagacacugccuggggccugcucagcugaacugugccccucgccugcugcagagacaaggccaggcuucuuuuucccucugcaccccccuacccccaggaaucgggguuggucuccaaggcuucuccccccagucucaaacaugcaggccucacucagcugcccagcuccaggagcccuaggucaccccugccagccuuugccuugauuucucaaacucccuuucucuuuagcaaguggauaaaggcauguuggcucuguccuggguccacaucugggcucugccacuugcuauggaguaaccuuggccaggucauucuccucugagccucauuuuccuuauuuguaaguugagggccaaggucuucaucugccagggccuggugaggagcagcagcaauagggaauaagagacucucuggcaaacucucaaguccgggauaaauggcuguugggaugauccuggacuuagugaggcuggcagaagugaaacucagccuggcccagccccuagaugcucacagucuggcagaugagacgucugugugcacacacgcaucacaugcacgcacugucaugagccagccuuaaucucuuuccugagcugauuuuguuugauguuuugcccaggugccucccaguucauuauuagcaccgccauucccaaccucaccugauuuucagauucaccugggaagcugguuaaacaggacagauucgugggcccccaccuugaaaauucagucaguagggcugcaugggcccaggcaucugcauuuuuagccagugucucaggcaacucugauguuccucaugugaggauuuuggucauccacuagucccuccuaagaucccacagacuucagcaaugaaugacuuuacagauuaugaggcccgcuuacaggucaagaaacugagguuucccaaggagaacuuugaacuuuauccaaaguugcacaguucugaaugagagugcagugucuggugaauggugggggugauuugagcuggaggaugcuaaacggaagagucuugggugggcgggaagggcuuuugcugggaggugacacuuggaccagggucuuccaggugggugggaucuaccuaaauguaagagaacccacaaaccaagcacagacuugaaaggggcagugccggggagagagucaugcugggcaaaaggagaaauaagguggcagagauugggggcaagucagacaacucuagugagccugggauuccaagaggagaaguucagauuauuaucuaggcagcugggagucacugauaguucuugagcugggggcugacauggcaggcauuugggguuugcuagaaacaaacccggcuaagcacgugggagcagaggucagggcacgccuccaaggaguuuccaaugguugguguggccucuugggccacaccacgagugacaggccaucagaagguauaccauguccccagcacccccagaguuuaagcuaaauugcaauggaaaguugagggagauggcuaccacuggggguugcccugggagauggccccugcacguaggaagaccacaguugagaagcgucgguccucccugcauccuagccccacccgaguguggauuuuagcgcugagcuuuucuucuggcugagcaguagccgcuguuaggcaccaucuuguagugcuggaagucgcugccaccacugcaccaacaguugccaaccugacagaauuagauaugagccucauccucccaaguuuggaagaagagcuuauguucagccucuggcguccacuguaucccaccaaguugggguugucgggaaugucccgccccuccaccacaucuuucaggccucaguuuccccucugugaaaugaguucccuccagcucugauggggccgucuguggaggaggcuagagacuguagcuuugucuugucacugaucugcuauguggccugggccucaguuuccucaucuguaaaaugggcuuggauguggacgugccaagaccuccaaagccccacugugagucuuugauuuugugugggaucccagggcauccccuggcacuuggcaaaccuuuaggggcaggaaaaauuaacuucaaagucauuauuggaagaugcucaggaauggacaucguuuaaugaaaagugauuuccuaaagaucugguguucaucuguagaguuuugaccaucugaugggaaacugugcucagauguugggagcacauccugguccacccuuccccacuguccacauaccccagcaucugucauugcaguuugcucugucgcccucguagaggagcucucagaaugccugacguggaaggcuguuucucccuaugcagaguguccccagagcccuaagcccuaaacauuccaucugaaaaauccucaucgugcugggccuuguauuaauacuaggugucaggaagcaggacccgggugacuggggaguaacagacagcaacaguacaggcugggaacgcagggacagagcuguccuggaggcugucccaucgaggcugugagggguaccugcucauuaggcaggggaagaguguaccgggcugagggcacagcacaagccaaggguguuggggcuugagaaaccacagcgugugcuucaggaaccccuggggaucuugggcugguucuggaugguggagggggccuaggaaucggcuuccaguuaaguagagcaggcaccugugcuccagaacacagugggcaccggugaccgacagugcuaguuccccacccugucuugcuaaaucccaggcuguuugguuccucuagcaccacacucuggucgagcugaauuucugaguccgagugagguggggcggagguaggaaggaagaagaaaguacauccucgucagggggaaaaacauguuuaaaagaggaacaaggagggggagguuguuugcaaacauuuaaugagguaggaguuucacauacuguagaugggauauugugccuacuuuagagaggguaacacugaggcugaagagagaaggugacuugcccaaggcuguacagcagagcgcccugacugguuuccauggcacuguggcauccggcagagccacagugacagaguuggggcuggcccggcuccugcacgugcacccuuagcugacucugucacuggggccuguauccuuccaguuucuauagagcaagggaggggcugcccucugcuuuucauagccaacaaggagcagggcuuuaggcuucuuacagcuuaaaaggagaaggucaaggaaauggcaaccaaccuuucucuuuucuugaguuucuuuuuuguggccuccagaaauaauccugggcucugcagagccuguuucaggcucauggucuacccuaccccgcccccauuuccggcaaaaccaggcugagggcugggcugcuagcgaagcugacagcaagagugacagcccuguccugucgcuggugagucagugccaggagguggcugccugcugacucacccacuccuuccgcaggcuccaggggccccuacagcagccugacuccagccagcccugggccaugggggaaggagauggaaaaggggcuuggcucccucugacccuucacccagccccugcacccuggagcagagcugcaggcagugugaccguugugcuguuauuggccuaaacacauagcaacaggaaaacaaccccaaaaccccagccuuaagagcaaguccaacagugcgcgacuccccaggucaggagaagccccgaugugugcagaaucugcagauggggcugcucucggcccugccucuggcuguggaaacaggccuccaaguacccaagguaggcauuuugguggcccuccccaagcuccucuuucuccuccagcccagcuguggguaccaagugcccuggaagucuacugagugguguccaggguccccucagacagcaucccagagacuugaccuuccucuguguguccaggcugucaggcccagcucucagggacucuuugaccagagacgucuuugaagccuacccuugaccagacacggaaccuuguccuuccucugaacuuguagaauaauuuuuguuucuuuaacaaaacgagccccucccuccuucucuagucguuagugcugugaaggugggacguuagugcugugaaggugggacggugacccaguaccccugugauggcccugggccagguguguagcaggugcucagucagccagagcuuuuguucccucccgccaccucccccagagagaauugccccagguaagcgagugccugcucagagcagagugggcagaugacuucccaagagcacauuacagcaaagggugacccuguuccuuucaaagcauggcuucacccauggagccggcaggguuugggcuuccugcacaaggauguuguguuugugccaccagucuuagguguuagguccuuggucaaggggaagacauucuggccacccaccccgcagguucucagcucauggugaggaacccaggcggccgaggugugggguuaacgacucuacaggccccaccagaaaguguuagcugagcacgguagcucccaucuauaaucucagcacuuugggaggccaaggcagguggaucacuugaggucaggaguuugagacuagccuggccaacauggugaaaccccaucucuacuaaaaauacuaaauaauuagcugggcgugguggcaggcaccuguaaucccagcuauucaggaggcugagaaacgagaaucucuuggacccagguggcggagguugcagagagcugagaucgcacccugcacuccagcuugggcaacagagcuagacucugucucaaaaaaaaaaaaaaaaaaaaaaaaaagucauaaguaccugcagggaaaaacccaacaugggcccuuaaguucccuuucagaguagaagggaaggguugguggucagggacaauccagggcuuuuagccaaaagcguugagcccucacuggggcagcacaaaacuugggauaaauccagguucuaacucuggccuugggggccccguccccucuuccucucugccacacucuggcuuucuguuucuucacuaugugcaccauggcccucuuuacaccugcuguucucugcucuuagaacaguguucccccaguucuuugcccccaguucuuugccucagcuucaguguggcuaaaagcuuguucccuagagccgagcuucuggguuugaauccagcuguaugacccugggcaaguggcuuuacuucucugggccucuuuccaucauccgggcuggugaggaguaagugagugaguuggugucuggaaagggcuuggcacagggccugcccacagugaguccucagcgagcugcuguuguuaugaaaugucaccuccgcagaggggccuacuuuguuguuuucugugugcugggcacugucauaaauaauugcucauuuauguguuuagugucuaucuccccuucugcaggucagcuugguagggcucacccacugucuccaguuccuagagcagugccuggcacauaguagggugaguuaacagccacugcuugccaaagccacucaaaccuuuguucuaacccuggaccucugagaugcagaggggaagugacuuggccugcaugacccagcuuucugaccucgcccacugcccuuuccccgacuuagcugcuugggcucugcuguggggcaccuccguuuggaguauggugugugccucaaacaccuucaucuggggcagcgccagccacccugccucauccuggcccuucucaggccauccugccaccgggagccugccgugccuccaccccucccccugcaacuggcacgguggcacucuccuugcugccucuccucugcugccagacugugguucucuggggcuuugggccagguccugccacuuccaaggagaugauaaaacaguuuggacccaguccccagaccuuauguucaccugccaauguuuuuaugaggggaaggugacaaguuggcugucuauuagacucauaccgugucucgccacccccggcguuguuccagaggcuuguucuuugcaaaaccugcucacugucauccacucuuccccagcaaaccacagacuaagaagaacuacguggucuggcugguccccauccagaggucaccuugccccaggguggcaccaaggucauggaguugggacgugggugcaaauccuggcccacuguccuguagcugugggaccugggauaaggcuucccccuucucugagccucagucuccugaucugugaaaggcaaggcugaugaggccgggggugagguagaggcuuuucugcagggcuuagugugauccaggcaggaggcuucuagcggaggucgggggucucugaggguagacccguacuuuggugggguggagguugcaguuaaaucaggagaggggaggaccucacccgaggaugcugaaccccagguagauaacaagccccugucccagagacggcaugcugaaacgauuuccucaacagaauucacuuucacuacgaccagaauauuuuugcucauuguuucggcuuuguuccgggcaaaacaaugccuggcuuccuggaugaccucaccgggacaagccaucagggcuguaggccagccuggucagcaucuccgcacgagcccauucuucccuuugccacggccaccuuaggugaccugggggcaauagugugaccaaagagagcagacuggccacaggcugagucuggcccccucuguguuuguguuugacccagguggugguuuagaaacugaaaaaugugugugugcauauaaaccagauuucaacaucucuugagaagcuggaggauccagccccagugggcaccagucccgaaggcaccugcaguagugggagcuaaggagagcugccugugagaguccagacuccuccuguccccugguucccacucuucccugcgaccuccccaccccaguggacuccuguccuuugcccaccaggccucuggaggcuuuggagcucgccacgcuugaguuagccuuuccuugggagcagauaaccaacagauacagaccucaugauacaauucaaugauucaaucucuuaaagguguacuuuuaaaauauauauaaaagagaaaaagaaaggcuuugauuaauuuccacuuaaaacagcuacuccacuuagagugauggaaagagcuucuacuuuauuauuauuauuuuuucaucuuuuuagaaacagggucuugcucugucacccagccuggagugagguggcaugaucacaacucacugcagccuccaacucccgggugcaagugauccuccuaccgcagccuccugaguagcugggacugcaggcgcacgugaccacaccuggcuaauuuuuuuuuaacuuuuuguacagacaggguccaaauguguugcccaggcuuaucuggaacuccuggccucaagccacccuuucacuucagccuuccagaguguugggauuaaaggugugagccaccacgcccacccaggaauagcacucuuaacaacaacucccuuuuuuuuuuuuuuuuuuuuuuuuuuuuuuuuuuuuuuuuuuuuuuuuuuggugcuuaauuguuaaacacuagggccaaggagagugcccuuggcaggcaucacuaauagauccuggccauccugcucacugagccuguaccuagcccagaaucuauggagacagugguccagggagccccaucagaguucccuguuugcuagaggagggcuccaguccagcacgccaucuguccugccugagucugugcuguuucauuagcuggccuggcccagcccuguggcccuuggcacugacugcuccccaggcccuguccagccuccugagccccgucuccaucauguggcccuucacuucccuguuugccuuugccuaguuccccaguuugucagccggcuugcagcuggcuccuuaaagacaccagaccccauuucauuugauccauagcagcuacaguaguugagaacauggacuucagaggccaagacagaccuggggggcauuuggagcuuaaguggccuuuuccucaugugugacuguggacaagugacuucacaucucugugcuuuaucagcacaggaaggaugggagcagcacccacugaggggauuagcuaagaaaaugaaaaugugcuuguagucagugcucuuuuuaaaaagaugcauauucugcuuguguauauggucagugcuuaauaaacacagcuaucuuuuucuuaaaaguaacuuuuuuuguuuuuuuuuggagacagggucucgcucugucacccaggcuggagugcaguggggcaaucauggcucacugcagccuugaccuccaaggcucaagugacccucccaccucagccucccgaguagcugggacuacaggcaugugccaccacauccagcuaauuuuuguaguuuuuguaaagaugggguuuugccauauugcccaggcuggaaguuuuaaaauugauaaauaaaaauuguauauauuuaugguguauaacaugauguuucacaucugcguauguuguagaaugacuggaucaagccaauuaacuuacguaucaccucgcuuccuaagcauuuuuuguguguagugagaacgcuuaaaaucuacucucaacaguuuucaaguauacaauauguuauuaauuuuaaucagcaugacaccaugacauacauaauagaucuaucaaacuuacuccucguacauaacugaaauuuugugguuuuugaccagcaauuccccaauaccucuaaccauccacuuuuucuuauuuauuuauuuauuuauuauuuuauuuuauuuuauuuauuuuauuuuuuugagauggagucuugcucugucgcccaggcuagacugcaguggugcgaucuuggcucacugcaguguccgccucccggauuccagcgauucuucugccguagcuucuugaguagcugggauuacaggagugcaucacaucaucuggcuaauuuuuuuuuuuuuuuuuuuuuuguauuuuuaguagagaugggguuuuaccauguuggccaggcuggucuugaacuccugaccucaagugaucugcccaccucggccucccaaagugcuggaauuacaggcgugagccaccacgccuggcccacuuuuucuuuuuuuaaaacaaacacaggguagaaugguugccacaaaguauaauagaauugcaauguggcuguuuuuuuuuuuuaaagcuacuauuuauugaucaauugguaugugcugggcugugugcugaauaacauuaggcagcauccugcuuagucccuggucuuguuuuuacccucauuuuuuaccagugaggaagcggaggcacagagagguuguuacuugcucugggucacacagcuuagucauggccucagcccagaaucuggcucuggaaugggcagaaaagugaggaaaggagagagaugccugcuguggaaagggcggggcaagggguccagccaggcacuugauuccacagcaagccuagugggcagggaguuguuuaggccucaguuuuccccaccuguagaauggaugucauccaggucucuucuugccccuguucugggacucuaggagcugcuugcccaacccgcugaucaguuugcuuaaccaagagguuugcugagaaaccuggcccagagauccuucuuaaaggccagguaugugcuaggcaguuugggaugggagaagcaggcaaaauaggaaacagacaaggaccuggccucuuccuaaaagcauggcagaagcuccugagugguuaugccauugacaauaugagauuuaaaucauuguucuccaccagaaagagacauguaggacacugguuguuaaauugagaagugcagggucugcaggacggcagggcaggugcagagaacucucgagccucugggaagguugcccaggaaaaauagaggcaagggcuugacuuuccccagagccuuggacugaggugguagaugcugggggaggcagcaucugcaacucaacucaaagcccagcuggcuggugcucagggcaccgggagggaugcagagcaagauauagggguccccauuugcaagcagugcagagaccucuuucuaagcuuugcucggugccggaggcccagguggccaggugggaacucuggccuugagccucucucuccuuuccacccguguguguagccucagccaggcugcucgcuucccugcgugagccucagcuuccuuuaucuauaaacuaccaaagucucuuccacaauaggaguguuggagaauaggaaacuguguucauaaacagcucagcccccagaauaaguccucacaaaucuuaauauuaaacagggagacagcaaagggauauuguggcaagccauggcaucgcuggcacggggcugcaccugccugcgugugugucaaaucugaccaggugaucugcaguugguuucaggcacagcuggcucuggcugucaccucuggaacacagagacaaggagaauguuuagcugggcacagggagaggcuucaucccauagccucuguaucagucaauucuaaucacuuguagcuguaauaaccaaagaggaagcucuuaaaauggggaauuauguaucucggcugcugcaaaauaacccugggcccagugccaaggaaaacagcccuugucggcgggugcagggacgccuguggaggaggacucgcuccugaguacucacugcgcagcggggugaccacuugugugugugugaggaagcuggggugacuggccuaauugcaaguuugcagaggugcacagagauacuccggggacucccuggaggguguccucugaggucagacugagccgcagagggacaguggaggcuaagcuccuaaggguuuggauacaucacggucacuguuacucccagcggagugaccucagggcgucucuugucaucucugggccuuauugaucucacccuggggaggaugaaggcuuuauauaccccaaggccagggguggacuggauaguagugauagcgguaguaagaggagauagucucaagucauaauguaguugcugugcauggagugugugccacaucuuguucuaagcaccuccugugcacccccccucauuuaacccucacaacacucccacagggaagguacaguuaccccauuuuacagaugaggacacugaagacuagugggguugagugacuugccuuaggucaccuguuuggggaagugacuuucagcuucuggguugaggcuuauauucuggucccuguaggggccagggugccuggggcagcuggcagggagccagggggcuuuuuauacugcggcuccaacagccaguggggaagguucagaggggacugagccugagcaguaggagggacuaaagcaguucuguguggcccgugucccaaggagaaggggagagggaagauggggccagagggucggcaggggcaugugcugggaccuggugggcaauggugaggagccuguguuuucuucuaggggugagcaaaggguugggcgggggcaugaggaccugauucugcuuuuuaaucugccuucagcugcugcauugagaauagaucaggggcgggcagaguagcagcagggagaccugugaggaggcugccacagaugccagugcaagggcugaggggccuguagcucgugguugccauggcgauagagagcuguggguggaugccaggaauguacaggcgggucuugcuggaaugggcuucuucaggggcagggcugcuggcuguguguucuucaaggcagguggaccugugacugcagcccccacagguggagaggugggugcaccuuagaaaugaggaguugggagacccccaccaugccaggcacgugacagguccccacucugcccuguugaaaacccccacccccauccuggcucagccccagguggugggacgaugggguccugaguguggaaggggguggaggcuucauuuuguaggaaaucagagccuagagcaaagggacuuggggaaccccaguugcuccuccuccauguuucuagaggguucucgaauauuaguguggcaagugggucugugugcccagagggcagagccgggacucucaggguagccgcagugaagcagaccccagcuccuagcggggauggacuuggcccaucccagcugccaaugaggucaugagcuucugggugaggaggcuccagggucauuuccugagaaacaccuucacucggagggaguugagucucacauccuccaauuaugcgcccaccgagccagcccacaaugggcugcccugauaaccaucggggggcugugcaagucaaugcuggaacaaugcuggcugcuaggacuauuuuuacaguagccauuggccugucgaaucccgcgcccggccccgagggagcagggcagagaaaggcggcgcggaugcucuggcagacagaggaagggcuccaugagcugcccagaggcuucaggaagccuuucuuggucugcuggccgccagauagugaaacaauuggggucccccaccccgagccagggagaggaaggaggugugggggaaacggggguuuuguugugcuuuugugccucuguuccucgagcacagccccugugggcccagcagcuggggccaagccagcacauccccucuccacaccccaaguccucaggcagcuacugccucacccugccugcaaggcccugaggccaagugacucgccuggucacaggauuggcaaagccaggguuugcaguugucaccagcugccuguggaugccacucugggauccaccuaacccagcagcucuugccugacacccuacugugugccaggcauggcgccuggcucugggacacaguugugagcaaggcaggugugguccuuguccccaggagccucuauucuaguugaggagauagacgacagggaagcgaggaauugaacaagauacuuucagguaguguuugguucucugaugagaagacaaacucagaugcccacuggagccagccaagcgaguguguccugagcuggguggugagcuggccaggguguggucgugugacaagggucacgugacaagguggucacaucugcuccagucagcaaucgccaugaggaguaugagcucacugugguccaaccuuccaauuuuucaagagaacucagaauucuugacuuuucucugaaaucugauuauuucaguguuggccaccaguuugaucaugaagacaaacaaguugugucccagacugcuuggcucugagucagccacuucugcugucauccuuuuuauucugcagauggggaaacugaugcucagagaggggcgaguaggccuaguagcucugguuuucccagcucauccguuuucugugucccucuguuauguugugggucagcccuugaaggcaggggacccagccuugagcuguuuccucacgcugugggcuagaaaucaggaugcucuugguaacccuugucaguucucagagagccagggguauccaccuucugcacagacggccacacugggugugacuguggcccucagggucgagcugacagggugagugagcacuuggggaccuuaggaaguacagaaagaagaggcucuggccuggcugguggcagaccucccucuagacugggagccaagcauaagugggcugaggguaaccaugaacagcuccgggggcuuagagauuugaccuucucuggggccucccguuggccaaacccaacagggagccggagggcaagggaaccuggcuuauaggaucuacagggucagccccuggaaucacagcaagccagaggaugguuagagaaggguggacaaauggggaugaacaagcacacuugcauaauccucaccagugcaaaucccuuauuuuuuucugcuagagaugugacugguuaauaaauugcacaucuauuucauaaacauccauucucuauacuuggauggcaacccaucucaaauauuguuuccauuccagccugaaaccccauuccucguucguuuccgucuaucuguuuuuuuaacuuacaguuauaaauggucaucccugugggcugggcacuguauuaaggcauuugcaaaagaggagccuccauuuuuuuaaauacaaauccaaauuuagaaaauaguaucuguuaauuucuagaaacugcuugcaggcuguuauuuggcagaugccuagaacugccuggguguguuguguuuugugaaagacgaugcuagggcuggggugcaggcugaagugugacacccagacgacaaaccugggggccucuggugcuucucuucagcaggugcccggggaauggaccugccgauucuguggguugcaaguguccacagccugaaucuugaggucccugguccaugaaggggucugaaugacuccugauguugcugucaaagcauuggacagacagggaugccaggccccuugccacaggcccgggcaggugggagccggcucguggaugaggaagcagagauugugucugagacauacagguggucccucaucagcugcaggaugcuucucuuuugucccccauagaaagcaaggagauggccaccaaggagaagcugcagugucugaaagauuuccacaaggacauccugaagcccucaccagggaagagcccaggcacgcggccugaggacgaggcugagggaaaaccuccgcagagggagaaguggucuagcaagaucgacuuugugcucucuguggcuggcggcuucgugggcuugggcaacgucuggcgcuucccguaccucugcuacaagaaugguggaggugagcuugggccgggccacaggggagcccauccaguacaaagccgccuuagagcuggaggcugggaccagagcguggguggccucucuuucccugcuuucccuggcccccccccuugaccuccaugaggucagccugccaugcuccugccaaccccacccuuagagacaggggauaagcccgacugagaaucagaguacuguucugcagggccuuucuguguuaccuugagcaggucccucagccucucugguccuccaguuugccaccuccaaagaggcaggacaaggccaggcuugugucucccaagccccagacauucacacaccuccuuaucuguccgccauaucuacuugccucugacucuuuaucuuuccuuuaauauucauguuugcuuuucuaacuuuaccaaauguacuccagaaagcaaauucuguuacccgcuguagauggaaaacugguaucauuugucaugcuccaaagguauccaggaauaaaaaguacagugaagauauuuuuuaaauguagugacugcacuugguuggguugaugaguugguugguuuggguuuuuggauuuugguuugcuuuuguuuuuguguuuuugccugcugaaggcuccgagcaggaacccucugacaggucuucuguuacgggguuguguugaggucaggcagcaccuaacggugguuucuugcuggugccaugaugggguugaagagaaccggauagggaggaacugcucacggcuggugacugcuuguugucaaaggcuugugugucagcagagaugggcaugccuugugcugcccacauuaguagaaccaccuuuuggggaauuuucccuuagagccugguuucuuaaccuuuuguaggucucaggccccuuugggacugugaugaguguccuagacgcuccccagaacaaagcacauacacuagacccaaguugcccacaguuucaaaggguuuauggacccgcugaagccauuaguggacaccagguaggauccccugccccaaugcuuugcccccccauucuuccccuuggucccgcccccaccggagaugccuacccucugccccuuaccaccucacccuuccuagcuggugcuuuucugccuccugcccugggcaggccuggggaggguaggugaaggccccaacaaagaggcgacgugugagugggucuuaagaggccaagccguccuuguucaggggacggauguggaggagacaggcaggcaguaggcacagcugacaugaaggcucugaggcagccgggcgcgguggcucacgccuguaaucccagcacuuugggaggccaaggcgggcggaucacgaggucaggagauugagaacauccugacuaacauggugaaacccugucucuacuaaaaaacaaaaaauuagccgggcgugguggcgggcgccuguagucccagcuacucgggaggcugaggcaggagaauggugugaacccaggaggcggagcuugcagugagccgagaucacgccacugcauuucagccugggugacagagcaagacuccaccucaaaagaaaaaaaaaaaagaaaaaaagaaagaaagaaagaaagaaaaaaaagaaggcucugaggcuugaagucccugguagauuugaaggugagagggagggcacacuggaaaggugaaaccagcuggccaggugggcagggccuggagcauuucccaccagguccaagaguuuggccuugagccucaugccccucaugcauucucucugguuccauuggcugggagggcuugggagccuucugcgucggcgcugccauggccacagccucacuuuugcccauucugcucucugcaggugcguuucucauaccguauuuuauuuuccuguuugggagcggccugccuguguuuuucuuggagaucaucauaggccaguacaccucugaagggggcaucaccugcugggaaaagaucugccccuuguucucuggugaguaugggacggaggucacuuggggccuggcacucaucaguuccacacauuuuuauugagcaccuauugucugccagguccauuggagccucaugcacaucacuuagcucuaugcugacacaagauagcagccaguacaguaccagugugaugcggaugcugcugcuuaggaguacggggaaaggagauguggcaagugccuagcacgcaguagcugcucaguaaggcccagcaugcccacuucccuagguuguugcauagagaagccugcagcugcacuguucacaguagcaaagacauggaaucagccuaggugcccaucggugguggacuggauaaagaaaauguggugcauauauaccauggaagacuaugcagccauaaagaauagcaguauggccuuugcagcaacguggauacagcugaaggucauuauccuaagugaauugaugcagaaacagaaaaacaaauaccacguauucuugcuuauagguggaaacucaaccuuggguauacagggacauaaagaugggagcaacagacgcuggggacuccacaaggggcggggagcaagggcugaaagacuaccuauggcauacuguguucacuacuuggguggcaggaaucuauggaagugcaaaccucaguuucaugcaauauucuucugucacaaaccugcaccugcacccccugaaucuaaacaagaaaaaagaagccuguagcuacuuggcaguagagugcagcagauaaacauucagguucaggaggcuuucugucuggguucaagucucauuaacuccccuugauaguuuugugacuuugagaaggucacuuuauacuucaauuuucucaucuaugaaauagaaauauagucguauguuuacuucacaggguugcuaugaagacaaaaugacauagccacguagaaugcuuuguacacagucagcaucaaaugaaugguagcuuccuuaguccuauguuuaguacuuaguaugcacacaaaauaaucacuguuaugauuuaauuggcagagacgggagcauaugugagucucuucauucggucauccacguaaauccauuuauccuuaagccuuucuuccauuaaaccacucaguaauuagacuauccauccauuuuccauccaucuauccaucuauucauccuuccauucaucuacccaaccuucuaaccuaccaccauccauacauccaucuaacaaacugauuaucuaugcaacaaauggauaucuauccaucaauccaacauucuucaauuuagcuguuuauccauucaucuggccauucauucaaucauccaacuauccaucuguucauucauccaucuauuuaucucaucuauucagcuauccauccauccauccauccauccauccauccauccauccauccaaacauccaaccauccaaccauccaaucaaccauccucuuuauuaucuaucuuuucauccauccaucuauuuauccauccauccauuguucuauccccccugcccccugccauccaucccauuuaucuaaccaucuguuguuucaccuuuccauucaaccagccauccauucacccuauaaauauuugguggucacuguugaaaggccucuuguggccuggggccuggggauaccauggccuuccaguugaguauguggccguggugggucuggccucccucagauguuuacucaucucauuugcccaaccugcagguaucggcuaugccuccguuguaauugugucccuccugaaugucuacuacaucgucauccuggccugggccacauacuaccuguuccaguccuuccagaaggagcugcccugggcacacugcaaccacagcuggaacacaccucacugcauggaggacaccaugcgcaagaacaagagugucuggaucaccaucagcuccaccaacuucaccuccccugucaucgaguucugggaguaaggccaccucauugaagcaaggaggaggacauggguggggcagagaggauggcccacuuccuuaucuccuccccugggauacaggagccacugucuucgggggagugggaggagggugcagaucuggagauaaauuuaugccuuuggccauagacaggacuggaaucccaguucugccacuuacuggcuguuugaccuuaggcaagccacuccuccuuucugagccucaguuucuuuaccuguaagauaaaaagaaugaaucauuacuacccugugaggcagguaugcauacuuauguugucuaaaaaugauacaguuuucuuaauguauuuuaggaaaaaauauauucuguuauugcacagagaaaaaugcauauaugaagcugaaguaguuaaguggaaagugaguagguagagugaaaaagaugcaucaguuagcuuuugcuauguaacaaccauccccagacuuggcggccuuaaacaacaacaauuuauuuagcucuugauuguucugcuuguuggcaguuugggcugagcuuggcugggcaguucuucuggucuuggucuccuccacgugucugcaggcaacuguagguccuccggguagcucuucugggguuuggccggcuauuggcuggggugugaggggcaacuggucccugugguuucaucacccagcaggcuagccugggcuugucaccggccacuaagcaagcacucuaggaacaagaaacggucaauccccgaaacccaagugcuuuucaagccucugucuguaucauuuuuguucaugucccuuuggccaaagaaagccacaagacaaacccagauucaagagguggaggaaauaaauucugucucuucaugagaggagugaagaacuguagucaguaacuacagggaggauacagaggacaaacaucagaaaggugggauguggaguccugaucuuggggaacucuugagugagcugauguguggagacauucuucuaacauagugcuuagaggcugaucaaaaauaggcuacugcaucauuucccucuucuucauaagccagccuuggggcucagcacucaagugcagccccuugacccuggaaauaacugagaugaggccuugagugaagguugugagccaggggcaggggugcuguuaaggaagagggugguucugguucugaaucaucacgagaugacagucccugucuuuugugugugguuuugccauuuucaagguguuuacccaccucuuaggagcuggcccaggaaugggccagagaagagggagcggccuaccgacuggccccagccaugcuuuggggucagggcugggacaucguuggcaaagaaggggucgguugcccucacugguguggagcccuuacuuggucgguccgugucacugucgcugcuccaggccuucaguguaugcucagggcagguccuuaggcccacugucacuggggguuccucuaguguguauauuuuccacuuacaaacaaaagggacauuggaagcacaaucauugccccucgguuccccgcucccuggggagcugaguucacagacaaagaaaggcuggcacuuccuuuuucucacuugaaugggguccaaggcacagccuuguccuuucucugcuguuuuuggaguggccugaaaaccgggccuuccccacuccuggacacuggcacucagccaguuacugaaggcguuugcugggaccuccuugccucagacauugacuggccugccuggguuugaacccucacuuugccacuucuagcuuaggcggaaguaucccgcucucugggccgugguauccucaccugcaccuggggagauggcagugcugacaucccaagguuguaggauggcccugacugcaugagauccuggguggccagcccugagaauccauuauuauuauuauuauuacuguuauuuuguuuuugagacagagucucacucuguugccaggcuggagugcaguggcgugaucucggcucacugcaaccuccgacucccugguucaagcaauucuccugccucagccucccaaguagcugggauuacaggaacacaccacuauguccagcuaauuuuuguauuuuugguagagaugggguuucaccauguuggccaggauggucucaaucuccugaccucaugaucugccugccucagccucccaaagugcugggauuacaggcgugagccacugugccuggccagaauccauuauuauuuaucgagugcccucauagugcauaaaacuaccccucagggcaguuucuuuguguguuaugaacuuaaagaaucacccccuauuguaaaggggucauccucuucugggcucugcuugucucgcuguugucuaggacccaggggucuuagagagggaacacuugggagcaaugugagguccucagguuggccaguccucacucacaccuuccagagggaccgggcccucggggguauucugggacccuugccuuccagaaucuccauucugagcaccccagcuccauuuucuggccuggaagacacugagacaguauuuaucuuuggaaagugucugguucugcaggcaucuucccaagcuucugcaugauccagauggauuugcucuguccaaagaacccuggcugccagcuugguacucaccucccacuccagcucucacaccucuccuaccccugcaccccuagccccagauuccagcagagcuuugugagaccaccugaacauucacaaauaagcugcccucuuucuagaacccuggggaagauugagggccauggagcaggagccuggaaagcaggcuuaggcaagaccagcacugccuccugugaccugccuucacagcacaggccgaggccagagagcuacaccaggggacagcucaguuccagcccugagccaggugccgugggcaagaaagacccggccuccugccuucaagagccuucucuuuucuuggcaugcaaugguggaaaggcaagagaaccaguagggaauaguugacuccugugagcauaguacuaggaacuugccccugucauuucuuucagucucuaaguagaggaaauagcuaggcaucauccaaaacucuucuuucuaccucaaaucccacauccaauucacacaucuucuuggcucccccuucagaguauaccuacaaucugagcacuguccccaugcacugucacccccaugggacccccaucacucuccuggacaccagcacuggccucuuggaucucuccgugccuuauccuugcaccuccguaaccaauucugaauccaaccuguuaauucccagcucagaacccucucauggcuuuucccaugcuaugaucucacccuggcagaaaggauugagacuauuucaacacagcaagugcucacugggugcugaaucuccucauuaguuccaugucuucauccaccugcguggagcagcaaaucacuaccucucucuggcucacuuccccaucugcagauggaggagcauaugagcugggcuuugaaggaugaguagaaguucacuaggcagaaaaggagagugacaagacagucuagguaggaggaacagcccaugcagagucagcauucugaaagcacaugaguauuugggaugguuuggcuagagcauaggaugcacgggugagggccagguagggccagggagaagggucaaagccuugaauguuaggcggguacauuugaacuuuguucucuuggaggaggaaccauagaagguauaugagaagggagguggugugacugaauugaaugugauuuuuggacauuccuuaaggaacacacuggugggaaagagaggcuggauguaugcugagcacugacuguauacggggccucggagaccucagccuucagcaggucuggguucccuuugggugaaacuuaucugaaucccccugaagauagccaccaacccugcagcgucugacccugggguuucucucgagugaaucuugucaggauuuuuugcgcguugcugucugggagccaguugggcggcagagcagugaggauacccucgaagguuggucuuggugacccucaagcugaagcccagccccagcuguugcuuccuuucacuucucuuauaugccccagaugcauaggucccuggcccguccuuuccuucagcaggaguugcuggcaggugcugcuggcaggugcucaguagucucuggaagucagggguacgaggcaccaggggagcggagccaucucccagcuucuucugggcaggaaaggucccuguugacccucccugccagcccuuccucccucuguuuucacagaggaggcagcagagcagcaaugggugacauuccccuuuccuuguggggggagacaaagcucaacucuggcucccacacaucccagcugcacgaccuugaggcagugaccucaccucuccacgcccucuucucuccucuguaaacagaaguagcguggucccaaugacucacagccuggcuugaguguuuuggagcuaagaccagggaugugcuuugcagggggccacgggacacugacgaugcaagacgugcagugcccugcccgaggucacgugcacagcuagaaggagcaaagcuuccagcccuggcauucagcacugcauccugccuccagcuaaccuuuugucuguguccccaccagccaccagcccagagcccgggccaggcuugggagcccaaguccauggucacaggucacauugugccacaugugugucuccccgcucccagguuacucuuggggucuucucucggccuggacccccuacacccacccugugugcagugcuaagucaccauucucagcagaagccagugagcugcacuuucccagauccucaugagaagccgcuggggccccagagacagucauuucaugcuggcuuuauaauugagcgccgaguugcucugggauggggaagcagagcuuuuguccccugcuucuccuugcugucuggggucaccucugucccaaggucgcccuggaggacaggcggggccagaccuggccagaggcccuccaucaggcuggagccgugccuuccuccuaggcuccuccagacccccugggagcucggcacguaucauuagacuuuauuagaaucaaagaaaugagucauauuugcaaacaaggccugcucagccaaucuuccccugcagcugucggaaagaggaggcgguggagaaaggcugcacggccccgugcucugggcggacgggcccuuuuauaauuguugccucugcuagucuccaggggagagccauggccaauaaauggcuggcgugcagucaaaaggaaacgauuuggcccgcuaggaggacguauuuacaucucugagugccggcuggacggcagcagggcggccgacucaaaacagacguccaggcaguucuuuuuuggaucccacccuggagugaaucauuacuauucuuggacaagaaugcagcuuaccucggagucuccucccucuguaugagacagacgaggaagcuggggaugauggggcccuugccaaggccagcaccaugcccggcacaugagguggcuggccccaggguggcaucaguaaaaaggaaccagguccauggcugauuucuaucugagugauuucaggugcauuccugaacuugucucagccucaguuuccccaucaaccaaauggguauaauuaauuuacucaauuaaugucagcugagcaccuauuagguaccaggcacuguucagugaucaagacagacauagacccugccuucuugggacugacauuuuagugggacaggcagacauuaaauagauagcacauguacaauuauaauauaaaagcaauaagugaugagaaauaggcucagggcaggggaaggacagugaccagggauguuuuuuacagaggguggccaggaacagcugcccuggggauguggccuuugagcagagaccugaaggaaaggagcgagggaguuuuggaacaaguggcugagggaagcaguuagguccaaggccuuaaggcaggaucgcguucgaccuguucagggaauggcccagauagcagcuaggguggcugaaggaggaggaagugaugcugcagucugggggaugaggguagggcuugggcgcccgcacccgcagccugcccagaacacuuccccuuuacacccguucaccuguguguuuacuaauuggcacccccucgcucuuaaaagugagucugaauggcagggucagaagggccguguuggccggggagcgggagcccugggaggacguggagcagaggagggauguggccugacauagguauugauagauucccucugacuuguuggggcaggaguagagggaggaagaccaacgaagaggcugcuggaaaucauccugggggcgucaggggccuggacaggggcagagacugugcugggagagcuguguuaacacuguggggagccugugcagcuuccuccugggguacuuaggaggcacaggugaguggcagggcgccauggcguucccucggcacgacacucuacaguuuacugagcacgcccucacugcuggguagggauuggcugggauccugaucggcugcuuucuggcugggaagacccuggaagucagacacggaagggacuguggaggggccugccugagauucagccugcauggcugcccgagaugucuuuggaaagaaugucgguugcucuggcccugagccugugucaggcuguguugugacaaauccugauugaugagauacauugguuucagcccuaguauguucacguggcccguuauaaagcuuuucaagaauuuaaaauaacuuuuauaaaggugauaugugcacauuaaaaacauugaaauagugcaaaaauacuuugcaaagugcaucccccucccccacacaggcagcaacugccaccagcuucuuguguguccugccaaaaauaguguguguguauucaaguacaaaugugucucugucucccucccucuuuacacgguagggagcaugucucaugcacuguucuucaccuugcuucuuuccugcauuuugucuccaggaccgagcuccuuaguaggacacagaacuuuccuguuuuacaccgcugcauuguauuccagugugugccugcuccacaguuuacaagcuccucuugauggacauuugagucauuuccaaucuuucacucuacagacagcacugcuugagggggguacuaugucucuggccacccaugcagauguaacuauaggagguaauccuaggaauggaauugccugaucaaagcaaacgucccuggauggcaccaugagguccuacaaagggacuaccaccagcaauggagaaggaggcggaggacucauuuucuuuguuguagacuccauagcuggucagcugccccgaacaagucaguguggcagccucccaucaguauugggcaccacugguuugaccagcauggugguaggagaagggcagaugcuguuagaugagcuggcugcaggcuggguauggucagaaucagggcucuggaguauuaagcuucucagccagcuugcccugaagaaucaaaggaaaggcugucuugugacugggcaucuuaucagcauauaaagcccuuguccuugggauguccagggucuggugggcaacacagacauuuccccagcgugggacaggacagcggaagacagacaggggcucuacagugagucuuccagaaccucagggaggcuuccuuugagacggaggauagugcaccuggugggccugggagaugguggaaaggugcucuuccuccucuccuggugcugcccauucacaaggaagucuugggccacugcccagccugcccuggcuuucacugaaggugcugagcccugcagaaugaggaaaggcuuuuuguuuuaaagccguggcaggcgccagauccacaugcuuggcagggccccagcugggaugugguuggccgccagccugcccuauagggaugcccccugccccaaggugccaggugaucccagcauauagcagaggacugaagagauuguuaaaucagcauauagcagaggacugaagagauuguuaaaauuuaggcucuguuuucucuuaaaaccagaccaacaguguaguggaguagagagagcacugguuuuggagucagacaggugugggcuugggguggcagcucugugucaccugcuggcucugugaccaugggcaaguggacccaccaagccuucauuuucccuaucuguaaaauggggugaauggccucuacuccugggaucagaugagauaaacugaaaaggccuuggaaagcaggugguugcugguagcuuuuauuucguccaucagcauuaucauguugacaucccuggugccagggggagcccacugaugucgcugugaccagcaagaagagggcaaagaaaagcuguccugucuuauggcuguuagugggaguauuucacggaucgguccuacagugacaugugaacuugcuguccucccaguugaguccauucauucacucauucacucaacaggucuuuauugagguccuccaaugggccagaugcuguucuaggugcugggaacacagcaguaaacuaaagaaaggccuugcuugaauaccaguugagaagggaaucuuggauuuauucaaaguccuuauguugaagcuucucuaaaaaaaauaaaauaaaaaugauaaagggucuagccugguguguguuccgagaaccagagcccugacuguggggguaaucccacggacuggcugaaagcuugggauguuccagaaugcuuccccaagagcauccugggcaggagcuguuauucucauuuuacaaaaggggaaacugaggcacagagucacacuucacucccugccccuccugcaugggagugugaccuucagacagggagcugacucccauuagaaggaaacucagcuucuuccagggguucgcaaacacccuggagcaugcagacccugucucuuguggccagcagccugugguggacagguaaccugggaggcccagugggcagggccgaugucucuguucucagcguggcuguccucgaucacuguugcagcagucagagcucugggaccaugggugccacuucugggcaucaaguuucauggccugggcugucaguacccugcaucgcccuggccugcuuucagaugcugucauccauaagaaugucugggaguagguacuugugugcuuguuuagcagggcagcaggaaucagcucggauuggugggaggcuuaagucuggacuccaaagacccacgcucugccgugucauccugggcaggguuggugacugucccgugccaauuauccuuaaaaccguuuaccugccucucucugagacccucaaaacccuggcagggcaggggaggaaaccagcauugcuuaggugccggcugugugccugaaacuucccugggcaucugaacaccacaguuaacaucugcaaagguuuaucaagugcuagcugcaucccagacccugaauuuaggaccuugugugacuuacauuuuagugagagauccagguuacacagggaugaauaaaauaauaagggacaauauugggggagggcaacacuuuauagacgaggagccagaggucugggaaaguuggcuaacuucguucugucagugacggaacaaacaguagagcugagaauugaaccuaguguuuggcccacgguuggcacugaagaagguucugcugaagucccaacagaaaaucagugcccauuucacagaugaggaaacugaggcucagggguuccuuaacuugccugaggccagacuaaguugaaccuggguuugccugaaucuggagucugagucuauccuuuucuuuucuuuccaacaacucugucucaagacaaauggggauuccuggguuuggaaaggugaggugacuuauguaaaugcagcgccucaggugggauuugacccccagccuguuaauguccgagccuuggcucucucuacuccagggccaggccccucacugacuccuggcucuguguuugcuucaaggcgcaacgugcugagcuuguccccuggaaucgaccacccaggcucucugaaaugggaccucgcucucugccuucuuuuagucuggcuaguguguuucuucugcaucuggaagggcgucagguccacugggaagguaaguuggacuucuguccguccccugccuccuggagagcugugccaggcuggcccucucccccacuucccgccugcaauuagccacgccccaagagggagguggccagugguggcgugcugguaagcccgcccucuggaaaaaaguaaaacucagguuuguuguagcguuuguccauuucauggugucagugcucccaccauguuugcuuucaagcuguccacaguuuaaugaccagcucacagaauuccugaauauugaagagccaggcucucaggagccuacacgagcuagccccauccaccacagcuuucucaucucaagguauuggcagucagugcagaugguagcagauaacuaauguugggcuucuaauaaauagguuagcugguaacaggagguuagccagcaaccgugguaagagccauuagccacagcauggacccucgcuuugcagagggggccacaagcauucccaucagcauugcagggagcuucgugggccugccccaaaccuacaaacuccaaggcugcguuguaacauuauccccagauaauccaagagcacuuuauggguugagaggcacuggcuuagauuuuagcugcuaaaucagauuaacugaguuauaacuaacauuucagccggcaccuccaauguuaguuguucaggaaagcguuagcugauaauuaaaucauccacucauggccaggguguuagcuguuaaccaaaguauuauucauaacuggaguguuugcugcugauuaauaugucacauagugacuaggauguuagugauuaacaaauguaaaauguuagcuuguaauuuuaagguuuuagguauaacugauacauuagcaauaguggaaauguuaacccauaacugaaauguuaccuguuacuaauuagagcugaacuguucccugaaaaccuagacacuggcuguugucauggcuuugcugaugccaaaggcuggugcggggguauguugugaucacaggugugagccugaacccagggcccuaagcuauaaagaacaaaggcguuugcucaucugccuuuagauagugcccugucaacgcuuuccccagugacucacaucccaaaagagggaacgucucuuuaagaucaaaaaacccccaaaagucaaaggagcgucuuaagguagcauuccagauggagcugugggcagugaccuuagcugccccagccacacaguggaauugaggguugaggaaugugucucccuggauaaagagcccccaaagaggcaaaaucauagauuuguagagauccaaguaauuauuccagucacuuacccugcaagaccugggacuccaggguugcaagagguagaaugggggugauccugugcaccccccuccaacacacacagugcccucugcuuguuucuuggggcagaaccacccugccauccugaagccaaggguggaagggaagcaguccaggccuuggacaccugcccgugcccaccagugagcacgguccugcccggaacaggcgggagcaggggacauggguaacuccugcaccuccuuggagagcaccuucacugugcuaccccgguucucugucucacaagcacaccauuuuauuccuuucuuuaaacaaugagaaaacucaggcuuagggaggucaagugacuuguccaaggucacuuccuccucucugagccucaguuuccuccucuauaaaauaggugauaguaggguuaaaaugagguguguuaaacaccuggcacaaugcuuggcacagacgguucuguaaaugcuaauucucuucuuuuuuuuuuuuuuuuuuuuuuuuuguaauuugagguggggucuggcucuguugcccaggcugaaaugcaguggcuugaucucagcucacuuucugggcucaagccauccucaaaccauccucccaccucagccuccugaguagcugagaccacaggcacaugccaccaugcccuucuucacucugccucaguuuccccacacagaagugagaaaguuucuguggagcacugguccugagcagugcuagagacaucaucacuuacuuacgcacuaguauuuuuugagccucuaccgugugccaggugcuuuguagaaacagggcugggggacaugcagugguucacaaaacagacaaaaauuccugugcuccaggagcugauggccuggcaggaagagucagguuguaacaaaacgaaugggaaaaauauauaggagucaaauggggaugcgagcuaugggaaaaagucaagcagagaaggagaauggggaguguugggagcaauuuugaauaggguggccaggcaagaccuaccaagaaggugacucuaggcaaagaugugaaggaagugaagggcugagccaggugaguauguggaggggaaaaucuccagguagaagugacagccugugcaaaggcccugagguguguuugacccagacccuuggggagcacccagucugauggaggaggcugauguccgccagggacagugagcaacuuuugagacauaaugcagaauacaggagaauagugucaaagccagagagagggugccaggcugcagcuguggccgagcaaagacgugaucuuccacggguccucccuucucacccuuagcaacaaccuccuucgugggguggcuguaggccucccaggggugggcgugauucccagaacaauagcagagccugggccaggccagagaagccaagacaaacacagucaggcucugugaacuuccucaagccccauggcugagaggcugccugcucgcuggccauggcuuccagcccuggccacagaccagguuuguggcugacgugggggcugggcccacaggcagcagauggaccucauccugccaaggcccugcucucgugucuaguccagcaaggaggaguuggaggguaauggagggagagccccagccugagaggcucaggaucugaguucaagucacuuugccucucuagguugcaguuuccuuuuuuguaauuuucacuauuccaggaaguugaaacuaggcugccauuaauccauucaacaaauagugauaacgguggcgaaagcgcaguagccugugagugccgggcagcauucucagugcugcuagguagcucauugaauccuccucaugguuuggaguaugugcaguuauuagucccauuuuacagauggggaaauucagguucaaggaggcucauuaccuugcccagcaucccacagcuugucaguggcugugcugggauuuggacccaggcggccccacucccgaccugggugccccacacucuuccgccucuugugcccacccccgugccagccugaggaugcaguaaguagggcguguggcaggcaugucccugcugucacagaguggggucugggaagggggcagagauccagacacucacacaggaagugcaagcccugcagacgcacaggggaggaggccccggagugagcauggacauucacugaggcuggggcucuucgcuguuggccuccggagcagcucuuuuugccugguuaaaaacaaagcaggggguagucagagccagguccuuuuagcucuggaucccccagacugcaugacuuugaacaaggcccuuucacuuucucagccucaccuuccccuuaugugaaaugaguuagugaagccccucaccaacagccagggcgcugaggauccuuagggccugccuaggaucucugggaucaauggcgagcccugcugcccaggcccuuaccucccaaaggaugccuggcucccccugcugcugcugcugcccagacacuuaccucccaaaggaugcccggcucccccugcugcucagccacccucuuuucuacugcccagaggggauggagaaaaguuguccuugugaguuuccuggacaguugggccacagggcuuuugggucuagggcucagaggagccacggagguucaccagcaagaguggaaaaauaccacgucccacagcaaggccugcugggccaccaccagaggccccuggcagcagcuagcaccagccugucccuuggggaucccgggggagccacagaaaaguugaaagcauggcucucaggggcuuguccucggagcagcagauucugcaaagcaaggguggcuuucaaaccugcuacuguaaaccaaaacccaucugagacagggggcucgaugagcuuagagguuuauuuugccaagguugaagaugugcucaggaaagagacugagccacaguaggaucuguggccugcacuuuuuccaaagagaguuuugagaaccucaguacacuaaaggggaggcccagcacaguagcucacaccuguaaucccagcacuugggggagccgaggagggcagauugcuuaaguucaggaguccgagaccaaccuggucaacauggcaaaacccuguuucuacuaaaaaauacaaaaauuagcugggcaucguggcgcguaccuguagucccagcuacucaggaggcugagguaggaggaucucuuaggcccgggaaguugagacugcagugagcuuugauugcgccauugcacucuagcaugggcgacagagaccgugucuuaaaaaaaaaauguaaggggaaacagcaggaagggacagaggaacagguaauucagguaauuaugcacgaugucucucagcaaaucugcauuuuccauaggguagagaacacacacauuuuccauaggguaggguguguacacacgguggaggaaggagacacaugccuagauguguggguggauggcucauuucuugucucuuuguccggcaccugugaagaugagcugugaguuuacauugucagggugagggaggccgccuggggagauacguggccuguaucucacaacucucugcugaagaacagaaagcaggccgguuuugugcgugugugugacucacuucccaagcuuaacuuuuuccuucugcauagugaguuugggguccugagauuuuauuuucccuucacacggcugagguggcgugaccaggauuuggggaggaacaaugacacacaucccaaagguguggggaccugacaccagcuggccuggauccaucccgcauccaccaccaguaacugugauugcaggcaggugcccccaccucucugggcagucuccucaucuagaaaaugcaggugaggcugaugccuggcucuucucaguugucugaggauuaaaugaguuaaaacucacgaagcccuuagcugagugccccgcacaaaauccgcacugcauaagugcuuguuaaauaaacuaacuacgugaaaacaaagaaagccaccuccacaccccugucccugacacaaagcccucuggucacagaccacuggguugcuuggcccaguggaggccuggcuggcuuugaaguggccgcccucuggagaccccugcggggcugcugucagcagcuauuguucgccagcccggguguggcccacaaagggccccagaggugggaacuggucggggcgccuggccgccuguccgccuguccucaggaagggagaggcagguugguuuucuuuuuucacuucuuuccccccuucuguggcuuccugaugugcccccgcccuccacgucugccuucccauccucgggaaaucauguaggcuccuggccucaaggagaagagaugacgguggcuggagaaacugaggccuggaggaacaaaggacgcccgggggcagaggcagcaguagggcccagccugucagugucggagagccauccugacagugccggccaaagaggcuucuugaaugcucaccgcaggccaggggccaucgagcaaggucagcguucccuuauccucaguggacagauggggaagcugaggcccaggucaccagcaagggguggcagaggcagcgugcaaccccugguagagguggcuccccagcugacccacagccucucuaccccucgaccuagaguggcagagugggaggcaaccucagagcuccuacggucccagcccuuuacuuccugguggggaaacagucuagagcggacagcggcuuccuggaggucucauggcaagccagccucuaagcuuggcuucagaccugagggccucccuacuggcugcccucuggucuuggggagaaucaguaaacugccaguugugggaggcuuuuugcuggucugcuaugugugggcuguggggcagguccccauucuguugcuuaagcccacgugacccugggcaagugauggacucucucugggccucaguuuuauuguugcaaaauggagauaguaauacaacuuaccucagaggguuagggcacgggccagugaaaauagacgucacagcauuuggaacagugcuaggcacacaguaagugcucaauaaacgcugccuagggguuguugggcugagggcagcugagcuaagcaggcccugaaagcuuccuuuuugcccuuuuccaaagccccuuucucauuguuucuacucaaagggaucauggccacaagaauuugcucugucgagggucguggugccagcuaggugagguuuggggcucugucacuauuggucagugucuguuacauacuugggccccagcagugcccuggcacugcacccccaacuccaugggcacauuuguccuguucucuucaucucaguuuccucuccuguaaaaugggugcauugacugugcagugguuccuccaagguccccugauccccagaugcggcccagggcucugccaaccagucucaauguuucaagguggccaccaugaacuuucugcaugucgaaguaaaacacuucaugccuuucugcacagagguuagcccuccacaggcucuggguucaaauccuggauuccguugaugcccugggcacguccuuaaagcccaccaagccucaguuucuccacuguaaaccaccguccuggggggcauggugaggaugaagugggcuugugccugggacguuccuacucagccagugcccugccugaaacacuaggaucgaacuguccauucagccaggcaccuucgaacuccucccaggcauaaucucugucuggaaacuccuuguguugaauaagaugggaaaauccauccaugagaacugaagccacaaacagcgcuugcaggacaagaggagagaaggucuuugggaggagauggccacaucguuucuaguccccaccucacaccugaucuuggccugucuggaacaugcagugugacccagggaaggccaugggucucccagaggcccggugaagcggggagccuuuccuauucccaguuaagggccuuugagaggccucauuuucuucccugaaggucucguccuuccagcaaaaucagugucaacaacaggcccucuuucuggagcaccuacugaguggcaguguuacaagcaucauccuauugaauccucagcucaccccuuguugaggggcuucuauuacucuuaucugaauucuacucaugaggaaacagguccagagagguuaagcaaugugccuaagaucacacagcaaaugaggggacggagcugggauuugaacccuugcuuaucugaucccuaaccauaggaaucauaccaacauuguaguuaguuguuaacuaauaugaccugcaugcaaugggcacaugccaugguuggcaaccacugggcugaggcuucuacacacgcacuugauagcuuacucucugauuuugcuuuuuccaccucuacgcccuggaaugucaguuccacgaaggcagggauuuguuuucugucuuauccaccacuguauuuugugcuuagauggugccugggacaaacuauuuauaggauguuuuucauuuaaucucaguaaaucugugaggugggcuggcgcuguggcucaugccuauaaucccagcacuuugggaggcugaggcagguggaucauuugaggccaggaguuugagaccagccuggccaaccuggugaaaccccaucucuacuaaaaauacaagaauuagcugggcaugguggugggcacccguaaucccagcuacucgagaggcugagccaggagaaucacuugaacccaggaggcggagguugcagugagccgagaucgugccauugcacuccagccugggugacagcgaggcuccgucucaaauuuaaaaaaaaaaaaaaaaaaaaaaagaaaucugugagguagguaccuguauauacccagauuacagaugaggcagcugagacccagagugguuaagcaaugugccaaaggccgcacagcaaguaagacagcaaaccuggcuccagaacuccugauccugaccagugcuccccucugccucucugagaggaugcucagacuuagcagcagcaagugaugcccauggccuccugaaucccucucgcccuugcaggucgucuacuucacagccacuuuuccauucgccaugcuccuggugcugcugguccgagggcugacgcugccgggcgcgggcgcaggcaucaaguucuaucuguauccugacaucacccgccuugaggacccacagguacuguggggcugggacacaccauccucccucccauccagggcugggccggcacaggacagggcaggauguagaggccacuggcagcacaucuuccgugguucuucagugcacaggucuagcugggccaccgcccccugguacuuuuccaccgggccuguggcgggugugccuguccacggugcugauggaccuuucuagcugugugcaucucuuuucaugucaaggacgucugaggguggccacuuagagaggcugcuuuaggcccugcaccaagggggagaaaucuucugaugagcaagucucccgcucggacccagcuucugcccacugcagccacaagggcugcugcauccuggggaugggagagucggggccuggagagcugcgggcuuccuuggcugaggguggaauucagaguuaauggccuuggaggguccacgggcagauaccgaaagcacaccuucuggcacucagccuugugaccuuggggagguggagaaagcccugggagauuuucuggguuuguuugaggaccugaauccccagggccuuccgguugcuucccaagggccugugcucuccuuccccaccacccuucccccuggacaggacacaguugugagagggguuggccagccuuggaggacagcugggaacgagcugcuuagugaagauucuggagagcagcuuugccugcauaguuccuugggaccuccuucugcauucuaacucgggggucugcaaacaguaacaacaaugguggugacagcagccuugacuuacgggcuugccauguaacuggcacugggcugaaucgccacucuuugaaccugggaaauagcucuaugggguagggcaaaggagcccauuuuauagaugugaaaacuaucuauaaacugcaggagugauauuuacuugcccacugucauuccaggguuggaauccagauccaucugcuucugaauccucuuaacccugaugcuaggucgcugggaggugggguguuugauuucuggggcuccuugcagcucaguacugccuugaaaggcaccuuggauucgagcauaaauguuccauuugcaugugcaaggucccguccccaggccaucgccagguggacauaacccucgcugccuccuccaggaagccagcucugacagcccuccucucuuuccuugccaccucccucccccucauagguguggauugacgcugggacucagauauucuucucuuaugccaucugccugggggcuaugaccucgcuggggagcuacaacaaguacaaguauaacucguacaggcaaguguugcgccggcgggccugguggacuuuagaaaugaugaugaugauguuuaaagaaaaagagaaguagggagcguggcuuccuuguguugugaauuaacuugcucccugacauauguguaacuuagggacuguaugcugcugggaugccugaacagugguaccaguuuugugucuggcuucgcaauuuuuuccauccugggcuucauggcacaagagcaagggguggacauugcugauguggcugagucagguacggugguaucgguggcagugguggugggcacugccaccuaguguguaagccaaguacugcaggcaugaagccagaccccagggggcuuugaggggggacgagccugguuucuaaaauggaccccccccccgccaccaagauaucccccaaauuucaaagaguacaaagccaaauuuuaaacauuuguauugcaauuuggcccugauggguggcaaaagcauggggggugguuaaguuggggaauuuuuagcuaccuuaguguggucuuccccgcccccccguccuuccccagcaaacuccugguuuccacaauagaaaccacuuuccuaacucaggcccaagucagccaccaaucggcauuccaucaccaccuucucagccuugguuucuguauuuugcacuuugcucccagcgugcucccucuaagcagacgcauucauccaucccaccgauuucucgugaaugagucccaacucugugucaggcaccaccguaggcacugggugcaguguguggggggagggcguagaugaggggacgaccuacugggacgguggcagauccaacuggggguggguuguaagcacagugucgccccucggggugugggcccuguugaccaggcacucuuccucgggcuaccuggagucacaggcauggaggaugccaguggcuuagaaucacggacucugcacagacggggaacuuaggaaucugggaucccagaguuccagcaaggugcuucuggaaccugagaaucauggggccuucaguugcuagaaucugcaaucucucaggugccucgauucugggacuuggccauggcugcuugagguccugggucuguagcuuuaauugcaguggcuuggguuaugggauucccucaggcucccaggauccucaaaguccaccuuuccgaccucuccacccuuccccggcccugcacaguuuacuuggaggguggucaucaguugguuuuguuauuuuacaugcugagcccccagccccaccccguccauguccuaauuucauacaacuucccuggggcuaccuggagguggcaagguccugggcugaggcuccuuccaagccgaagggagagcguggggguuauuaacuucagggaccaccauagacuagggccagacacagccggaggcccugccauuccacugcccuugaccuccugugccaucuguauuuggaacaugaggcgaugucccagucccugaguccuagagcccuagcacuggggggucagaaggugccucagcaucgcguguccagauguucccuucucagaugaggagaccagcaaccugagagcaagggcuuugcuugggauagguggggcuacaacagggcuuucugaacauccuguccacuauuucuccacuugucacacgcuggacaggccuucugacacaagggugucccccuccugccauccagcccacccuggacacaugcaacaaccucuggcccuuccagugugagaauuuggcccuugugaccucccagagccccuggccccuccucacugucuucuuugcuuggcagagaugcacacugcccagccccauccugagaccccugacaacacugcaggacccccuuggcaaauccacaugucacccccacacaccucuccacugucccugcuuccaaaguggacccucagauguacuguucccuccacugagcccaaagagcccccaaaagcaggccagagacugaggacacagaauguaacuccagaaguccccacgccccuuagggaguuuggcaauuagaguggugagggggagccagagaugauuuauaccuccucuguagauggcuugcuuucagcugagggcuugcaaaccaaucgcaauugagugggaaucuccaggaguauggagugaauuuggcaaugggagauacagauagauacauacaauguaucuuccuccauggacaacgaaguauuuucguagacacauauauugucaaucucaguuguuuuuuccucccguccacuucaaacaccuugucauuuauuccccacggugaugucugaacagccggcacaucaagggugauuauuucucuaauaagcuuuuaacaagcaccauauugagugaagugcauuugaacaagauaauuauuuagccuaacagagugcaaacaagacguggcauggcacauugucugcuagcagagaggcauccagagguucucggaguggcuggauuaugucuccuggacuucucucucuugaguucaccaugcacuuuuagagaaagacgcucagacccucucccagaggcucgcuugagaaaggcaaaacuaaaauacagaaacgagcgaauugagaaucuucacaacgucccugguggguuggggguugugggggcccauuuugcaucugucuugcagcuggcuggacucgauuccucauucaguguggaccagucagggccaacgcugauguucuguagggaccaguggggccccggucuggguggaaacgccgcggcuuuugacuccaacuucaacuuugauucaaaagucaucucaccggguccugggguccauauuuuucugaaccuggcccugguucuuuugggcauguucugagcaguuuugggcuugguaacccccgcuccugaugggggucuccagcaucucagcgagcaaccacucugucgcugcccaaggauauauuuuggucagguuuucucuggauuguaaaaggacacacccuucccuggcacacuggggguguuaacaccguauaaugugguuucugguuccaauuuauuguaaaguuggguuuugcuuuuuguuuuucauucuugagccauucgucugguuucuaaucccugcugaacagcuccugcucuggcccuuuuuguuuccugcuucuugacuuuuuuuuuuuuuuuuuuuuuuaguuguagauuuuacuuucuuuugcugcccucgcuucucagacccacaggucucaguuaacaauuaaauuauuuccguuggcauccgcuuucaggcaggcuggagacaggaggagacauuucucucugucuccggaaugucucccaucagagacauccccugagcugacagagcucccaucuccccagcucucccucagguucuauccaagucccuucuuuugaaacccagagcccuuuucuagugacauggugucuaccucugagaaucuaaacacaggaaggcuccuugugagucauuuauggccaccugccccucacuuuucagguggggaaacugaggcccugagaggguauggggugauucaaaaaggaaauuggaagaggaugacuuggaugcaggccucagggcuugcaggccugggaccuugccccugcacccauguucccucagcuuugggcccugguuggcccaaccuugaccucaugggcuuggcucugaccuugccagggagagccccacaaaugcaccccugaagagacaggccuccuguugggcgugguuuuguauugguuuuucuuuccacuccuaugguguuuuagccauuaacucaaaaauagaaacuuucccuuugcaaaggagacugggcggucaggucaccaccacgcucccccgccuccuuccagcaaaggcuguccacucaauggcuuugcuuuggggugggaggauccucccuuuccuuugucucugcagaccaagcccugggcucagucugcauccuaccccaaauaaccacgccccgauggaugcuggugugugaggaggccacgugugcuguguaggagacagaugcuaaaaccgggccccuccugagccccagcgugucccacccaaaggcgagacaggccuggucucuuuccccaggccagaguucagaccuggcucccugcuguauuugggucugagugucuuugugugagcccaggguucccaguggcuugguggcugaugucuccuccccugugccccuccccguuuucuuuccuuucuagguccuggccuggccuucauugccuacccaaaagcugugacaaugaugccgcugcccacauuuugguccauucuuuuuuuuauuaugcuucucuugcuuggacuggauagccaggugcguauaagggauggcccuggggcgacugccccuguggggaaccugacucugggaaagacuccuuauuccaccugggagguggucaacccccuuccccccuccagucagacuuccagugcuucagcugugaggguuccuccaggacaccaggaauagaaaaagcucugcguccccagaaagugcauuugaacaagauaauuauuuagccuaauggagugcaaacaagacguggcauggcacauuaucugcuagcagaggggcauccagagguucucggaguggguggguuaugacagggacaaccaggguuugugguuacagucaagccacaaaugacgaauuggaggucaugacucaauaagucaugaugugcuccaguggagcgucggcggggcacaggaggacauggcagaugggcgauucggagaagggacccacauuucugugugagcugaucauugucugggccaucguaauaaguugcaagugcccaggagaagccuacgccacacucaggauucugugcucccuggagcgugcgaggggcugggcauuggcucccucccgugcuuuauacaccgcacaggccgggagccucgcucaaacccgcccugaccucuggcuguccuggcuucuccccucccaaggcaggacuccugucuccacugagguucuuuccugcacuucuaaaccccguaucccaccccuucagggcucaggccuccacuagaaggugacucauggccagggaaugccagugagagccgaugaguggcugcaucuggcuguagaguagccagugccuagugugggguagucagcagugcucggaggacaauucacuugagcuccugggccccuuucccuggaaauagguguauuuuugacagggucuuguugaaacaacaguucagagcacaggcaugacuccaggaguagggauuuauggcaugugggacaggcugguugugugcccagcccagcaugagccccucaggcagcgccaugcacaugggccacugagaagcagguaggauguagacuguguagucugggucuggaggucugaaugccucuugggaagccuuugagcaacugagacccccugagagguuggagcuugcagccagggcgggagaacccuuugucccccuccccgcgggccgaagucuucagagucauugucccaaguggguccccagaaccugguaggggaaaagucucugaaggucaagcagaggagggugaguccagggagaggaggcggccagccagcaaggucaagagcagagcaggggauuuggcagagaagggggcaggauuagcagagaagacagaacgaaaacaucagggagacggaaaacaaaauacuucugcaguuguugauagacuugagcugaauaaacaagcaggaggacuccauuaaucauuccuaguuaaugaguuuggccuucagaggccccaagcaaauggcuuuuauaacuucuuccagagcucuaagugaaagaaaaaaacaaaaacagagguuaauaaaugacaaggcaugacaucuucaugggcccaaaauaggccacuugggcuuuggaaacggcucccugagcagguggagguggucacucauuagauuuucuccccaggaaguggggccugguggaggacacgcaucucucagggaggccccgugucaguggcacacggagagaaucuggugggcucucacagccacuccuccuacuuugcagagcgaggaacucaaggcucagagcaguuagaugaccugccagggacaaggguagaaaucgaaccuaagucacuggucucccaggccccaugucccagggaaccaggaugggaaucugaucgcacagguggggcuuccuccuuugcaucucuuugcuuugugaacuuggggaaauggggaagguuuugcagaugccagcagugugccucacccacugccagcacugugacaggaucagagcccucugccguaagagguguucccugggugccgguccucauggcaggcuucugugugugcguguguuuggggugaccacacauuuaccaucuaaaccagguuuaagugcacaguucaguggcauuaguaccuucagacauugcgcggccaucaccaccguccgucuccagaacuuuuuccucuucccaaauggagccucuguccccauucaacacugacuccuaacuccccaguuugcccuccugccggccccgcaccuggcuuuuuguacaugaacuccuuaagcugcaguguugcaaugccuggguacuauuuuuacccuucuuauagcugaggaaacugagacuuagagagaccaagaacuuagccaaggcuccacacagcuagugaagggcuugauaccaggucugccugucugcagaaacugucucuuaccugcuaguuugucccaacuggccuuccccuugaauucccccaaaauaacuuccuccuguuggaaguauggagaucuacagcccagaggcagaggccucccgcugauguuauugcguccugggcaagggagcagggggugucacccugacucaucagggguuccuaccauuggcgggaacaguccgucuggccuaagagccaucauacugcugcgccuuucuuggugagacaggguagaggagucagccauguggaggcagaugccuguugccauccaggcuacccaagagggacacgguuuuuuguuuguuuugagauggagccuugcucugucgcccagguuagagugcaguggcgcagccuuggcccacugcaacuucugccuccuggguucaagugauucuccugccucagccucccaaguagcugggauuacaggcaugugccaccauaccuggcuaauuuuuuuuuuuuuuguagaaacaggguuuugucauguuggccaggcuggucucgaacuccugaccucaggugaucugccugccuuggccucccaaagugcuggaauuacagacgugaaccacugcacccagcugggacaugguuuuuuuuaacaaauugugagaggagaugagaguuggaacccacuccuccugcaaccaaagagcucacccagcccgcugacauggguuaacaguuaucucccacuugcagauuuacucuaauaauuucaaaucuuucucaacaucccugccaaguggacaagauccucccauuucacggagaggcaagugaggcucggagaagccaaucacacagcuguuaagcgacggagggcugaagaggcugguggagaagggcaguguucucuggaagcggcaggaacugagaaauggggguuugugcuggucuuggcccugauucacagcgacacugaccuuccugucuuuaauuuccccaucucaaaaaaggaaagaaccuuuguuuuuagcuccuuuugaagcuuaaguguuugagcugccgguuugcuauaauucgguggcaauuuagguucaaaaccccugcggcagacacaugagucagaggucaaaaaagcagccucuucucuuggaucccucuugagagccuccugcucgucuuuucccuuauuccugguggcagucucaucucuccagcccuugucagcacaugaaagggauuucuccccguuuguguuccuucccuggauuuuccugcaaugcgucccaaaggaggaagggguuagauuucucugguaggaaugcuggggaaacguccuucccaaaagccucguucagaugaaaggacaucuggguccagguugaauaagcucuucaacuuuugaaggaaucagauaggccuuggaggguguguugguuggcagggaaguuuggguguagccauccaaauuuaaagugcugcugugugcucuuuaaccccaaagcuucucuuuuaagacugugcuacaugcacagaugccugcacacaggaggagaggaagagcugagucuggagaccaucagcugggcauuagaucaauggcgaugccuacccacaggguggaguuuuaucaauuaaaaaaugaggcagcuuucuguguaaugauguggaacaacccccaagauaaaugguuaggcacgagauggaaagguuuagaaagacugagaauuccccugaaauguuaccuacagaggggccuuuuccaaccagcuucuuuuccuuugggagcccaggaagggguuccuggagucccaggcagcacacacagcgugugugcgcacaugcaaaguccucucaugggcuugugauccccaaaggauugaaagccacugugugaaucugaccugaacugccugccauuccacugauggggaaacugaggcucagacuuccccugaccugccaagcaaguuggugcuaagguccacccauucaucacauuuucugagcagccaaugugucuggcagggcucggcauucgaggcccaaaagugaaugugauaccacccuuaucuuccacgaggauggagaucagugagggagguugucauggcaacacauauaugccccugaaugugccaggacagagggucagcauuggcuucagaggcgcaguuguucucaagcucagcuuuggaggauggggaaaggcauucugguggcaggaacagccugagagaagaugcagagguguggaauauuuggccagcucgguguggaccaccgaauguugcguugucuggcuccgaggaguggcaggcgggacuccccaggcacagucagggaggccaggcuuccacacuuggacuugaucucacaggccaauucuggacacaaggauggucacgucugcuccugcauuguguguuccugggcccuucccuccgagcagcaggcaaggguggccugagcgucagccgcucaccagcucucucucuuccccuccucaguuuguugaaguugaaggacagaucacauccuugguugaucuuuacccauccuuccuaaggaaggguuaucgucgggaaaucuucaucgccuucguguguagcaucagcuaccugcuggggcugacgauggugacggagguagguggcucucucagcuguguuucaggcuuggugcuccagugcccuccucaaggccauaguggaggcagcagcugggugagagggccagguaggggcuucaucucccagccccacccaauucagggguccugcuuggaccaacacuggggguagcacgagggggcucaggagcccacagcugacccaaacuacccaauuauuuugccuguugcuguggcaacacugugaccacccgcugcccucuguccugggaagaggaucuucagcugaaauccauuucacaacaucucuguucaccccugacugugugcccuucucaggccugggggugggguggagacauucucaaggguaaacgcaggccucccaggaaauaccacagcaccacguagaggugcaccaccuugcaggucaccugccacaggaccgaguccugguggguauggguugauagggggcacauacacuauucagagggugagcaggggccaggaggaggggcgauuucagaugcagacaagggaagcaaagagcagaagggaacgggaacgucuaagacgugucuagcaagaggcaagccagaugagauaaagauuguacuaagaauggaagccuagcaucaaagccagggcacgcucucuccugcaugcccccccccaccaccuccccuguuccccaggaacgggucccauuuaacaguucuccgaaaacccaauucagggcuucacuucaccauuuuuccuuaccagaaguaaaaguguuuuucuggagguauuuguaagaacccccaccccagaagucagauuuuagggccacucacugagcagcugggugacccuggagucuucucugucagcugcacuuggugugaagcaccuccuugggaagcaggcucccguggacccaucauuuugcuuucauuuaucuguauguguguuuuuaauuacauuugucaaacaugaaguugagcaucuuuuuguauauuuaucuggucaucagagucuuuguccauuuuucucuuggguuuuuuuaaucuuauugauaugccagagcucuuuguauaugaaagaaauuggagaccagguaggaaaucgaccuucugugguuuuuuucuucacaggguggcauguauguguuucagcucuuugacuacuaugcagcuagcgguguaugccuuuuguggguugcauucuuugaauguuuuguuauugccuggauauauggugaguacagauuuuuucauguccuuucucaaggcucuccuuugggcuucucuacuuagaagcuucagaagcagagaauacuaacagaaauucaauuugaguugaacaguaggcccucccuaccuagacuacacaaauaaucucacuguagccacacugaagauccuccuggugcuaaaggugugaggugugacuggauguuuucacaguuucagaacuugguugugcaggaccuggaauacuccuuuuuuaucuccuugaggccuuggguuugaguuugggcugugccuaagauugcacaccuaggguuuggagugugccucagauugccagaaaaauacaagaugcagaguuauauuugaauuucauguaaaugucuguuuuugccacacuuguauauccaugguguggagaugcagaggccuggaucaggucccagagaccccacucauggccccugagcugcugcuggccuugaacgcugugucagaaaaugucccccucugucucuugcaggaggugauaaccuuuaugaugguauugaggacaugauuggcuaucggcccgggcccuggaugaaguacagcugggcugugaucacuccaguucucuguguugugaguuccauuucuguggcucuggcugguggccucuucucccuggggcuugacauuuucacccgcuaaaccaucuuucaugcagcaucuguucagcgugggcuuauaauaaacccagcuucagcgcugccugggagaggggaggaaggcugcuccagggaguuagcuugaguugaguuuugaaggauaaguaggaauuugucaggaguagaaaacaagaagggcauuucuggcagaggagccagccugugcggggccaaggcauccuaaaagaagaggguguaucuggagcauguugagaaauccaggggauccagaauugaaagcacauucuuuccccaaaccuuccagagcgcaugagcucuguuugggucacuggggaaguagaggggccuuugggauaucuaguagagaggucauagacauuggaaaugggguguuuccauggagagguggggguaguagcuuagagaggggaaguccuggguucucccaaggauagggaagcuuuggacucacccaggcccaaggguaucagugugccacguuguucuucccacgaggaugcucucgcccaccauguuggaguuggccuuggcaccugcccaugcagucugcuucauggucgcacuccagggugccagugaguggaauuccuccauggcaaagccgucaggguuugcaaucacuugugaucauuggagcuuauugccagggagaccacauccauccugccauucacggcuccacuauggggagcacaaauggcccaauauuccuuggauuuaggagacaggugcugaggacaaauaggcccuccccuccgugaccugcuaucaggccagacuaagucaauguugcuguuaacucaugauaugaccucaagcaagucacuucccucugugagccucaguuuccccacuuguaaaaccaggagacugugaaggaggaccccgguggcagcugacgaccuuagacuguuacuguuauuuaauaugcauaugaagccuuuuccucugaagugcagacuuucucccacaaaaauaaguaaugguaagagccaguaaccacaacaauuggugaguuuaucuuuggagaugaguuuaguuggcccaccuguguucucauccugguuuaauguuugcuugugggcagcucuucucagcacucugacccucaguuuccuuaucucucucccugaggagcuggauacgucagagauaggcugcauucccagguggugagaugaggucacccucauggagaggaaugggaaacaggcaggcacuggcucaagcuccuccugcuugggagggcccagggcagcaucucuugggacucacucaucugagccacagcccuacacguagggacgggaacaacagcagggccagacgugcaguuggugcccaguaaaagaugccugcaggcuagugcucucccuugcccaucaccgacucugcuuuagaaagaugcaucuuccugucaaaucccaguuacuagguguugaagaguuaggccauuuucacauuauggaacaaucagaggccacccugggcccuccucagagaugcugucauucugacuagaagcagaagccccgggagccccgagccagccuuaggugcucuucucacagggaaaggugggcuuugcucccuuuagaggcacagggcugaccccaccccaccauucaugcaugcugauggccacuagccauuagcauggacccagggcugggcuguggacaccgaacagggcaaggcucaggugcccaggccccugcugcugguggcucagagauagacauggaggguggcagugggggaagaaaggcuuucaucuacgcugcuagcacuuauggugcacuuguuguauguaccuggagcugcacuggguguuaaagaacuaggacaagacacacacauuccuacucucagacucacagucuggcagaacacgugugcccaagagaugguuacaaccacucgcuuucuggaaggagagguauggguggugccugggcaaguaaggcagacccaguggagccaaguuaggaugagaagaugugggggaaagagggccaggcagaggaaacagcccaugccaagacccagaguucagugacagaggagcuagaaggaauucuucaggguggcuggaguguggacacggagggagaguugaggcagaugagggaggaagggguacagcuucugcugacacucccggcugcaccgaggaguuugggcugcaucugcuggcacugggagccacagaaggguuuugagcagggaaacgacuuacuguguuuuuaccggggcgggggggauccuuauggcagcagagaggggugugaguucugagccaguccuuucccaaggagagagacccuucccucagguugaggccaguccuagucccagaagccccccaccccccgaugcccaggaccccucuccugacugcccccaucucuccgcagggauguuucaucuucucgcucgucaaguacguaccccugaccuacaacaaaacauacguguaccccaacugggccauugggcugggcuggagccuggcccuuuccuccaugcucugcguucccuuggucaucgucauccgccucugccagacugaggggccguuccuugugguaagugcuugggcccagggccaggggaggugggaggcgcgaggccaaaggugauuguugucaguuugcugcgugaucucaggcaagucaccugcccucucugagccauaguucccucacccauccagugguucagcuuaugggcagcagagugcauugugggaagacgggaagcaaguagaguucacaugggagaaggcuuuauggagacauuggaagccgggcuguggggugaggaggaacuugccagauggagaaugugagagggaagguguuccugguguuggcagaguuggggugggcagugaggcuggagaggugacuguagcuuuggaugccaagcuaagagcuggggcuuuauccugggaccaguggggccauguuccugaagcggugggacaaagccaggagccuagggaggaagccugagccccacccagaugccuucuuuuauugaggagccaaauuuaggaucaucccagcccaugcuggggucuucuccggaucuguggcggcagccagaccucugccucugugccugcuggggccuccccuggccccaccuaccuucagccuccucucagaaauuccuccaacagcccuggagaucccaggcccuggcaaaggcccuacucuuuccaagaaauucuuuucucagaaucucccuuaaccuuuugagcuugggcuggcuccaagagugcacuguuuuguucugggcuguuuuuauuguuauucucuuuuaaaaaucuggagccaggauguccuggggcccuggcucccugcugggcuggguccuguuuccuccugggcaggggaauggccuggagguggugcugguggcaggggagggaggggagacugaggaagcuggcagggcaggaggaaauccuugaaacugggggggccccugggguuauccuggagcuuuugacccauucuauuuuuucagaggacagagggcagcaccccaaccagucuuuagccagaacgcuaaauggcccuaugagcuguuaacagacugaaauacugggccuggggacaggcagggaacagugacugucccgagcccuccaggugaccccacaauacuccaggccaacccaaccagaguuuccagaauguccuuacuguccagaagccaaaggguucauuagggcacagcaaggggucucuaaagguucugauuggucuaggggucucugcucugauuggugagugcccaaagcaauuacauaccauugguucagggggacacccaacaggucacuaacuugguguccuucaaagccucauuuuaaaauauugguccagcccacauuuagaaguuuggguggagugggguuggcaugggggaaagaggugggggagugggugagggcaggcuucaccccacacugguaccccguccuccugugccagucugacuucaccaaaggccccugugaaggcaguugagccaccaucugucugucuuucuuuaugugccccucaggggcucccaccugcacaagucaucaagguguccucccagccaugagcuucucucugagccagguucuggcaaacccagaucucugucccaggaugguuccagcucugccugagccuccuguguaggcagagccccaaguggcugccuggggguuugacucuccuccgcccucccaggcacagcccauuguauggauguggagaggcaaagugauggagggagagcuggcagguggcucaggugagggaagucauggggguagggcugggagcaaacuggagaaggugcuacaaggaggggaccugggccuggaguugccagaucuugcagcuuuucaagaaaagauggaaaacuggauuuaaaaacaaaaaaaauagagacagggucuugcuccuuugcccaggcuggagugcaguggcucaaucacagccucaaauuccugggcucaagcaaucuucuuuccucagccucccgaguaacuuggacuacaggcacguaccaccaugccuggcuaauuuuuaauuuuuuuuuuuaagaguuagggucucacuguguugcccagacugccuuuaaauccugaccuugagcgauccuccugcuucccaaagugcugggauuaccgaaaacuggguuuuuaaaugaaauacuguagcuuuuaauaagcagcuuuuaaaaauuuguaacauaccuaaguugaauauaaaugccuagaaagagggcuuguuguuuuguuuguuugucuuucaacugcuggccuauucaagucucugaguugacaguuggcaagagguggacuggggagugggagucugguugagucccaguucugacauggauuuucuggguauccuuggagagggacacucaaccaacugugaggacaaaacucacccugcucaggagugaucuagaauucccaugcagcuccuaucucuuggaagggcagcucaaaugcgagcaagguucuccaagcccuuaagauguaaacccugcugggaggacuggaugccuucaggaaacuagggaagaccugucucugcaagaaggcaggaaguguagcuuaugggaggcugaggaguuuggaguuucuccuuggggaaggugggagccauggaggcugaagacaguuguccaacucagggcauacaaaugagaggaacucaacugcugcuuugcaaggcagagaaaucagagggagagaaucacagggaggcauauuuuaguuccauagaagaaaaaaagcacaugaagguugagucccccaucccuguaggaacguaagcagggguuuggccaaggaaggaaaccaccaacaggaauuccgccuugagucagggccuaguggcaccuuaggagcgccuuaguucaauuccauuauuuccaaaaaggacaaaaacaggagaucagagagggugugaguuuaccaaaaaccaaacagcacaugagccaauucaggaggaggcagauggcccuggcgaaggggagaccaggccgccugacguuuccccccucacuccugucauccuucuccagagagucaaguaccugcugaccccaagggaacccaaccgcugggcuguggagcgcgagggagccacaccuuacaacucucgcaccgucaugaacggcgcucucgugaaaccgacccacaucauuguggagaccaugaugugagcucucucgggucgacggggccggcggcuuuccugcuguuuacuaacauuagauucucauaggaccagguuuacagagcuuuauauuugcacuaggauuuuuuuuuuuuuguaauugucacagaaaauguaauuguggguaugugugcgugcguguguguguguguguguaucguguguguguguuuuguuuugauuugggggauauuuuguacaaaaagaaaacccacgggaagauguccguggagaggcagagcuuucauacugaauuagauguauuuuaugggaauuugguaaauuuuucuuuguauuuuuuuuuuuacauauaaguauauauacacuuagagauugucauauacuuuuaccacuugaauugaucuucuugccagcaauagaucucauuuucaaaagcaauucuucggugcuguguagcuggcagaaaguucuguccaguaaacgcaggauggaauuuuccugggacucuacacccaucuuaaggugguauaccuuccaaauccugguucagauggaagaaauagcaggagagaggacccauuagcuggcagacccagggggaagaaaggagggcugugaggagauaccucauuaaacuuggcuuagugaagaagagagaugccaaaggaaugaaccaacccuucacauaaaggagacuggcugaagcugaaugaggaggcccuauagcagaagucugauucuaagagcaguagaaacuuguaccagaagcaaaaucccacuuuuaauuuugagauggugaguggauagucaguagaccgucagaaccacuggccagagagggagcugcuagagauccaagaaggcuggcaggagugaggcucacaacucagccucgcaagagguggcagaggcacaggaggccacaguccuuccuggggcauuccaggcagagaaggagcagaggcucucccggcaggagcuggggucucagggcucagaugagucuguugcauuugaauggggucauagcagguucuggucauuccccaagcaacaucucagcaucucuuaaaguugccugcaggaaugaagcaugacauaccuguugagggacuaggggagugguggggaggugaguggaccaaaggauauaggccccaggcaugcagaugggcccggugucggggaggggugcuuucuuuccucaucuccccacuccccacucucagccugggagacuccugccaagcccucauuaaagaugccacccugggcugcccuggcaccuagcaaggcacaccaagaacagcuuuugagucuguauccuccacugggggaagugcucccaguucagaacaagggcagcccguggugcugaccuaggauauaacaaagcucuucacuucaaaaccccugcaauagcuggguuuacagacauuuaccaccugcggacccaaaagagaaggccuaggagaguuuucuagaagguugggauugucaggguccuggccccucagaacuggcuugaucaagggccuuauguggagcagagguugucucugaaccaggagagaagguacuauaccuuucaaauccccagggcagacacacccccacccagccccuauuuggaccuaaacugugccauuugaacagucacuuccaagcucagucuaaaugaaaccgaaacgugaccacgcacaaaggcagucacugccucgaggggugcagaccgcagaauuuucacagcaggggcucuuggaacccuggaaacccccuucuuaaauuugggaggaggaguaugccuuuggugucccccucccaaggggcaauucugaaccccaucuuuggcaggcauacauauuucacuguuuccaaagcuaucuacucugccaaacaacacccaguccuauuccaaacucucaacgauucuaucuuguuccuguuuuucuauguauuuaugguugccguuugugucugauuugauuuuacuguuuuuucccugauuuuauggaguagcauugugaccuguuuuccuuugucuuauauaacuuuaguaaacuaaccacugucaaugauugagggcagguggcacguggggaagaggggacuuggcacgcaguggcuaccugggcauuuguggucauuucaguuuccaucuccccagcgggggcucccugggugaaaggccacaguauuuuggguugguaggcaaauugcaacauucuggacauggccugaggaaggccucuucuuauaagauucucagaccaaauucuagaccaaagacacaggcagaccaaguccccaggccccgccuggaaggaagucguuccucaacucuccccaaggcaccugucuccaaucagagcccucucgcccagccagcccuggcucugugugcagagcauagcucugcgaguaccuguguaauaaugcucaaccuucaugucuccguauaaacgaaacuuuccaugagagcucaugacucugguccaccugucuauagagaaugggcaaaguccuucaccugcuuucugcuugggaugggucagaaaugcugaugcccgcacauagcccagccagccagaucuggaaaggaagcgaggggguuguuuaaaucaauuuuuuaagaugaagaagugggagacacugcguugagaugggccaugcuagggccacagagauuuccugacggucagggagagaagggccuccaggguccccuaacccaacgcccuuguuguaaaugagguaacugaggcucagggaggcacugugagccaggaauggauuuucuugaaacagcucuagcugcagguucuccgagguaggugcagggaauggugagugucuaaccagggcuacauccagcaacauccucaaggucuuccugacaaccaaagacaagccuuuauggaaaaggaaaugcgcuccccuccauguucagggaugaggggagcagcagcagccacacucccaccauccucacagaauuccuggacccaugcgguggcuccgugagcugggugacuccagccucaccugcacaccccagcccugcacggggcccuccuuccucccagcagcccuuggugagcuaggaauugagaucccuguuugugaaagagggaacugaggugcagagaagccagaggugugccagauccuuaggcaggauuuagaugaagucgcccuggcuccagacugaccccgaggcucugcggggaguuuccaggcagcaggaaguggccuuggaugcucuccuuccaggacagcauaaccccugggccaugugcagcuccuucacugcccccuggauccccagcauacccccaaagacaguggggaaacacaaggggagagcacagcauggccccuccagcccacuucagggcacucuuguaucacccggguaccgccacacuggucccccacccagccagcaucucccagcacagccccucucccuggggaaaugcucuggguagccagucuaaaggcagaggcaccuaacugcuccccgcagcccaccccacccaagauucagacacaagccaggaaaggacccaagagaaaauccuucaagguggccugaggucccaucccucccucagacccauguggucccaggccaggcugccugggacacgguaaauaccacugugugcaaaaaucgaaguacaaaaccacaagacuaaacaaaacaaacccagagagccaaacuuguagaggugggcaguccagaaagcagggggcagcccucccccuuuccuucucucccugauccucagaauauauauuguuguaauaggaagcauuuuugcauuguucucuugugggugucacuacagacauguucuggcguguucuccgagggauggagcauccuguuauauauuugacuucaaauugagauguuggcuucauuuuuuuuuuuuacccaauuaaucucccaaucccuagcaacugugacucuguauuuagcacaagagaaagcugagaaugugggucuugccuccuuccagaaauaugucuggcucaucaggacauuuuuuuaaaacuucaaaauauuuuuaagauauuuuaaacuuuuauaaaaaaaaaaucaaccaacaagagacuuuucugaggaggaacauuuguauuugaacaagauccuugguguguaguucagucuugcaguauacaagcuuuuguguauaaauguuuuaugauaugauucccuguauuuugcagggguuuuuuucucuuuugcuuuuuagauaaauauguauaucaauauuuuaaauucaucuuugcuuuuuuuagaggaguuuguaaucaccuuauaacaugaaaauaaacauuuccuuuuuaacauccaa

SEQ ID NO: 14799 - RNA, 86805 nt, Homo sapiens
uuggauguuaaaaaggaaauguuuauuuucauguuauaaggugauuacaaacuccucuaaaaaaagcaaagaugaauuuaaaauauugauauacauauuuaucuaaaaagcaaaagagaaaaaaaccccugcaaaauacagggaaucauaucauaaaacauuuauacacaaaagcuuguauacugcaagacugaacuacacaccaaggaucuuguucaaauacaaauguuccuccucagaaaagucucuuguugguugauuuuuuuuuuauaaaaguuuaaaauaucuuaaaaauauuuugaaguuuuaaaaaaauguccugaugagccagacauauuucuggaaggaggcaagacccacauucucagcuuucucuugugcuaaauacagagucacaguugcuagggauugggagauuaauuggguaaaaaaaaaaaaugaagccaacaucucaauuugaagucaaauauauaacaggaugcuccaucccucggagaacacgccagaacaugucuguagugacacccacaagagaacaaugcaaaaaugcuuccuauuacaacaauauauauucugaggaucagggagagaaggaaagggggagggcugcccccugcuuucuggacugcccaccucuacaaguuuggcucucuggguuuguuuuguuuagucuugugguuuuguacuucgauuuuugcacacagugguauuuaccgugucccaggcagccuggccugggaccacaugggucugagggagggaugggaccucaggccaccuugaaggauuuucucuuggguccuuuccuggcuugugucugaaucuuggguggggugggcugcggggagcaguuaggugccucugccuuuagacuggcuacccagagcauuuccccagggagaggggcugugcugggagaugcuggcugggugggggaccaguguggcgguacccgggugauacaagagugcccugaagugggcuggaggggccaugcugugcucuccccuuguguuuccccacugucuuuggggguaugcuggggauccagggggcagugaaggagcugcacauggcccagggguuaugcuguccuggaaggagagcauccaaggccacuuccugcugccuggaaacuccccgcagagccucggggucagucuggagccagggcgacuucaucuaaauccugccuaaggaucuggcacaccucuggcuucucugcaccucaguucccucuuucacaaacagggaucucaauuccuagcucaccaagggcugcugggaggaaggagggccccgugcagggcuggggugugcaggugaggcuggagucacccagcucacggagccaccgcauggguccaggaauucugugaggauggugggaguguggcugcugcugcuccccucaucccugaacauggaggggagcgcauuuccuuuuccauaaaggcuugucuuugguugucaggaagaccuugaggauguugcuggauguagcccugguuagacacucaccauucccugcaccuaccucggagaaccugcagcuagagcuguuucaagaaaauccauuccuggcucacagugccucccugagccucaguuaccucauuuacaacaagggcguuggguuaggggacccuggaggcccuucucucccugaccgucaggaaaucucuguggcccuagcauggcccaucucaacgcagugucucccacuucuucaucuuaaaaaauugauuuaaacaacccccucgcuuccuuuccagaucuggcuggcugggcuaugugcgggcaucagcauuucugacccaucccaagcagaaagcaggugaaggacuuugcccauucucuauagacagguggaccagagucaugagcucucauggaaaguuucguuuauacggagacaugaagguugagcauuauuacacagguacucgcagagcuaugcucugcacacagagccagggcuggcugggcgagagggcucugauuggagacaggugccuuggggagaguugaggaacgacuuccuuccaggcggggccuggggacuuggucugccugugucuuuggucuagaauuuggucugagaaucuuauaagaagaggccuuccucaggccauguccagaauguugcaauuugccuaccaacccaaaauacuguggccuuucacccagggagcccccgcuggggagauggaaacugaaaugaccacaaaugcccagguagccacugcgugccaaguccccucuuccccacgugccaccugcccucaaucauugacagugguuaguuuacuaaaguuauauaagacaaaggaaaacaggucacaaugcuacuccauaaaaucagggaaaaaacaguaaaaucaaaucagacacaaacggcaaccauaaauacauagaaaaacaggaacaagauagaaucguugagaguuuggaauaggacuggguguuguuuggcagaguagauagcuuuggaaacagugaaauauguaugccugccaaagaugggguucagaauugccccuugggagggggacaccaaaggcauacuccuccucccaaauuuaagaaggggguuuccaggguuccaagagccccugcugugaaaauucugcggucugcaccccucgaggcagugacugccuuugugcguggucacguuucgguuucauuuagacugagcuuggaagugacuguucaaauggcacaguuuagguccaaauaggggcugggugggggugugucugcccuggggauuugaaagguauaguaccuucucuccugguucagagacaaccucugcuccacauaaggcccuugaucaagccaguucugaggggccaggacccugacaaucccaaccuucuagaaaacucuccuaggccuucucuuuuggguccgcaggugguaaaugucuguaaacccagcuauugcagggguuuugaagugaagagcuuuguuauauccuaggucagcaccacgggcugcccuuguucugaacugggagcacuucccccaguggaggauacagacucaaaagcuguucuuggugugccuugcuaggugccagggcagcccaggguggcaucuuuaaugagggcuuggcaggagucucccaggcugagaguggggaguggggagaugaggaaagaaagcaccccuccccgacaccgggcccaucugcaugccuggggccuauauccuuugguccacucaccuccccaccacuccccuagucccucaacagguaugucaugcuucauuccugcaggcaacuuuaagagaugcugagauguugcuuggggaaugaccagaaccugcuaugaccccauucaaaugcaacagacucaucugagcccugagaccccagcuccugccgggagagccucugcuccuucucugccuggaaugccccaggaaggacuguggccuccugugccucugccaccucuugcgaggcugaguugugagccucacuccugccagccuucuuggaucucuagcagcucccucucuggccagugguucugacggucuacugacuauccacucaccaucucaaaauuaaaagugggauuuugcuucugguacaaguuucuacugcucuuagaaucagacuucugcuauagggccuccucauucagcuucagccagucuccuuuaugugaaggguugguucauuccuuuggcaucucucuucuucacuaagccaaguuuaaugagguaucuccucacagcccuccuuucuucccccugggucugccagcuaauggguccucucuccugcuauuucuuccaucugaaccaggauuuggaagguauaccaccuuaagauggguguagagucccaggaaaauuccauccugcguuuacuggacagaacuuucugccagcuacacagcaccgaagaauugcuuuugaaaaugagaucuauugcuggcaagaagaucaauucaagugguaaaaguauaugacaaucucuaaguguauauauacuuauauguaaaaaaaaaaauacaaagaaaaauuuaccaaauucccauaaaauacaucuaauucaguaugaaagcucugccucuccacggacaucuucccguggguuuucuuuuuguacaaaauaucccccaaaucaaaacaaaacacacacacacgauacacacacacacacacacgcacgcacacauacccacaauuacauuuucugugacaauuacaaaaaaaaaaaaauccuagugcaaauauaaagcucuguaaaccugguccuaugagaaucuaauguuaguaaacagcaggaaagccgccggccccgucgacccgagagagcucacaucauggucuccacaaugaugugggucgguuucacgagagcgccguucaugacggugcgagaguuguaagguguggcucccucgcgcuccacagcccagcgguuggguucccuuggggucagcagguacuugacucucuggagaaggaugacaggagugaggggggaaacgucaggcggccuggucuccccuucgccagggccaucugccuccuccugaauuggcucaugugcuguuugguuuuugguaaacucacacccucucugaucuccuguuuuuguccuuuuuggaaauaauggaauugaacuaaggcgcuccuaaggugccacuaggcccugacucaaggcggaauuccuguuggugguuuccuuccuuggccaaaccccugcuuacguuccuacagggaugggggacucaaccuucaugugcuuuuuuucuucuauggaacuaaaauaugccucccugugauucucucccucugauuucucugccuugcaaagcagcaguugaguuccucucauuuguaugcccugaguuggacaacugucuucagccuccauggcucccaccuuccccaaggagaaacuccaaacuccucagccucccauaagcuacacuuccugccuucuugcagagacaggucuucccuaguuuccugaaggcauccaguccucccagcaggguuuacaucuuaagggcuuggagaaccuugcucgcauuugagcugcccuuccaagagauaggagcugcaugggaauucuagaucacuccugagcagggugaguuuuguccucacaguugguugagugucccucuccaaggauacccagaaaauccaugucagaacugggacucaaccagacucccacuccccaguccaccucuugccaacugucaacucagagacuugaauaggccagcaguugaaagacaaacaaacaaaacaacaagcccucuuucuaggcauuuauauucaacuuagguauguuacaaauuuuuaaaagcugcuuauuaaaagcuacaguauuucauuuaaaaacccaguuuucgguaaucccagcacuuugggaagcaggaggaucgcucaaggucaggauuuaaaggcagucugggcaacacagugagacccuaacucuuaaaaaaaaaaauuaaaaauuagccaggcauggugguacgugccuguaguccaaguuacucgggaggcugaggaaagaagauugcuugagcccaggaauuugaggcugugauugagccacugcacuccagccugggcaaaggagcaagacccugucucuauuuuuuuuguuuuuaaauccaguuuuccaucuuuucuugaaaagcugcaagaucuggcaacuccaggcccagguccccuccuuguagcaccuucuccaguuugcucccagcccuacccccaugacuucccucaccugagccaccugccagcucucccuccaucacuuugccucuccacauccauacaaugggcugugccugggagggcggaggagagucaaacccccaggcagccacuuggggcucugccuacacaggaggcucaggcagagcuggaaccauccugggacagagaucuggguuugccagaaccuggcucagagagaagcucauggcugggaggacaccuugaugacuugugcaggugggagccccugaggggcacauaaagaaagacagacagaugguggcucaacugccuucacaggggccuuuggugaagucagacuggcacaggaggacgggguaccaguguggggugaagccugcccucacccacucccccaccucuuucccccaugccaaccccacuccacccaaacuucuaaaugugggcuggaccaauauuuuaaaaugaggcuuugaaggacaccaaguuagugaccuguugggugucccccugaaccaaugguauguaauugcuuugggcacucaccaaucagagcagagaccccuagaccaaucagaaccuuuagagaccccuugcugugcccuaaugaacccuuuggcuucuggacaguaaggacauucuggaaacucugguuggguuggccuggaguauuguggggucaccuggagggcucgggacagucacuguucccugccuguccccaggcccaguauuucagucuguuaacagcucauagggccauuuagcguucuggcuaaagacugguuggggugcugcccucuguccucugaaaaaauagaaugggucaaaagcuccaggauaaccccaggggcccccccaguuucaaggauuuccuccugcccugccagcuuccucagucuccccucccuccccugccaccagcaccaccuccaggccauuccccugcccaggaggaaacaggacccagcccagcagggagccagggccccaggacauccuggcuccagauuuuuaaaagagaauaacaauaaaaacagcccagaacaaaacagugcacucuuggagccagcccaagcucaaaagguuaagggagauucugagaaaagaauuucuuggaaagaguagggccuuugccagggccugggaucuccagggcuguuggaggaauuucugagaggaggcugaagguagguggggccaggggaggccccagcaggcacagaggcagaggucuggcugccgccacagauccggagaagaccccagcaugggcugggaugauccuaaauuuggcuccucaauaaaagaaggcaucuggguggggcucaggcuuccucccuaggcuccuggcuuugucccaccgcuucaggaacauggccccacuggucccaggauaaagccccagcucuuagcuuggcauccaaagcuacagucaccucuccagccucacugcccaccccaacucugccaacaccaggaacaccuucccucucacauucuccaucuggcaaguuccuccucaccccacagcccggcuuccaaugucuccauaaagccuucucccaugugaacucuacuugcuucccgucuucccacaaugcacucugcugcccauaagcugaaccacuggaugggugagggaacuauggcucagagagggcaggugacuugccugagaucacgcagcaaacugacaacaaucaccuuuggccucgcgccucccaccuccccuggcccugggcccaagcacuuaccacaaggaacggccccucagucuggcagaggcggaugacgaugaccaagggaacgcagagcauggaggaaagggccaggcuccagcccagcccaauggcccaguugggguacacguauguuuuguuguaggucagggguacguacuugacgagcgagaagaugaaacaucccugcggagagaugggggcagucaggagagggguccugggcaucgggggguggggggcuucugggacuaggacuggccucaaccugagggaagggucucucuccuugggaaaggacuggcucagaacucacaccccucucugcugccauaaggaucccccccgccccgguaaaaacacaguaagucguuucccugcucaaaacccuucuguggcucccagugccagcagaugcagcccaaacuccucggugcagccgggagugucagcagaagcuguaccccuuccucccucaucugccucaacucucccuccguguccacacuccagccacccugaagaauuccuucuagcuccucugucacugaacucugggucuuggcaugggcuguuuccucugccuggcccucuuucccccacaucuucucauccuaacuuggcuccacugggucugccuuacuugcccaggcaccacccauaccucuccuuccagaaagcgagugguuguaaccaucucuugggcacacguguucugccagacugugagucugagaguaggaaugugugugucuuguccuaguucuuuaacacccagugcagcuccagguacauacaacaagugcaccauaagugcuagcagcguagaugaaagccuuucuucccccacugccacccuccaugucuaucucugagccaccagcagcaggggccugggcaccugagccuugcccuguucgguguccacagcccagcccuggguccaugcuaauggcuaguggccaucagcaugcaugaauggugggguggggucagcccugugccucuaaagggagcaaagcccaccuuucccugugagaagagcaccuaaggcuggcucggggcucccggggcuucugcuucuagucagaaugacagcaucucugaggagggcccaggguggccucugauuguuccauaaugugaaaauggccuaacucuucaacaccuaguaacugggauuugacaggaagaugcaucuuucuaaagcagagucggugaugggcaagggagagcacuagccugcaggcaucuuuuacugggcaccaacugcacgucuggcccugcuguuguucccgucccuacguguagggcuguggcucagaugagugagucccaagagaugcugcccugggcccucccaagcaggaggagcuugagccagugccugccuguuucccauuccucuccaugagggugaccucaucucaccaccugggaaugcagccuaucucugacguauccagcuccucagggagagagauaaggaaacugagggucagagugcugagaagagcugcccacaagcaaacauuaaaccaggaugagaacacaggugggccaacuaaacucaucuccaaagauaaacucaccaauuguugugguuacuggcucuuaccauuacuuauuuuugugggagaaagucugcacuucagaggaaaaggcuucauaugcauauuaaauaacaguaacagucuaaggucgucagcugccaccgggguccuccuucacagucuccugguuuuacaaguggggaaacugaggcucacagagggaagugacuugcuugaggucauaucaugaguuaacagcaacauugacuuagucuggccugauagcaggucacggaggggagggccuauuuguccucagcaccugucuccuaaauccaaggaauauugggccauuugugcuccccauaguggagccgugaauggcaggauggauguggucucccuggcaauaagcuccaaugaucacaagugauugcaaacccugacggcuuugccauggaggaauuccacucacuggcacccuggagugcgaccaugaagcagacugcaugggcaggugccaaggccaacuccaacauggugggcgagagcauccucgugggaagaacaacguggcacacugauacccuugggccugggugaguccaaagcuucccuauccuugggagaacccaggacuuccccucucuaagcuacuacccccaccucuccauggaaacaccccauuuccaaugucuaugaccucucuacuagauaucccaaaggccccucuacuuccccagugacccaaacagagcucaugcgcucuggaagguuuggggaaagaaugugcuuucaauucuggauccccuggauuucucaacaugcuccagauacacccucuucuuuuaggaugccuuggccccgcacaggcuggcuccucugccagaaaugcccuucuuguuuucuacuccugacaaauuccuacuuauccuucaaaacucaacucaagcuaacucccuggagcagccuuccuccccucucccaggcagcgcugaagcuggguuuauuauaagcccacgcugaacagaugcugcaugaaagaugguuuagcgggugaaaaugucaagccccagggagaagaggccaccagccagagccacagaaauggaacucacaacacagagaacuggagugaucacagcccagcuguacuucauccagggcccgggccgauagccaaucauguccucaauaccaucauaaagguuaucaccuccugcaagagacagagggggacauuuucugacacagcguucaaggccagcagcagcucaggggccaugaguggggucucugggaccugauccaggccucugcaucuccacaccauggauauacaaguguggcaaaaacagacauuuacaugaaauucaaauauaacucugcaucuuguauuuuucuggcaaucugaggcacacuccaaacccuaggugugcaaucuuaggcacagcccaaacucaaacccaaggccucaaggagauaaaaaaggaguauuccagguccugcacaaccaaguucugaaacugugaaaacauccagucacaccucacaccuuuagcaccaggaggaucuucaguguggcuacagugagauuauuuguguagucuagguagggagggccuacuguucaacucaaauugaauuucuguuaguauucucugcuucugaagcuucuaaguagagaagcccaaaggagagccuugagaaaggacaugaaaaaaucuguacucaccauauauccaggcaauaacaaaacauucaaagaaugcaacccacaaaaggcauacaccgcuagcugcauaguagucaaagagcugaaacacauacaugccacccugugaagaaaaaaaccacagaaggucgauuuccuaccuggucuccaauuucuuucauauacaaagagcucuggcauaucaauaagauuaaaaaaacccaagagaaaaauggacaaagacucugaugaccagauaaauauacaaaaagaugcucaacuucauguuugacaaauguaauuaaaaacacacauacagauaaaugaaagcaaaaugauggguccacgggagccugcuucccaaggaggugcuucacaccaagugcagcugacagagaagacuccagggucacccagcugcucagugaguggcccuaaaaucugacuucugggguggggguucuuacaaauaccuccagaaaaacacuuuuacuucugguaaggaaaaauggugaagugaagcccugaauuggguuuucggagaacuguuaaaugggacccguuccuggggaacaggggagguggugggggggggcaugcaggagagagcgugcccuggcuuugaugcuaggcuuccauucuuaguacaaucuuuaucucaucuggcuugccucuugcuagacacgucuuagacguucccguucccuucugcucuuugcuucccuugucugcaucugaaaucgccccuccuccuggccccugcucacccucugaauaguguaugugcccccuaucaacccauacccaccaggacucgguccuguggcaggugaccugcaagguggugcaccucuacguggugcugugguauuuccugggaggccugcguuuacccuugagaaugucuccaccccacccccaggccugagaagggcacacagucaggggugaacagagauguugugaaauggauuucagcugaagauccucuucccaggacagagggcagcggguggucacaguguugccacagcaacaggcaaaauaauuggguaguuugggucagcugugggcuccugagcccccucgugcuacccccaguguugguccaagcaggaccccugaauuggguggggcugggagaugaagccccuaccuggcccucucacccagcugcugccuccacuauggccuugaggagggcacuggagcaccaagccugaaacacagcugagagagccaccuaccuccgucaccaucgucagccccagcagguagcugaugcuacacacgaaggcgaugaagauuucccgacgauaacccuuccuuaggaaggauggguaaagaucaaccaaggaugugaucuguccuucaacuucaacaaacugaggaggggaagagagagagcuggugagcggcugacgcucaggccacccuugccugcugcucggagggaagggcccaggaacacacaaugcaggagcagacgugaccauccuuguguccagaauuggccugugagaucaaguccaaguguggaagccuggccucccugacugugccuggggagucccgccugccacuccucggagccagacaacgcaacauucggugguccacaccgagcuggccaaauauuccacaccucugcaucuucucucaggcuguuccugccaccagaaugccuuuccccauccuccaaagcugagcuugagaacaacugcgccucugaagccaaugcugacccucuguccuggcacauucaggggcauauauguguugccaugacaaccucccucacugaucuccauccucguggaagauaagggugguaucacauucacuuuugggccucgaaugccgagcccugccagacacauuggcugcucagaaaaugugaugaauggguggaccuuagcaccaacuugcuuggcaggucaggggaagucugagccucaguuuccccaucaguggaauggcaggcaguucaggucagauucacacaguggcuuucaauccuuuggggaucacaagcccaugagaggacuuugcaugugcgcacacacgcugugugugcugccugggacuccaggaaccccuuccugggcucccaaaggaaaagaagcugguuggaaaaggccccucuguagguaacauuucaggggaauucucagucuuucuaaaccuuuccaucucgugccuaaccauuuaucuuggggguuguuccacaucauuacacagaaagcugccucauuuuuuaauugauaaaacuccacccuguggguaggcaucgccauugaucuaaugcccagcugauggucuccagacucagcucuuccucuccuccugugugcaggcaucugugcauguagcacagucuuaaaagagaagcuuugggguuaaagagcacacagcagcacuuuaaauuuggauggcuacacccaaacuucccugccaaccaacacacccuccaaggccuaucugauuccuucaaaaguugaagagcuuauucaaccuggacccagauguccuuucaucugaacgaggcuuuugggaaggacguuuccccagcauuccuaccagagaaaucuaaccccuuccuccuuugggacgcauugcaggaaaauccagggaaggaacacaaacggggagaaaucccuuucaugugcugacaagggcuggagagaugagacugccaccaggaauaagggaaaagacgagcaggaggcucucaagagggauccaagagaagaggcugcuuuuuugaccucugacucaugugucugccgcagggguuuugaaccuaaauugccaccgaauuauagcaaaccggcagcucaaacacuuaagcuucaaaaggagcuaaaaacaaagguucuuuccuuuuuugagauggggaaauuaaagacaggaaggucagugucgcugugaaucagggccaagaccagcacaaacccccauuucucaguuccugccgcuuccagagaacacugcccuucuccaccagccucuucagcccuccgucgcuuaacagcugugugauuggcuucuccgagccucacuugccucuccgugaaaugggaggaucuuguccacuuggcagggauguugagaaagauuugaaauuauuagaguaaaucugcaagugggagauaacuguuaacccaugucagcgggcugggugagcucuuugguugcaggaggaguggguuccaacucucaucuccucucacaauuuguuaaaaaaaaccaugucccagcugggugcagugguucacgucuguaauuccagcacuuugggaggccaaggcaggcagaucaccugaggucaggaguucgagaccagccuggccaacaugacaaaacccuguuucuacaaaaaaaaaaaaaauuagccagguaugguggcacaugccuguaaucccagcuacuugggaggcugaggcaggagaaucacuugaacccaggaggcagaaguugcagugggccaaggcugcgccacugcacucuaaccugggcgacagagcaaggcuccaucucaaaacaaacaaaaaaccgugucccucuuggguagccuggauggcaacaggcaucugccuccacauggcugacuccucuacccugucucaccaagaaaggcgcagcaguaugauggcucuuaggccagacggacuguucccgccaaugguaggaaccccugaugagucagggugacacccccugcucccuugcccaggacgcaauaacaucagcgggaggccucugccucugggcuguagaucuccauacuuccaacaggaggaaguuauuuugggggaauucaaggggaaggccaguugggacaaacuagcagguaagagacaguuucugcagacaggcagaccugguaucaagcccuucacuagcuguguggagccuuggcuaaguucuuggucucucuaagucucaguuuccucagcuauaagaaggguaaaaauaguacccaggcauugcaacacugcagcuuaaggaguucauguacaaaaagccaggugcggggccggcaggagggcaaacuggggaguuaggagucaguguugaauggggacagaggcuccauuugggaagaggaaaaaguucuggagacggacgguggugauggccgcgcaaugucugaagguacuaaugccacugaacugugcacuuaaaccugguuuagaugguaaauguguggucaccccaaacacacgcacacacagaagccugccaugaggaccggcacccagggaacaccucuuacggcagagggcucugauccugucacagugcuggcagugggugaggcacacugcuggcaucugcaaaaccuuccccauuuccccaaguucacaaagcaaagagaugcaaaggaggaagccccaccugugcgaucagauucccauccugguucccugggacauggggccugggagaccagugacuuagguucgauuucuacccuugucccuggcaggucaucuaacugcucugagccuugaguuccucgcucugcaaaguaggaggaguggcugugagagcccaccagauucucuccgugugccacugacacggggccucccugagagaugcguguccuccaccaggccccacuuccuggggagaaaaucuaaugagugaccaccuccaccugcucagggagccguuuccaaagcccaaguggccuauuuugggcccaugaagaugucaugccuugucauuuauuaaccucuguuuuuguuuuuuucuuucacuuagagcucuggaagaaguuauaaaagccauuugcuuggggccucugaaggccaaacucauuaacuaggaaugauuaauggaguccuccugcuuguuuauucagcucaagucuaucaacaacugcagaaguauuuuguuuuccgucucccugauguuuucguucugucuucucugcuaauccugcccccuucucugccaaauccccugcucugcucuugaccuugcuggcuggccgccuccucucccuggacucacccuccucugcuugaccuucagagacuuuuccccuaccagguucuggggacccacuugggacaaugacucugaagacuucggcccgcggggagggggacaaaggguucucccgcccuggcugcaagcuccaaccucucagggggucucaguugcucaaaggcuucccaagaggcauucagaccuccagacccagacuacacagucuacauccuaccugcuucucaguggcccaugugcauggcgcugccugaggggcucaugcugggcugggcacacaaccagccugucccacaugccauaaaucccuacuccuggagucaugccugugcucugaacuguuguuucaacaagacccugucaaaaauacaccuauuuccagggaaaggggcccaggagcucaagugaauuguccuccgagcacugcugacuaccccacacuaggcacuggcuacucuacagccagaugcagccacucaucggcucucacuggcauucccuggccaugagucaccuucuaguggaggccugagcccugaaggggugggauacgggguuuagaagugcaggaaagaaccucaguggagacaggaguccugccuugggaggggagaagccaggacagccagaggucagggcggguuugagcgaggcucccggccugugcgguguauaaagcacgggagggagccaaugcccagccccucgcacgcuccagggagcacagaauccugaguguggcguaggcuucuccugggcacuugcaacuuauuacgauggcccagacaaugaucagcucacacagaaaugugggucccuucuccgaaucgcccaucugccauguccuccugugccccgccgacgcuccacuggagcacaucaugacuuauugagucaugaccuccaauucgucauuuguggcuugacuguaaccacaaacccugguugucccugucauaacccacccacuccgagaaccucuggaugccccucugcuagcagauaaugugccaugccacgucuuguuugcacuccauuaggcuaaauaauuaucuuguucaaaugcacuuucuggggacgcagagcuuuuucuauuccugguguccuggaggaacccucacagcugaagcacuggaagucugacuggaggggggaaggggguugaccaccucccagguggaauaaggagucuuucccagagucagguuccccacaggggcagucgccccagggccaucccuuauacgcaccuggcuauccaguccaagcaagagaagcauaauaaaaaaaagaauggaccaaaaugugggcagcggcaucauugucacagcuuuuggguaggcaaugaaggccaggccaggaccuagaaaggaaagaaaacggggaggggcacaggggaggagacaucagccaccaagccacugggaacccugggcucacacaaagacacucagacccaaauacagcagggagccaggucugaacucuggccuggggaaagagaccaggccugucucgccuuugggugggacacgcuggggcucaggaggggcccgguuuuagcaucugucuccuacacagcacacguggccuccucacacaccagcauccaucggggcgugguuauuugggguaggaugcagacugagcccagggcuuggucugcagagacaaaggaaagggaggauccucccaccccaaagcaaagccauugaguggacagccuuugcuggaaggaggcgggggagcgugguggugaccugaccgcccagucuccuuugcaaagggaaaguuucuauuuuugaguuaauggcuaaaacaccauaggaguggaaagaaaaaccaauacaaaaccacgcccaacaggaggccugucucuucaggggugcauuuguggggcucucccuggcaaggucagagccaagcccaugaggucaagguugggccaaccagggcccaaagcugagggaacaugggugcaggggcaaggucccaggccugcaagcccugaggccugcauccaagucauccucuuccaauuuccuuuuugaaucaccccauacccucucagggccucaguuuccccaccugaaaagugaggggcagguggccauaaaugacucacaaggagccuuccuguguuuagauucucagagguagacaccaugucacuagaaaagggcucuggguuucaaaagaagggacuuggauagaaccugagggagagcuggggagaugggagcucugucagcucaggggaugucucugaugggagacauuccggagacagagagaaaugucuccuccugucuccagccugccugaaagcggaugccaacggaaauaauuuaauuguuaacugagaccugugggucugagaagcgagggcagcaaaagaaaguaaaaucuacaacuaaaaaaaaaaaaaaaaaaaaaagucaagaagcaggaaacaaaaagggccagagcaggagcuguucagcagggauuagaaaccagacgaauggcucaagaaugaaaaacaaaaagcaaaacccaacuuuacaauaaauuggaaccagaaaccacauuauacgguguuaacacccccagugugccagggaaggguguguccuuuuacaauccagagaaaaccugaccaaaauauauccuugggcagcgacagagugguugcucgcugagaugcuggagacccccaucaggagcggggguuaccaagcccaaaacugcucagaacaugcccaaaagaaccagggccagguucagaaaaauauggaccccaggacccggugagaugacuuuugaaucaaaguugaaguuggagucaaaagccgcggcguuuccacccagaccggggccccacuggucccuacagaacaucagcguuggcccugacugguccacacugaaugaggaaucgaguccagccagcugcaagacagaugcaaaaugggcccccacaacccccaacccaccagggacguugugaagauucucaauucgcucguuucuguauuuuaguuuugccuuucucaagcgagccucugggagagggucugagcgucuuucucuaaaagugcauggugaacucaagagagagaaguccaggagacauaauccagccacuccgagaaccucuggaugccucucugcuagcagacaaugugccaugccacgucuuguuugcacucuguuaggcuaaauaauuaucuuguucaaaugcacuucacucaauauggugcuuguuaaaagcuuauuagagaaauaaucacccuugaugugccggcuguucagacaucaccguggggaauaaaugacaagguguuugaaguggacgggaggaaaaaacaacugagauugacaauauaugugucuacgaaaauacuucguuguccauggaggaagauacauuguauguaucuaucuguaucucccauugccaaauucacuccauacuccuggagauucccacucaauugcgauugguuugcaagcccucagcugaaagcaagccaucuacagaggagguauaaaucaucucuggcucccccucaccacucuaauugccaaacucccuaaggggcguggggacuucuggaguuacauucuguguccucagucucuggccugcuuuugggggcucuuugggcucaguggagggaacaguacaucugaggguccacuuuggaagcagggacaguggagaggugugugggggugacauguggauuugccaaggggguccugcaguguugucaggggucucaggauggggcugggcagugugcaucucugccaagcaaagaagacagugaggaggggccaggggcucugggaggucacaagggccaaauucucacacuggaagggccagagguuguugcauguguccagggugggcuggauggcaggagggggacacccuugugucagaaggccuguccagcgugugacaaguggagaaauaguggacaggauguucagaaagcccuguuguagccccaccuaucccaagcaaagcccuugcucucagguugcuggucuccucaucugagaagggaacaucuggacacgcgaugcugaggcaccuucugaccccccagugcuagggcucuaggacucagggacugggacaucgccucauguuccaaauacagauggcacaggaggucaagggcaguggaauggcagggccuccggcugugucuggcccuagucuaugguggucccugaaguuaauaacccccacgcucucccuucggcuuggaaggagccucagcccaggaccuugccaccuccagguagccccagggaaguuguaugaaauuaggacauggacgggguggggcugggggcucagcauguaaaauaacaaaaccaacugaugaccacccuccaaguaaacugugcagggccggggaaggguggagaggucggaaagguggacuuugaggauccugggagccugagggaaucccauaacccaagccacugcaauuaaagcuacagacccaggaccucaagcagccauggccaagucccagaaucgaggcaccugagagauugcagauucuagcaacugaaggccccaugauucucagguuccagaagcaccuugcuggaacucugggaucccagauuccuaaguuccccgucugugcagaguccgugauucuaagccacuggcauccuccaugccugugacuccagguagcccgaggaagagugccuggucaacagggcccacaccccgaggggcgacacugugcuuacaacccacccccaguuggaucugccaccgucccaguaggucguccccucaucuacgcccuccccccacacacugcacccagugccuacgguggugccugacacagaguugggacucauucacgagaaaucggugggauggaugaaugcgucugcuuagagggagcacgcugggagcaaagugcaaaauacagaaaccaaggcugagaagguggugauggaaugccgauugguggcugacuugggccugaguuaggaaagugguuucuauuguggaaaccaggaguuugcuggggaaggacgggggggcggggaagaccacacuaagguagcuaaaaauuccccaacuuaaccaccccccaugcuuuugccacccaucagggccaaauugcaauacaaauguuuaaaauuuggcuuuguacucuuugaaauuugggggauaucuugguggcgggggggggguccauuuuagaaaccaggcucguccccccucaaagcccccuggggucuggcuucaugccugcaguacuuggcuuacacacuagguggcagugcccaccaccacugccaccgauaccaccguaccugacucagccacaucagcaauguccaccccuugcucuugugccaugaagcccaggauggaaaaaauugcgaagccagacacaaaacugguaccacuguucaggcaucccagcagcauacagucccuaaguuacacauaugucagggagcaaguuaauucacaacacaaggaagccacgcucccuacuucucuuuuucuuuaaacaucaucaucaucauuucuaaaguccaccaggcccgccggcgcaacacuugccuguacgaguuauacuuguacuuguuguagcuccccagcgaggucauagcccccaggcagauggcauaagagaagaauaucugagucccagcgucaauccacaccuaugagggggagggagguggcaaggaaagagaggagggcugucagagcuggcuuccuggaggaggcagcgaggguuauguccaccuggcgauggccuggggacgggaccuugcacaugcaaauggaacauuuaugcucgaauccaaggugccuuucaaggcaguacugagcugcaaggagccccagaaaucaaacaccccaccucccagcgaccuagcaucaggguuaagaggauucagaagcagauggaucuggauuccaacccuggaaugacagugggcaaguaaauaucacuccugcaguuuauagauaguuuucacaucuauaaaaugggcuccuuugcccuaccccauagagcuauuucccagguucaaagaguggcgauucagcccagugccaguuacauggcaagcccguaagucaaggcugcugucaccaccauuguuguuacuguuugcagacccccgaguuagaaugcagaaggaggucccaaggaacuaugcaggcaaagcugcucuccagaaucuucacuaagcagcucguucccagcuguccuccaaggcuggccaaccccucucacaacuguguccuguccagggggaagggugguggggaaggagagcacaggcccuugggaagcaaccggaaggcccuggggauucagguccucaaacaaacccagaaaaucucccagggcuuucuccaccuccccaaggucacaaggcugagugccagaaggugugcuuucgguaucugcccguggacccuccaaggccauuaacucugaauuccacccucagccaaggaagcccgcagcucuccaggccccgacucucccauccccaggaugcagcagcccuuguggcugcagugggcagaagcuggguccgagcgggagacuugcucaucagaagauuucucccccuuggugcagggccuaaagcagccucucuaaguggccacccucagacguccuugacaugaaaagagaugcacacagcuagaaagguccaucagcaccguggacaggcacacccgccacaggcccgguggaaaaguaccagggggcgguggcccagcuagaccugugcacugaagaaccacggaagaugugcugccaguggccucuacauccugcccuguccugugccggcccagcccuggaugggagggaggauggugugucccagccccacaguaccuguggguccucaaggcgggugaugucaggauacagauagaacuugaugccugcgcccgcgcccggcagcgucagcccucggaccagcagcaccaggagcauggcgaauggaaaaguggcugugaaguagacgaccugcaagggcgagagggauucaggaggccaugggcaucacuugcugcugcuaagucugagcauccucucagagaggcagaggggagcacuggucaggaucaggaguucuggagccagguuugcugucuuacuugcugugcggccuuuggcacauugcuuaaccacucugggucucagcugccucaucuguaaucuggguauauacagguaccuaccucacagauuucuuuuuuuuuuuuuuuuuuuuuuuaaauuugagacggagccucgcugucacccaggcuggagugcaauggcacgaucucggcucacugcaaccuccgccuccuggguucaagugauucuccuggcucagccucucgaguagcugggauuacgggugcccaccaccaugcccagcuaauucuuguauuuuuaguagagaugggguuucaccagguuggccaggcuggucucaaacuccuggccucaaaugauccaccugccucagccucccaaagugcugggauuauaggcaugagccacagcgccagcccaccucacagauuuacugagauuaaaugaaaaacauccuauaaauaguuugucccaggcaccaucuaagcacaaaauacagugguggauaagacagaaaacaaaucccugccuucguggaacugacauuccagggcguagagguggaaaaagcaaaaucagagaguaagcuaucaagugcguguguagaagccucagcccagugguugccaaccauggcaugugcccauugcaugcaggucauauuaguuaacaacuaacuacaauguugguaugauuccuaugguuagggaucagauaagcaaggguucaaaucccagcuccguccccucauuugcugugugaucuuaggcacauugcuuaaccucucuggaccuguuuccucaugaguagaauucagauaagaguaauagaagccccucaacaaggggugagcugaggauucaauaggaugaugcuuguaacacugccacucaguaggugcuccagaaagagggccuguuguugacacugauuuugcuggaaggacgagaccuucagggaagaaaaugaggccucucaaaggcccuuaacugggaauaggaaaggcuccccgcuucaccgggccucugggagacccauggccuucccugggucacacugcauguuccagacaggccaagaucaggugugagguggggacuagaaacgauguggccaucuccucccaaagaccuucucuccucuuguccugcaagcgcuguuuguggcuucaguucucauggauggauuuucccaucuuauucaacacaaggaguuuccagacagagauuaugccugggaggaguucgaaggugccuggcugaauggacaguucgauccuaguguuucaggcagggcacuggcugaguaggaacgucccaggcacaagcccacuucauccucaccaugccccccaggacggugguuuacaguggagaaacugaggcuuggugggcuuuaaggacgugcccagggcaucaacggaauccaggauuugaacccagagccuguggagggcuaaccucugugcagaaaggcaugaaguguuuuacuucgacaugcagaaaguucaugguggccaccuugaaacauugagacugguuggcagagcccugggccgcaucuggggaucaggggaccuuggaggaaccacugcacagucaaugcacccauuuuacaggagaggaaacugagaugaagagaacaggacaaaugugcccauggaguugggggugcagugccagggcacugcuggggcccaaguauguaacagacacugaccaauagugacagagccccaaaccucaccuagcuggcaccacgacccucgacagagcaaauucuuguggccaugaucccuuugaguagaaacaaugagaaaggggcuuuggaaaagggcaaaaaggaagcuuucagggccugcuuagcucagcugcccucagcccaacaaccccuaggcagcguuuauugagcacuuacugugugccuagcacuguuccaaaugcugugacgucuauuuucacuggcccgugcccuaacccucugagguaaguuguauuacuaucuccauuuugcaacaauaaaacugaggcccagagagaguccaucacuugcccagggucacgugggcuuaagcaacagaauggggaccugccccacagcccacacauagcagaccagcaaaaagccucccacaacuggcaguuuacugauucuccccaagaccagagggcagccaguagggaggcccucaggucugaagccaagcuuagaggcuggcuugccaugagaccuccaggaagccgcuguccgcucuagacuguuuccccaccaggaaguaaagggcugggaccguaggagcucugagguugccucccacucugccacucuaggucgagggguagagaggcugugggucagcuggggagccaccucuaccagggguugcacgcugccucugccaccccuugcuggugaccugggccucagcuuccccaucuguccacugaggauaagggaacgcugaccuugcucgauggccccuggccugcggugagcauucaagaagccucuuuggccggcacugucaggauggcucuccgacacugacaggcugggcccuacugcugccucugcccccgggcguccuuuguuccuccaggccucaguuucuccagccaccgucaucucuucuccuugaggccaggagccuacaugauuucccgaggaugggaaggcagacguggagggcgggggcacaucaggaagccacagaaggggggaaagaagugaaaaaagaaaaccaaccugccucucccuuccugaggacaggcggacaggcggccaggcgccccgaccaguucccaccucuggggcccuuugugggccacacccgggcuggcgaacaauagcugcugacagcagccccgcaggggucuccagagggcggccacuucaaagccagccaggccuccacugggccaagcaacccaguggucugugaccagagggcuuugugucagggacagggguguggagguggcuuucuuuguuuucacguaguuaguuuauuuaacaagcacuuaugcagugcggauuuugugcggggcacucagcuaagggcuucgugaguuuuaacucauuuaauccucagacaacugagaagagccaggcaucagccucaccugcauuuucuagaugaggagacugcccagagaggugggggcaccugccugcaaucacaguuacuggugguggaugcgggauggauccaggccagcuggugucagguccccacaccuuugggaugugugucauuguuccuccccaaauccuggucacgccaccucagccgugugaagggaaaauaaaaucucaggaccccaaacucacuaugcagaaggaaaaaguuaagcuugggaagugagucacacacacgcacaaaaccggccugcuuucuguucuucagcagagaguugugagauacaggccacguaucuccccaggcggccucccucacccugacaauguaaacucacagcucaucuucacaggugccggacaaagagacaagaaaugagccauccacccacacaucuaggcaugugucuccuuccuccaccguguguacacacccuacccuauggaaaauguguguguucucuacccuauggaaaaugcagauuugcugagagacaucgugcauaauuaccugaauuaccuguuccucugucccuuccugcuguuuccccuuacauuuuuuuuuuaagacacggucucugucgcccaugcuagagugcaauggcgcaaucaaagcucacugcagucucaacuucccgggccuaagagauccuccuaccucagccuccugaguagcugggacuacagguacgcgccacgaugcccagcuaauuuuuguauuuuuuaguagaaacaggguuuugccauguugaccagguuggucucggacuccugaacuuaagcaaucugcccuccucggcucccccaagugcugggauuacaggugugagcuacugugcugggccuccccuuuaguguacugagguucucaaaacucucuuuggaaaaagugcaggccacagauccuacuguggcucagucucuuuccugagcacaucuucaaccuuggcaaaauaaaccucuaagcucaucgagcccccugucucagauggguuuugguuuacaguagcagguuugaaagccacccuugcuuugcagaaucugcugcuccgaggacaagccccugagagccaugcuuucaacuuuucuguggcucccccgggauccccaagggacaggcuggugcuagcugcugccaggggccucuggugguggcccagcaggccuugcugugggacgugguauuuuuccacucuugcuggugaaccuccguggcuccucugagcccuagacccaaaagcccuguggcccaacuguccaggaaacucacaaggacaacuuuucuccauccccucugggcaguagaaaagaggguggcugagcagcagggggagccgggcauccuuugggagguaagugucugggcagcagcagcagcagggggagccaggcauccuuugggagguaagggccugggcagcagggcucgccauugaucccagagauccuaggcaggcccuaaggauccucagcgcccuggcuguuggugaggggcuucacuaacucauuucacauaaggggaaggugaggcugagaaagugaaagggccuuguucaaagucaugcagucugggggauccagagcuaaaaggaccuggcucugacuacccccugcuuuguuuuuaaccaggcaaaaagagcugcuccggaggccaacagcgaagagccccagccucagugaauguccaugcucacuccggggccuccuccccugugcgucugcagggcuugcacuuccugugugagugucuggaucucugcccccuucccagaccccacucugugacagcagggacaugccugccacacgcccuacuuacugcauccucaggcuggcacgggggugggcacaagaggcggaagaguguggggcacccaggucgggaguggggccgccuggguccaaaucccagcacagccacugacaagcugugggaugcugggcaagguaaugagccuccuugaaccugaauuuccccaucuguaaaaugggacuaauaacugcacauacuccaaaccaugaggaggauucaaugagcuaccuagcagcacugagaaugcugcccggcacucacaggcuacugcgcuuucgccaccguuaucacuauuuguugaauggauuaauggcagccuaguuucaacuuccuggaauagugaaaauuacaaaaaaggaaacugcaaccuagagaggcaaagugacuugaacucagauccugagccucucaggcuggggcucucccuccauuacccuccaacuccuccuugcuggacuagacacgagagcagggccuuggcaggaugagguccaucugcugccugugggcccagcccccacgucagccacaaaccuggucuguggccagggcuggaagccauggccagcgagcaggcagccucucagccauggggcuugaggaaguucacagagccugacuguguuugucuuggcuucucuggccuggcccaggcucugcuauuguucugggaaucacgcccaccccugggaggccuacagccaccccacgaaggagguuguugcuaagggugagaagggaggacccguggaagaucacgucuuugcucggccacagcugcagccuggcacccucucucuggcuuugacacuauucuccuguauucugcauuaugucucaaaaguugcucacugucccuggcggacaucagccuccuccaucagacugggugcuccccaagggucugggucaaacacaccucagggccuuugcacaggcugucacuucuaccuggagauuuuccccuccacauacucaccuggcucagcccuucacuuccuucacaucuuugccuagagucaccuucuugguaggucuugccuggccacccuauucaaaauugcucccaacacuccccauucuccuucucugcuugacuuuuucccauagcucgcauccccauuugacuccuauauauuuuucccauucguuuuguuacaaccugacucuuccugccaggccaucagcuccuggagcacaggaauuuuugucuguuuugugaaccacugcaugucccccagcccuguuucuacaaagcaccuggcacacgguagaggcucaaaaaauacuagugcguaaguaagugaugaugucucuagcacugcucaggaccagugcuccacagaaacuuucucacuucuguguggggaaacugaggcagagugaagaagggcaugguggcaugugccuguggucucagcuacucaggaggcugaggugggaggaugguuugaggauggcuugagcccagaaagugagcugagaucaagccacugcauuucagccugggcaacagagccagaccccaccucaaauuacaaaaaaaaaaaaaaaaaaaaaaaaagaagagaauuagcauuuacagaaccgucugugccaagcauugugccagguguuuaacacaccucauuuuaacccuacuaucaccuauuuuauagaggaggaaacugaggcucagagaggaggaagugaccuuggacaagucacuugaccucccuaagccugaguuuucucauuguuuaaagaaaggaauaaaauggugugcuugugagacagagaaccgggguagcacagugaaggugcucuccaaggaggugcaggaguuacccauguccccugcucccgccuguuccgggcaggaccgugcucacuggugggcacgggcagguguccaaggccuggacugcuucccuuccacccuuggcuucaggauggcagggugguucugccccaagaaacaagcagagggcacuguguguguuggaggggggugcacaggaucacccccauucuaccucuugcaacccuggagucccaggucuugcaggguaagugacuggaauaauuacuuggaucucuacaaaucuaugauuuugccucuuugggggcucuuuauccagggagacacauuccucaacccucaauuccacuguguggcuggggcagcuaaggucacugcccacagcuccaucuggaaugcuaccuuaagacgcuccuuugacuuuuggggguuuuuugaucuuaaagagacguucccucuuuugggaugugagucacuggggaaagcguugacagggcacuaucuaaaggcagaugagcaaacgccuuuguucuuuauagcuuagggcccuggguucaggcucacaccugugaucacaacauacccccgcaccagccuuuggcaucagcaaagccaugacaacagccagugucuagguuuucagggaacaguucagcucuaauuaguaacagguaacauuucaguuauggguuaacauuuccacuauugcuaauguaucaguuauaccuaaaaccuuaaaauuacaagcuaacauuuuacauuuguuaaucacuaacauccuagucacuaugugacauauuaaucagcagcaaacacuccaguuaugaauaauacuuugguuaacagcuaacacccuggccaugaguggaugauuuaauuaucagcuaacgcuuuccugaacaacuaacauuggaggugccggcugaaauguuaguuauaacucaguuaaucugauuuagcagcuaaaaucuaagccagugccucucaacccauaaagugcucuuggauuaucuggggauaauguuacaacgcagccuuggaguuuguagguuuggggcaggcccacgaagcucccugcaaugcugaugggaaugcuuguggcccccucugcaaagcgaggguccaugcuguggcuaauggcucuuaccacgguugcuggcuaaccuccuguuaccagcuaaccuauuuauuagaagcccaacauuaguuaucugcuaccaucugcacugacugccaauaccuugagaugagaaagcugugguggauggggcuagcucguguaggcuccugagagccuggcucuucaauauucaggaauucugugagcuggucauuaaacuguggacagcuugaaagcaaacauggugggagcacugacaccaugaaauggacaaacgcuacaacaaaccugaguuuuacuuuuuuccagagggcgggcuuaccagcacgccaccacuggccaccucccucuuggggcguggcuaauugcaggcgggaagugggggagagggccagccuggcacagcucuccaggaggcaggggacggacagaaguccaacuuaccuucccaguggaccugacgcccuuccagaugcagaagaaacacacuagccagacuaaaagaaggcagagagcgaggucccauuucagagagccuggguggucgauuccaggggacaagcucagcacguugcgccuugaagcaaacacagagccaggagucagugaggggccuggcccuggaguagagagagccaaggcucggacauuaacaggcugggggucaaaucccaccugaggcgcugcauuuacauaagucaccucaccuuuccaaacccaggaauccccauuugucuugagacagaguuguuggaaagaaaagaaaaggauagacucagacuccagauucaggcaaacccagguucaacuuagucuggccucaggcaaguuaaggaaccccugagccucaguuuccucaucugugaaaugggcacugauuuucuguugggacuucagcagaaccuucuucagugccaaccgugggccaaacacuagguucaauucucagcucuacuguuuguuccgucacugacagaacgaaguuagccaacuuucccagaccucuggcuccucgucuauaaaguguugcccucccccaauauugucccuuauuauuuuauucaucccuguguaaccuggaucucucacuaaaauguaagucacacaagguccuaaauucagggucugggaugcagcuagcacuugauaaaccuuugcagauguuaacugugguguucagaugcccagggaaguuucaggcacacagccggcaccuaagcaaugcugguuuccuccccugcccugccaggguuuugagggucucagagagaggcagguaaacgguuuuaaggauaauuggcacgggacagucaccaacccugcccaggaugacacggcagagcgugggucuuuggaguccagacuuaagccucccaccaauccgagcugauuccugcugcccugcuaaacaagcacacaaguaccuacucccagacauucuuauggaugacagcaucugaaagcaggccagggcgaugcaggguacugacagcccaggccaugaaacuugaugcccagaaguggcacccauggucccagagcucugacugcugcaacagugaucgaggacagccacgcugagaacagagacaucggcccugcccacugggccucccagguuaccuguccaccacaggcugcuggccacaagagacagggucugcaugcuccaggguguuugcgaaccccuggaagaagcugaguuuccuucuaaugggagucagcucccugucugaaggucacacucccaugcaggaggggcagggagugaagugugacucugugccucaguuuccccuuuuguaaaaugagaauaacagcuccugcccaggaugcucuuggggaagcauucuggaacaucccaagcuuucagccaguccgugggauuacccccacagucagggcucugguucucggaacacacaccaggcuagacccuuuaucauuuuuauuuuauuuuuuuuagagaagcuucaacauaaggacuuugaauaaauccaagauucccuucucaacugguauucaagcaaggccuuucuuuaguuuacugcuguguucccagcaccuagaacagcaucuggcccauuggaggaccucaauaaagaccuguugagugaaugagugaaugaauggacucaacugggaggacagcaaguucacaugucacuguaggaccgauccgugaaauacucccacuaacagccauaagacaggacagcuuuucuuugcccucuucuugcuggucacagcgacaucagugggcucccccuggcaccagggaugucaacaugauaaugcugauggacgaaauaaaagcuaccagcaaccaccugcuuuccaaggccuuuucaguuuaucucaucugaucccaggaguagaggccauucaccccauuuuacagauagggaaaaugaaggcuugguggguccacuugcccauggucacagagccagcaggugacacagagcugccaccccaagcccacaccugucugacuccaaaaccagugcucucucuacuccacuacacuguuggucugguuuuaagagaaaacagagccuaaauuuuaacaaucucuucaguccucugcuauaugcugauuuaacaaucucuucaguccucugcuauaugcugggaucaccuggcaccuuggggcagggggcaucccuauagggcaggcuggcggccaaccacaucccagcuggggcccugccaagcauguggaucuggcgccugccacggcuuuaaaacaaaaagccuuuccucauucugcagggcucagcaccuucagugaaagccagggcaggcugggcaguggcccaagacuuccuugugaaugggcagcaccaggagaggaggaagagcaccuuuccaccaucucccaggcccaccaggugcacuauccuccgucucaaaggaagccucccugagguucuggaagacucacuguagagccccugucugucuuccgcuguccugucccacgcuggggaaaugucuguguugcccaccagacccuggacaucccaaggacaagggcuuuauaugcugauaagaugcccagucacaagacagccuuuccuuugauucuucagggcaagcuggcugagaagcuuaauacuccagagcccugauucugaccauacccagccugcagccagcucaucuaacagcaucugcccuucuccuaccaccaugcuggucaaaccaguggugcccaauacugaugggaggcugccacacugacuuguucggggcagcugaccagcuauggagucuacaacaaagaaaaugaguccuccgccuccuucuccauugcuggugguagucccuuuguaggaccucauggugccauccagggacguuugcuuugaucaggcaauuccauuccuaggauuaccuccuauaguuacaucugcauggguggccagagacauaguaccccccucaagcagugcugucuguagagugaaagauuggaaaugacucaaauguccaucaagaggagcuuguaaacuguggagcaggcacacacuggaauacaaugcagcgguguaaaacaggaaaguucuguguccuacuaaggagcucgguccuggagacaaaaugcaggaaagaagcaaggugaagaacagugcaugagacaugcucccuaccguguaaagagggagggagacagagacacauuuguacuugaauacacacacacuauuuuuggcaggacacacaagaagcugguggcaguugcugccugugugggggagggggaugcacuuugcaaaguauuuuugcacuauuucaauguuuuuaaugugcacauaucaccuuuauaaaaguuauuuuaaauucuugaaaagcuuuauaacgggccacgugaacauacuagggcugaaaccaauguaucucaucaaucaggauuugucacaacacagccugacacaggcucagggccagagcaaccgacauucuuuccaaagacaucucgggcagccaugcaggcugaaucucaggcaggccccuccacagucccuuccgugucugacuuccagggucuucccagccagaaagcagccgaucaggaucccagccaaucccuacccagcagugagggcgugcucaguaaacuguagagugucgugccgagggaacgccauggcgcccugccacucaccugugccuccuaaguaccccaggaggaagcugcacaggcuccccacaguguuaacacagcucucccagcacagucucugccccuguccaggccccugacgcccccaggaugauuuccagcagccucuucguuggucuuccucccucuacuccugccccaacaagucagagggaaucuaucaauaccuaugucaggccacaucccuccucugcuccacguccucccagggcucccgcuccccggccaacacggcccuucugacccugccauucagacucacuuuuaagagcgagggggugccaauuaguaaacacacaggugaacggguguaaaggggaaguguucugggcaggcugcgggugcgggcgcccaagcccuacccucaucccccagacugcagcaucacuuccuccuccuucagccacccuagcugcuaucugggccauucccugaacaggucgaacgcgauccugccuuaaggccuuggaccuaacugcuucccucagccacuuguuccaaaacucccucgcuccuuuccuucaggucucugcucaaaggccacauccccagggcagcuguuccuggccacccucuguaaaaaacaucccuggucacuguccuuccccugcccugagccuauuucucaucacuuauugcuuuuauauuauaauuguacaugugcuaucuauuuaaugucugccugucccacuaaaaugucagucccaagaaggcagggucuaugucugucuugaucacugaacagugccugguaccuaauaggugcucagcugacauuaauugaguaaauuaauuauacccauuugguugauggggaaacugaggcugagacaaguucaggaaugcaccugaaaucacucagauagaaaucagccauggaccugguuccuuuuuacugaugccacccuggggccagccaccucaugugccgggcauggugcuggccuuggcaagggccccaucauccccagcuuccucgucugucucauacagagggaggagacuccgagguaagcugcauucuuguccaagaauaguaaugauucacuccagggugggauccaaaaaagaacugccuggacgucuguuuugagucggccgcccugcugccguccagccggcacucagagauguaaauacguccuccuagcgggccaaaucguuuccuuuugacugcacgccagccauuuauuggccauggcucuccccuggagacuagcagaggcaacaauuauaaaagggcccguccgcccagagcacggggccgugcagccuuucuccaccgccuccucuuuccgacagcugcaggggaagauuggcugagcaggccuuguuugcaaauaugacucauuucuuugauucuaauaaagucuaaugauacgugccgagcucccagggggucuggaggagccuaggaggaaggcacggcuccagccugauggagggccucuggccaggucuggccccgccuguccuccagggcgaccuugggacagaggugaccccagacagcaaggagaagcaggggacaaaagcucugcuuccccaucccagagcaacucggcgcucaauuauaaagccagcaugaaaugacugucucuggggccccagcggcuucucaugaggaucugggaaagugcagcucacuggcuucugcugagaauggugacuuagcacugcacacaggguggguguaggggguccaggccgagagaagaccccaagaguaaccugggagcggggagacacacauguggcacaaugugaccugugaccauggacuugggcucccaagccuggcccgggcucugggcugguggcugguggggacacagacaaaagguuagcuggaggcaggaugcagugcugaaugccagggcuggaagcuuugcuccuucuagcugugcacgugaccucgggcagggcacugcacgucuugcaucgucagugucccguggcccccugcaaagcacaucccuggucuuagcuccaaaacacucaagccaggcugugagucauugggaccacgcuacuucuguuuacagaggagagaagagggcguggagaggugaggucacugccucaaggucgugcagcugggaugugugggagccagaguugagcuuugucuccccccacaaggaaaggggaaugucacccauugcugcucugcugccuccucugugaaaacagagggaggaagggcuggcagggagggucaacagggaccuuuccugcccagaagaagcugggagauggcuccgcuccccuggugccucguaccccugacuuccagagacuacugagcaccugccagcagcaccugccagcaacuccugcugaaggaaaggacgggccagggaccuaugcaucuggggcauauaagagaagugaaaggaagcaacagcuggggcugggcuucagcuugagggucaccaagaccaaccuucgaggguauccucacugcucugccgcccaacuggcucccagacagcaacgcgcaaaaaauccugacaagauucacucgagagaaaccccagggucagacgcugcaggguugguggcuaucuucagggggauucagauaaguuucacccaaagggaacccagaccugcugaaggcugaggucuccgaggccccguauacagucagugcucagcauacauccagccucucuuucccaccaguguguuccuuaaggaauguccaaaaaucacauucaauucagucacaccaccucccuucucauauaccuucuaugguuccuccuccaagagaacaaaguucaaauguacccgccuaacauucaaggcuuugacccuucucccuggcccuaccuggcccucacccgugcauccuaugcucuagccaaaccaucccaaauacucaugugcuuucagaaugcugacucugcaugggcuguuccuccuaccuagacugucuugucacucuccuuuucugccuagugaacuucuacucauccuucaaagcccagcucauaugcuccuccaucugcagauggggaagugagccagagagagguagugauuugcugcuccacgcagguggaugaagacauggaacuaaugaggagauucagcacccagugagcacuugcuguguugaaauagucucaauccuuucugccagggugagaucauagcaugggaaaagccaugagaggguucugagcugggaauuaacagguuggauucagaauugguuacggaggugcaaggauaaggcacggagagauccaagaggccagugcugguguccaggagagugaugggggucccaugggggugacagugcauggggacagugcucagauuguagguauacucugaagggggagccaagaagaugugugaauuggaugugggauuugagguagaaagaagaguuuuggaugaugccuagcuauuuccucuacuuagagacugaaagaaaugacaggggcaaguuccuaguacuaugcucacaggagucaacuauucccuacugguucucuugccuuuccaccauugcaugccaagaaaagagaaggcucuugaaggcaggaggccgggucuuucuugcccacggcaccuggcucagggcuggaacugagcuguccccugguguagcucucuggccucggccugugcugugaaggcaggucacaggaggcagugcuggucuugccuaagccugcuuuccaggcuccugcuccauggcccucaaucuuccccaggguucuagaaagagggcagcuuauuugugaauguucagguggucucacaaagcucugcuggaaucuggggcuaggggugcagggguaggagaggugugagagcuggagugggaggugaguaccaagcuggcagccaggguucuuuggacagagcaaauccaucuggaucaugcagaagcuugggaagaugccugcagaaccagacacuuuccaaagauaaauacugucucagugucuuccaggccagaaaauggagcuggggugcucagaauggagauucuggaaggcaagggucccagaauacccccgagggcccggucccucuggaaggugugagugaggacuggccaaccugaggaccucacauugcucccaaguguucccucucuaagaccccuggguccuagacaacagcgagacaagcagagcccagaagaggaugaccccuuuacaauagggggugauucuuuaaguucauaacacacaaagaaacugcccugagggguaguuuuaugcacuaugagggcacucgauaaauaauaauggauucuggccaggcacaguggcucacgccuguaaucccagcacuuugggaggcugaggcaggcagaucaugaggucaggagauugagaccauccuggccaacauggugaaaccccaucucuaccaaaaauacaaaaauuagcuggacauagugguguguuccuguaaucccagcuacuugggaggcugaggcaggagaauugcuugaaccagggagucggagguugcagugagccgagaucacgccacugcacuccagccuggcaacagagugagacucugucucaaaaacaaaauaacaguaauaauaauaauaauaauggauucucagggcuggccacccaggaucucaugcagucagggccauccuacaaccuugggaugucagcacugccaucuccccaggugcaggugaggauaccacggcccagagagcgggauacuuccgccuaagcuagaaguggcaaagugaggguucaaacccaggcaggccagucaaugucugaggcaaggaggucccagcaaacgccuucaguaacuggcugagugccaguguccaggaguggggaaggcccgguuuucaggccacuccaaaaacagcagagaaaggacaaggcugugccuuggaccccauucaagugagaaaaaggaagugccagccuuucuuugucugugaacucagcuccccagggagcggggaaccgaggggcaaugauugugcuuccaaugucccuuuuguuuguaaguggaaaauauacacacuagaggaacccccagugacagugggccuaaggaccugcccugagcauacacugaaggccuggagcagcgacagugacacggaccgaccaaguaagggcuccacaccagugagggcaaccgaccccuucuuugccaacgaugucccagcccugaccccaaagcauggcuggggccagucgguaggccgcucccucuucucuggcccauuccugggccagcuccuaagagguggguaaacaccuugaaaauggcaaaaccacacacaaaagacagggacugucaucucgugaugauucagaaccagaaccacccucuuccuuaacagcaccccugccccuggcucacaaccuucacucaaggccucaucucaguuauuuccagggucaaggggcugcacuugagugcugagccccaaggcuggcuuaugaagaagagggaaaugaugcaguagccuauuuuugaucagccucuaagcacuauguuagaagaaugucuccacacaucagcucacucaagaguuccccaagaucaggacuccacaucccaccuuucugauguuuguccucuguauccucccuguaguuacugacuacaguucuucacuccucucaugaagagacagaauuuauuuccuccaccucuugaaucuggguuugucuuguggcuuucuuuggccaaagggacaugaacaaaaaugauacagacagaggcuugaaaagcacuuggguuucggggauugaccguuucuuguuccuagagugcuugcuuaguggccggugacaagcccaggcuagccugcugggugaugaaaccacagggaccaguugccccucacaccccagccaauagccggccaaaccccagaagagcuacccggaggaccuacaguugccugcagacacguggaggagaccaagaccagaagaacugcccagccaagcucagcccaaacugccaacaagcagaacaaucaagagcuaaauaaauuguuguuguuuaaggccgccaagucuggggaugguuguuacauagcaaaagcuaacugaugcaucuuuuucacucuaccuacucacuuuccacuuaacuacuucagcuucauauaugcauuuuucucugugcaauaacagaauauauuuuuuccuaaaauacauuaagaaaacuguaucauuuuuagacaacauaaguaugcauaccugccucacaggguaguaaugauucauucuuuuuaucuuacagguaaagaaacugaggcucagaaaggaggaguggcuugccuaaggucaaacagccaguaaguggcagaacugggauuccaguccugucuauggccaaaggcauaaauuuaucuccagaucugcacccuccucccacucccccgaagacaguggcuccuguaucccaggggaggagauaaggaagugggccauccucucugccccacccauguccuccuccuugcuucaaugagguggccuuacucccagaacucgaugacaggggaggugaaguugguggagcugauggugauccagacacucuuguucuugcgcaugguguccuccaugcagugagguguguuccagcugugguugcagugugcccagggcagcuccuucuggaaggacuggaacagguaguauguggcccaggccaggaugacgauguaguagacauucaggagggacacaauuacaacggaggcauagccgauaccugcagguugggcaaaugagaugaguaaacaucugagggaggccagacccaccacggccacauacucaacuggaaggccaugguauccccaggccccaggccacaagaggccuuucaacagugaccaccaaauauuuauagggugaauggauggcugguugaauggaaaggugaaacaacagaugguuagauaaaugggauggauggcagggggcaggggggauagaacaauggauggauggauaaauagauggauggaugaaaagauagauaauaaagaggaugguugauuggaugguuggaugguuggauguuuggauggauggauggauggauggauggauggauggauggauggauagcugaauagaugagauaaauagauggaugaaugaacagauggauaguuggaugauugaaugaauggccagaugaauggauaaacagcuaaauugaagaauguuggauugauggauagauauccauuuguugcauagauaaucaguuuguuagauggauguauggauggugguagguuagaagguuggguagaugaauggaaggaugaauagauggauagauggauggaaaauggauggauagucuaauuacugagugguuuaauggaagaaaggcuuaaggauaaauggauuuacguggaugaccgaaugaagagacucacauaugcucccgucucugccaauuaaaucauaacagugauuauuuugugugcauacuaaguacuaaacauaggacuaaggaagcuaccauucauuugaugcugacuguguacaaagcauucuacguggcuaugucauuuugucuucauagcaacccugugaaguaaacauacgacuauauuucuauuucauagaugagaaaauugaaguauaaagugaccuucucaaagucacaaaacuaucaaggggaguuaaugagacuugaacccagacagaaagccuccugaaccugaauguuuaucugcugcacucuacugccaaguagcuacaggcuucuuuuuucuuguuuagauucagggggugcaggugcagguuugugacagaagaauauugcaugaaacugagguuugcacuuccauagauuccugccacccaaguagugaacacaguaugccauagguagucuuucagcccuugcuccccgccccuuguggaguccccagcgucuguugcucccaucuuuaugucccuguauacccaagguugaguuuccaccuauaagcaagaauacgugguauuuguuuuucuguuucugcaucaauucacuuaggauaaugaccuucagcuguauccacguugcugcaaaggccauacugcuauucuuuauggcugcauagucuuccaugguauauaugcaccacauuuucuuuauccaguccaccaccgaugggcaccuaggcugauuccaugucuuugcuacugugaacagugcagcugcaggcuucucuaugcaacaaccuagggaagugggcaugcugggccuuacugagcagcuacugcgugcuaggcacuugccacaucuccuuuccccguacuccuaagcagcagcauccgcaucacacugguacuguacuggcugcuaucuugugucagcauagagcuaagugaugugcaugaggcuccaauggaccuggcagacaauaggugcucaauaaaaauguguggaacugaugagugccaggccccaagugaccuccgucccauacucaccagagaacaaggggcagaucuuuucccagcaggugaugcccccuucagagguguacuggccuaugaugaucuccaagaaaaacacaggcaggccgcucccaaacaggaaaauaaaauacgguaugagaaacgcaccugcagagagcagaaugggcaaaagugaggcuguggccauggcagcgccgacgcagaaggcucccaagcccucccagccaauggaaccagagagaaugcaugaggggcaugaggcucaaggccaaacucuuggaccuggugggaaaugcuccaggcccugcccaccuggccagcugguuucaccuuuccagugugcccucccucucaccuucaaaucuaccagggacuucaagccucagagccuucuuuuuuuucuuucuuucuuucuuucuuuuuuucuuuuuuuuuuuucuuuugagguggagucuugcucugucacccaggcugaaaugcaguggcgugaucucggcucacugcaagcuccgccuccuggguucacaccauucuccugccucagccucccgaguagcugggacuacaggcgcccgccaccacgcccggcuaauuuuuuguuuuuuaguagagacaggguuucaccauguuagucaggauguucucaaucuccugaccucgugauccgcccgccuuggccucccaaagugcugggauuacaggcgugagccaccgcgcccggcugccucagagccuucaugucagcugugccuacugccugccugucuccuccacauccguccccugaacaaggacggcuuggccucuuaagacccacucacacgucgccucuuuguuggggccuucaccuacccuccccaggccugcccagggcaggaggcagaaaagcaccagcuaggaagggugaggugguaaggggcagaggguaggcaucuccggugggggcgggaccaaggggaagaaugggggggcaaagcauuggggcaggggauccuaccugguguccacuaauggcuucagcggguccauaaacccuuugaaacugugggcaacuugggucuaguguaugugcuuuguucuggggagcgucuaggacacucaucacagucccaaaggggccugagaccuacaaaagguuaagaaaccaggcucuaagggaaaauuccccaaaaggugguucuacuaaugugggcagcacaaggcaugcccaucucugcugacacacaagccuuugacaacaagcagucaccagccgugagcaguuccucccuauccgguucucuucaaccccaucauggcaccagcaagaaaccaccguuaggugcugccugaccucaacacaaccccguaacagaagaccugucagaggguuccugcucggagccuucagcaggcaaaaacacaaaaacaaaagcaaaccaaaauccaaaaacccaaaccaaccaacucaucaacccaaccaagugcagucacuacauuuaaaaaauaucuucacuguacuuuuuauuccuggauaccuuuggagcaugacaaaugauaccaguuuuccaucuacagcggguaacagaauuugcuuucuggaguacauuugguaaaguuagaaaagcaaacaugaauauuaaaggaaagauaaagagucagaggcaaguagauauggcggacagauaaggaggugugugaaugucuggggcuugggagacacaagccuggccuuguccugccucuuuggagguggcaaacuggaggaccagagaggcugagggaccugcucaagguaacacagaaaggcccugcagaacaguacucugauucucagucgggcuuauccccugucucuaagggugggguuggcaggagcauggcaggcugaccucauggaggucaagggggggggccagggaaagcagggaaagagaggccacccacgcucuggucccagccuccagcucuaaggcggcuuuguacuggaugggcuccccuguggcccggcccaagcucaccuccaccauucuuguagcagagguacgggaagcgccagacguugcccaagcccacgaagccgccagccacagagagcacaaagucgaucuugcuagaccacuucucccucugcggagguuuucccucagccucguccucaggccgcgugccugggcucuucccuggugagggcuucaggauguccuuguggaaaucuuucagacacugcagcuucuccuugguggccaucuccuugcuuucuaugggggacaaaagagaagcauccugcagcugaugagggaccaccuguaugucucagacacaaucucugcuuccucauccacgagccggcucccaccugcccgggccuguggcaaggggccuggcaucccugucuguccaaugcuuugacagcaacaucaggagucauucagaccccuucauggaccagggaccucaagauucaggcuguggacacuugcaacccacagaaucggcagguccauuccccgggcaccugcugaagagaagcaccagaggcccccagguuugucgucugggugucacacuucagccugcaccccagcccuagcaucgucuuucacaaaacacaacacacccaggcaguucuaggcaucugccaaauaacagccugcaagcaguuucuagaaauuaacagauacuauuuucuaaauuuggauuuguauuuaaaaaaauggaggcuccucuuuugcaaaugccuuaauacagugcccagcccacagggaugaccauuuauaacuguaaguuaaaaaaacagauagacggaaacgaacgaggaaugggguuucaggcuggaauggaaacaauauuugagauggguugccauccaaguauagagaauggauguuuaugaaauagaugugcaauuuauuaaccagucacaucucuagcagaaaaaaauaagggauuugcacuggugaggauuaugcaagugugcuuguucauccccauuuguccacccuucucuaaccauccucuggcuugcugugauuccaggggcugacccuguagauccuauaagccagguucccuugcccuccggcucccuguuggguuuggccaacgggaggccccagagaaggucaaaucucuaagcccccggagcuguucaugguuacccucagcccacuuaugcuuggcucccagucuagagggaggucugccaccagccaggccagagccucuucuuucuguacuuccuaagguccccaagugcucacucacccugucagcucgacccugagggccacagucacacccaguguggccgucugugcagaagguggauaccccuggcucucugagaacugacaaggguuaccaagagcauccugauuucuagcccacagcgugaggaaacagcucaaggcuggguccccugccuucaagggcugacccacaacauaacagagggacacagaaaacggaugagcugggaaaaccagagcuacuaggccuacucgccccucucugagcaucaguuuccccaucugcagaauaaaaaggaugacagcagaaguggcugacucagagccaagcagucugggacacaacuuguuugucuucaugaucaaacugguggccaacacugaaauaaucagauuucagagaaaagucaagaauucugaguucucuugaaaaauuggaagguuggaccacagugagcucauacuccucauggcgauugcugacuggagcagaugugaccaccuugucacgugacccuugucacacgaccacacccuggccagcucaccacccagcucaggacacacucgcuuggcuggcuccagugggcaucugaguuugucuucucaucagagaaccaaacacuaccugaaaguaucuuguucaauuccucgcuucccugucgucuaucuccucaacuagaauagaggcuccuggggacaaggaccacaccugccuugcucacaacugugucccagagccaggcgccaugccuggcacacaguagggugucaggcaagagcugcuggguuagguggaucccagaguggcauccacaggcagcuggugacaacugcaaacccuggcuuugccaauccugugaccaggcgagucacuuggccucagggccuugcaggcagggugaggcaguagcugccugaggacuugggguguggagaggggaugugcuggcuuggccccagcugcugggcccacaggggcugugcucgaggaacagaggcacaaaagcacaacaaaacccccguuucccccacaccuccuuccucucccuggcucggggugggggaccccaauuguuucacuaucuggcggccagcagaccaagaaaggcuuccugaagccucugggcagcucauggagcccuuccucugucugccagagcauccgcgccgccuuucucugcccugcucccucggggccgggcgcgggauucgacaggccaauggcuacuguaaaaauaguccuagcagccagcauuguuccagcauugacuugcacagccccccgaugguuaucagggcagcccauugugggcuggcucggugggcgcauaauuggaggaugugagacucaacucccuccgagugaagguguuucucaggaaaugacccuggagccuccucacccagaagcucaugaccucauuggcagcugggaugggccaaguccauccccgcuaggagcuggggucugcuucacugcggcuacccugagagucccggcucugcccucugggcacacagacccacuugccacacuaauauucgagaacccucuagaaacauggaggaggagcaacugggguuccccaagucccuuugcucuaggcucugauuuccuacaaaaugaagccuccacccccuuccacacucaggaccccaucgucccaccaccuggggcugagccaggauggggguggggguuuucaacagggcagaguggggaccugucacgugccuggcauggugggggucucccaacuccucauuucuaaggugcacccaccucuccaccugugggggcugcagucacagguccaccugccuugaagaacacacagccagcagcccugccccugaagaagcccauuccagcaagacccgccuguacauuccuggcauccacccacagcucucuaucgccauggcaaccacgagcuacaggccccucagcccuugcacuggcaucuguggcagccuccucacaggucucccugcugcuacucugcccgccccugaucuauucucaaugcagcagcugaaggcagauuaaaaagcagaaucagguccucaugcccccgcccaacccuuugcucaccccuagaagaaaacacaggcuccucaccauugcccaccaggucccagcacaugccccugccgacccucuggccccaucuucccucuccccuucuccuugggacacgggccacacagaacugcuuuagucccuccuacugcucaggcucaguccccucugaaccuuccccacuggcuguuggagccgcaguauaaaaagcccccuggcucccugccagcugccccaggcacccuggccccuacagggaccagaauauaagccucaacccagaagcugaaagucacuuccccaaacaggugaccuaaggcaagucacucaaccccacuagucuucaguguccucaucuguaaaaugggguaacuguaccuucccugugggaguguugugaggguuaaaugagggggggugcacaggaggugcuuagaacaagauguggcacacacuccaugcacagcaacuacauuaugacuugagacuaucuccucuuacuaccgcuaucacuacuauccaguccaccccuggccuugggguauauaaagccuucauccuccccagggugagaucaauaaggcccagagaugacaagagacgcccugaggucacuccgcugggaguaacagugaccgugauguauccaaacccuuaggagcuuagccuccacugucccucugcggcucagucugaccucagaggacacccuccagggaguccccggaguaucucugugcaccucugcaaacuugcaauuaggccagucaccccagcuuccucacacacacacaaguggucaccccgcugcgcagugaguacucaggagcgaguccuccuccacaggcgucccugcacccgccgacaagggcuguuuuccuuggcacugggcccaggguuauuuugcagcagccgagauacauaauuccccauuuuaagagcuuccucuuugguuauuacagcuacaagugauuagaauugacugauacagaggcuaugggaugaagccucucccugugcccagcuaaacauucuccuugucucuguguuccagaggugacagccagagccagcugugccugaaaccaacugcagaucaccuggucagauuugacacacacgcaggcaggugcagccccgugccagcgaugccauggcuugccacaauaucccuuugcugucucccuguuuaauauuaagauuugugaggacuuauucugggggcugagcuguuuaugaacacaguuuccuauucuccaacacuccuauuguggaagagacuuugguaguuuauagauaaaggaagcugaggcucacgcagggaagcgagcagccuggcugaggcuacacacacggguggaaaggagagagaggcucaaggccagaguucccaccuggccaccugggccuccggcaccgagcaaagcuuagaaagaggucucugcacugcuugcaaauggggaccccuauaucuugcucugcaucccucccggugcccugagcaccagccagcugggcuuugaguugaguugcagaugcugccucccccagcaucuaccaccucaguccaaggcucuggggaaagucaagcccuugccucuauuuuuccugggcaaccuucccagaggcucgagaguucucugcaccugcccugccguccugcagacccugcacuucucaauuuaacaaccaguguccuacaugucucuuucugguggagaacaaugauuuaaaucucauauugucaauggcauaaccacucaggagcuucugccaugcuuuuaggaagaggccagguccuugucuguuuccuauuuugccugcuucucccaucccaaacugccuagcacauaccuggccuuuaagaaggaucucugggccagguuucucagcaaaccucuugguuaagcaaacugaucagcggguugggcaagcagcuccuagagucccagaacaggggcaagaagagaccuggaugacauccauucuacagguggggaaaacugaggccuaaacaacucccugcccacuaggcuugcuguggaaucaagugccuggcuggaccccuugccccgcccuuuccacagcaggcaucucucuccuuuccucacuuuucugcccauuccagagccagauucugggcugaggccaugacuaagcugugugacccagagcaaguaacaaccucucugugccuccgcuuccucacugguaaaaaaugaggguaaaaacaagaccagggacuaagcaggaugcugccuaauguuauucagcacacagcccagcacauaccaauugaucaauaaauaguagcuuuaaaaaaaaaaaacagccacauugcaauucuauuauacuuuguggcaaccauucuacccuguguuuguuuuaaaaaaagaaaaagugggccaggcgugguggcucacgccuguaauuccagcacuuugggaggccgaggugggcagaucacuugaggucaggaguucaagaccagccuggccaacaugguaaaaccccaucucuacuaaaaauacaaaaaaaaaaaaaaaaaaaaaauuagccagaugaugugaugcacuccuguaaucccagcuacucaagaagcuacggcagaagaaucgcuggaauccgggaggcggacacugcagugagccaagaucgcaccacugcagucuagccugggcgacagagcaagacuccaucucaaaaaaauaaaauaaauaaaauaaaauaaaauaauaaauaaauaaauaaauaagaaaaaguggaugguuagagguauuggggaauugcuggucaaaaaccacaaaauuucaguuauguacgaggaguaaguuugauagaucuauuauguaugucauggugucaugcugauuaaaauuaauaacauauuguauacuugaaaacuguugagaguagauuuuaagcguucucacuacacacaaaaaaugcuuaggaagcgaggugauacguaaguuaauuggcuugauccagucauucuacaacauacgcagaugugaaacaucauguuauacaccauaaauauauacaauuuuuauuuaucaauuuuaaaacuuccagccugggcaauauggcaaaaccccaucuuuacaaaaacuacaaaaauuagcuggaugugguggcacaugccuguagucccagcuacucgggaggcugaggugggagggucacuugagccuuggaggucaaggcugcagugagccaugauugccccacugcacuccagccugggugacagagcgagacccugucuccaaaaaaaaacaaaaaaaguuacuuuuaagaaaaagauagcuguguuuauuaagcacugaccauauacacaagcagaauaugcaucuuuuuaaaaagagcacugacuacaagcacauuuucauuuucuuagcuaauccccucagugggugcugcucccauccuuccugugcugauaaagcacagagaugugaagucacuuguccacagucacacaugaggaaaaggccacuuaagcuccaaaugccccccaggucugucuuggccucugaaguccauguucucaacuacuguagcugcuauggaucaaaugaaauggggucuggugucuuuaaggagccagcugcaagccggcugacaaacuggggaacuaggcaaaggcaaacagggaagugaagggccacaugauggagacggggcucaggaggcuggacagggccuggggagcagucagugccaagggccacagggcugggccaggccagcuaaugaaacagcacagacucaggcaggacagauggcgugcuggacuggagcccuccucuagcaaacagggaacucugauggggcucccuggaccacugucuccauagauucugggcuagguacaggcucagugagcaggauggccaggaucuauuagugaugccugccaagggcacucuccuuggcccuaguguuuaacaauuaagcaccaaaaaaaaaaaaaaaaaaaaaaaaaaaaaaaaaaaaaaaaaaaaaaaaaagggaguuguuguuaagagugcuauuccugggugggcgugguggcucacaccuuuaaucccaacacucuggaaggcugaagugaaaggguggcuugaggccaggaguuccagauaagccugggcaacacauuuggacccugucuguacaaaaaguuaaaaaaaaauuagccagguguggucacgugcgccugcagucccagcuacucaggaggcugcgguaggaggaucacuugcacccgggaguuggaggcugcagugaguugugaucaugccaccucacuccaggcugggugacagagcaagacccuguuucuaaaaagaugaaaaaauaauaauaauaaaguagaagcucuuuccaucacucuaaguggaguagcuguuuuaaguggaaauuaaucaaagccuuucuuuuucucuuuuauauauauuuuaaaaguacaccuuuaagagauugaaucauugaauuguaucaugaggucuguaucuguugguuaucugcucccaaggaaaggcuaacucaagcguggcgagcuccaaagccuccagaggccuggugggcaaaggacaggaguccacugggguggggaggucgcagggaagagugggaaccaggggacaggaggagucuggacucucacaggcagcucuccuuagcucccacuacugcaggugccuucgggacuggugcccacuggggcuggauccuccagcuucucaagagauguugaaaucugguuuauaugcacacacacauuuuucaguuucuaaaccaccaccugggucaaacacaaacacagagggggccagacucagccuguggccagucugcucucuuuggucacacuauugcccccaggucaccuaagguggccguggcaaagggaagaaugggcucgugcggagaugcugaccaggcuggccuacagcccugauggcuugucccggugaggucauccaggaagccaggcauuguuuugcccggaacaaagccgaaacaaugagcaaaaauauucuggucguagugaaagugaauucuguugaggaaaucguuucagcaugccgucucugggacaggggcuuguuaucuaccugggguucagcauccucgggugagguccuccccucuccugauuuaacugcaaccuccaccccaccaaaguacgggucuacccucagagacccccgaccuccgcuagaagccuccugccuggaucacacuaagcccugcagaaaagccucuaccucacccccggccucaucagccuugccuuucacagaucaggagacugaggcucagagaagggggaagccuuaucccaggucccacagcuacaggacagugggccaggauuugcacccacgucccaacuccaugaccuuggugccacccuggggcaaggugaccucuggauggggaccagccagaccacguaguucuucuuagucugugguuugcuggggaagaguggaugacagugagcagguuuugcaaagaacaagccucuggaacaacgccggggguggcgagacacgguaugagucuaauagacagccaacuugucaccuuccccucauaaaaacauuggcaggugaacauaaggucuggggacuggguccaaacuguuuuaucaucuccuuggaaguggcaggaccuggcccaaagccccagagaaccacagucuggcagcagaggagaggcagcaaggagagugccaccgugccaguugcagggggagggguggaggcacggcaggcucccgguggcaggauggccugagaagggccaggaugaggcaggguggcuggcgcugccccagaugaagguguuugaggcacacaccauacuccaaacggaggugccccacagcagagcccaagcagcuaagucggggaaagggcagugggcgaggucagaaagcugggucaugcaggccaagucacuuccccucugcaucucagagguccaggguuagaacaaagguuugaguggcuuuggcaagcaguggcuguuaacucacccuacuaugugccaggcacugcucuaggaacuggagacagugggugagcccuaccaagcugaccugcagaaggggagauagacacuaaacacauaaaugagcaauuauuuaugacagugcccagcacacagaaaacaacaaaguaggccccucugcggaggugacauuucauaacaacagcagcucgcugaggacucacugugggcaggcccugugccaagcccuuuccagacaccaacucacucacuuacuccucaccagcccggaugauggaaagaggcccagagaaguaaagccacuugcccagggucauacagcuggauucaaacccagaagcucggcucuagggaacaagcuuuuagccacacugaagcugaggcaaagaacugggggcaaagaacugggggaacacuguucuaagagcagagaacagcagguguaaagagggccauggugcacauagugaagaaacagaaagccagaguguggcagagaggaagaggggacggggcccccaaggccagaguuagaaccuggauuuaucccaaguuuugugcugccccagugagggcucaacgcuuuuggcuaaaagcccuggauugucccugaccaccaacccuucccuucuacucugaaagggaacuuaagggcccauguuggguuuuucccugcagguacuuaugacuuuuuuuuuuuuuuuuuuuuuuuuuugagacagagucuagcucuguugcccaagcuggagugcagggugcgaucucagcucucugcaaccuccgccaccuggguccaagagauucucguuucucagccuccugaauagcugggauuacaggugccugccaccacgcccagcuaauuauuuaguauuuuuaguagagaugggguuucaccauguuggccaggcuagucucaaacuccugaccucaagugauccaccugccuuggccucccaaagugcugagauuauagaugggagcuaccgugcucagcuaacacuuucugguggggccuguagagucguuaaccccacaccucggccgccuggguuccucaccaugagcugagaaccugcgggguggguggccagaaugucuuccccuugaccaaggaccuaacaccuaagacugguggcacaaacacaacauccuugugcaggaagcccaaacccugccggcuccaugggugaagccaugcuuugaaaggaacagggucacccuuugcuguaaugugcucuugggaagucaucugcccacucugcucugagcaggcacucgcuuaccuggggcaauucucucugggggagguggcgggagggaacaaaagcucuggcugacugagcaccugcuacacaccuggcccagggccaucacagggguacugggucaccgucccaccuucacagcacuaacgucccaccuucacagcacuaacgacuagagaaggagggaggggcucguuuuguuaaagaaacaaaaauuauucuacaaguucagaggaaggacaagguuccgugucuggucaaggguaggcuucaaagacgucucuggucaaagagucccugagagcugggccugacagccuggacacacagaggaaggucaagucucugggaugcugucugaggggacccuggacaccacucaguagacuuccagggcacuugguacccacagcugggcuggaggagaaagaggagcuuggggagggccaccaaaaugccuaccuuggguacuuggaggccuguuuccacagccagaggcagggccgagagcagccccaucugcagauucugcacacaucggggcuucuccugaccuggggagucgcgcacuguuggacuugcucuuaaggcugggguuuugggguuguuuuccuguugcuauguguuuaggccaauaacagcacaacggucacacugccugcagcucugcuccagggugcaggggcugggugaagggucagagggagccaagccccuuuuccaucuccuucccccauggcccagggcuggcuggagucaggcugcuguaggggccccuggagccugcggaaggagugggugagucagcaggcagccaccuccuggcacugacucaccagcgacaggacagggcugucacucuugcugucagcuucgcuagcagcccagcccucagccugguuuugccggaaaugggggcgggguaggguagaccaugagccugaaacaggcucugcagagcccaggauuauuucuggaggccacaaaaaagaaacucaagaaaagagaaagguugguugccauuuccuugaccuucuccuuuuaagcuguaagaagccuaaagcccugcuccuuguuggcuaugaaaagcagagggcagccccucccuugcucuauagaaacuggaaggauacaggccccagugacagagucagcuaagggugcacgugcaggagccgggccagccccaacucugucacuguggcucugccggaugccacagugccauggaaaccagucagggcgcucugcuguacagccuugggcaagucaccuucucucuucagccucaguguuacccucucuaaaguaggcacaauaucccaucuacaguaugugaaacuccuaccucauuaaauguuugcaaacaaccucccccuccuuguuccucuuuuaaacauguuuuucccccugacgaggauguacuuucuucuuccuuccuaccuccgccccaccucacucggacucagaaauucagcucgaccagaguguggugcuagaggaaccaaacagccugggauuuagcaagacaggguggggaacuagcacugucggucaccggugcccacuguguucuggagcacaggugccugcucuacuuaacuggaagccgauuccuaggcccccuccaccauccagaaccagcccaagauccccagggguuccugaagcacacgcugugguuucucaagccccaacacccuuggcuugugcugugcccucagcccgguacacucuuccccugccuaaugagcagguaccccucacagccucgaugggacagccuccaggacagcucugucccugcguucccagccuguacuguugcugucuguuacuccccagucacccggguccugcuuccugacaccuaguauuaauacaaggcccagcacgaugaggauuuuucagauggaauguuuagggcuuagggcucuggggacacucugcauagggagaaacagccuuccacgucaggcauucugagagcuccucuacgagggcgacagagcaaacugcaaugacagaugcugggguauguggacaguggggaaggguggaccaggaugugcucccaacaucugagcacaguuucccaucagauggucaaaacucuacagaugaacaccagaucuuuaggaaaucacuuuucauuaaacgauguccauuccugagcaucuuccaauaaugacuuugaaguuaauuuuuccugccccuaaagguuugccaagugccaggggaugcccugggaucccacacaaaaucaaagacucacaguggggcuuuggaggucuuggcacguccacauccaagcccauuuuacagaugaggaaacugaggcccaggccacauagcagaucagugacaagacaaagcuacagucucuagccuccuccacagacggccccaucagagcuggagggaacucauuucacagaggggaaacugaggccugaaagaugugguggaggggcgggacauucccgacaaccccaacuuggugggauacaguggacgccagaggcugaacauaagcucuucuuccaaacuugggaggaugaggcucauaucuaauucugucagguuggcaacuguuggugcagugguggcagcgacuuccagcacuacaagauggugccuaacagcggcuacugcucagccagaagaaaagcucagcgcuaaaauccacacucggguggggcuaggaugcagggaggaccgacgcuucucaacuguggucuuccuacgugcaggggccaucucccagggcaacccccagugguagccaucucccucaacuuuccauugcaauuuagcuuaaacucugggggugcuggggacaugguauaccuucugauggccugucacucgugguguggcccaagaggccacaccaaccauuggaaacuccuuggaggcgugcccugaccucugcucccacgugcuuagccggguuuguuucuagcaaaccccaaaugccugccaugucagcccccagcucaagaacuaucagugacucccagcugccuagauaauaaucugaacuucuccucuuggaaucccaggcucacuagaguugucugacuugcccccaaucucugccaccuuauuucuccuuuugcccagcaugacucucuccccggcacugccccuuucaagucugugcuugguuuguggguucucuuacauuuagguagaucccacccaccuggaagacccugguccaagugucaccucccagcaaaagcccuucccgcccacccaagacucuuccguuuagcauccuccagcucaaaucacccccaccauucaccagacacugcacucucauucagaacugugcaacuuuggauaaaguucaaaguucuccuugggaaaccucaguuucuugaccuguaagcgggccucauaaucuguaaagucauucauugcugaagucugugggaucuuaggagggacuaguggaugaccaaaauccucacaugaggaacaucagaguugccugagacacuggcuaaaaaugcagaugccugggcccaugcagcccuacugacugaauuuucaaggugggggcccacgaaucuguccuguuuaaccagcuucccaggugaaucugaaaaucaggugagguugggaauggcggugcuaauaaugaacugggaggcaccugggcaaaacaucaaacaaaaucagcucaggaaagagauuaaggcuggcucaugacagugcgugcaugugaugcgugugugcacacagacgucucaucugccagacugugagcaucuaggggcugggccaggcugaguuucacuucugccagccucacuaaguccaggaucaucccaacagccauuuaucccggacuugagaguuugccagagagucucuuauucccuauugcugcugcuccucaccaggcccuggcagaugaagaccuuggcccucaacuuacaaauaaggaaaaugaggcucagaggagaaugaccuggccaagguuacuccauagcaaguggcagagcccagauguggacccaggacagagccaacaugccuuuauccacuugcuaaagagaaagggaguuugagaaaucaaggcaaaggcuggcaggggugaccuagggcuccuggagcugggcagcugagugaggccugcauguuugagacuggggggagaagccuuggagaccaaccccgauuccuggggguaggggggugcagagggaaaaagaagccuggccuugucucugcagcaggcgaggggcacaguucagcugagcaggccccaggcagugucucuaaggacaggaaugagcugcaaggcacauugccugggacuuaggggcuccccucacugucacccagcagagaggagucacuuucuccaguggaggcagcaggugggacuuccccaacagcagaaacaccugucccuuaaacaccaccuccccaggcauagggaacaauggcaggaaaggccagcggaggcucuggugacauugcuugaccaaggugaggcuugcccugcucuggacugugguucagaacugcucucaggagacucagcagccuggaggugcagggucccaaaugucccucccacacaccugcacacagggccccucucucagcaaaggcacccuccccaggagagaaaguuguacaccauaaauaaaccugucucugcuucagguuccucaaauauagaaugggaguaauaacaguaccuaaguugugaggcuguugagagauuaaagaaccaaacauguauggacugcuuagaacagugccuggcauacagcaggcacuuagaaaguucaagcuaucaggaugaugacaaaauugaccggcauucuuccucaacucaugggcagccugggcucugagccgaggcccugcugagcaucucuugggcaccaugcccgccgagugcuuuacagaucaucuuacagggccaagaccagggcucaaacacuggccaaccgcuucugagauucagggugucacccuaacagcugggccuccuccuagcugcccccucccuucuauuccaacugucucucucccaggccucucaggggccagccuccucuucugcagugcaugugacugggggauccugggguccccaucaauauucuugcugagcaauguggguccccuguguuggugggucccuggggaucugagcacagaugugaaaaccugccaucaccucccuccccuagcccuuaggauacaguuaggggagcaucucagggcagaaagcagaguggaggagccgagggccagaucagggccugcaguuccccaugcaaaguacugaguacccuucuggcccuugggaugguggcaccugcuaagcuggggagauggaaguuacaggggcugggaacuggacucgagaguagaaaaggacuuugcuguggaccugcagagcaaccccaacaacccacaggagggaagagcagggcagcuccuuggagcaggguggccaggcagcuucucuccaccugcuggccccugggacaccuugggcagcuggagagaaaaccuucaggagaggaauguuaccuugcugguggcccccaggauggcugcaacugcagaagucagacacugggaccccucaacauggcagcuuugaaaccccacagcuccuggcugaagguccuugggcaccggggaccccuccuuuaggcauuauugaaugacagaucagcccaacaacuugaugcccagaguucacauauaguaagcagacagaggccugggaaggaaggcggggcuagccaggaagcucugaagccaggcugauggggcucaaaccccagcucugcaaccgugggcagcauaugcucugugccucgguuuccucaccuguaaaacauggcugauaauggcaucgaccucacaggguggauggcgaucccaccagguuaauuucucaggacagggccaggugcccagagaaguguacguuaaaacuccaggugugaaggggaacaucuacucaugcuggggcuaaucuggaagagcugccugccuguagcaggacucaggacagcugcaauuauugugguuggcucuuaggucuucccaaagggcuucuacucugaggcacagaagcagccagagagugcggaagacacccagcacccagggucucugugccucagaguaccugagcaugaggucacaaugcuccuuccagcacagcgcagggugcugggaggcuguguuuuccaggaaaguacaccacauaagaacgcucugcagcagaacuaaagccagagagggguuccuuuaucacagaacccccaucgccacgccguuucugggaggcccugccauucccaggcccugaaggacacauuccugcucauccucaggugcaccuuccccugggaagccggcccagaaguuucuucuuccucaccaagaccgcaggaagcucuagggcagggccagcccuccucccagguagggaugaggagggucccggcuuauugucauagcaacccuugguucuccuaauuccaccuguucuuguauaacugaaauaauaacugcagcugacauugucugucuggcacugugacgggcacuuuacauaauucuagcuaauagaaauguuuuaaucaggcuaaauauuuuuuucuuuccuuaaaucauuuuucacugauuacagcugcuuacuuuucuccuaauuaguccgaaaguagcgagacuguguagcaucuuagagucuaauggggcuuaaaagcacacucgaaaugcuuuaaauguaugcaaaauccuccaaccucguggccaaucccagcucccugggcugcaggcuugcaugugcaguuuggggaucagcagguggacgcaguauuuuacccaauccuuaaccagccacccuuugggauggcuggggggggacuuaccccaaauggagaugaggaacuacggcucagaaucaauaagcgacuugaccgagguugcacagccaggaagugguggacuggagucuggaucgguaaccacugcgcucuggggcaccgccuggcugugaccuuagauaccaggaagucucucccccucaaccugacacagggggaaacugaaaccagcaggaggcaggggaauuauuuuucaaauuaacucaaggauuagaauccaggucucuugaaucagcccagaucaaaaguauuuucacggaccggguggcagcuggccucaaucauaagagcagcagcuaacagcccuggcugcgcgaggcccagugcucaaugcuugcaaggcaucuucccauuuaauuauacucauaauuggugagagucaugcauaccugccgugauuacuaacuacugaccccgcaggcuagggaagaaauguuuagccauuuaaauucagacuggccagagaaauuaaguggcugauauccaggggugugaccaaucucaaugaaacugaugaggggaaggaccauggguagucucccaacccacaccauuuuuggaaacgcaauuguugccuuccacccucccugccccgagucccccacccaccccucaccuccuuagagcuuccuuucacuccugcaaagugugucacccacugcagccccggguguaaucagcuuauucucccauguacagccugggccaucugaaaacgguucccuuuacuccuugggggcaaggauaccugagauuuaggccacaacuauauauagccaagaaauccguccuuuuuaauugacucaucuauuuauuuggucaagcaguuccugcugacccccagauggccgaguucuacauaauuccucccgacaauguguguggagaggaggggcccucccugccucugcugcuugggcucuguauucccagugcaggcagcuccugcgggacucuguuucccaaauaagguuugccuaguuccacccuuugccuaugcugcaucaccuauguuuuaguuggaaccuaacacugcaccccuucccagcugcaaguggugaccucaggaaugucacuucccccuggggggcucaguugcaucaucuguaaaaugggucaucgucgugaauuacacaaggaagguacaaggaagugccucgaauacacaauuggauuugcucucaggagaaacaggauacucugugcccaagaaagauuagccaucuuucauggcgugccuucguucaaccaacacuugaccuugacuccgccccuucuuagcauccagcuaagugcagagagaggcagaaacaaacaccccugggcuccagaucugccacacugggaaaauaccagcugaacgguuucuccagccgguguugugugucaaacaggcggcuucgaccgagcuuccuucaauagcgccguguccccguccccucccucccaaugcacuucacgggcucccaaaaccacgugagucagcaaacuggguuagacaccucguuagaguggguuuccucuggagacuuguggccgugccugugauucuccugcagcgguguuugguugaaggcaggguuugucuguucaggagccaguugucaaaacaacaagcacuaccuuuaaggggcaguuggaaccaugaaauaaggauuccuguuucuggcugguuccccagagugaaucaagaccaaccacucugaacagauccgaggccacugagccagacccaaccccacccccuaccccaggcagcuccucuccccuccccauugcccagagcaggacaccccagccacgcugcacuccuuagggcuucuacaggcuuccacucucuaccaggccuuuccacgggcuguuuccccuacugggaaugcccucacugucuggugcccaacuggcauauuuuugauauucaagaccucagggagcuuuuuuuuuuuuuuaacuuugcgugcccaaagcaccuucaagaggcccuccccaucccugacaggguccugauuuguagcaucuucccacacaagcucccaggcuggacagagggcagcucauuucagggucccuagccccagcuggggccugaaccacagcaaaaguccauaacuuuuggaugacugaucagacuuucaauucucaauguuuauaugcuuagagauuuuuccccaaacuuccccuaacgucaaacacucuugcuggggccuuuccaguacuaggcagagcuggcagggguuugaaaaggugacuuucucaaauggacuagaaaggccaaaggaaaacaaaaggucuugacuccaugaccuuaagcugggacgacccuucuccccagaaucauccugcagguccagaacccagccaugagacuuccagacucggccacacagggaucgcuuggcccacagaaggccacacucccugauuuugucuccuuuagggugagagacuucacugaaugucuggauuguuaaaugugaauaaaucaccccugaauuaugaccaauauuaauuaauaagacacauuugguauuuucaaaauaccaagaugcuuucuccuacaugcacuugcuaacccaguaguuaucauagggcccauuuuacagauggggcaacugaggcccaggcagaagauggacuugcccaaagaaguagcaccaaauacuauucucuugacagcaccaaaacaggaaggugguucugagaggagcagaggccugaggucucaaggugcugugugaccuugagcaggucacuguacuucucugagccucaggaggcuuauuaugaggaaaguggaugaaaagguggaggcagacaggcucaugagcccacagucacaaacagcuuccuucuacccaccugagacaagguccagccuccuggcucuuuaccaacugcacugugccugguguauagugguugcucaauauuuacuaagugaaugaauguugucucacaacauucaugugugagugucucacacucaucccaggugugagaucacaccgaggcaugagaaggccuggcacagcagggcucccuccccuggacacacugucuguccuuccagaggcacuucguccccuucuuccuauccagaagacaccucuugccugcuggcuguagaguccuuuugaaguccucuggguuccucuacaguuuuuccaaagcaaaugcccauuacuaagggugucauguggacaacacacaugccaccucuucccaccuugcccccuugacagacacugcuaaucaauccuggcuuccuucucauugauguggacccagucuuggauuccucaucagaaucuggucucucuggguccccaguaacuuaagggacaagagacagacccuugucugggaacccuuguccaggacuggcaggaugcccagaagagacuugaggggcugugagacuagcagaagcucucaggaaaacucaacccagaaaauauaaaugagaaccuagcccccuccuugugacagagguagcaaaggagguaggaggcgugaguccuuugcaacacaauggcccaggugggaccccacagagcaagaggagugaggguagggauuuggaggugggagccaagcuggggcuaggaauugaaaggcugaagagcagggaugcaacucuaccucuggcugggaggagggugggggugagaagcaaugacaggaagccaagguggccugcaugcaggcccccagaaggugagccacuaagcggccaagcugggguggggccuggacaccggcccuaugcugcacgugcucugugccugacuuaguggaggacgcucagcucagaggagagauccgcaccagggcaucggcuccuaaaucgaagggguggagacucacccaagcucggcacugccaccccaagaaccuacccugggaauaaaugauuuauucuauucacucuuuuuuccauggcgaaucagaggucacacagaggguuagugacuugucccagcucugccagcaaguguguggagacaugaguagauaaaggcacccugagggucccugcgggcauuugggucugaauacugaccccaggacaccuuccuucaugggugccugaggagccagcccuccaaaacccccgaggcugucugcagccccagggauccuggcggugcuugcuuuuuaaguccaggagguuucuggacuuaauuguccacugacuuagaacacauggacagauggaaaugccuuccaggaacuccccucagacuucacugaggugggcagccauggucccgaaagucccuguccauuucugaaaaagcccccucccuuaagaaaucccccuccgaccccugcuggguccaagagccgagacgagaagaugcacccaagacauccucacuccaccugaggcccaagcuuucccacgaggcugaggccagagaggaggcaccugccugcccuggccccagcucccagcagcagcugugugcaaaaccaaagccaaagaugugggcuaaauccaggcuccuguccugacacguggcugacuuccaguuucucacugccuuccugagccccaguuuucucaccuguaaauggggggcaguaguaacuacccuacaagaugauguagguaucaaagcuggaaaaaccgugcaaacuguagagggcugcagaugcgauuacuaugcauauauucagacuucucugagauagaggcaccaaacauaaucacaauacuacgagcaauaacgauguuaacuucauuuauugaagaacugcuaugugccguucugagcuaacguucacaguuagaacugcuaacuuucaccauuuuucuucccugacccucacaaccagagaagggagcuucuacaucaggcccguuuugacagaggacacugaagcccacagcgagguuaaacgaugugcucagagucacagagcaggguagaaacugaaugacauucacacucaggcucacgggaccccugagcucagguccuaacaguacaucucuagaggauggaguauguuuuucaaccucgagucuggcccaguacucagagcuauuuuuugcuuaccggcuuuuucucaucucccccaaaugagaaaggcuggcagacugggggcugcuucucugggaugaauuguuuuaaaucccguuuccuaaagucccgaaggcaggagcuccccagggaggugccaccccuccaucuccaugccccagggcugucacugauauuaggccagagugaaaaugagggcaaccccugcggggucaaugauucaucaacacguaugcagcaucucaaacacgugcaccccauucgaccagcaagcccacuucuugcuuagaccaacguguaaagacgcccacucaaaagaaguucacuggcuucagcuuugccagacaaaaaaguucgggaaauuggcggcacaacacuuuaaaucuacuuaccaugacugaauuguacacuuucaagggguuaagauggucagcuuuaaguuauuugucuuuuacaacaauugaaaauagaggcugggcgcgguggcucaugccuguaaucccagaacuuuggaaggccaagucagaaggaucacuugagcccagaaguuugaaaccagccugggcaacauagugagacccagucucuaaaaaaaauaauuagccaggcauggaggcaugcauguaaucccagguacucaggaggcugaggugggaggaaggcuugaguuuggaaggucaaggcuguagcgagcuaugaucacaccacugcucuccagccugggugacagagcaagacucugucucaaaaaaaaaaaaaaaaaaagcagagugguuuacaagagaaacuguaaccagccaauuucccaucacuaugggauuaauuaaauaaacacugcuuuagucaaacaaaucauggcuuacaacaaggucagcaaacuggccacugggccaaauccagcagcuuguuuucucuugccucagccuccagaguagcuggaacuacaggugcgcaccaucacgcacagcuaauuuuuguauuuuuaguagagaugggguuuugccauguuggccaggcuggucuugaacuucugaccucaagugauccacccgccucagccucccaaacugcugggauuacaggcgugagccacugugccuguucaaaaauguaugacuuuuauaaccagaguaaauaauaaauaucauuuuauuacggucuugagccuucuaggaagcgaauguugagguuggcacuucuguugaacaggccugagguggccuuuucugacaacacuggaagucaugggccuguuauaucaacacuccuauaugcaccaguuuacaaugggugcggggcaugggggcagacaccccgugggagaucucaccacaagcccagagagggucucccuguuaagaaucuucuuucuuccuuaagcugccccaggcaccgggagggugaaucugauuucuggacucagccccauagcugaggggguggggaguugcucuagggggggcucaccuugggggauaaaaugagaaauugcauguggggugcuuggcacugaugugcuaggccuuuugcacacuuaaccucacugugcuuacaaagugaugaggucacccccaccccaaaaucccaguaucaccgucuuucuaacccuccugggugccacuauugcuccauuucagggguggguuaccugaggcucaggguaguucugugacuccuccaggucacgaagccggcagggcuggaacagagauuugaacuagggacugccugacuccccagcuccauggacuccacuacauggguugcccccugucagcaauacuuuuuugggcugguccauuaauaguucaggcucugcugaacaacuaacacacauucccauguccgcaucaugccccuucucagaugagaaccugaaggucagagcccucaagugacgugcccagugaggagggcgcacaccuagcagugcucagacuucagagcugacaaggucuguucuuccacccuguuccucuagacaccccugccaugucagggggccgaggagcccuuucagaaaguguuaagccaagagggcugcuuggaggagcaucagauaagucugagggcaaaucugccucucagccuuuucuauaaaaugggcucccaagcgcaaauacaucagcaagccucaaaaagaggaacauuggcaaccucuguuuacugccuguaacagcccaucccaggcagggccccuugcacaagacucuaucuggaagcagaacucacauuccagccucacggcagcaggagccucauuucccaggugcuuugacuacucauuaaccaggaggaagucccgggggaaggggaaggggcugggcccagaggccguucccagccugaggaagugggcuagagucagcucaaucagguucaaauccuucccagcuguguagucuuggaaacaaucaauucaucucuccaagccucaguuuucugaucuguacaauagggaugacaucagcgcccaccucacaaggcuccugaggaggcugugcaugagucugugacguguuuagcagugccugaugugcaauaagcgcucaaugaauuucucauauuuuuucaaaaagaguaagagcacacccacuucuuuggguugacagaguuaacacaguaaaccucucggcaguauaugagcaugcugaguccaggaagcgguagcaaucauuauuauugacgucuauaacuauuaugaugacgccuguggaggcugacgucgaguaggucaccuccaugccugcccaguggcuggcuggguacacaccccugcccgaugucacagcacaaagaauaugucuccaugggguggggcugcuugugaccaagcaaccuaggccagcugagcuugaugaaaaggaaggacuugguccagcugcuagcagcagcagguugaggagcucugggccacaaacaaacgcuugccuagucccggcuucacaggggaccccacuccaaccaauccgaacccuggaccagugggagcuuaaccuucccccuuagaaauuucugcccaggaagccaggguuuucuaauuccaaagcagaguccacagugggucuugacaucaauguaaggggucaaggccaucuuuuuuacuaaaggaagacagagcagaccagagcacagcagauggcgaguacgaggaugaucugagaaacuucaauuucaggguuugaguuugacguguguguuuguguacaugcacacgcaggccacaucccauuguaaaauguauuuaaugaacgcugaggauuaaauaagacucugaaagccccuagagcaggcaaugucuuaaucagcgaaggagacaucccuuaaacccuuuuuaaaaacauaaugacgauccugaacuaaaagaaaaauaaggcugcuguaaacacugagacaaucagugcaaugccauuaagauccacagauaacagaaucacgucaauguuaaaucaguguccugggguagauaacugugcuaggguuauauaagagaauggccuugcucuuuuuuuuuuuuuuuuucgagacggagucucgcugcgucgcccaggcuggagugcaguggcacgaucgcggcucgcugcaagcuccaucccccggguucacgccauucuccugccucagccucccgaguagcuggaacuacaggcgcccgccaccacgucuggcuaauuuuuuguguuuuuuaguagagacaggguuucaccguguuagccaggauggucucgaucuccugaccucgugaucugcccaccuuggccucccaaagugcugggaucccaggcgugagccacggcgcccggccuggccuugcucuuaugaaaggccugaaggauugaggugaaggggcaucaugccugcaauuuacuccccaaugauucagcaaaaauggaagaauguucacgugacuguuuuuauuuaacauauuagugagaaagagaugaagcgaauguggcaaauguuacccaugggaaaaucucaacgaagggcauaaugcgaggccacuguaauacucuugcaacuuuagcaaagguuuuccauuuuacuuguuuauuuauaauuuuauuuauauuauuuuuaauuuuugcugagauggggcucauuauguugcccacgcuggucucgagcuccuggccucaagcaauccuccugccuuggccucccaaagugcagggauuggaggcgugagccacugugcccuugacaacaucgugaaaccccguuacuccaaaaaauacaaaaauaagcugggcacggcggcacgcgccuguagugccagcugcuagggaggcuggggugggaggaucaccugaaccuggggagaucgaggcugcagugagcccugaugacaccacugcaccccagcguaggcgacagagugugacccugucucaaaacaaaaacaaaccuuuaacagagacagagccaagcucagaccccaauccucagaaucaacucagugagggcauccuccccacggcagacuugccccaggcuacucugcagcagagccaggacagggcacaggcuggaucuccaaaaccagugcuuggcccauuugcagggcgucccugugcccucuggcacagacuggcuggggaccaagcaggcacagaguggccaagccaggccaggggaucugccaccuggaggugagguguggacaaggucugugggccucaggggucccgucuuguccuccuagagccugggggagacacggagcuccugagccccccaccuugggucacugcacaacgugugagacacccaucccaccuggagguccaaggucacuuacguuugggagcuccucagaagggcugugguucugguucuggaucuauugcaaagagaggaagcgaagacggaagaaagagaucuggucagaggcagacugugcacagggccccuaauuguccacccacuuguaaccaccagacgugugugcuggggaggggcugaccaaaccccuuggaaggccaggacgcugaggcucacacaugcauacucacacaugccaacacaagcucacaugcagacgcacagacacaaguguaaucauaugcagacucccagccccacacacuugccugugucagccacacacauguucacagccacacacagacccacaugggacacacacucacacaugcacucccacucacucacacacgccccucucuuggaugcaggguccccaaaacuuagucagcagcaagaaccaucacauugcccuuggucagaggggaacaagguuucagcugcaaauggguaagcuguuccacagcccuagccacagaaagcccacacuccugagcgccccaccagcucagucacauagccugacuauucccaaggggcgcagggacacaccagggccagagugaggggccucagagaagauccuugggggaugugguauucaccaaccaguucaggggcgagaaucacugugccuaggaaaucugcugagcuuugcugagccaagcagucccggacgugacuaacccagaagacuuuuuuuggagcggggggguucuguugucuuuuucaguagaagcucaguuugggaaauaggcagcugggggcagaucaccuccuccuaccagcaaagcuccuugcccugaggcuggaaggcucuccuggauuccuggaaucuaaguguacaaagucaggaaaucauuucuucucaaaugagauauuuucaaugaacuguuaaacugggaucagcagaaaugggcagugggugucucagggggagagggcaugggagggugggucugggagagcagacagaggccuccaggaccccuuuccuugcuguagcuguagcccugcccuggcagccuccuucccagacccagaggcgcacuugccagugucaguaaaugccagucccggcagccuacagagcucccugucccccaaauuagaugaucucauugcuuuguuagggccuccacauucaacaggcucacacuggcacccacuggguacaaggcacuguggaguaggaacagucagucaacaacuuauggugcacuuacugugccaggcacugcacugggcacaugaagcucagcaguggaugacagagccaaggucccugagcucaugaggccuggaaccaccggcuagaggcugggcacaugagaggccaucaaggcuucauucuaggcucugugaagucugggcuggauuagugaugucugcuguggguuugggugguggaaguagcaacguaaaccuugcuauccuagaccauacacagggaagugggauaaagugaaagaugaaggcagccuguuuaaagcacgagguuaagagaaucagaggaaggacagcauaauucugcauagggcaaaaccuuaccaauuacaagaggccagcccaucucagagaggaggauaagaauggcacuaaaggcuaggugugcucaugucugcaaucccagcacucuuggaggcugaggcagaaggcucaugagcccaagaguucaagaccaaccugagcaacacagggagaccugucucuacaaaaaaauaaaauuuaaaaauuagcuggguaugguggcacaugccuguagucccacccacuugggaggcugaggugggaggacugcuugagcccagaaguuugagguugcagcgagcagugaucguaccacugcaguccagccagggugacagagugagacccugucucuuaaaaaaaaagaaaaaaaaaagaauagcacuaaaguccauaugucuagccugcuggcacccaugccccuucuggggacagcuuaaaccuguuccaggaggagacccacauaggccugcucucagcccaaggggucuagauggacugaccccaccuccuccuccuaggugggcacgugagccagcccuagccaaucagagggggcugucuugauuggcucaaagauaggcacuugaccagccuggucaaaaacagugaugacuaggacuuuugccaaaaauauuggggaaaaacaaggcucuuucuugguugagauggcuacauuggggcagggggcggcacuacacuggugagcagcuagggcauccauggagaaugaagcaggcauagagagacccggagccgggagacagagagaaggaaacugagucccgaugacaucuuucagcaccuggacucagccccaggcugaaguauggccccaggcuuuuaaguuaaaagagucaguaaauguucuuuuuuauuuuuaaugucaguuuaggccggguguggugacucaugccugggagacacagaaagacucaucucaaaaauaaauaaauaaaaaaaauaaaacugaagucuguuugaacugauuucugccauuugcaagauaagaauccagaccuauacccugccuugaacuugcugcguaauuuuaugcaugucucugacacacuccucccauuauaaaaaagaggaaggaugcagaugacagaacaccugagguucccgcagcccuggcacucuaguuaucacgggcaaggauuaggccugacccuucccccagccccacccccggccccaggcacacagccagagaggucaucagcccuucccaaaguuaaauacaaagcagaauugccuggagggcucuugaaaacccagaaugcggagcccugcccccaaggucuaaaugagaaggucugggguggggccugagguucugcauucugcaggcucccacgugaugcccauacugcugggccagggacagcauuuugaggacucagagucacuacguguucuacuuuucccaguuugcugaggacaggugcucagugcaaaaauaaagccccagccagcagaagaccacgaccucucuguccucaaagcagacggcgauuacggagaaugccugcguggcugcagggaugaaccagccuuuaaacaacggaagcagcaggucccagcuccuguggucccaucacugccccuuccagccagcuguguucccuggaauguauuuaaauaaugggggaggcugucagaggcuaaggugcuuccuugggcuccagcaggcuccaggcugguuuuccaggcgcccagagcauccccaguggcucccccacucccaggcaucaugccagccccaaaucccgcugugggccuuguccggacacagugacccaggccgcccugcugucagcagccuggcuagcccugggcucuccccugauuuacauccgacuuggcugccuugaaaagccuccuguggcuuuuggagcgaggacacuguucaguagugaaaggcuuccccaacagcaaccuuuccaagguggcgcuggcccagcacgaaugccggcaggcucccagcugugugaccuugggcaaguuaccugcccucagcagggccucgggucuucaugugcaaaaugggaauaguggugucuuuggugaggauuaagaagaggaguugacgaagcacaggaucuggcuuuuaauguauaggaggcucacaacugcacuauuuaucuccuugacucaaagagugguccccagaccagcaccguccacagugccugggauuugguuagaaauucagggccccaggccccacuuaggccugcugucucacuguugucacccaggcuggagugcgguggcacgaucucagcucaguacaaucucugccuaccaggcucauccucccaaauagcugggacuacaggugcgugccaccacacccggcgaauuuuugcauuuuuuuagagaugggguuuugccauguugcccaggcuggucucgaacuccugagcucaagcaauccaccugccucagucucccaaaauacugggauuacaggcgugagccaccacaccuggacgaguuuuugcuuuucuuuuuuuaaaagucuguucuaauugauauucuaccaguggcagaagaggaauccacauuauuguuccucgaggcaacguucuuuacuaaaagccuguugcuacagcucugcucagaguaacucuggaacuccuguccccaaaucgggacaccuccuuucagagccagggcuaggacaucuugaaaaaccaccaagaggaugacugcauccuuaaaggagucccgcaggaacagcaccccgugugguggcacgcgcuuccacaauggauagaauggucuuuccucccuuuauucagaagguauuucccuuaaacacaaaaccuaucugggccaccccuuacagggccagggaggagaaaggacucacuuaggucacagagcaagccagaggacagggguauucuaagccugguguugcagugccugaugcagggccuuugauuuuaaaagggcauuagccaugcauguguaaucuuuugucugacguccauagcccugccagacagacagcuccaugaggguacaguuuggucugucuuguucaccagccacauccccagggccuaggacagggccuggaacaagugaauauuugugagauggauggauggauugauggauggugacaggugaauauaauuuccaagccuggagccacucagauguucaaaccauagguucccauuucagaguagaaggaauuaggcucucuugauuuguauguugagcaacaacugugugccacaccccuaggcuggaugcuggagcauccaucccuccccuugauguguccccagucaagugcauggguauaagguaagaccauaaagguccgagcucaggccagaggaaaggaccacaaggcucagagcagggcgagcugaaguccacuuuaacucacgucaucuuuuuugagugcuuacuacgugccaggcacuguuaagaggcucaaggaaugcuucccagagcaggcagcuccaagcucgccccuuaagagugggaauaaggagugaugggaggaagggccuugcgggcugagggaccagcaugggcagggcugagagagcuggacgcuuggucuagcuaggagcagaaaccagccagacuacaaacaaggaaagaaguugugguaggugagcgugaacgcuggccaagagccagaucgugaagggccuccaaugccaggcuaaggagguuggacuugauuucacaaagcacuagggagccaccacugaaggcuuuugagcaagagagugacaugcagagagcugguccccagaugguacagagagguauccaggaggcacagaggcuagugaggaggcuguugucuugggcuggugugauguccaccugcagaggaaacaccaggugucaucucugaaggaaugaauguccuugaaaucaugaccugagucuucccucauggugcugacuagccuuggggcaagagaggaugucccuuaggaccucccccuuccggcacccuucacucaguaagcaugacucugcugaaaucgcuggccaaccacacuccuccaccuccaaccaagcaacuggcagccuuggguuaaggacuuuccacuggaacaugacagugagucacuuggcauuuaugugcaaagaaaaguccuggaaaggaagagccucucagggcaccccagcaugaggagggaccacgcagagaagugguccugagccucugggucggcaaggacccgaugugagcagaacccugagggcucagcccucugccuuccagccuaggccugcucagauaccugcugagggaggaagccuuccauugccagcccaacccuucuccuggagaccaccagcccucucccuaccuuccacguucuauuccaugcaguggccagagcugcucaccacgcuccuucuugagcuuuccaggaaccccauccugggcucugggggugucuccugagcagccaaacuguaaggagucuuugcaauugauacaguuuugcccucccacccacuuuccagugacuugugacaaaaccaggaugugagagucaugaacaauaucaccgaagguuugagguggaggcauuaacccuuuccuuaaaucccucccugucaaggggggguucacacaagcaaugaaugaugggugcggcugggaggggggagcacagggagccacaucugugaacaauggcuuuuuuuuuuuuuuuuuuuuugagauggagucucacucugucgcauaggauggagggcaguagcgagauguuggcucacugcaaccucugcccaagugauucuccugccucagccucccaagcagcugggauuacaggugcccaccacugcaccugacuaauuuuuguauuuuuaguagaaaugggguuucaccauauuggccaggcuggucucgaacuccugaccucgugauccgcccgccugggccucccaaagugcugggauuacagacgugagccagugugccuggccaacaauggcucuuuugauggcuuuaucuuccuguguugauaagugccuccuuugggccucagcguccucauccauaaagugggugggcagagaagguuaacuggaugaucccacaaccccaaaguccccacacuccacagccuggggcugcucucccucagaccugaggcggcguucccagacuggauccuuggccugccuuggcauaaaccaucuuagacuguucacuaaccuccuccugauagggaucuccccucccuccuugagcacaggugcuguguauuccucccugcccucuuggcccuggcccugugccuggcacacaguaggcacucaugaacguuugccgugcggucagugggacgaggaugggcugaggcauccgguggacucuggguccagcgcuccuuccacccuuuccuagcugagugugggcuggggccacccauuuuucugaugaacucaucucugagacaggaagggggauaaagcaccguggaugcucaauaaauaugaguuccuucccuucucagaaugcugaaucggcucagccggcuccucugcacccuccggggcaaguccuggguggggguauuucauuuacugagcuggcagcacugggggugaucagacaggacacgcaaagucaguggcucccaaaugcaggcuggcuguuuggaauggccuggcagauccguguguucugacaugcaguccacauggccugcuauugggauagaccaaguggcagaaccaagaacaguaccaugucauuuuuguucaaaacaaaacaaaacuggccaggcgugguggcucacgccaguaaucccagcacuuugggaggccgaggcgggcagaucaccaggucaggagaucgagaccauccuggcuaacauggugaaacucugucucuacuaaaaauacaaaaaaaauuagcugggcgugguagcgggugccuguagucccagcuacuugggaggcugaggcaggagaauggccugaacccaggaggcggagcuugcagugagcugagaucacgccacugcacuccagccugggcgacagagcgagacuccgucccaaaaacaaacaaacaaaaaaaaaacaaaacaaaacuacagcuagcuuccaaacagaucccaaauaaugccuggaucaaagaggaaaucaaaacucaagugaaaacugauccaguaaguaacaaaaaggagucuauguccauaugcacaccuggauaaaguuuaagcuguaugcagagggaaauguauaaccuuauauuaaaaagagauaugauagacugcccagcauuuucgaaggccaaggcaggcggaucacuugaggucaggaguuagagaccagccuggccaacauggugaaacccugucucuacuaaaaauacaaaaauuagccaggcauaauggcacgugccgguagucccagcuacucagaaggcugaggcaggagaaucgcuugaaccugggaggcggagguugcagugagcugaggucaagccacugcacuccagccugggugacagagcaagacucugucucaaaaaaaaaaaaagaaagagauaugauagacugucaaucaggcagguggacagacugaagaucagauuguacuuuuuuauaaugauccgaaaggaucacuuuuuaguuuaugcaguuucguauugcuugagguauauuacuuuuauaauuaaaagugaaugguuuaccaguuucucaaaaaguuaacacauaucuacuaccuuauaacccagcagcucuaguccuagagaaaggaaaauauauguccacaaaaacacuuguacagaaauaugcacauagaagcuuuauuaguaauagcugccccccagcuggaaacaacccaaauguccaucaacagcauggaugaacgcauuguggaacauccauacaaugggagacuacucagcgauaaaaaaaaaaaucaacuccugauauacucaacagcacagauggaucccagcaaugugaggcagaaaaaaauggacaaaagaguauacacuaaauaaguccauuuauaugaggauuuagacuggcaaaacuaauuuauggugacagaaaucagaaagugggccugguaugguggggcaugccuguaaucccagcacucugggaggcccgcaaggguggaucguuuaagccuaguaguuugacaccagccuggcaacacagcaaaacccugucucuacaagaaauacaaaagaaacuagccaggugugguggcgugcgccuguagucccagcuacuugggaagugaggugggaggaucaucugagacuggggaggucgaggcugcaguagagaucaugccacugcacuccagccugggaaacagaauaagacucugucucaaaaaaaaaaaaaaagaaaaagaaaacggagaaaguggcugucuugugaggugaggagcacaagacaacuuucugaggugcuggaaauguucuauaucuugauuuggguggugguuacacagguguauacauuugucaaaacucaucaaaccguaacagaaucuuugcauauuacugcauguaaaucauaacucaauuuaaaaaacauuuuuuaaaaaucaucuaaggugggaggaucgcuugagcucaggaguucaagaccagcccaggcaacauggugaaaccuccuccguacaaaaaauacaaaaauuagccuggagugguggugcaugccuguagucccagcuacuuggaaggcugaggugggaggaucacuugagcccaggagaucgaggcugcagugaacugugauggcaccacugcacuccagccugggcaacgaagucagacccugucucaaaaaaaaaaaccacaagaaaaacuuuaaaaauacagauucccaggcuccaucccccuggagguucugauucaguauguccaggcugggccugggagucugaauauguuuguuuguuuguuuuuaaguaucccaggcaauucugauaccugaccacaguuagggcagcccaccugccucccccaucauucccuccccacucuuuuguuucaggugguuuauuauuuguauguugguuuuuccaagagaagggugguuggccacacaacgcuggagcuuuagaaacagaacagcaauuccucacucucucugcuuucccucucguaacccuaacucccacccuuggcaucagccucugcccagguuuccaaaugaagccucugaccagguaaggcaggaaaggaaacuccgcagaccuguccaggacuggcauaacucaccuagagacacuagggcugugugcuccagggaggucaaagccagcaaguuaauggccuguguaccgguuaaauagcauguccaggccuucacccccauguuuacagaaagaguucagggcaagacucauugguacagaaaaugcuuaguggcucggugacucuccgucuccuggaccccaguuccguuccuuacucaccaucaggguucuccugggcuccaggcuugacuggcuucugccccacuauccuuaaacccaguaugacuccugcugccaucaggagaaagcccaaacccacuuacacagcauucaaggcccuccggcuggcacgguggcucacaccuauaaucaacacuugggaggcugaggcgagaagauugccugagcccaggagcuugagaccauccugggcaacauaguaagacccugucucuauuuuuauaugugaaaaaauaaaacgccccccuccccaccaucuggcuccuauuccucucuccagcuaggacccggggaaccuguucuacaaacaugcuuggcuauuucacgccacugugcccuuguggcuacucugcccccuguggagaaugccagcccauccuguuucuccacccacagacaauggcaacuccgacacuguguccucuaggaagcgaaagugccuccugcccacuaccccacccucacugcacacucagcugcuccuugggucuucuucacuguauccuacggaugguaauggccauugcaguuaccacaugcuucuaccucugggacaggagcuccuagaaagccaacacucuaccuugaacccagugccagcccagagcugaccuuaaccaaggucuauuaaucaacuaaaugaagcacauuaaaaaagcgcucucauucucacuugaaggcuuccuuaggcauuuccagauccacagcuccugcccagaacccauaaauucaaacgaacgcucuggccaaguuggcaaacacaggaaaaugagaugcagccccaaagaaucugacucuugcucaugaccuucugcagaaguggggaaucagcauguaccugccaggguggcccugggauuucaggccaaccccaauucccaggcagacccccucuggcugcagcuaagcugcauucuggggagcccuuauaauuuacuucucagcuuuuucuauauacgggaauguguucaaugacucacaaguuucuuaucauucaggacuuuuggaaagacuuucagagaaguacaccucccaaauccuuugacaaacugacaggcggacaaguucagguuagaaaacagaguccccagagcccggacugccuuguggagggcugaccccugcagcagaauggguagcagggcucaggggaaggcacaaggaagggagaaugaguaacuagggacagaagcaaggugcaaaugggucccauaggcucacuuuccugcccuaaggacugggacaccuuuguuccucauuuuccccaggccccgguucaauuucaacucccgaggauaucagugaccaaagccccauggggccaaaacucacagcugagcuagggaaaaccuuuugaaacuuaauuuuguccagucaaggcaaagucccuuagguggcucucaguuuguccaucuauaaaauggguacugcucaccaggccuccagacucugaaaagcagaugugguccaaucaccacagguugaggugacgggaaggaggcaggggaggaugauugcagcugagccauggguuaguacaaggguguccccaaaggacaaagccuccagaaugcaccuuggcccuugccauacaccacagugacccaggaccucgugacacccucuaaucagcagcucuacagccgagcccggcuuuacagcuuacuacaagcuuauucagccucaucucccucaauccccucaaggacguagugaggccggcacugguguccuugcugcccaggcagccaagccgaggcucaaagaaaccaagggaaucaaccaaggucacccacccauuaaaacaaagcauaggacuuaaaucaguucccuggggacaagcuccuaccucuggucccugguuuacucuauaaccagucugccccacccauuuuacagguaaggaaacugaggcagaaaaaggguugcccaaggucaacugggggcugagccaggccuaacaccucccaccauucuaccagucccacccuguuggggguucuuagccgugcuaggcccccuuuggauccucuccaacaccaucuugaugaaauuccucccccaccccaccuccucaugcccaccccacaaucccugggugacucccuggucgagagggaggcaggugguugcuaagcacucacccgcucucucucucauaaaaauaaacuccuucuggcuaggagacucuggacaagauccccucccuucuagccaacaaaaaauuaaaaagaaauuuuaaaaagaucuccucagugacauuuacuugaacgucagcugugccaaagcgggggccaauuuagugaaguccaaauggagccaugcgccaguaaaccucagcccgaagacccuccauucaagugucugggcaauuacugagcugauuuauuuccccagacaggaaacgggggcccaggcugccucccaagcuuuuggggcugguccuggggaugccgggaucuggcagaggcccaacagugaccaaaauagccaggccgguggcccuacccggcacacaccucccugccugggagagcugcccacaggucuccucuccaguccaggcugaaguccaggcugaagcuuugaggcuguaggaggaggucccuggaauucucucuguguggcuucccuagugggagggggacgagaaucuccuacucaaaagaggaacccacagaaggaagagaaauagucuggagggggaaguguccugcuggcccugccggcuguccacuaccccuuggcugccccuccgggccuuggucccaccacucaggacugcuggacgcuggcgcugccaccugcacaccaccuauggagugcaugcaccuauggagccacgcugcccuaucaccucuccccacucagcgccggcccuggagaaccagcucuggccauuggacccucuaggcaccagggacacccucuuggguacagccgaggacacacgagugcccacaaccagggaccuggagacacaaccacacucagggacacgcacgugcaccuagccagggccuggaagacgcagccccccacacacagauucaugcagacacaaacggggacacacaagagcacacauccaaagacagcacacucagguaucacacacagagaggcacacacacacagcccagcacgcagagaauaacagacaugcaccggaacacacaugugcacgcugcuggggacacggugaaacagucacccucagaaacacagacacagggauacggaggcacauguaggcauccugacggagacaggcacacagauaugccacacacacacacacacacacacacacacacacacacacacacacacucuccugccgcccgcaccaagagccggagcccuuuugccggggaaacaauaacagccccgccagcgggacugagcaggcgacucucggucccuuccgcgguggugaaaggggcgccggaugggcgcacgcggaggggaggaggccgggacugcggcgacgcggggauggggaggggcugcagacggcgggcagcgccggcugcgcgcccagcucccggucccuccgguaccugggguggcugcggcgccgcccgcagcaucugcucaggcugugccaggguuccgccggccgggggcuggccugcccggcucgcucucugacccgcugggugaacagcuccagcacucccucuuggcgcagcuuguccucugggcuugcgguccucggggcucggcguuggcggcggcgcgaaggaagcgguaauuuauaagcggcuucuuccugaccucgcgugucuguugucugagcaggcagcucucagcaucacccauccugcuggguggaaaaauaccagcucggccgggccgggggc

SEQ ID NO: 14800 - RNA, 2329 nt, Homo sapiens
gcacccccagaguuuaagcuaaauugcaauggaaaguugagggagauggcuaccacuggggguugcccugggagauggccccugcacguaggaagaccacaguugagaagcgucgguccucccugcauccuagccccacccgaguguggauuuuagcgcugagcuuuucuucuggcugagcaguagccgcuguuaggcaccaucuuguagugcuggaagucgcugccaccacugcaccaacaguugccaaccugacagaauuagauaugagccucauccucccaaguuuggaagaagagcuuauguucagccucuggcguccacuguaucccaccaaguugggguugucgggaaugucccgccccuccaccacaucuuucaggccucaguuuccccucugugaaaugaguucccuccagcucugauggggccgucuguggaggaggcuagagacuguagcuuugucuugucacugaucugcuauguggccugggccucaguuuccucaucuguaaaaugggcuuggauguggacgugccaagaccuccaaagccccacugugagucuuugauuuugugugggaucccagggcauccccuggcacuuggcaaaccuuuaggggcaggaaaaauuaacuucaaagucauuauuggaagaugcucaggaauggacaucguuuaaugaaaagugauuuccuaaagaucugguguucaucuguagaguuuugaccaucugaugggaaacugugcucagauguugggagcacauccugguccacccuuccccacuguccacauaccccagcaucugucauugcaguuugcucugucgcccucguagaggagcucucagaaugccugacguggaaggcuguuucucccuaugcagaguguccccagagcccuaagcccuaaacauuccaucugaaaaauccucaucgugcugggccuuguauuaauacuaggugucaggaagcaggacccgggugacuggggaguaacagacagcaacaguacaggcugggaacgcagggacagagcuguccuggaggcugucccaucgaggcugugagggguaccugcucauuaggcaggggaagaguguaccgggcugagggcacagcacaagccaaggguguuggggcuugagaaaccacagcgugugcuucaggaaccccuggggaucuugggcugguucuggaugguggagggggccuaggaaucggcuuccaguuaaguagagcaggcaccugugcuccagaacacagugggcaccggugaccgacagugcuaguuccccacccugucuugcuaaaucccaggcuguuugguuccucuagcaccacacucuggucgagcugaauuucugaguccgagugagguggggcggagguaggaaggaagaagaaaguacauccucgucagggggaaaaacauguuuaaaagaggaacaaggagggggagguuguuugcaaacauuuaaugagguaggaguuucacauacuguagaugggauauugugccuacuuuagagaggguaacacugaggcugaagagagaaggugacuugcccaaggcuguacagcagagcgcccugacugguuuccauggcacuguggcauccggcagagccacagugacagaguuggggcuggcccggcuccugcacgugcacccuuagcugacucugucacuggggccuguauccuuccaguuucuauagagcaagggaggggcugcccucugcuuuucauagccaacaaggagcagggcuuuaggcuucuuacagcuuaaaaggagaaggucaaggaaauggcaaccaaccuuucucuuuucuugaguuucuuuuuuguggccuccagaaauaauccugggcucugcagagccuguuucaggcucauggucuacccuaccccgcccccauuuccggcaaaaccaggcugagggcugggcugcuagcgaagcugacagcaagagugacagcccuguccugucgcuggugagucagugccaggagguggcugccugcugacucacccacuccuuccgcaggcuccaggggccccuacagcagccugacuccagccagcccugggccaugggggaaggagauggaaaaggggcuuggcucccucugacccuucacccagccccugcacccuggagcagagcugcaggcagugugaccguugugcuguuauuggccuaaacacauagcaacaggaaaacaaccccaaaaccccagccuuaagagcaaguccaacagugcgcgacuccccaggucaggagaagccccgaugugugcagaaucugcagauggggcugcucuc

SEQ ID NO: 14801 - RNA, 2329 nt, Homo sapiens
gagagcagccccaucugcagauucugcacacaucggggcuucuccugaccuggggagucgcgcacuguuggacuugcucuuaaggcugggguuuugggguuguuuuccuguugcuauguguuuaggccaauaacagcacaacggucacacugccugcagcucugcuccagggugcaggggcugggugaagggucagagggagccaagccccuuuuccaucuccuucccccauggcccagggcuggcuggagucaggcugcuguaggggccccuggagccugcggaaggagugggugagucagcaggcagccaccuccuggcacugacucaccagcgacaggacagggcugucacucuugcugucagcuucgcuagcagcccagcccucagccugguuuugccggaaaugggggcgggguaggguagaccaugagccugaaacaggcucugcagagcccaggauuauuucuggaggccacaaaaaagaaacucaagaaaagagaaagguugguugccauuuccuugaccuucuccuuuuaagcuguaagaagccuaaagcccugcuccuuguuggcuaugaaaagcagagggcagccccucccuugcucuauagaaacuggaaggauacaggccccagugacagagucagcuaagggugcacgugcaggagccgggccagccccaacucugucacuguggcucugccggaugccacagugccauggaaaccagucagggcgcucugcuguacagccuugggcaagucaccuucucucuucagccucaguguuacccucucuaaaguaggcacaauaucccaucuacaguaugugaaacuccuaccucauuaaauguuugcaaacaaccucccccuccuuguuccucuuuuaaacauguuuuucccccugacgaggauguacuuucuucuuccuuccuaccuccgccccaccucacucggacucagaaauucagcucgaccagaguguggugcuagaggaaccaaacagccugggauuuagcaagacaggguggggaacuagcacugucggucaccggugcccacuguguucuggagcacaggugccugcucuacuuaacuggaagccgauuccuaggcccccuccaccauccagaaccagcccaagauccccagggguuccugaagcacacgcugugguuucucaagccccaacacccuuggcuugugcugugcccucagcccgguacacucuuccccugccuaaugagcagguaccccucacagccucgaugggacagccuccaggacagcucugucccugcguucccagccuguacuguugcugucuguuacuccccagucacccggguccugcuuccugacaccuaguauuaauacaaggcccagcacgaugaggauuuuucagauggaauguuuagggcuuagggcucuggggacacucugcauagggagaaacagccuuccacgucaggcauucugagagcuccucuacgagggcgacagagcaaacugcaaugacagaugcugggguauguggacaguggggaaggguggaccaggaugugcucccaacaucugagcacaguuucccaucagauggucaaaacucuacagaugaacaccagaucuuuaggaaaucacuuuucauuaaacgauguccauuccugagcaucuuccaauaaugacuuugaaguuaauuuuuccugccccuaaagguuugccaagugccaggggaugcccugggaucccacacaaaaucaaagacucacaguggggcuuuggaggucuuggcacguccacauccaagcccauuuuacagaugaggaaacugaggcccaggccacauagcagaucagugacaagacaaagcuacagucucuagccuccuccacagacggccccaucagagcuggagggaacucauuucacagaggggaaacugaggccugaaagaugugguggaggggcgggacauucccgacaaccccaacuuggugggauacaguggacgccagaggcugaacauaagcucuucuuccaaacuugggaggaugaggcucauaucuaauucugucagguuggcaacuguuggugcagugguggcagcgacuuccagcacuacaagauggugccuaacagcggcuacugcucagccagaagaaaagcucagcgcuaaaauccacacucggguggggcuaggaugcagggaggaccgacgcuucucaacuguggucuuccuacgugcaggggccaucucccagggcaacccccagugguagccaucucccucaacuuuccauugcaauuuagcuuaaacucugggggugc

SEQ ID NO: 14802 - RNA, 5399 nt, Homo sapiens
uauuuuaugauucaagauuggggcauuucugcaguacacacaaaaggcccaaggugagauaaggucucagugcuacaguuaauuuguauauucuuuuuaauauaaucuauugaacuuacuuuaaaaggaacggaaagaggggaaaacaagcaauccaaaauguaucagagagagagcuggaguugaggaugccuugcugauuuucugaaaaucaaguuaacuuuucuaggcagaauggccacagucugcagucauccuggaaagcccugggggaugcaucugcauuucauccugucucaagcuguaaaccugacuuuauguauaucucauugcagagagacagggguggggguucugcuuagucacuaagcggcugagucuacuuagagcuuuucuacuauucagacagcuucacaaauguggaaggacagguaaaugcagcaugaucauacugugcauaaaauguuggaagcuacucugaguuucuuuaugucuuaaauagacaaacaggucuucuugauccagggaugcuugugaacauccagcagccuuugauacgugaggaugguacaguucuccuggccacggauucuaaggugacguucucuacucaugcucucucucauccuuuauguugacauugcaggcugcuucucuaacugugugcaccacuuucuuccuggccuucagagaccacaucaaaagcaugaccuaugucucggucuccuuauuguugugauagcuaucuugugauuuguuuuagagaugcugauggcuucucagaucagagcuggcuggucauaaucacuguaacaugucagucuagaugucaauuugguggacauucagugguucucuuuucuguuauaguuuucuuuuucucuuauacacauuggcaaacuacuagccaaggaaagaaauacuuaucagauggccuuuuugcaaaagccccggguuccuuuuuauuagaugaucuucaggaggaagcucagccaggaaucuaucaguuccaaaacuuugcuagagcagaucagucauagggauuuaacuuguggacagagauguucgucaguccaaaagggggagacuugcuggcuccugugaagauaaccaaggagggggauuuuuuccaggccagggaacucacuguuugucucauccuggugcuccugauguaaaccaaguaaugaggaaguaguagcagcaagccacaacucuaagagggugacuugguaauugagaacacuggcauugcugcaaccauuagaaccagagcaaggccugcaggcuuccuccucaucuguucacagucucauucauggguguacucagggcauuacagggcauccucuuuugggaaagagaagacaaaauuuagagcccuugccugucauggagagcugcccugcaugccuugguccucaggcugggccuugcaccuucugucuuugggcaggggccacaugcaugaugggagcugauggaucacgcaucgugggcuuagcuuaucagcagcacacauucuagaacaguggcucugacugcauggucaaaugcagagaaagcguaagccugaaaguaaggcccagauaaccuuaaaaacagauuaccaagggauucacagcaaccauucuauugggccauccacacacagacugggaaugagaaccaagacuccagaacuggcuagaacuggguucagagucugacagugcucuucguagccacaugcuucuuuccugcacuuguaaauuucuugguacacagugagcauucaauaaauguuaaugguuaggaauuaguuauugucacuuuggaggagaaugaccacaaagcuguaugguauuucaggaaucaagagaaagagcuucagaggcagacuguguccuaccccauuccuuccuguguacaauggaaacaacaauaccccccacagaaguuugauacgaauaauaaaacauaugcaaagcacccacaggaagcuacuuucagaaacuguuuuccaauuuuacuuugaaguaauuauacauuuaaaauaauuuacuaugaaggaaguacagugcuauuacagagcucccacauagccuucgcccagguccucccagugguuaugucauacauaccuacgguacaguaucacaacgaggacauuggcuuugguacaaaccauauguauuguucugucuuuuuuauauuucacucuucuucaacuucauuuccuucaacauaccuuucuguuaaugaggaucuuacaguagcugcacaguauucuaugugucuguugugauuuaaucauuucuguuuaugaccuuuucuacugauucuaguuuuucauuuuguaaucaagacauaaccuuguguguacauaucuugguuugaguauaucucuggcuuucuuuucuuuuucuuuuucuuuuuuuuuuugagacagggucuugcucuguugcccaggcuggaguacagugguaugaucuuggcucauugcaaccugcaccucccaggcucaagcaaucuucuuaccucagccuuccgaguagcugggacuguaggugcacagcaccacgccuggcuaauuuuucguauuuuuuuuguagagacgguguuucaccauguugcccagucuggucuugaacuccuggacucaagcaauucacccaccuuagucccugcagagugcugagauuacaggcgugagccacuaccccuggcuuucuuuuuuaauugaaauauaauucacaugccauaaaacucacccuuuuaguguauaauguagugguuuuugguauauuuacaagguuguacaaaccauccccacuaucuaguuuuagaauauuuucgucaccucagaauaaaccccaaacccuauuauguagucacuccuccuuucccccucuucucaaacccuaccaaccacuaaucugcuuucugacucuaugguuuugucaacucuguacauuucauauaaaggaaaucauacaauauauggucuuuuguggcuggcuucuuucacuuagcaugauguuucuaagggucaucaugauauagcauguaucaguacuucauuccuuuuuauugccaaauaaugcaccucuguuuuuuuuuaaagacaagaguuucgcucuuguuuccuuggcuagagugcaguggugccaccucggcucacugcaacuucugccugcugaguucaagcaauucuccugccucagccucccgaguagcugggauuacaggcaugugccaccauacccagcuaauuuuguguguuuuguuuugagauggagucucgcucugucgcccaggcuggagugcaaucgugcgaucucggcuuacugcagccuccgccucccgaguucaagcgauucuccugccucagccuccugaguagcugggauugcaggugcgugccaccacacccagcuaauuuuuguauuuuuaguagagauaggguuucaccauguuggucaggcuggucuuaaacuccugaccucacgauccgcccgccucggccucccaaagugcugggauuacaggcgugagccaccgcuccuggccaauuuuguguuuuuaguagagaugagguuucaccauguugggcaggcuggucucgaacuccugaccuuaggugaucugccugccucggccucccaaagugcugggauuauaggcgugagccaccacgcccagccuaauaauacaccuuuguauggcuauaccacauuuuauuuauccauuagucaauugauggacauuuguguuguaccacuuuacauucucaccaacuguguaggaagguucucauuucuccacauccuuaccaacacuuguuauuauccaucuuuuugauuguagccaucccaguggaugugaagugguaugucauugugauuuugauuugcauuucucaugauguugagcaucucuucauaugcuuaugggcuguuuauauaucuucuuuggagagaagucuauuaucuuugggguuuuguuguuucauuuuguuauugagacagggucucacucugucugauaggcuggacugcaguggcacaaucauggcucacugcagccuugacuuccugagcucaagagacccucccaccucagcuuccuaaguagcugggaccacaggcacacaccaccacgccuggcuaauuuuuuuacuuuuuguagagacagggccuugccauguugcccaggcuugucucaaacucuugggcucaagggauccuucugcuuugcccucccaaagugcucuuuuuccuuuuuuuuuuugacauggaaucuuacucugucacccaggcaguggcacaaucucagcucacugcaaccucugccuccuggguucaagugauucuccuucuucagccucccaaguaccugggguuacaggcaccugccaccaugccuggcuaauuuuuugcauuuuuaguagagacaggguuucaccauguuugccaggcuggucuugaaccccugaccucaggugauccaccucccuuggccucccaaagugcugggauuacaggcaugagccacugcauccagccucuuuuuccauuuuuaaauuggguugucuuuuuauuauugaguuguuagcguuccuuagacauucuggcuacuaaaccauuaucagacaugauucgcaaauauuuucucucauucugugaguuguccuuuuguuuuaugggcuuuuacuuucuugacaauuucuuuugaagcacaacaguuuuaaugaagucuaguuuaucuguuuuuguucugucauuuugucacauaucuagauuuguguaaauaccaccacaccaagauacagaacuguuaaaucacuaaaaagaucuuccucguguugccccuuuguagucacacuucccucuccucgaagcuguuuuugaaccagcauuauaacuucauuggccugagagucauuugcguaucuguguucauuuuuaaugucaguauuuuuuguuuaauaggcugaaacaagccagggagcucugggcacacuggcaaauguagugaccucccuugccaaccuaagugaaucuuugaacaacggugacacuucagaaauccagccagaggaccagucugcaagugagauaacucgguacgagcccaugaggauggagucuccccuccucgccuggacacccucccucuauugugaggguggaaaacagcauuuugguaccugugcuguauuuaacuaaggaugauaaaauuguuacaaugacccugcucaucugucuucuuugaaauuuuaacugugggaacauagacccaccuauguuauacaguauaaaacaaucaaaacuucuuuucauucccaaccauggaaaaggaaauugaguaaaucaguagacauaggaggaaaacucuaguggacagcgguuauuugu

SEQ ID NO: 14803 - RNA, 3219 nt, Homo sapiens
auuaucuggaugcagguuuuauuaucauuaggaugacugucaucgacaagggauaggggcuuagaggguuauauacaaaccacaauuccuaggcgauguuucaauauucccacacacauuuaucccacagccagacacagcacaacaccacaggguaugccccuacauaugcuucuccaagcaguaacacagcugugggucagggcucugcccacccacaaagggaugcccagaaaggagaagauccuggguccugggggugaaguuuacacauggagaauccugccagguuggggaggggauggaagcuggauuugcacacaacgcuucagucccaccccacccucacuggcugcccucccaggggcucccugucccacuuggggagucuuugcaagacacagaaggaccaucuuagccaaggcuaaggaaggagcaggccugugguggggggggugagaggggcucugggaucugcccccuugccuauggugcuaaguggaggaaagugggguuuaaacugcuaggcugauuuucucacaugccuaaaggaagagggcaaggccaggggcugggaugugugugaauauggggcugggagggaggggcucaggcuuauggucagggaucuaacuagagaauacagaggucaugaaugguggggcacacagggcucaagacauccuuagaccacaaacucgacuucagggaaaacuggguucacuccuccaggggcucucugacccaggcugcccgccgaccagggugcugccgcuuuuccucagcucccuggcuccuacucaggucauccaggagccccagcagaaggcccgcuugaccauaggcucccuggggcccacaggggccucccagggcccucuugcccggaugcuggcguuuuucaggcaucaggucuuccucucucucuuccuccuccuccucuucuucccagcuccuuugagccuugggaucugccagccuucugccugggugcugccgcuucgggacagcauaugcaagccagggggagcgccggccaggaugcugccgcuugugcuggguuacaucgacugaccaugaagccucaucuucucgucggccagggugcugccguuuguggggucccacagcccccccuucuuccucuuccucuucuucaacucccucuuccuccuccuccucucuuuugccuggaugcugacguuuggagagccagucagauugaaagaucugggacgcuggggaaggaaagaggucagugaggggccccugacccauguaauaggcaggcgccugagugcccacuccugcuuuucucccaggcaggguacauuuccugcagcucccacucagaggcauggucuugcaccugccccucaggccucacagauacacacauucacacaauagucaaaggcauugccucuggguuccaaucccagcucuggcgcucccuaguugucugaccauaagcgacucaauugaucucugggagccucaguuuucuucuguguaaaaucguaauaacaguaccuaacuaagagguuguuaggaagaucaaacagugugauaagguguuugaagugcuuggaauagugucuggcacagaagugccuagacaguaguaauucaaacugucacacacaaagaaacucucucccuagcacacagaagcuuccccacccagggccugcucucugugaaauauucccagcauugagacaggggaggaaucugaccccgaggaauggucaacuccagaucccgccuaggcgcagccagggaggguuucugagcuuccgaaaggcagaaggcuagcugaccaagccuccccuccccuuugccggcagguuuccacggcucucccaauagccuagccccacagcccccaacagccccauccacucaccggagugcucacccugguccccuugcagccgcuggauguuuucccggaggaagaggaggcgcuccaccuggcgcaggaagucauccaggcccggaugcuccgcggccgucacugccuccugcugggccgccucuggcugagcacggccgccggggacaccggucagguucagggucaaagccagagcgagcagcaaccaagggccgggcaucgcggcgucuggguuaggggacagagggagccugagcgcaccgaaucacagcacaucccgcuccaucucccccgacgcccgccagaaacaaaccacgcacaguucaaccgcccucccagaagcaggaccacugccccucgugcaggggcgggagcagcggcggguucgccccggcucugcguccacaccugucaccucuaggcguccucgcccccacgggugccuguagugccugcgcccaguucugcuugcgcaaggcaggaggccguaggaaccccaucgccagcgccaccgccacccuucaaugugacgcggaacuggggaagccaacgcugggacugccucgccgggagugcaaccauugagauugcagcgccaggcacagccgcgacgcuaacgguugcguccccgccaagacucccccaaagguccccaucgccacguucuaacuccaagcuccguggccgacguccucauuccaacgcgaagaucccauuucuaucgcuaagauucagguucuaaagcucaaagucuauuugcaaagcuaagauucuauuucuaaugcuaagcuuucaugacuaagccaggaaucugauucuaacgcuaaaauccuaacuucaacgcuaaaauucuauuucuagcguugagauugggauucgaacucccagguucucaggccgacgcccugaauacccagcucuguccggcggcacccaggcagggggugccgcggagcucccaccccgcgcugcggacucuggcgaccugagugcccagcagcgagagccuccgaugugcccgcgccgugccucccgucggguccccggccugcgcucggggaggacccgggggugcgagcacagcgcccgccugugcaccggcccuguucuccaggaagcucucagagaaccgaaggugagggcgggccgagagggcucccuuuccagugcucccggacaccgucugcggaaggagagggguuggggcgguuaccugccaggagugggcuccacaggauggguccgggauccggggacucgggauccgcagucggcaggucaggagucugcagcgcugaggaccccgggcgccugccgag

SEQ ID NO: 14804 - RNA, 30488 nt, Homo sapiens
agaguuuugauuuuaauuguguguuuauuucuguggaugcuuugguauaauaucuuaguaauuccaaauguaagcauaccucaguaauuguguuaauagccauaaagccacuuccauggugcuucaucauuguaacugacggugaaacuaacaacaauaaaaaguauguuggaggugcuaacauguugcuuucaacagaaagcaacuuagauuuauuagggaccaaggguagcaauuaauccuucugccugguugcuuucucucucccaguacucccaugcauuagaugaugucaagaagcaacugcugcugugugaauuagccuucuccaaggucaaaauggagauugccuacuucaacacuuguuacuaaagagcaguauuuaggaaagaaaccccaaaucacuauuaauauagcuuccagcaucccuaaaaugaagcuucugugaaccuaggguuuaaguccccaucuuagaucagccauugguucuggcucaagucauugcggauuuaagaaucaugauggugagaaauauccuccagaaauucaaccuuuucuauccuuuuuaaaaugggccuuuggacucuuuuuuugguaguguuuguuuuugaaauaagguuccuuuuuuuuuuugagacagaguguugcucuguugcccaggcuggagugcaguggugcgaucucggcucacugcaaccuccuccucccggguucaagugauucucaugccucagccucccaaguagccgggauuauaggugcccaccaccacaccuggcuaauuuuuguauuuuuaguagagacgggguuucgccauguuggccaggcugguuucaaacucaugacuucaggugauccgcugccuuggccucacaaaguucugagauuacagacaugagccaccaugcccagccugaaauaagguucuuaaacucacaugccuuucaguugacuccugcagucagucccaggaggacauuaaguagucuaugcauauguccuaugacuugaggaguaaauuggaaagagaccucuauacuaucgaaccacagcagaaaguaggcuaaaaauccagagcguucuagagaaagcuaauucaucuagauaaucacagauuaaaagucugcuaggugauaccauguauccaagaugggucuucgguguuccuuugugcauugcccugucaaccugcuugcugaucaccuuggaaacugugcuucuccuuaggagaaauugcuuguucggguuuuucaugacaaaccuaaaaauguucucugagccuugcuuuaggugcauuggaauaaugcuugucgacccaaguaaugagaauuuaugagcucaugaaggaauugugcuuuuguuucugccuggcuaacuuaugaauuuuugucuaccucauuuucguauuaaaguuugcagcuucuguagguaggaagagaaaauguuugauaccaguauuuuauaaccucacugcuucucucccuagaagaaauaaagauuguaaauaucacuaccauauuuucuaaacacaguuuuaagcagccacaccuagaauuuucugaauauuuugagcaguacagauuucuauguguuauauaauaaagcauauuuauuuuuucauguuauuuaauuuuauauacaauguuuaaaaaaucaguguuuaucagcagacuguaaaggcaaguaggcucuguggauuagaaaugaauguauauguuucuuuugguuuuaaaaagauacauuuuaauuuuguaaauucccuccaaccuguacaaccccucccucaaaucugaguagccaaguaucuagcuuuguguaauuagacagcuucaaguauguauuuuaaagggauacuuuaaaaacauauuucugaguuggaaaugaugcuuagauuuauaaacaaaaauauaugaggcuuaauauuuuguuggguauuuuuucuuuucuaguacuguuguccugaauuauugaaucucaacuaugaaauaugcaugcuccauuuauugaauuuguagauaaugauaaauuauagccagaagacaaaaaaaggugauuggaagaaaugguucugaacacauaagagacagcuagguacaggaaaaagcaaaccuaaugugcacaaauuugauuacacuuuauucuguguguucagauaacuguaaaaggcuuacagcauuugucaauuuuguuauuuguucacugcaauacauuucagaaagcauuucuuaugaaaggaaaauaaaauacuacaacaacuaccuuggaaguuucaagagagccuacccuuuucaaaaaauaccuaaaucauaaaaaugacccggaggccuauugauaccucauccuccuccugagccuccuuuuugcaguauagguuauuaugguauucaugggugaaaggaccaagguaaggagggucccuguaugaguuaggguuuauuuuuaauaaggugagaaauaagauaacuucuccaaaggaaaugaagauaacaauagcuaacguuugcuguguguuuacuguauaacaagccaaauuaagcaaauacacaucacauuaacccucuuguuuuaacccaugagggaggugcuguuaggaacccauuugacuagccgauaaucuacuucagugauaggaccuugucguuaggguacugacuauuaaucuuguuuuggcagaaagaaacaaccuauguucagaaugaacuuuuagguuccuguuuauauuccauaaaggaugugccuaaaacucaaacuucauuuagccucaacauuauuuagcuaauuaugacauuguccauuugauuccagcaaaagaaaauccaaauucauuccuguuauugguaaauucccauaaccagcaauuacaaaagcuucaaacaacuguuguuuagggaauggcaaaauauuccucucuuucauuuuacagauacauuuuuagccagauuaacaggaugauaucaagauuuugacuauaaggaauaucacauuaaaugcauauguauuuuuuauaaauaugauacuuuuacuacaaugaagacauguuuaaacauauugcuggcaucuuuagaaaauaagagccacauuauuuggcuguaucaguauggaguauaaaaaauaagauaguuuuuuguggaacaaaguguuaugacauacgaauuuacaaaguuuaccuuaguucuguguagcacucaucucuaauguguucagaacaaucaaaauacuugccugcaucuauuucacuggagacaaaacuuagcaggcuuuuaauaaucuuuuuucaguauuuacagagauuguaugccuaugaaagacugauccugccuucugaugcuauuuugugguagcuugacagguucuauuuucauggauuuaaaaaguccacagguugggggagcaggguuaggaguguuauuggacucugaggaggaguccagguccucucccucacuccuguuguggaguugcccuucuggaauggaaagaaauagaaacuuuggaauguggagugggagguagagguugaguccaagcauaauuggcuaggagggaauccuggcgauuagugauggcaguugaggaagauuuauuuuaaugccagggguuggggguuggggcagaauaaaaaaacucuggguuguuucuuuaaaaaaaaaaaaucaauuuuuaacaaauacuuucuaagugccuauuguaggccagggacuguuccaggugcuaaggauacagcaguguacaaguuagagcucuuuguucuaagggagcaagagaaauuuuaguauuaaaucaauacuaaacaaauguaauuaaagaacugaugcuuugguuuuccuggcagcuucgccaccaccauaaaaauaaaaauacaacuugcuauuaggguagguaccuucauggauacugcugauguuuauucaguaaguauaaauuagcaauuuuaucuuugcuuuuaaacgugcaacuggccagucauuuuaaaugacagaugcugccuggcugauggcacagaacuuuuaaaaaccuccuauuggagaauaugcuuccaaucaccauuccauuagaacccaaaugugaguucaguggucugagagccaggaugaguggagaaccuaaucuucugccuucucccugcuggguccuuggccuccacacaagguggagaguuguggucugaggguacuuuuucccuuuguuauuuaauggguaccaauuaaaagauguggaaugugcggaucuccacaccaucuucuuugcuuguugcuguuguuuucucuaaagugggaucauugucaugaaugguuuuaacaaccauaaucucucuuuccugaaauuuauaaaauagaaaauuggcagccaaggaaagcauguccagggguaguauggaagaugacucauguaggcugaacccagaaauccaucacucuuagcaagaucugcauccccuuucucuuaugagaaagagcuuaugccuuggccaaaaaaaucuaguagcuuucugcagcgauguaaauguucucuauuuuugccuuccuuuauggaagccacuagucacaugugguuaauacugagcacuugaaacaugguuaagugacaaggaaacugcauuuuuaauguaauuuuuaaauuacucuaaauagcuaccugucgcugguggcuaccauaucggacagggcaaccucaggcaacaggacaucucuaacaauuaauaacaaacuagcaaagaaaucaauaaauuuauaaaaauaaauuggggagaaaaaccguauuccacauguaagggguucccccauaggaugcccaugcaucuggugauuagcauucucuugccuuucuuguguuucgugccuuuguuuuggaaaacuucaguggguguuccuugacagcugggcauuagaaaaugcagaggacagugaaaagauggccuaucagaaccaggggucuugagaguaguaacuccagggcuucauuguaaaagcagcuguuaaaacaaacucuccucugugaaucucagaguucaaguucaucguggccauaaguucaguuaaggagaaagcauguuuauguguucaguggguugaaagggcaaggcuugaaugaugcuuuuuaggagacggcaaaaguggaaaacaccagguagccaccuuguagaagcuugaauuccaggagaucauucccucuuugaaggaaaaguuucaggaaggcagcuuuucauauucauugaacccaguaggugaagguugagcagauuagcuuugcagggcucuguuucaaagacacaucagaagaaaccgaguugaggcaaugucucuccuccaugacuguaaauguagucauuuaauuuugcaaaacuuaaugucuacagugucaaaaagaaaaaaaccucuuauucauuuacauuuuuacucuauacugagggccccaagaaauuuaaacuuaugcaacaacauugacugcaaauugacugauaauugccaucaguucucuuccucaguggccagauagaguguuuuccccccguuuagggcaacauccugaauuaaauuauaaucugacagauggucuguuuuuagaagcacugauuaaucuacuaugcucacucucagguugacuaugcacuaaaaugagaaauaguucaaaugauucucccuaagccauuuucuucugaaauaucucagacagugaaugaauugauagcuucaguuauccacaaaggagcagauuuuuuuccccacuuaauuugucacacaauguguuuccucccauaauuauagggaggacuuugauuuuuuuuuuauuauaacaaccacuuacauuuuggaacauuuacuuugugcucagaauuaugcuaaacaauucacccacguuugucuaacuuaauccucucuacaugaugaagucagcaccaucagagaaguugcuuaguugaucucacugcucaguaguggucucuaggucucacugcugggaaguggcugaaccaggauuugaauuuaggauuuucugaauuuuaagcuagugguuuaagccaagauauaauccccucaucucauuguuuaguugaugaaaugguaaaauguaacaugaguggaaaggguaugucuacaauguaggauuuuauguuaucccagaguguaacuauuaauauuugaaauguucugaagcuaauugagccauuuacaaguuuugcuuaggggauaagcaaagaaaaucaggaaugaauauaagaaaauugucucaaaccaaguaaaagagcaagauuugggguuuucagaagauuuuaagaaaaaagcaaccaguauuaagcacauauugggugcuaucucuggcauuuuuaguagaaauggaauaacuugagguauuuucuuuauuuaguagauauauagauagucaggaugauagauuuuauuagagccagucaggugacuuuacaucuguucauggugaugagguuccuugcagaagguaagaugcuguagcacuuacaagugaauuaugaaaaaugguaaaauuuacuaaaaugugaucucaccguaacucucugguugaaauaaagcauauucaaugcauuggaacgucuuccaaacuauuuauugagcuaaaauuaagcuauaggagcugaacucuucuuuuagcaaagcugucuuauucauucccauugguaagacagucaaccaccuugaacccuguucuugcauccucuuccucucaucaccccucauucucacaacuaccucuguauuccuuaguccauguggcaggugaauaauaaaacaguuacgcuugggaacuugguaagaugaacagagggaaauacaacagggaaaaagcagacuguguuugcuuccuuuuucuuagcuaggacagaggaagaaauauagacagagccaacacauuuuaagugaaaaaccuguuuccccaaucauuuauuuaauugccccauaccugaauuuccuucugccuaaugaaacccacaguucaaacugggugccucucucaaacuaggcauacuauaaacaauguugaaaugaaugaaugagcucagcuacucaggugcugaacuccuuauuacauuagcccagaaauauggaaguaaagagcuaacugguagaagggaaucauuaaaaagaaaggcauaggauuauuuagugcuguuguauuaauaaugaugauauccugacuuagagaguuguacgguauuuacauaaaagaguguccuugauuugaggaaaaaagaguuuuagagaugaugggauguuaugucucuaaauuacucucaaauuuuucagggaaagacaaaauaauaauagcauauagagagagagauggggggagcaaauguggugaaauguuggcaauuggggacucaggaugaggggauaagggagaucuuuaugauguucuugcaaucuuucuauaaguuggaaaauuuucaaaauaaguuacuuuauaaaauuucuuaaagaaacaaauguauucagaguguguuuuuuccuucacaaggaaguaaagaguagaucuggauuuauuucacaacuuuaaaaauucugacacauucuaggaagcuguuuuuaaucugagauuugcacuguaaugugauaaaaaagggagugggguguggcagagcucagcagaaacagaaucuuuccuacuuuuuuauuggccuuuucccaugauuuucucuuuccuaagccuucucuccuccucccuccuccccaucccacccaugcagcuaaacugaaaggccucugagaauggugcauuuuuuuugcuucccuuuucccaggggaaucuagacuuuuauugcaucucuuccuaguaaauuccaguaaauaucuggccauaugcagacucugccuuuucuuaaucgacugcuauccaguccacauccagauuccuuugaaaaugaaagcauuuucccaaaaaugugugcuguuuguuuuccuugagauuaauaaaagccccaccuagcccacuuaccuauuccugccuugguauguguccuuucuuggugaaaucauuauuuccuucuuuuugguugucuuugaaucagacguaacauauccgagccccccgcagggugcagggucauggacauaaugucagggaggaaguucuguucagaagaacguguuuguucauuguaauugggaucuucauuguugugcaugggaauugauuucacguuguacacggcacguuuucuauagaugggggcuuccuaacccuuuuagcuggagccccugacuucauugagcggauguucagcaggcccuuuacaacucccaucaacaaagaaucucugugugcccugaccucaccaagucaauuugaaucaauucaguuuugagaacuugcugaaggacuuucugagaaccuuaguauaauucaauaguucucaauugggaggugauuuuagccugcgguggacauuuggcaaugucuggagacaguuuugguuguuacaauggggaugcaggugcuaugggcaucuaguggguagaggccaggaaugcugcuuaauagucuacaaugcacagcacaaccccaacaacaaagaauuggcuuaccccaaaucuggaaauagugccaccauugagacauuuggagccucauucaaaagcgaaagcugaaagucacaguugcaagucccgcagcuaucugaaagcucuucucucuggagaguugaauuucccauaaaauguaggugagauuccagggagccaucaaggucagucaaaucgaagaaagguuuucaaggaugagcugaaaauaugagaucucaaacuugucucaccagacugugaaucugcaaaucaacaagcaccaucacucauuuuguggggcgggguugaggguuaaaagagguggcagauauuguaaaugugugcagaugugcccaacugaccaacagacauucugcauggcaacuuugacaagaguaauaaacuaaaaacagcauaaaugugggugggcauuucuaagaaaacaaggguuauauccucaucauguucauaauguuagcauugucugauagcacugauaguucauauauagagauuccuuuuuaaguuuauguuucaaacagagcuucccauaucagugauagaauaugaauauaugaauaggucagcaguaucuagggauuggucagacuugagcaucagaguugaguauauagguuucucuuuugagaacucuucuggaaguaggauuaauucuagugagcauuuuaccugauaauuucugauuagggacuaagacagcaguacauaaaguguuccauggauugugaauagguaugaagaaggguuucccaaccuuggcacuauucauauuuggggccagauaauuuuuuguuguagggacuguuugggacauuguagaugcuuaucagcauccuugaccucuaccuacuggaugccaauagcauacccccucgguugugacagugaaaaauaucuucagacguugccaaauguucccugggaggcaauaucacccuuccuuuucugccagguaguucuaugaauuucucacagcagaauuucucuuuccauauuccuaugggcauuagagagguagaacaucagcauuuaccagacauauuugauacuaagucccuauuuguuaagucagagaagucugagguuauaaaaucauucccuuccuccucaaagggaagugaaauccuuauauuguagagaucaccaaguuuucauagucagacauuuccacuuugucuggguuuuuaaaaaaccuaucagagaaaacuauacauaggggaucaccuuuuccaaauauguggcauuaacuuggcuuuccuauacaugaacuucuggggaagcaaguuucugcaguucuaccuccucgcaccuccucuuuuccacucugcaaaucuuugcuccucuagcagauggcaaaugcuauauauuucccaaccccaacccccaugccacacaaacacacucaaaacggcagguacaacucugagaucagagggucagaaaacauuuuagaugauaugucuuggucccagaaggaaaaucaaucucaauucuuuuccuuuaaaaaggucauuaacaauggccauaaacacuaguagugacuccaaagcuuugagacuggagaagaaaucuauugguagaggaaaggcaaagaaaauaaacccaagagacugucaucaaccucagaaauuuuauggugggaccuacacucuaaugaaacauuggauuuucccugcaauguucaaacuuuauuugauggaagaccacagaaauauguauuaaagaacagacuuaugcacuggugcccaauguggaagagaucuugguuuuccauaagggaaguggaugcugucuuucagaauuaauuggaaccuuaaauuaccaauuggcuaugugaaaagcccuuuaaaauuagaaauugaauuuugacuuuugccuaacuguaaucuuaccgguaauucuaggcuauaaauugagcacaugcaaauguuuugccuaggaaagaaucccuaaaaaaugagaaaucuuggccaggcauggugacucacuuugggaagcccaaggcaggugguuugcuugagcccaggaguucgagaccagccuuggcaacguggugaaaucccaucucuaccaaaaauacaaaaauuagccagucucacaaccuggucucuaaauaaauaaauaaauagauuaaaauuuuaaaugaaauuaaaaauuuuuuuaaaaagaaaaauugccccuaaacaaagacacaccaccaccaccaaaaagcucacugcucugaaugaaugaccuucuccacuucaguaguuaccaacugauggacaauuaauugucuuacauuuccugauguggcacauauaggugcccauuugcaauuggccaaauggauuugacuagaaguggaaaauaauaacaaaggcccucauuuauuaaacaucugaugugagcccuggccuugaccagguccuuugugugcauuauugccaauccucuuauaauccuugcaaaauaggucuuaugaugucuaucgugcggacaggaaaacugagauuuagggaaguuaagaaagguucccaauaauuauacagucaguaauuauuggauccagaccugauggacuccaaagccccauguuuuuccacugccucucuuggggagcuuucaaaacuucuagaaacaugaauuuugguuugugaugcauaaaagaaacaagccugaauagaaaccaguucagcccucuuuugcuuuauaaaagucccugggacuggguccuuggaaucugaauguuucccaaggguuuuuagccagauuccugauuuuguuuauuuuacuuaucacaagucagagauagcugaauauuugcauuucugaauaggaucuuuuuuuacauuucacuuaguuuugaauggcuuucaaagaaacucaaauuuggacugggucacccagcaaccucaggccagagcuuugaaauggaucaguuucccccuggacuuuuacagcauccuaaaaugaugagaauuaguacauuuguaaggaaagguccuacugagcuaagaaaauuuggucuuucuggacacggccugauccucauauuuggguaaaaaguacucuccauaagaguuagacuucguggggacuggcuguagagaguuugcaggaggguggcuaugauuucauucuaucaaauucacuuuacaaaaucuugggcucgguauugguuuuagaguccuggauauccuauacuuagaaagcaaggcuuuuucuaaaugaaagaaaacuuauuaaaaaaauugaucaggaucacugagacacauuguuuuggaacagaagagugaaucuucaguuuuaugcuuuuagauguuuccagccaaaagaaagaaaauaccuggccuggauaaaacccauucuugaguauugcauuucauuguauucuguuuuucauauauauauacacacacauacauuuuugcacccaucugacaaaaaugucacucuaagaugacaucuucagggagaggaaacaacauuauaugacacgcaggguauguggugggaucaguggcuaagaaugcacugucaauguuucuugcauuuacagggcaguguaguauucugaguuccuagcuucugccucuugucggcuucuuuuauaugauauucucagauaauguucccuuuagaugucgccugugcauuuaguucuguagauaugaguuaaauauuaaaccacaagaauauguggcuaguuuuggacugaauggauauaagagacaggagacagcaauuguuauuuauuugguucuaacaauaaacugagcauugugcagaauguuuacuuaaucuuuauucuugugagauaagugguucuagguucuauuggauauuauuuauucacuuguuucaugcauucauuuggacauuccauaaauguuugaguguuuuuuauaaaccagguaccauucuaggcauuuuggauauaggagugaaaaaaaacacacaaaaaccuuugaacucauuacgcuuaccuucuaguggagaguggagacaagcuacgaaucacaaacaaaacaaaaaagucaaauauauauuaugaaagaagacggcaguugccauagauaaaaauaaauuagggaagaaggauaggagauagcguagaagaguaggugagaauuagauuaaauuaaauuagagcuuaauuaaauuaauuaaaaggagguuuagggaagucuccauuaagaaagugacauuugagcaaacauaggggaaaauacaaaaggaagccauguaaguaucugggagaagaguauuacagguuaaggccugaaagcgggaguacaccaggcaucucuuagugauaccaaagagacuaauguggcuagaacagaggaugugaaugauaggauaggaaauuacagaugaaacugagggagacgaacauggaggcagacuguugggcaaguagaggaaggaggguuagccuauuggacggaguuuuuguuuucacuuugagauaggaagggacuggcagugaaaacguggguggaggcacuaagcaggaacaugaauuuguuuuuaaagguugacucuggcuucuggauuuagcagaggguacaggaggaacacacauggaagugguaagaccauuguaguaacucagaugagagaaagcauugcucagaugacaguggucacaagggaagugguaaggagugguaggauuuggaagaauuuuugagauagugccaaaggauuagcugagaguugacuauggggugcaagagucagaaaggggucacaaugacucccguuuuauggacuggacaagugaaaggauggaguugccaccgauuaaaauggggaagccuacaggaagaacagauuuguggaggaagagcaggacuucuguuuugaacauguuaaguuugagauguguaggcgucaucacuucauaucucuguuaaacagaauugaauauagauguuugcagugguuaagcauccugccaaaaauaacaaagaaagauauuuccagucagaccaggucugacuguccuaacaccguauucauagccacuacacccuucugccucaaucuuuugauuuccaucugaauacaucucagaguaguguaggaaucauuugaauuugcagaaaaccaucaaauguaauuuuagccuuuuucaaugccaagucuucuguguugugagccauuuacauuuuaucugguuauuacugcucaucccguccuuucauagugguacuuuugagccuuuuuuuuuuuuuaaccaaaggaaggcaggaagaggagacaagaaaagccacaaaggacuugaauaaugcauauugagagugacugugugcuguccaaccucccgauagagcaaugcuaaauuggaggaugagcaucuaauuugauaaugguuaaaaugaccuuuaucccugcugcugagauacauuucucuggauacaggcucagacacguaugcaaaucuuaguucuggaguuggcauuaauauccacccacaaguaaauuaauuacauaagcugcuucccgaaaauguuauaaaauuuucaggauagucuaccugacaugcuggccuguaaagaugcuccuuucacaaugagcuuacagaagaagggccagacaggcagagaaaguaagacuggaggaagcaacugaauuaacuguguccuggugucuuuuaaaugacuuguugacacauagauaguucuuugggaagagaacaagauccaaggggcagauauugguuagguacauggaucacuucucuacagaagcauuucagaagguggcugaagcuuuccagcucuguccccugacugcuuuugacaguagcauaagucaugucaagugggucugccccagcacugucaucuccuagcagacugacaucuccagguagccuugaacucuccaguccaggccuucaaucacaguccaccuugagaguaccaagaaacuuuggucacuguuccuaccagucauagcuuucccaccaauuacuuacucagacacaacuucacucaccucuggaacaaauuucucacccaccgcccucccugucuuccagacggcuuucauaaauaaucccauggcaggcauagaguggguccuuguauuaucuucgccucuuucuugaaaaaugugaacaucauuauucugcugaugucagguuacaaauaaucacccgguaaaccuugaaagggaaaagaaguccuacaaaaacaggcaauguguuugggaauaaggaaucaacaggcuaauagagcccuguuacccacaugagggguaacacugccuggugauuauugucaucaguuccccaggguacuccuggauauagccacgauagaauucaccaggugcuacauuugcagauuuccuugguuuuuguuucuuucuugaugggaaagacaacgguaaaauauuuccacucuuggagaacaaaaagagcccuaauuuggguuucauagcuugcauaacugauuucauauacugcuauauuuaauguuaaaauuuauuuuccccucuaauaugaaguuguuacauugugagaucgaagguuggggaacuggagcgcccugucccccauauuccugggggcguuggggugggaguggaagaugugagccccucguugucucccuuuauuugccuggcccugccaucucccuuacuaagcauaugcagggccaccuacuugguucucauauugacagcagccuucgacugugcuccaagaguugacaugugaaucuugguuccuuuucuuagaccuuuguagcguugcaaaggcuggaguguuggggggcaguggggaugggaggauggccuaaugccccauccggcugggaugaccgugacucccacauccgcuuucuuccuugguguucccugccaaucucaggcgcucucagcuccuuuucaugguaauaagugccaggguggucccagacauaaacagccaucaggcaggccuugucaacacuggcuuuacgcccugaagucacagcccuuguuuccugguaaagcuuucucuccauuuuuccucaauauuuugguugucgcugccacuguucagagccauucuuguuuugugagaagccuguaaaaccuccccugagugaguucauugccaauaaggagauguguuuuuugacaaaggacugugacaacucucacagcagagcagggcguggcagggaagugagugacuguggauucuguaaugguuaucauugacgcugcuucuguggcucaggacauuuaaagaaauggcauaacaaaagacaagggagaaacgcaggaguucuugagaaaaccuaaguguaagcagggaaugauggaguagaaaagggauguggcauucagauacagcaucuuuccucuccuuacucuggugagaagagacaauacugguaaguaauagucucuaagagagaaaagggcacuacagaaggaaucuucaacguauauaacugcucuguggauugauuucucugggaacuuuggaaagaaaagcacuuugcccauucacagggaugagaucuugccaaagucccaccuuuaccuaucaaugccucuguuagaauguuagacuccauuaguuaacaaaauuuuuuuaaacucaccuuuuaaacuucguguuaagagauauucuaaaaggguccacugaauagaaauaauaguaguaaugaugcaaaaaaaauguaccauuuguaugcugucuggcugaaacacaaagagcuuugcaugcauugucucauuuaauuguaacacagugauauuggguacaguuacuacuauucucccaucuuacagagaacaaaucugagcugagagaugaagucacuugccccuaguggcaccuugguaaaaugacagguaggguaggauuccagcccaggccugucugacucucaaaccuuugcaacauuuuaaagcaaaaugaagacaagcacccuccccaccaccccagcugccauuuccuguguuggcagcacccaagcaccccuuggaauuugcucuuugcuggugcuuuggaacaagagguuguuacacucuugcuuaggggugagaaagaaucagagugugugguuagcugugguuuuugaacaacaccauaaccuagccccaggcccccauugcgacgggagccaaauagcauucugugcuagggacagaagauucuucagccugcauuuucuccuucccugcugugugaccuugggcacaacaucucuccuuuucucuagucuugaauuuguaaaauaaauagauggacagaauaaucuuugagaugcccugcagauugagcauucaagagauuuuuccuuggugaauugccagggggccaaaauuuacaaccugcagccuucccuucuugaccguguaaagagcauucacccaucaauggaaauaguaaucuacuauguggcaucuggcaggccucaacgaguuaauaaacccugaaaaauguccaagagaaaaguaggguagcuucagucaaggggaaauguggcccuuuauuuaugggauuguauguuugcuuuuuauagugucuuucuucacaggcacuaaagguguugugagaaaaggcauuaaagucagagcuauuaacauugcguagcuacucucuucgugggagacugaggaaucaggcaacucuaaaagucuuaagagacauuuccugagguccuugcuuucuguuguugccauggguaaguagaggugagcaacugguugucuuaaccaggccauuuuuccaguguagcuuaaggauuaaagugguugggguguguguguggggaggggggcggugugugugugucuugcccugucaaccaggcuggagugcaguagcacagucauagcucacuaaccccaaaccccuaggcucaaucaaugcuccuaacucaguugcccaagcaguuggaacaacagcugugcaucaccaugcccagcuaauuuuucuuuuuuuuuuuuuuuuuuguagagauggggucuugucauguugcccaggccagucucaaacuccuggguucaagugauccucccaccucugccucccaaaauucuggcauuaaagucaugagccagagugaccagccaugcuguauguaaagccuaacucuccugcuuccuggugcuaugacccugggcaagugacgucaccucuuugacccucagucuccuuaucgauacaaaaaaaauccuaauagcuccugagccaccagacugcuguuggaauuaaaugagagaaaccaguguucuuuaucccaauauccugcucauaauaagaacacaaugaaagguagcuaguaugauuuucaggaguucugcucaaacugaaagagagugcucuugggguggccuuuuugaaucuaaauaacuugugccaaaugaguucaguauuagcaccaugagucggauuccaggugguucuuucauuccggccuuuacaaaaacauggcauugguuuauaguacaccucugugauggcuauaguuuucauauguucauucauuuccauaaauauuugcugacugacuacaguguggaaagcagcaaguaaacauguaugaguugcagcuacuaucuuuuuuccaugugguaagccccacaugguuuuccaggccuuccacugagcaauguuugaaacuuugaucacuaaaucuauauccuuguguuuauggucuuucuucaguggaauaguagguacaggcuggcaucuccuuugccucccccaacagugugacgcucaugcaguauucacuucauuugucacugucauuggcaaaggcaguccugaaccuugggcauaugcguugcauccuuucugaugacauacuuuccagaugagcugugauuuuauguuuuguuaaaguuaaaaggagaguggaaucaagaagaguuuguuguuguaugaaaagauacaacugaauauuuuuuaaaugaagugauuuagauguuauuuucauagucuguagacucacaagggaaaggccuugaauaguaauuccuucagucuccugucucaaaacaccuaucugaguaaugguuagccaucuguugucaaaaauccuuagaucagaagagccuugacaacuugguaauagguucucguauaugacauuuaucuuggccuuucagugcuuguuauuucucaccugcuaucagccaguccugugguuggaaauauggacuaguuggucagcacccccauuucauauuucauguauacagaaucucaucaauccagaccacuugggaaugggaaucaccuagauacauagaacugugcccagacacugugcuagggcugucccccuggcccaugcauuaguccuugcauagcaggcaucugcuauaacucaggcaguccugguccucauucaguccccuucuagugcuuuuucuaagccccugccuuuucuuuuuuucuuuuuccauuuuuuuuuuuuuuuuuuuuaagauggagucucacucacuccgucgccaggcuggagugcaguggaggaucuugacucacugcaaccuccaccucccagguucaagcgauucuccuuccucagccuccugaguagcuggaacuacaggugcaugccaccaugcccagcuaauuuuuguauuuuuaguagagaugggguuucaccauguuggcuagaaugguccugaucucuugaccuugugauccgccugccucggccucccaaaguccugggauuacaggcgugagccaccgcacccggccgccccugcuuuuucuaagccccugcaucuuccagccccacccagaagccucuuucuggccagauccuguguacaucucugaccucuaccuuccccuucuuauuccuucuugguucuuuaugguaucuuuagcaacucuguguagaaauccaucuuguuuuggauguccagguccuuggcagccucagcaaccccagggaucccauucucuuuaguucuccagcccuucucauucaggcagacacaccagggcuguuuucuggcuucucaauaacuaagaaaccacguuccucuguauaagugaaaggaccaauguggggcaucccuaaaaccagagacagcacaccaaacccauauucgucugcaccauauccagugcuacuucuugagagagagcccucgauagagguuaagaacagacggcccaugucuugaguuuccuuuccaccagaugaauugaaaugcaaggauuucaagcucuuagaccuuaauuagugaaaaguguuaacacaaucucugaacaaaacaccacauuucaacauccccuucaagccacccaacagaaacaaaagccugaauacccaggcacuugggaugcugaccuuggugcugcuaaguaacaaacagagauuacauugucugggagucuugcucaaaguugggaggaagaucauucuguuacacaaaguuggguuguuucccaagaaaaaaaagucagaguccuauuggcaaaguaggaggcuuuuuggcugugaauuugaggaauuaaauauucccuagagcaagaacuaucagauguguaaccaauaaauagcacguacuaggugacacacuaaauuugacgauuaugucucagugacacauggugauguaaaagucagugccugagaaaggacuggaaaugaucugauggaaauuucccucagaauguaagagcugaaacuuguguuuauuugauuaucaaaaugauagccccucuaucaggucauaguaggcccauuaauaaaccuguuagauuugaacauuuccacgagcagcugcuuuucuucauugguaaguuagaaagcauuaaaagaagaguauuugcuaucagauuagauaccuugagaauuuccuaauugccuuuagaucuuaacaauauuaggcagauaauaaguauggcaagugcugcauuguuuuuuccaagucaauuccagucaaguccccaaauuuaaaaacaaaaacaaaacccuggaauggguagguuacagcuaguccagauagugaaaagauaaggcauuguauuuagaagcuacuucauucaucuucauuccauuagcaauagaugucaguuauaccucagaugaauuuuuaucagugagguuggugauaauuuaacuauuuuucacugugcuguuauuguuuccaacagaaauguauucauuuguguugaagucaugugggaagcacuauauaaagcauugugguuaugccauucugaaaacaccaauugucuccacuaauaguaccuaucucuauuacugaguuucacuggguuauugggaugauuaaauuagaugaugcauauaaagucuuagggcagugccuggcucauaaaugugagagaguuguaccuuuuccaauucuuccucuacagguuguugccaacuuuuaggcuguaacuucugaugaccacaguagauuacuaaauuaauauuucuaacaacucucuuuucccuuauauauuaagagacagcuuguuuggacuauuuguauauugaagugacugucccuacauauagacuuguguuaaggucacccauguucauuugauuacucugacacaacuauguuucuucacccuagucaagcaaauuuuaccacccaugauucuauauccuuuaaguucaacucauuuccuagaaauaaauauaucuuugacucccaaugcuguaucucccaguuuuccccaucucuguaaguguuaucacuaucuacccaauugcccaaaccagaaaccugaaaguuaucccugauacugcccuuuccucuccacccuagaguagauccaucauuucuacuucaaaaaaauacaucuuuuuuuuuuuuuuuuuuuuuuuuuuugagacggagucuugcucuuucgcccaggcuggaguacaguggcgcugucuuggcucacugcaagcucugccucccggguucacaccauucuccugccucagccucccaacuuccccuaccuaagcauuccugagugacuuucucauuuccacucacacuguuuucccacuugggcucuacucaggcaaaguaaauguuuugaaacaaaaaucagaccaugucuuacucugacuugaaacucuucagugauuuuucaucuugugcagaauaaaauccaaacucauaauuguagcucauagcuuugcugccugaccccaggaaguaccucagugagcccucuuccaaccauuccagccuguuuguuuccuaguacuuaccucaaugaauaaucauauauuuauuuuugucaucacuuaauuaaugucagcuucccucacuggucuguaagcuccaugaagacagagacuugucaauuuuguuuaucgcuacauuucuaguacuuugcauaauuucuggaacauuguaggugcucuauaaauguuugucgaauaaauaaaugaauucauuccaaaucuaauugaacccuuauauuauuuucuuuucagagaaauguuuuaaaauauuaaaauuggucacuauuaauagggauuaucugugugcaagucaucagcauacuucuagagauuuguggagauacuucuaggaacuucauucuaaaagccuucuagaauuauaucgcaaagucuuuauauagaucaaacacuacagguugaaugaugaauauuuuuguuuugguauagauauuucaaguuggauggcuuccuuccauccuguauacuccauuaagauuuucagaaugacuacuccaaaucauaauauucauaagauuagagcucaaaugaaaacagcaauauuuucaccuccuaaaguuaaaaaaauuaaagccaaauguauuaauauacguacuucacauuucucuaugagcaacuauugaacuuuuuauagugguuuguguuuacuagaaaaacaugucugguacauuuaugaauggauaacugagcaugcuugguaauagugguugaguuaauauguuucaugaguuacauguuucacauggugcuauuuauuaggcauaaaagggcauguugguaauuuaacaaaaucacaaaguuagugggggaaauaaauauugaauagaaggaaaugacacuugaaaucuguuuucauugcguuuucacauuuuguucuucauucuuaaauucauuucccucuaaaaagcaagaccauuauauugggaaauaaugugucuugaaaacccgagccagcagcuuaugaucugagugguaaugacuucuguaaucacuaaugaggcaauggacauugcauaucucagcacacucacuggggccagccucuugccuguuuuacaagaagcugucauaucaaauuuuugucccgacuccaugggcacuuugauuccuaaaccuuucugagaaaccuaaucugaaaucaaagucaaguuucucagauguggucagacaaggucacauuuaaaacaguccagugaaucugcagaucaaaguugaaagguaaugccucccucccaaaauuggcacagacuuaccugcuagcuuaccuuucaguuucuaacgugccuuuuucaccucuucccaguggacugggaaaacgagagcuuauccucuggaaaaugguucaagaguuuuauucuuaaaucauuuaauuaagaaauugaacauaguuguauuuuggaaaugcaccuuuaucccagucagugaaucacaggcauuuuguugaagaaauauaucacuauuucauaguaggacuucuuaaaaucagaauuucaugguaauuucagguucaugagcuuuauuuuuggcuccaauucucaggauuuacccacacucuugagugagccaaaaaugccacacaggauugcugcuguaaugcuguggacauuuuuuuuuucaaugccaccuuccuucccuauuaagccuugagauauuauccaaacuggcgcuguaaaagaggggaaugguaacucuuguuaggcauugucuuaacaucucaagacgcagguuuuuucucaaacuccguguaauuaaaaaacaacaacaaccuugccauugcuuuauauugcaguguucugucucuuguggucgagggcauaaacaacgaaauguuuacugcauggcaaaagauggaagccauuuagaaagugauuacuguaagcaccuggcuaagccacaugggcacagaaagugccgaggaggaagaugccccaaauggaaagcuggcgcuuggagucaggugagcaaugcuucuccucuacugacugcuuccuuacguuuggccacguggcugaccccaguguguucacuuguguuucuaugcacgguuuugguuuuaccgaggggagcucggggacugggaggggagaaucauuaccuagauagucaggauacuuacuagcugugugacauugggcuccagccucuggagcuuuggauaauaccuauaauuagggguggcugugagggugaauucuaaguggaaauagggaucagauggagcacaggucagccccucaauacuucacugauggcauugcauuaucaccacauagaaaacuacuaacucagacugcacugaagcugacuguggucaccuggcagaaauugagucucaguuuaucuuggagguucuugaagaaagggcuguugacgaaaguucuagaaaauaccucugcccauuugcuugcuuacaaaaggugaaggacagaagagagaguucucuguuauuuucuagcuauaugaccuuggguaauuuaauuuuccugagccuacuacacauggcucuuaugacgauuuaaugcaaucaugaaugcccagcgcuuugcaggggucuucaaucuaguaggcucucaagaguuauauuuuguuuggacaagugugauguguguaugggauggagaagggugugaguacccaagacacugauuacaguuagacuccacuaauucuaaacauuucauaagcuagucaggaacugggugugaguuucccuauugaacuugaaacaggaaccuuagaagcuucuguuuaaucucuaaacacuggauaugugaacuaaagccguucauaucaaauccuuagaguagaucugguaacuccacacuugcacauuuucuuaguuugguugaaggugcuaacuuaaaaguaauaaggcucaauuucuuuuaaaacauucuguauuuaaugcugcuccuucucuccacugaucugaaucaaugaaguuuuacuguauuuccggugcuuccaugcaguggagaaucauucagaugacuccagauaaucgaugggaaucuagguucaagguuggcgggcucuagcauggauucuuccagagccuagaaucuugauucuuaaggccccaaagcagcuuuggucauagcguacauuaauguggggaggauucgagaauccuccauuucaauaugacuaauggaaaauuccuucagaaaccugaauguauuuucaaugcccugaucuggcaucacugcccuccauauccuccagucaucauuccucagggcaguggccucaugccucucaaggccuuuaucauaaugaaacauggggguuuuguuuguuuuaauuuaacaauaaaaaaaaaaucuauacccagccagagcugguuccuccuuugccuuccuucggggagcauauucaaggcaauauuucauaccagucauccuucuuaauguuuuucuaagugauccuugucaucuguuaacuuccaucccuuuuuuuuuuuggagcuauucgauucauguaaaagcuugcagcuagcauuauuuaagauaccacgcuaauuagcuugucucuuguggacuuucaugaucuguuacuuuuuuuuuuaauguuccuuggccucuacuuaucuguuuuauuuaccucugaauauuaauuaaguucagagcauauaaaugaugcucauguuaaaagccaauauucacaaaggauaauuaaaagaaucuuuugcucuuuauugguaaacacagagugaguuuuaauccagcaucaugugaucuugaugggaagccuaaaauugcuuacaaagcugaaaugauuagguuuaaacccuggggguuuuugccaacauaagguaauaggauuaucagaaugccuccccagaauaaacugcaccuguucaaaaugauugcucggaaaagucaagucaccuuuguagaaaaugcaaguaaacacaguuauauaauggucuguggccagccuuauaauguccugauuugauuuguagaaauaaauaagaaaagcaggcaagacaaaguacugcauggguaaaauucaauuugggcaauuuagaaguguaccugaaaauaaucagacccagugguuaauggagaaagacggucugcaugauuaaagauuauuggcuuccuaaugauccagugguaaacaagaauaucccuaagacugugauaguaagcaagaguaaugauuguccacuugcagcaauauuuagaagauuuuauaucuggucuuucuguuuucugcugguaguuacagccuagucauccugucuucaagguaggaaaaauaauugguuuaauuucucaucacaucgaaaggucugaugauaauaugauauauaggauauucggauagaaacuacaauagccaugcuaaucuuuacaguuucucugcuaguauugauguuuugagauuuaaaguggaauauuucacuucugugucuucugaaaucuugaauuuguaaagaaaaucagcuuuucuugaaggagggguggaauuauucuuacugaagccuuaaaggguuuuucucucuccaaaaagauuacauuucauuuguuuagauauuuuuaaucaagagcuaaggaaugccuaugaacuuuuacgacaaaaauuagcaucaaguucuugauucagacugacaaaugugaagacucaauauucccaugauacaaaaagcguuucacaguaaaacuuuuuuaacuuauccuaucgcuauagaguuuuuaaaauaaagaucaaaaauaaaaagaauaaauuaucagauuagaaugaagguaacacaccaaugcauuaaucaaucaugaauucaugcaaucaagucauucaucaguucugagaugcagaucuucuucacaguucaacaccuuuguggucaggaugggcuucacaaacuaugcaaugucaugauuuccuuaacagcccuuguugucuuucuuagugcuacaaaauauaaugguguguuuugcaaucaguguugucuuacauucaaugaaauaagcaucaauuuuuaaaagaucuccagugcuaaugcugaaauggaaucuaccauccauucuugauuaagacuuuucuuauaauuauaauuagagcagcuguauugugaugucauucugaaguguccuucaaguguuuaauggagaaauguggcaaauguguggcuuguguucuuugagaaauuaaggaagccauaugcacauggucagugaggagaacuagaguugcuuuaguauuuugugcuuuccauuuauuuuguuuguauuugaagcaugagcauugguauugaauuguuugaagacaggccucucacccacacccucacugaccugcuacaaaagacugcaucauauuagcaccaauuuaaaaacugggaucgcaaacgcacauucgcaguagcuaugcuaccuugucuaagacaaauuuuacuuuguguuuuugguuuuguuuuugcuugaguucgggugauuaucucuguuuuuuuguuuuauuuauuuaugaaguaucugccuaaaagguuuauugggaaguaucagagguauuuuauguaaaaugcuuagccuagagcuaagcuuucaaaugggggugauuuuguaccccaugggacauuugggaaugucuagagacaguuuugucacaaguugggggggaauaagggggaacuagcaucugguaguuacaaaccagguaugcugcuaaacuuucuacaaugcacacgacaacgccccccccacacacaaaaaagaauuauuuaauugagaaaccucaguauacuagcauauacuguaugcuaguauagaaacccuagcauauaguaaguguuuaguaaaaguuuguguuauuauugcuauuauuguuacuuauaaaaguugguuuauauaguuguuuuucaaacuaaucgcugcuuuaaugucaucaccauaauuucagcaguaauccuggaagaaaguauauaaaacuauuucuagguuuucaaguauauauuaugauucccuaaacaucaaaaguucaauggagauucuuucucucuauggaaauaagcaucaaguuccccuuuuaaguuggugaguucugcauacuagcauugcacaguggggaguagagagagaugaaacauagcucccagcucaggaguucagagugaaaaacgucuacuuugaaaccugcacgaauagacugugguggugggaugauggcuguggggggagcacauuaauagaggccauucagauguuuucaucugcaaacgaacuaaaagguguacugaacagaacaagaaaacuuggauuuacacacacauacacauaccaccaccaucacugccuccggggucacacagaggucuuucugcugcuguuuuauucauggggugccugcacaaaucucucagaauuccaagcaagccuggcuggcucucuaugcaaacuguugccucccuugagauagcacaggaagaaaaguugaacacagaaaacuaacuccgauggaguggaccucauuuugagcaaagauuacugugaaugcauuauucagaaaggcaggcuuguaccuugcugugagcacuuaagucauguagaaacuuuugaaugugguauuucaaagcuggcuuugcaucaugaaaaucagaagccagaaugacauaucguauaauugaacuuuccugugucuuaauuugucuuuugaaaaauuaucaaacauuguaggaagugauuuuuuaaauguuggauacuuauggcucuuaguaccgugccuucguugaaccauaaguaauuuuuucaauuacaauagcuucaaaaagagguuucauuuauuuaguagccugaauagucuuauacauucuaaaagucuuuaaauauguuuucauuuuucuuuagguuauuaaaacauuaugagauucugcauauaguugaguccuauaccaaacucaaauuuguuuacaauauucuuucuguauuuguauuuggauauauuguuccagaaacgugcucuuuuauauuuaagaccccaaauugaaauagucaaaagacuuuuugguuguuguuuauugaugaugauaauauuugaacauguccaucauuuaugggguaacucuaucauguuacaguacauucuuuuccaguguaaucaaugggaaauauuauucauguagcucuaaugagcauuaaauggccauucucuauagauagggucaucacuuguguucaggaauccucccauuacacccaggacauaaugacuuuaaaagucugguuucuugugggucacaaacucauucaauccaauuaauacaauugagcccaaacaauaguagcuauguugauccaaaauauuuucuucuguucagcuagcuuugaugugaacauaugguucuccucucuggcauagauuuaucugaaacaguaugauuucucaaguuaccuucuaaauaucguuaccuguuuucuuaaaaucugaaauggagagaaaauuaccauucagcagaauacauuugggugugauucuugauaguaaauuuccauuaauagucucaaagaaaguugaauguugcuacagguuaauuggaaaauaauuuuuucaaguuugaaaggucaugauucuauuauuuaagaagacuuccucuuaggaauauggcuuuaauguauguuaagcuuauuuucucaacaccagaccaaaaaauggaggcugagcuaucacaaaaauuuggaaauaauuuuuaauagcuaaguguaauaauauaccauucuuuccaaauguugccuuuaguuucuggcugucaaaaccuuaaucaagacaauaauucuuggccuggccauaagugagauuaugaaacccagcaaugaggaaaccauuaaaaaauuaauuuagaggaaaguuaauugcagauuuaauaugguguuuugcaaguuggucagcaaaauguuucaacaugauuaacaauauuuuucaagggcugaaaacauuaagcccgaggaaaugguuuuuccugucagcuuuuauucuucauauauucaucugagguuguaaauagacacaaauucuuuagugaauucugugguuaaaaaaauaucgccuuaucuccaugaauaggagcaagaaaaggaagagacuggagaaaauaauucuacuuauaaaguccuaaaaucuucagugguuuacuucuccuuggguuauauuuuuaaucugccaagaaauucuucuuguacaacacugucucuccaguuuucaugagucucaaauccuccaggauagaaaucauuucaaguuuucauuucucauggcagcacuauuuccagguugugcuaaaugauucauaaugauuuuuauuaaccucuucaauccucuaagaauuacauuaacuugagggauuccuccaaacuugagcaccuuccucacucuccagcguggauaagauaagcagugaguuuccagguuuaagacaugaucuaggaucccuuucauugcaaauuagaaagcgaugugauagcuaugaaagucauuggauuaggagugcauuccccuccucugugacccucgacaccccccgcccccccaaaaaauaaaugagccgaagcucccacuuacguucucugucuucuuagugcucuguguccuguggccgaggcguacagcagaggcaugugggcugucagaucggaacacacaaaauagccagagagaccgagugcaacccauacaccagaccggagucggaacgcgacugccaaggcccacgguguccccucuacacuuggagggcagaggaaug

SEQ ID NO: 14805 - RNA, 15865 nt, Homo sapiens
uucacucucuccuuuaagaauagcucaaguuaagacuguggaaccuacagacuagaggacuuggaaaagauuauuuccaagcaugaggguuuugcaaccuuugaucuaauuaauuauguuugaagagucuggcuuauuuaugagaggugagcuuuguaauugugacauugggagccaaaauaucuuuuccaaaucucauuccagaccuuccugccagagacucuggugcuggaucaccuucuguaacagacccacagaggcacgcuagaagauaacaucagccagacaugaaaucuguugugaauuuguucaaacacucgucugcucaagcuaaagggcaaagauaggcacgugggucuguaaaaggguaaucagcuccaggagggcaggcagcaauccuuggaaggggggcaaaaugguugcagaguuacaugugcuugauccagugccauggagguguccugcaugccacccggcacagcgguuaaaucuccaccacuggaaugcuccuuugcaaguccucuccagauaagaaggaaagaauguagcaguuaagaaucuuaucguucaaaauaccuguccccagggacccgccugccaggaugcacauuccggcugcugacaagucugcauagauguuggcuuggucucagggucacacauucuaucauuuaaucgaucuucaccaaacugacaccagaccuggcggugcuuaugcccuuuuccacaggugaccaagcacuguaaugaaaagcggagcuagucagggucauuucugaucaauguguugugguuucugggguuauuuauugaugaguaggaacagguguguccuuuucccacagcaaucacucucccauagcaauuuguaaauauacuaagccucauuuuuuuccuuuuguucguucauuuauucauucauucuauauuuauagucucugggccaguuuugagcacaaaauaaacuaaacacagcuccaugcuauaaaauuugaaaaacaacauucauaauuuuauagcauaggaguuaagcauggggaauuauaaaucacaucaaccuaaguuuuaacacuuauauaaccagucacaagaucucucugaaccucaauuuucucaucuguaaaaugagaauuagugucuacugcaaaggguugugaaaacuaaaugaaacaaauacaaguaaagcucuuggcacaauguucauuuaauaaaugccaaauguaaucaucauuuuauccauacuuacuguagaaaauuugaaaacuguagaaaaacauaaaugaaaaaauuauaaugacccaaaaucucgcuacccaaggauaaccauuaucaauauuuuauuauuuucuuuccagucuuuuuaagcaacuuuggauuauagugaauuuacaguuugaucucccaacccccauuuuaucgcauauuauugcaaagguuuguuacuuaguuugaaauuauacuuuaguauuagcuaucuaaguaaaauuuaaaccuacuacuuaucuuuuuuuaaccaaauacuagagauuuuuaagcaaaggcaauuuguuaaccuagaacuaaagcacuagguuugcaguucauuuguccaggaaucagacacuguuaaucaaauacacuguuaauugacugccauuucaggggcauuaagaguauccuuuucagauuuauuugauggugaaaauaagcaguuaauacugcacuuauaaggaugggauaagagcauggauguaggagcuguagcagggagacuuuuucuuuccccauauuccugauuuggcccauuaaaaaggaaacuucuguuucguauuucuuauuucccuucuuccccuuaaggaacguggagugagucccugcuugguaagaaucuccuugggcuguguuaacacugggcuguguuaauagugagugcuaauacuauaucauaaaagcaagaaagaggcugcaucuucuuucucuuguuguccugggaccaucugugcuaagcaauggaggguuugccuugugcuucauaaaguaaaggaugagaaaggcauaaaucuggaauacucagucugguccauuucuuuucuuuuuuuuuuuuuccgaguuuuauuuuuuuuucuugcaguuggauggguaagucagagaggucacucccuggggucuaauucucuuauuucaaagacaaggaaguaggaaacuucauguugacuucagaugugagcuaguauagcuuuaugauuaauaaauccaugauuuccuuucagugacuuagcuagggcucaaagaggagggaaggugauggacugcaacuucaaaaucacaacagaagcuacaacagugagugaucuagccaagcccaaagugcccugaggucacugguagacuaguuacauccaguacgacagucauggugcaggcagagaacuggaguuguuuucucaagggagacaagggagaaagggagaggugggagaaaggugcacaaggguuugucuuaaacagauagagagcaccagaacuagaauguaagagaugaccuaggggaaauaacagcccucccaucuuaccucugaccagucuccagauuuccacuguggacaagggaacucacugcaccucugaaugguaacuuucucuugaugugugcauuugcugucauccaguacaucauuucggguauugacacaaauagcccuucuccucugggucccaccgucacagcuuuuugaacacuguagggacaaaauaaauaaauaaaacuguugcuaaguuucuuauaaaguaugcugaagauccuggcuauguugucucuuccagcucuuaagaaacaacacacaagcuggccaacucuaguuauuuugguggagaucuuuucauguuaucaguuugcuuaccagguuuauaauuaaacucaaaauuagcucauuggcauauaaaaauaaaaccggaaauggcuuguagaguaugcaaaagaaaucaguugaguuguuccacuucuuccaaauuuccacacgucaugcccaugucagacauuacaaaucaaccaugcuacucuauucuggaaagcuugaauggggucaggcauuacaaaucaaucacggucaucucuuccgcacagccuaaauggggcuuacacaccugcaaggagccaccaucaacuaaucagacagcauccaagaagacucuuugagugagagccaacuuacuucaguccaggcagaauagcgccagccacccguguuacauuccccugagcauuuuucacgguugcuugguuugggauggcugcugcaaaaaccaucaucaaccuucucagucuucccauccagccugcuauauuuggcacaguagauguccaaugugcgguaacccaagccacacugggcacuacauucacuccugcuggcaacaugccaccuaugcaaaaauaauggggcaaaaccaacauuucuguuaaaaauauaugccuuaucuauagucaacugguauucauagaagaguugaguucuuuuuucuuucuuaacucgaauaccaugaagcccaaagccacagucaguugcuaaaaucuaauuuuaaaccaacauauccauguguuuuucauggcugccaauguacauagaagucacagaaugacagccagagguguuaccuuugugaugauuuuaccccgauagucaaucugaaauucaagcuaccaaaaggaaaacauuuuuuucaaguguauuaaaaccuguguacauuauuaucuguaaauaaaggcucuuaaauuccuugaagacauggacuauauuuuauacaauucaauuauacacuuuaaaauuagauuugaaucuauaaaucucugucaccuuuguauccauacuaccuguaaugagauuauggggggacacaguagguauucagugugugcuggccaaucgucugguucuuuuaauacccuaggaauaugaucagcagugcuuaaauuuaaaaagaaaauaaauaauauucuuaaacuaaauagaauauucuaaauaaaugaccuuaaaauguauuuuguugauuagauuuagaaauccaaaaagggugauuuccuuguacucuucauuggauuucacucuugacuguucacucaucacugcuuagaaauugugugguuuguugguuaccaauguccugagacuacuuccauguguaccuguccaggguagaacucaggguaaaaaagaguucuggccucaugcuuaucuuggaauuucucaugaaugccccaaaguaggucagaguugaccaucuggcaaguaaagugggcuauggagauuuuccaauagagugacaccauauuugggggauuuuguucuaacccggaacauguucaaugagaaauuguaaaacaaugcuuuaucucauccugucacaguguaguggggcaaacucucacuuccuucaggaaguguggcaaaaauguggcccaauuuaacagaagcaucuggaacuuucaucugcccuuugauucuuggcuaccuucucuuugccuucgucaccauuuccuuguggaaagguuauuuuccauccuggaugaagaaggaagguguccugccuccacaagaaaacaugccagcagcuuagcauggcagaguggcucaagugccccugacaguaacaucauccccagaaucugagcagagaaucuugaagagucuauggaaagggcauagcgcagccuuagaaaaguucucaaaaugcuacccccugcuuuguagucucucccuggaugguggucuucaauguuucguguucauuuaguucauuucaagggacauaaaauacaauuguauuuuaauacuauauuucaggaaaccauauuccaaaguguuguuacuaaguagaaacugagaaaaaaaaaguguaagccuguguguuuuuauugcaggggaaguugugggauuaaauaauuuuaagaacgacugaauucaaaagguuuuauauauuacagaacuuuucaaggccuucaaaauguugaucagcauuauuaaccuccacagggggaaggagauucuugguaagucuugucagacauacuggugugccaugaaucaucauucaaaaugagugauccacaaccaugcguuuggaaaagcuauuucagaguuugaccaaucaguaacaaucuucucuucagucuuucaguuuuggacacagcuacuugacaauaauuacuauaaaucaugguuauauugacugucaguuugauagaugcaagauagaacaccuuauuuaggcuugguuugugucgguguauuuuucagugaacgauuuuauuuucccaacaaucuauacaggccaguaagcuacgcauuuaaaagcugacaaauaggcaugaucuucugguuaauuuuaggaaugagcaugcaccugucuaaugaggccuuggaaacuaauccuaaacuccugguuuuucuuugcauuuuaaaauuccuaacccuaugaucuucauaucuaccaaaagaccuggacauaaucccuuuaccuuuucuuuaauuagaggugcuauuauuaccauuggccuaugaucugacgugcuguccuuguuuggucugaguagaguacauauaaaaguuaagugucaaaaaaauagugacuuucuccaaaugggaaauuuagaauuuagaauagcuuagugugcuagcauaccuacuauaugaaacacaaagaacugaagcccuaauuacagcuagguauugugacauuauuuuuaauaaaaaucagaggaugaacuauggaaucagaaagaccuggaugugagugucaauuaagugacccuaguugcgugcuucacuaagccucaguuuccucaucugugaaauggagggaaacagaaccuauuucacugggauauuugggggauugagugaggcaagccauguguagcauuucacacauauggcagacauucaagaaaaguagcuauuccuguuauaauuuauuauuauuauuaucauuauccuugguguuucauucuccaaccaaguuuuaagcaucauguaacuccacguaaaccaaugagcggaaaucuauuugagaucuuuugcaucauuuuacacaaaaacucauggcuucggggguaccuuuuaauguauuagcuuuauaagcacuguuuacauuuuaugucuaaaggcuuccaaugcaggagaaacuuuggagaacaccacauaagccagcaucaucacaaauuaaauaguggcucacuuuggaaucugcucaaagugaaaaauaguuuuucaaaauaacagcucaaacauuaucuccacccucaaauuggugcuccauggguaaacuuaaaaagaggguucuuaaagaauuauuuauuuuuuagaucacauucuauuauucgcaaugcuauguauaaauccaccaucugugcgaucauaggagcauacuuagcacuguaggcaggaguucugcuguaucuauaguuauaaucagagacucaaccagucucguucugauucaaucaguggagaaaaaacagguaaggggcuccaagcaagguagggaacagggauggggcaaaaaaacucaugggaauuauuucuuuucacaaaggaagagaagcuacccagaauagaauccaugaguaacacucaucguuauaacugaauuaagaauaaaaauaacucucuccuaggauuuaagcacaggaucuagguacagauuuagauuuccgucacuccacuaacucguugugugagcuugugcaauuuguuuaacgacucucagccucuauuuuccuuauuuguaaagugguaagaauaauaauauauaaaucauaauguuguuugaagaauuaguaggguauuaauuauauuaacaggauaauagauaaugggauaauauaagaacaauccuauuaguaaaagaauauuaauaggauaauauauaacuguuagaaaaaauaguucuuaguaaaugguugacucuauuaccauaaccauuacagaguacuggggaauauagugauaauuugauauaaggcuacccagaaaaugucaccauucucaauuuauuaagguugugccucaaggaaucuauccaccaauucauuuuuuuccccaaacuguagugauuaauucaguuuagcgguuaguuaacuaauuauuuuuuccugaagagacuugaacuuuaauuuaacucaauuggcugaaacaaagauggguuuauauggacacuaucuacaacaagaauauugccuaguauaaacgucugccuuuuaaugucuuccuguuuuuuuuuuuuuacaaugacuuuugucaauauauuuuggcaagccaauuucacuagggcaaugagcuagaaagucagugacacuggguagaggcuagaaagauccugggcuuugaagucagagccuucagucagaacuggcaaaaauaugacacucguaccauaacugcuccucucacuuccauggcagacauuaguagucaaucucagaacuccucuauuuucucagagccucaaguaggccucauaaucugcccuaaagcacuacaggcagccaauacccuuugauaggauuuggcauuguaauguggagccuucaaagugcuuaaguauucacuuuucugcuuauaaauggugagaccuuaacacauuccuauaccacucuccacugaauuucccuucuuaaaaggaggacaaaacagcaacucaccuuaacugcauuuaacugucaugcagaguauaaaaugcaagccccgacuacuuaauauuucaauaugacacagucaaccuugcaggcaaauagaaaagcuucagaaugcucuacccacccaguauuuccugccucggauuuuacacuuuucuuaaacacagaauuguuugaauaucucagacauccauauauacauuuucuucuuguuucuuccaugacgcuaccuuaguguacugcaacuuucagguguguaggaguucuucuacugggugguauacacucucgguagauauaggucauuauggguacuuugagggaugagguucucccccuuuucuuuugacuuucaaaacaaguuuucacguacaaugugacucaaucauaaugcuaauaccuacccagcaaguugugaggaucaacugaauuuuuuuuggcaagugccauacucuauuagcuauuuuuaauucuuaggugaacaagaaaucugcacauguaugucuuggauaaucaguuccagagggauggagaauugguuaaagcuuauuucacugaaacacaagaaaggggaacuaaagaccagcauccccuccuuuugcuucuccugcugggaccuccugcaagacucucacaauucaguaauaaaggccuugagaaaacaguggcccaccucaggucacagucuguaccacaggguucaguaauguguccaggcuggggcagccgaucgcaucuuugaucagaaacaguaagcugaucagauucccuggugcaaacaaguuuucguuuccguuccccuaagcagaaagggaaaaaaaauuauucagggaaaauaaucuauuccauaaacuauuuagaccccggauuggcaagcauuuucucuaaagagccagacaguaaauaucuucagagcguaugaucucuguugcacuauucaacccugacauuacagggcaaaagcagccacucacaggcaauacauaaacaaaauugucaugacuguguuccaauaaaacuuuauuuguaaaaguagguaggccgggcacaguggcucaaaccuguaaucccagcauuuugggaggcugaggugggcggaucaucugaggucagauguuugagaacagccuggcuaacguggugaaacccguucucuaccaaaaacacaaaaauuacccgggcaugguggcaugcaccugugaucccagcuacucgggagacugaggcaugagaauugcuugaaccagggaggcacagguugcagugggcugagauugugccacugcacuccagccugggcgacagaccaagacuccaucucaaaaaaauaaaaaaauaaaaaaauaaaaaaauaaaaagaaaagaaaaagaaaaaaaagguaggcgguaggcuggauuuggccugcuggcugugguuugcugacuccucauuuagacaaaagaaaacaaaauaaauaacauaugcuaugacuacuaaaaccaugcucuggaaaauuacaauggcggaggugauuuuugcuugguuuuacacauguguacaaaaauuucuuaggaugaagaaaucuaaaauuucuugaaucacuuaaaaaguucaacuucccagccaaaaaugaccagacacauucaaagaaaagagauuagagaacguaugcagauagaaggguuugcaguuugcaugcauuuggcuguuauuaaaaauaaauaaauaaauaaaauaaacuucucaaauccccagaacucaaauucaaagcagauaccuuggcaggguuuacugcaugcuugccauggcccaugacuguuccaguaaaacugcugagguuuaucuucaauuggaauauugaaagaauagcguacaucgggguuguacaacuuucccaccgacaaaaccuagaauguguggacaaaacagaaacgaacugggugggcuuaguaaugccaagcagaagaaaaggguggugggcucauggucaaguuuuuaccugaagcaaaaguucuugcucaaugcgaucuguugaguuaauucuuucuacggcagucucggacccacuguacucuaccacagcauucccaaugcgaauuucccuuuuggccauugugacaacaaaguuuccauuuagcaagaauucaccuuuacugcuugauaaagcuguaggugaagaaacagaauaauacauugaucugcugucaaugacuagcuguuugaaauaugaaguaacaucuggauagguagagagucgcugugcacggaauggggacuuuugaggcagacaggcauggcuucaagucccaaguuugcuacuugccagcuguguggcuuugggaaucauuuuccauccaucuccauuucuuuaucucuaaaguggagauaaaagcaccuacucccuugugguaucugugaaaaauaaaauguaaccuagguguccuaauaaaccuugaucuuguuauacaagacccacaguuauagaauuauagauggaaacaaaaguguuuauaugauuugaaaauaugcauuagugaacggaacacuuacaaaauugguuccuagacaaaucuauauauacuagaauuagucaagccuguugaaucuuuguuaagucuuuuuuguuugacagauguugaaaucugaaaauccaugguuaauaugaugcucaaagaucuccuuaucaguguagcucacugugguagccagccucaaauauggccccaacgagccuuguggcaugguauucacacuaugugucauccccucccacauucaauaggaaugacugcaaucacuaggacaaugcagaaacaacagaaccugacuucuaaggcaaggccaaaggcacuuuggcucugccuugcucuuccuuggaccucugguucuggaagaagccagcugccauguugugaggauacuaaagaacccacagagaggccugcaagcagcagggaaguacugacuccuucugccaacacccucugagugaguaaucugggaaguggauucuccagcccuaguugagucuucagauaauacuacauuccuaacugccaucuugacuacaaccucaugagagacuucaagccagaaacacccguauaugcugcucccaaauuccuuacaugagaaacugagagauaguauauauuuguuguucuaagccacuauguccugagauaauuuguuacacaguaaaagauuaauacaccaacccagaccauuauuucuaaaccugcaacugccucccauuguuagcacauauuacauacucucuauccgcuuucucaucuuucuccauggcacuuuguuuauacucucucuuuccaaacaagaauguaagacccaugaugguaagaauguugggaucauuuuauucacuacuguaccccaguuucugaaagagcacauggcaggugcucaguaaauauguaucuucggggaagaaugaaugaaucuacuccagaucuugcaaaagaugaaaaaaaucagugaugcugcaaaagugauauuggagaacugcuugaaucgagugccaaaauguuggccaaaugagaaccuggcagaguuagaccaguuauggaaucuaaaauagucaaacccauagaagcagaggguagagugguaaaugccaggggcaggagggaggggggauggggagauguuggucaaagauacaaagauucaguuaagcaagaugaauacauucuggagaucuaguauacagcaaugugacuauaguuaacuuuaguguauugcacacuugaaauuugcuuaaaggguagaugauaaguguugaaauaaacaaagagagugggaaagagaaagaagaaagaaaggaaaagagagacaaagaaagaaaaggaaagaggaaggaaggagggaagaaaagaaaaaagaaaacaaaaggaaaugguaacuauaugggugauagauacauuaauuagguugguuuuggugauuauuucacacuguauaggaguauaaaaacauaaaguugaacaccuuaaauauaugcaauuuuuauuugucaaguaucccuugaugaagcugaaaaaagaaacaggaaagaaaauugacaaggaggaugagacaacagcugcuucagaagaaauuauuuauuuauuaaaaggucaagagagcuuauugggaaaguuaauaaaucucuagaaagcuuuucuaaaauugacucccuuucagauuucacuguuaaauccagacuuucagucaagaauauacuacuuugcuauuaugugacuugauaugaaaaauauaugcaaaaauauuuaucaauugccuuauucuuuucaaaaccuuggcaugauuaaaaugaagauguaauuuuguugauggucaaauacaaauaaauuuauuuucauaauuuuugauuaauuucucaagauaaaaucucaaucacaucuuuuccuuuuaguauuuaauucaaaauuuugauugugcugcuuuuuucuccccugguaccacugcuccuugaauaaguccucuugaguguugggcuugacaugaagcagguauuuaauaaaucagagcuauuaaaaauuugggcucugaacaaagacuagagaaaggcccccccuuaccgucuguaauuugugcaagaguagcaaauuuuaguagugaggaugcccuugaaagauacaggccauauauuuaggugaauaaaagaaacaaggacauuuaacucacagauggcaaauaauuuucauccccggugccaaugucaaucaauugguaacagccgcccaagaaaccaugcugaacgugauucaccaacagcaucaugucuuagcaucauauugaugauaccuguauugguuguggaaugaggaguggacaagaugucuuagguauuagcuagauccuaacucaucuuucauugaugcaggccaucucaucaauguaggugacacauuaucuuucaccacucaggagagaagcaauguguacacagaagagguuccaaggauuuagguuaaguaaauauuauauccuuauguggauacuaaagagggcagagaugaagcucugaauauuugugguucagcagcagcaggauccuuaauuuucauagacaugggaaccucacagaguucaugcaauuggacaccuuacugacgcagggcuauucauuccaggauuaggaauuaacugcauugaauucuguuccuaauccagcacuucauuuaccagaauucucacccacauaaacaacaucuggccccaagagaagaauaaggugccuucaucugaaaugacugagaagaauguggugacacugggaaaugucaagauuagcuuuuaaaaggauaaaauacccuccaacuucuuggcucaaaauccuuuggaagucaccacuaccuacaagauaguacaaccuccuuagcauagccucccuguaacuuuacaaaucuuaaucuucaccuaucuuccuagucugaccauucacucccaccaauaaaccuaaauuucaaguccuguauauuuccaggucagccauauauccuucuacaugguggcaguaaagugaacugguuaaguguguagcgucugaagucugacccauaaggauaccaaucuuucccauuuucuauuuguaucaccuuggauaaauuacuuaaccucuccaagccucaguuucuuccucuguauaaugaguuucuuauaggauuguuauauggauuaaauaagaauccauaucagcuuuaguuccuggcagaucaaaaugccuuuguauguacugucuccuuaucacacuucuauaagguagugucuauuauagaagccuaauuuauggaugagaaaggcaugacuuaaaauaguuaauuucccaaggccagguggcuccuaaucauggaaauccauuuccagagucuacaaacuacuaaaauuuuccaagaagggggucaacaaacguuuguuaaaugaguaaaugaguucaugcauucguucucuuguauacaaauagaaacuaaguauguuuguguuguagauuuuucuuaaauguaaauugcucauuuuguuagucugcaugagcccuugagcaaagcagccauuuaaaaauccacuuuuuugacuaauagacauuggagaguaccaaaggugggaggauaaaaggaggauaaggguugaaaaacuaccuauuggguacaaugcucauuauuuggguaauggguacucuaaaagcucagacuucaccacuacccaauauaugcacguaagaaaccuguaguccuaccccuuaaauauauaagaugauaaaauacaaauuuacuuuuauaagcccaagaaagaucccaacccauaguaggugcucaaucgaugaugcugaaagaauaagugauugauggagucugacacucaugacaaggaggauagagugcuuccagccaaaugacucuuucucagucaguguaaaccucugacaaccucgucuugccugcagcuccugcagcgcgagacccaucagccaugaaagaggcaggaguuucaaugggucacugaagccaagguuguuuccguggcaccuugggcauccugaggcugcucccuaaugcgggucauucaaauggugacaguaugaugugcugucaacaaaaucacccaguucuuucaaaugaaguugcaugcuagcuacccagcugaugucuugauaaaaaggaggaaauaaaaagucagaugccgguucuguaaaucaagugauaauccaguguggucauaugcaaagagugauagucuauucuggguuaauuuggggggucuuuuccaaugucuccagguuuccuuucaugcuuugcugacucagggcauuucacccuuccaugcauauucuuuauuccaguagaugugaguagggagaaagagaggagcacaaaugauaucggauuccucuuacgaucugccgugauaaaugguuuggccccagacauccuuaaaaucaucagaugaaaaaaaaaaauccuauuuuaucuugcacugcaucgauucccaucuucccauugccacaauuaaucaagagcuaaguguacuggagacaaauaaguaucacagaaauggcuacuuuuucuucuaaagagauacgaacaugguggcccuggguacaacuuggcuuuagcucaacaggaggaagggguccaugugaaaggaugaccuuugacaggaaggcuuccugcuuugguacuuugugaaacaaauaguuuccugaaaacaagagccuaaugcccaaccucccacuaaugcgauuaagggagcuaauuuccuggguugguuucccucccauugcacccaucagagcuggguugcuacaaaaggcccucucuccuggaaauuccucccuccuagaauacacagaaaaguauggcuuggcugacacugaaaaaaaacauaagggauaaggaugaauauugcuuagcaauggaacagcugugacuggacucaacgcgagacucaguguggguuguaaaaccuucucagugcaugugcugcaucuuccaucaagccaagaguaaauauuuacauaugccagacuugaugacaacaucaaauucuuccuaacuuguugaguaaccaccgugagguucaaaggcucugaggucucgacuuucacacucaguggacugugacuugcaauguaggcuugcacacuuuucauuugcuucuagagagacuuccuuaugccaacaggugacuuucccauucuauuccguuaaagugucauaacuggcucagauugccugugccagaugacaaaucuuccuuaauuuuguuuucauucuuuacaaggagauuaagaaaccuccacugaauaauaaaagguuaucaggaggcccucccugaauucaggugcuugaugugcauugauuaaguugacuugaauugaggccacuacuuggagggagauuguuuuuccaagaaagggaagaauagcagagaauccuucucucuuucgaagagaagaaaggagcaacucaacauggccuucaggucucaggaaauuaauuuauaaagcaggcugcaugcaaugcuguuucauuuaauuaggaaguaguaaggacacugcagccacaugcucaaauuuauaaccaaguguacaaagaaaaauacuugccccauucugcagcugugcaaggagaaauggauuccccccccaaaauaauuuguaaacaguccuccaagaacuuuguuaauugucuuau

SEQ ID NO: 14806 - RNA, 1335 nt, Homo sapiens
cacuggcaaaaguuuuuuaauguugucugagcauuaaaagauauggaaggcccauccuaaauacagagaagaauuaugguuaaucuguuguaccgaucccaauuagauaugccauuucggauacagauagaagaaaaaagaaaaaaacuuuauuaccuguucauuaugaaucacaauuaaguucacaauaacaauauuaauuaaauuuccaauacuugggucuuuauagauagaggcuaccugcaaccgagauaaauuuuucaaaguuaauugugaacuccguguaagcaauaagcaagucacgucuuacguugggcuccaccucuuuuuuacguuucuugcaacauaugcauuuugugguugugaauuuuucauucacucaacaacacuuuuuguaaagucucuucauaaaauucauagaucacaguuuuagauaacagugaauucaaacaaauuuaaauuccucugaaauugcauugccacgugacuuaacaguucucuguaccagaacacuggauauuaauuuuccaucaagcucuuuccucucaucugaaguccuggauugccaacuuauagaaucucacauugggugcacguuagccgacacugcuauucuuuaauguuugccacccauuguguccuugacaaccucguuaaccuggugggguuuuuauuuuugcaguauuauaauuaauuauaggagcuaacauuuacuaaaugcuuauugugagcuggcugaaaacugcauacacacaugcauuuagucucuacacagcgaaacucugggcugaaaacuaaauacacaaaugcauuuagucucuauacagcaaaacucugggcuggguacuauuaaaauuucuguucaacaaaugaggaaacuaagucacucagagaaauuaagucacuugucugaggcuacacacuggugaguagaagagccagaacucucaaccuagggcaguuugacccaaaguccauguucauaaucaaaauucuuaggagagaacugaaauuaagaggugaaaaugaggcugugcauaugcgcagggccugauuagauguucccuucccucaugggcaugagagggcuggaguaucugggacugagcggcaugugggggugagaggggcacggaggccaggcaggguuggggggcgcagaggggaaugggucacagcagugaacaaaaaggcaaggaguaccauaggccacaaggggggaagaagaaacccuaaagcuaugcccaaacaggauugcuuuucacauucaucugggggauuuauuaaaaauaaguuucaguucagguaaaucagggcucgucuauuaaaagaaaa

SEQ ID NO: 14807 - RNA, 18865 nt, Homo sapiens
cacagggcgcccggcgcgccucggagcgcaaguuccucgccuucuccugcccgcucgcugggcauuaugcggccaagcagccgagccccaguccuccuccuccuccugcuccuccggcuccuccugcggcccgagcggcucagcucucggcaggcggcggcguugcucagccgagcgcagacgggacccucgcagcgagaccucagcgacuccuaaagucaaaaguuggcggcgggcgccgggcuccgcgcgcucuccacggccgcugccucgcgucgccgccgcagccaaggagggcaggagggaggggggugggggcagcggagggaggggugggaagcaccaugcaguuuguauccugggccacacugcuaacgcuccuggugcgggaccuggccgagauggggagcccagacgccgcggcggccgugcgcaaggacaggcugcacccgaggcaagguaaccaggcuccggcccccgggaccccgccggccccgacgccgccucccgguccucgcuccugggcaggggcaccccgcagcggaggcuucucuccuuuuccuagaaagaauuaucucccgcuuugcagccucucccuucuuugggucauccccaaccaauugcuagggagggacacuauggaaacgaauuuaggcaaccccccccuaccuugcuguugccagauauauccccauccccacucccacgccgcaaacuaaaguaacuuaguaauugggggcaccagauagcgucauguuuuauuuuauucagguuauuuaucaauaucugaaaucauauauauuuugacuuguuaauugucuggcucggaauaguguauccucagcaccuagcacagguccuguuacuggcacauaguaggugcucagcaaauauuuguccacugauuaagggugaagggauugacucgaaugggcuggaaaauaaggucagaacaaaguccccaccuucguuuuaaauuaaagcuuaaggaaaaaugaauuauugguucauauaccucugcuucucuccgcagugaaauuauuagagacccugagcgaauacgaaaucgugucucccauccgagugaacgcucucggagaacccuuucccacgaacguccacuucaaaagaacgcgacggagcauuaacucugccacugaccccuggccugccuucgccuccuccucuuccuccucuaccuccucccaggcgcauuaccgccucucugccuucggccagcaguuucuauuuaaucucaccgccaaugccggauuuaucgcuccacuguucacugucacccuccucgggacgcccggggugaaucagaccaaguuuuauuccgaagaggaagcggaacucaagcacuguuucuacaaaggcuaugucaauaccaacuccgagcacacggccgucaucagccucugcucaggaaugguaagugggcgcgcgccaccuccucuccccuuccgccuccucgcccgcuucuagaagacuuaauuguccucuaagccuagagacccucacuguggcgaggcuccgcuccucuccggcguuaaauaucagcuagaaacucguaugguuuggguagcuagcucugugcgugcgaguacacuggcguggagcgcacacacccgcccccaggggcuucuggauguuucagagcuuucuggaguuuggacucgguucagcggcgcguugcccaacgcugcgaggcggccuggaagucaguuuccaaacucggagaaaguuacuggaguugcgguucccugcagcaaacuuggccacccgggagcggagccgcugagcgcagggcggaccagacuccuuauuggugcgccuugcaucggggauguggggcugaggauccccugcccaaggcacugggaguuccuucaguguguguuguggagggcggugcguaaucuagaguccccgcuuucucucagggccuuuauucacgcgccaggaacccugaggcugaacuggauugacagggagcaggucccgucccaggaacggaagggugggccgagggcucugggggcgggggagaaggcggagccuaccccggacgcuuugaauugggguggaaccgagagugggggugcagcgcaguccaacucugcacccuacuggcgggguggccgggagaaacgggauagugggagacagccuggagaggcuguccggacgugauuucgguuccucugggguuucuacuacucacggguuccagggaguggagagagggagccugcggcgcacguuucccuagggacugaggcagggcggggaggccgccuucuugcgcugccaaauagcauuuagcagggaauccacguugguuccccgacucucugucgacccccgcaugugcccuccaguggaucuuacaaggcaucugccccccacuucuccacgacauuugaggagucgcugcgguacgguucuggcccgagcaagggugguccuugacuuucccaagcgacgugcguuucugccacgcgcgugugacgcagaaacuuucccgggucagucucucccagcgcacggcgcuguaagcgcaauggggucguaggcacugugcccggugaugccuuuauucuucccgaagcacccacagccccucccucccuuuucuaagcggggccuuggauacucacccccagacacugggcugcuccaucagugcgcugucguucgugggucuuaaaguucccaagcacauccuuccuucucugccuuucaauggaaggaucggguggagagcguggcaagccugaagacugggaggggguaguucuagccugcugggauucaaggaaagggauaaaccccuuuagcccccagcaaagcgcccggagccguggcucccgaaaugcgcugucgagauuguuugggggugggcggagacggcagcuuggcgaagugggagggggugcugcagugagucaucgcugccccaggaccuagggcaagagcucuggaauccuucugguccuugaaagguuaaggcucggguaggcagaagccagccgucugagcccagagccuggagugccccuagauuccaagauaguaacccccaauuccaggaccguagggauaggacugcguguguacgucaaguuuguaaacagccuuuacuccuccucucuccccgccuccacacccgcugaagccuaguggccccagcaguuguauaaauauuuuacugcgcaggaccuucauuuucauuggcaguuuuaggugguagugcgcacgugguuucuuugggaacugaggacuagggcuucagaaacgacuaccuggacugugauaaccucauuuauauugcguuuaauucgcagucugccucuuuuggggaaaagggcccucauacaucuuaaagauaugcguucugguucuucguaucuucagccauuaaucuagcuccaaaaccccugccccuuugucuuccuucuggaaguuaucuccucccaagacuuccccuuaccacuucugcagcaguggcaucaagauguugcuaguucuccgccuaggagucuuccaggaaaucuugaagagucuaccagagucuaccagauuuuggagugggcugugccauccugccaccccuagucaguugucaguuuuucugaauuucaucugagaugggucgcccgccucuccugaacaucucuacccuaaaucuaucccgcuucacuuuucucccccucucuccuuaggacugaugucuaagaaauauuacacugggcuucuucuccagucuuucuccucgaucgcuaacuccauuuggcauuuaagacuauuuacagugcacucacucacauccacauguccagucucagcucccaaucuuuccuccacaaauccugcauuucaggccauggguuuuacacugcuuucucugcaccccacccucaauccuagucuucauugccuuugugccuuggaauuuacuuggucuucucacucaucuucacaugcucaaauccuacccuucuuuggagguguauauaauuuauaucucuucuuucccagaagaccuuuucauaguuccccauguugaugucaucucucccccucccccuucauagacacuucugagagucucucuuaugaugcuuaguacguucucccuuguaucaagguucuugguacacauguucuauccuuuucuccuuggcaacagggucagcaucaacucauuuuucuccuauauuggagcuuuguauguuguauauacuuagcauauauguuugaauaaauagucaccuuaaccaagaaaagauaacucuuaggcccaccuuugugaaucaacaguacaauuaauuuuggcaucacauugauaugauuuauugagcucuuacuauuaaugucugccuggcacuacuguaaguaguuuacauauguauuaucucauccaaauccuccaagaacccaauccucagaacaacacauuuuacugacaaaaaaaaaucugagacuuugagagcuggagacuugcucaagaucucacagcucguaaguggcagcgcugggauuucaaccgggucuuucugauccaugugcuuaaccauagaccagagacugauccuguucuccugaagagaaccucaggguucuuuuauaaaaaggcacgagacuaaagucagguuagacucaaugcugugcagcugcuucuguaccauugaaggggaauuugggcccaaucacuuccuccuucugugucuugguuuccccauuuaccaaucaaagguggcaaaucgucaccagcugagcucccuggcucuuucccaggacucaugucucugauaggcuucacauguugugauaugcucucugauuugugcucagagaacaccagaguuguguauugaacacaggcagagaauaaauuuauuaaaucacugcuucucuggcaacuagcuacucugucucuuagucugaccacaccugagcugcccuuuucuuaaaccaggggcucaugaaucauguggagagcuuuuaaaacaaaaaacaaaaacauucuagauccaucccuagaaauucugaaucugugaguaggggguaaugcccuaaaucuaauuuaaaaacaaaaacaaaaaaccuucccaggcaauuuugaagcuagcuguuuuggggagccaacgucuuagccuagugcugcucauacuuuaucaugcguaagaauacccugggagcucauuaacauuucaauucuugggcccuaccccuagagauuuugauucaauagaucagauuugggguggagcacaauuauuugaauuucuaauaagcuccuggaugaugcugaugcggaugcagcugcugauguucagggagucauuucuccugugucaauggaaggaugcaaggcaucagauuuuuuuuccagcacgggaaaugagaaagcggaggagaagaguggagcuugauuucuccucuuaaacaccacucagcaacuuggcauggggaauuuuucaguguucuuguaauuuuuaguuugggugguucaaucuugagguaucauuuaucauuuguaaaaacuuggguauguggggugaaaaggagcaaaaaugacuugcaaggugcuuagaaugauuaguaagagcaaauuuuauccuaaugguuagaggcuaacacuggcaacaccaaaaaccguucacgaguucuaagccuuugcaaggugucaggcauuuugcuaagcacuuaauuaucauuaucuuauuuaaucugcacaguaacucuuuacauuaaguaucuuuauccccagcugacgaacaaggaagcuuaaacagagugguuaaggaacuugcccaaggugaauggguaggugcuggugcugaaauuggaaccuagggcaaucuggcuucaaagccuugcaggacaucacuccccuauuuugcaaaggaaaggguuggugagaggaucaugugccagcguuacaggugguaccaccuugaaugcauuguggccaacauaugcuucuugaauuugaaucaaugggaagacuucaauaggccagcuuuuccugcuggagugcauacuugucccuaaguuucuaggcucucuaaguuuccaagacucuuucgacagccugcaggaaugauuggaacuugagcucuaaggaaguauuucuuagagacagauuuggauagcagguacaaucaacugaagucaaaucaagaauaaguuacugauaugacacuuugggaggcugagccaggcaacauauugagccugggcaacauauugagacccccaucucuacaaaaaguaaaaaacuuagcugggcaugauggcaugcaccuauaaucccagcuacucaggaggcugaggugggggguuugcuugagcccaggaguucaaggcugggugagagagcaagacccuaucucuaaaauaauaagaauaguaaauaauaaauaauuuuuagaaaauauacugauaugacagagaguggaaauaaaccacuucuccgcauauguugcagcauuuucaguugaaacaacccuccugaaaaagagauuggguaaaaugacaccaucucuacuugaaaauguucuuuugguuuuuuuccucccaaugacugaguuacguuaaaucaaccucccaucucucuucauuugcagcugggcacauuccggucucaugauggggauuauuuuauugaaccacuacagucuauggaugaacaagaagaugaagaggaacaaaacaaaccccacaucauuuauaggcgcagcgccccccagagagagcccucaacaggaaggcaugcaugugacaccucagguauuugcuucuugcuuaagcggagagcccagcucuuugagauggguaaauugcuauacuacagagauguagcucucuuucagucuacaaagugcaaccauaugcauuauuguuuauucaguccucaaaugauguagggauacauaccccacuguacagauguggagacuaaggagagguuuaguaccuugucuaaggugcacagcuaagaaguuauaaagucaggauuugaacucaaagcagugacuccaugcccucuaugggaagagccaccuuuucuguugaaguugcugauuuuuaggcuuaaccuugaguaauauucaggucaugauaguagcacccucagucaccaaaugcauguauuuuuuuuuggcaucuucuguucauuuggguguuuuuuguuuguuucaccauguaggguuacagaaaugucuuauaaauggaagccacgaaaacauauauguguuuguugaauguuuccuagaaacuucagguuugcucauguucugugacuuaaggaacuguagcaagguaccuguacguuaugcugugagguaccaaucaaccagucaaauccuaugugcccacugcuagucuccuuccauccuggccagauucuuugagguuuugcgcugacauguuuggccauugucaaggauaugucauucugggcacccuggaaagcuucugucuguguuucuucaucugcagucuuguagcaacacuucacugccucagaagccugguuacuuucugccugaugauagguuauccuaugaaauaauuccucaauuugguccugcgucuuaggauguucgugaaaauacuuaaaaaaaaauucuuggacuucccugucucuaaaacuuuaucuuucuuucuauucuuuauuuuuaaaauugcuucuccaaauuaaauagcaucucagggucuuucugguaucuccaaacaaggccuaaauucaagaccaccagggaguuuccucaaaugcuccccagaggaucacuuacuucaucuuauaccuguaccagguuguucacugggauagcaugugguguccuauucucuccuggaauuauuauuucuaaagugaauccuuuaauaaaagauaacauugacuauuuauaaccuacaaguagccaaauuuaaggguguaacauuguaggucuuuuggcuuuaucccauccaguucuguguucuuaccaccauaacaagauggaauauaacuaaagcauucugucagacucuaaagagccaagggauaugaggaguagaggggcaaguauacuuagauacaucaaaaacaauaguuucagcagcagguauacagucaagacugccagccaccagcaaguuuaauggacaggacauuuaucacaguuuugaccgugcuaguaagaccauugaccuaaacuucuugacuucccaaaucuguauuagcaaguacacauuuuagacauguguauaaauguaaacauaacaugaaauguauacauaacauacagaaaugaaaucugcaguuccccuccuuccaucuuauuaguauauauucagaagacacugaaauauuuuuuucacugaugaauuuauugaccaaugacacuucaugauauucuucuccccuaaagcggcuacaggucaacauuuuaaaaaaugacuauuuauuauuguuuuauucuguacaugcauuaugcaaagcacuguacauguaccaccuugcuuaauccuuaucacaaaccuaugagguaguuaccauuccuaacucuguuguauaauaccuggaaaaggagcugagauuuacagagaugaaguaguuugcccaagaucucacagcuaguccacaaugaugacccauguuucucugucuuauuccgugacccauuuucucugugcaggagucuguguggaaaagagagagggggcagaaagagaaagucuuaauuaguacugugauucaaaaaaaucuucaagguucauuuuaaaauauuaauuaugcaaguuaauggacauuugauuuccugggcuggaggaaaugucauugucaaauccuguuaaaaacacaaagaagagugaaucuuaaaaaugucaggcucgaagacaaugaagaugcguuaguuaaaaaaaauaaaauaaaagucuauuuugguuccagucguuauuaagguuggggccuuuaauuaccaccuuccaaaucacaaugccaguacuuuuaguuuuccuccuaguguuugcuugcuccugaccaauauggcaugccguuccuucaucccuuguaaugaaccaggagcccagcaguuuugaucagcucuuccaaagguugcugcugggcugugccacucuggucucucucuuccagcuacuucugcaccccuucuuugaauucagaugcagcuucucagaacaguuuagaauauggcacgauucaccagcagguaucagaggaauggaccaacaggucaaggacaccucuggaaccagguagccuuugcacagggagugaaaguagguugaggugggaguagucccucuugccagagagaaaaggggcugccuagcaauagcaauccacucagauucagugguucaucuucccucccaacccccaaucaagagcagugguugguaaccaaaagugaccuuuagaaguacucugggagccucauacaaaugcagauucuuuaaaacaaaacaaaacaaaacuaaccccucucccaggcaaaugugaugaagcaagaaucagugguuuuaauagugcuccaagugauucagauguuuagcuaaauuugagagucacugcuaaaguuggguuuaaggcaguagucauuaucugucacuugcuguuggcauugcuguggacuugacuuucuacaucagugcuuuccaugucuccucuucucauaggaugauaggauacuggaacuggaggaguccuuagcagucuugucuaggccaacaaucuaauucugugcagauaaggaaacugaaguugcaggauguuaagaugcuuccucccaggagugauauccuauauauucaacaccaacccauccgaaccuucccuagccuugggagagaggucuccugcugagcucaguguaacccuuuaguuaccagaucaugggaguaggagcagggcaagacacaaugacugugacacuuucacacgcagauggaauaugucuuggucauuucugaaucuugagguaugccuaauuuucaaaaaaggauucugagauaacuuauguuaaaaagggaagcauagaaggagucuacugcaaugaaaacuuuauggguuuagaaaggagucuacaguuccguuucuucauucaugcgugcauuuauucaguuagccaucaagucuuuauugagcaacuucucugugccaggaggagaaaaccaggaacuguccauauuccugguuaguuguaugacuucaagcacacuuuagaauauaaagugaggauaacauguaccuuucaagauugaaguuagggcuaaaugaguaugaaauaaugaaagcucccaggacaguguuuauuuagcaugugguagacaaucacagaaugguagguguuuuuuaagguucaugaaaauagaaaacaaaacaccacaaugaggaaaggaaaacuccaaauacuaaaauucaaagguaauagcccagugcuucuggguaaucaugaaggguuuaggggacuugcccaaggucacccugccagcuaguagcaaggcugagggugcuuucuguccccuuguuuccucuguacccaaugcaacauuuaaauauuuucuuucuugcaaguuucucuuggcccaguggcugcccuuccugauugucucuguuuugucaucacugguuaugucuauguguauacauuugggccauuugagugucucugcauuuauuugucuuuucauccuauuugugaguucuuuaggguucacgaugggaaguggggugucuucucucccuauggcaugcccuugugacugcaguguccuuuacauacuggguccucaguaaaauucacugugcucacugccugcuagccccacacaccaggggcacaagcaaaaggccuaugggagcccuuuggagaguggcuugcuuuuauaagccacuuccugcggauccuucccauugcuuguuuccagaugagaucccaaguucuguuucacggacacucucuauuugacccugaauuuugcacaagaggauuuagugguucuuaucagugcuuccugguaggugggugagagaaaggcagggaagaaggcuguuuuguuugccugggccuggaaggcaaguguuuuucucuaacucaaacuucucccucaccuucccaucucagcaaggccagguaauuuuuguuucuuaaggcauuuaagaacugucuacucugugacccaucaaugcugugccuaaggaaauaaucagacaauuguguaaagguguuuaugaacgagauccaguacaguguuguuuauuauagcaaaagccuggaaacagccuaagugcccuuugggaggaagauagaucaauacauuauggggcaggcauauaauggauuccuaugcagcuguuaaaaaugauggccugaauuuauguuaccaaacacagaauauauauucagugaacaagcaggugauaaacuaauauguuugguaggauauuauuuuuuuuuaaugauaaacucuauuuggguacauguguguaaacagaauaucugaaguaaaggcaugaaaauauuaacagugauuauuuaugguuacuaggaacauaggcagucuuuacuuuugaacuuuuauauucuucuauuuugugacuccuuugcauguuucuuugauaguuucauaaucagaaaauacagauaaaaugaaacagggauaguggcauggauuuauuuugcuagaccuauugaacuugucacuggagaccaauagccaagccacauuuuggucucuuaggaucuuaggaccuuagaaguggagauuaucgguccuuuauuuucuuggaaugaggcagucucaauaaccagacagauaaaaauccugccuugugucuacuucuuugggacaucuguggcugguuaaaguugaaucucucauucaacccagcuaaauugccuugugccuguuggacugacccugguauuauuaagauuuaaucuccauuaggcacuggggacucuguuuaucacucccauuagaagguaccaucacuuccugauugggauuuccaggcugcaguuauaaaggcuggaaaacauaagaugauaauuaaagccaucaucuguuaggcucuuaugugcauaugggaucacuaugcuacacacuuuacacacauuaucauauguaauacauuggucagcauuguaggguagguauuauuaccccuauuuuacaguugagaaaauuagcucaaagagguugagaaacuuguccaaaaugucacacagccaggaagaagagagucugagccuuaacccaaucuauuuccaaugugcuauacuaugggccaaauugcauagaaaacacaaauggaaacugcuauauagaaacuccuuuuuugguuuauuugguuuuuugagacagaaucucacucuguugcccaggcugaagugcaguggcgcgaucauagcuuacuauagccuucaauuccagggcucaugggauccuuacaccucagccucccaaguagccaaaacuaaagacauaugccaccacacauggcuaauuaaacaacaaaaacuguagagacagaaucucccugggauuacaggacugagccaucaugccuggccuacaaaccccuuuuuaacuucauuuuuggagcaucuucuuugacuaccaucuaauuuccauucccuagaugauacuaauaagaguugacauuugcugaguguguauuaugugguagccucuguuccaggcacuuuacaacuuuacauggauuacauauuucaauucuuaccgcaaacuccauuuugcagauuggaaaacugagacacagagaagucuguaauguugacuugccugagguuauaaagcucaucaacauaccauuuucuucagcccuuauguccuggucuaguuaggggauauuuuuuggccucgguauugauuugacugcauucauauaugaauuauuuuugcuggcaggaauuuuuaaaugccugucuggaauuugauuugauuugaggaaggcugcuuggugccugaaauucccaccaagacucuaaugacucacagaggccuugugucugucuccagcaggccucugauggaguguaugcuuguuacacauuaaccucuuggaucccauuaauaauuuagcauagauuagcugauuagauuagcugcccuucgagugguacccaaauggagugagagacggagcuggggagcagaccccugagggggcuuucgguaaaacauucuggggcagccuauggguuccaggcagugacggaagcuuuggcugacuucagaauccugccugggccccaagcaagucagugguugguggcuaauuagugacuuaugcuaggaacuugucugccugcacuuucaccacacacuuucugcauucuuagacccuuucagccuuguaaagaucaagaacaggcagcauuuaaggaacuguguacuuggcaauguggaagcacauuaugguuauuucauuuacuccugcaacaguucaugggaggaagaugcucugauuauucucauccuacaaaugagaaagcugaacucagagaggugaacaaacuuguccacagcuugcagaaagggaaaaagcuggcacugcaacucaagacugauuaugaauuuuuaaaguuaguuauugccauuugggauuuaugguuugagccugauuuccuuucauuuuccccuuuuuguucuucaucgguguuuauacauuuuuuucucuuuuuuauagucuucaaugacuuucugucuaauaaacagucaauauaagcaaugaccucuaaaauccuugguaaauuauuagaaaaucacuguuuuaaauacauuaauucuuuauuucuucaacuugaucuacugaaugguacuuauaaaaauucugcuuuccuuuuuuuuuaaaaaaaaacuuuaguguuaauagugcaguacuccaauaaagucauuaagagguaguaaaaaagaaacuucuaauacaggaauuguaccuucuuucauuuguucccacuuauucauuaaauuuuuuuaaaaauuaucauuuuguuuuuaaaaaccauuuuauuaugaacaucuucaagcauacauaaagcuagagacaauaauaaaaugaaccacuguaaacaccaugaaucuuaauaaugacuaagauuuuucuacauuugcuuauuuuucuuuaugcugaguauauuaaaacaaacucaagauaccaucucuaaauauuucaugauaaaucuuugaaaaguggggaucuuuuccuaaguaacuauaauauuauuaauauuugauacguaauauuaaguaauauuauaaauaauguuucagcaaaauuaacaauuccuucauauugccuacacaguaccuauauuaaaauuuuucucauuguccccaaaaugccuuuuuacaaucaucaguuagauugugaucuaaacaaaguccacacauugcaacucaucguugucucuuacgcaacuuuucacuuuguugucgucaucgcuguuguuaaaauugcuauuuucguucuaguuugagauuugcugcauauagccccuuuuucccuuccauugccccuacucuuugcuucaucuuuaucaucaucaggucaggcugcaguugcaaggauuagaaaagcaaggccagucugcaaggccagagcagguacccagagcaaagccccugggccauuaagccacuucucagagugauuuaauugaagggaaaggcaguaucuuugggagguuuuuugacuccuugucugaagugccuugauggcugucauugugauguuccuaucaauaggaagauccucaauuuacagugccgucaugcauagggugugugugacccaugcauucuuguuagguaauuuugugaacaucacagagugcacugacacaaaccuagaugggauagccuaccacacaccuaggcuacgugguacauagccuauuguuccuaggcuacgugguacauagccuauuguuccuaggcuacagaccuguacaguaugugacuguacugaauacuguaggcaauuauaacgugauguuaaguaucuguguaucuaaacauagaaaagguacaguuaaaaauuuaguauuacgaucuuaggagaccacugucauaucugcauuccaucauggacugaaauauuaaacuaccuuuucuauccuuaaaggaucucccucaccuguguuuugaagcccagaagggccaguuugcaauuaggauuguaagguggcaaguuagguuuguaccugagauuagaacucauugacauaugaaauaugcguauuccccaaaaccuuuguuguuguuguuguuuugagagucuugcucuguugcccaggcuggagugcaguggcgcgaucuugacccacugcaaccuccaccuuccagguucaagcuauucuugugccucagccucccaaguagcugagauuacaggugugcaccaccacacccagcuaauuugcauauuuuuaguagagacaggguuuugccauguuagccaggcuugucucaaacuccuggccucaaaugguucaucugcugugaccucccaaaaugcugggauuacaggcaugagccaccacacuuggccccuaaaacuuuuuaauuaagcuucuggauccaaagacagccagaagagcugccugcuuuacaccuucugugccaucucaggaccuuucccuguuucuugcuaaucauauuuuagggauuccugacacuuugcuucagaaacccauucccugcugaagaaaaggggugcuacaagggugaauacuugauaauguguucaccuucauaggaaccaucugaaacuggcuaagacgcacaucuuucuuuagaagggacuucagaaucagcagaagacucuggaagagggccaucuagcugacagaggcaggaggauuuugguguuaaccugagaacccuucagaccuuucacuugaguaggcugucuuuucaaaguaagacauggcaaaguuucuugaguuucuucauaugaggggauaagcccacuuugguuaauaaagugcuauuuuaucaugcauugagguuuaacauuugcaccuuuguaucugccaaagaugguuucuuuaugauaauuguaucauaaaagagucuuuauuauagccauuuauggcuguguuuucucauuugacuuuuuaccuguggaccagauaucugcauggauguucugugcaacugaaaaucauuaauaaauaaucugaauaucacaaaaagagcauggguaaaugcaagaucugaugugguaugcacaugugacugaguagugggcuuugagaaggagcaaagucaaacgugaggcaaauguuggcacaagucuuccuuuuuauugauucccaauuccuauaugacauuagaauuagaaugaauguuaaaaaugcaguugcuguguggaaaaaguucaaguuaauguuauuggcuugagaauuuuucugcuaauuauuuuuuauuuuuugaaaaaucuuuuuauuuuccauucguguuuccuaguguuuuccuuccauuuuucuauuaauguauaauuuacaugcuguaacauuuacccuuccuagcauacaguucugcagguuuuggcaaauguauacagucauagaaccaucgugauaaucaaguuaaagaacaguuuuugguguccuuuguaaucagccccucuccccaccccuguuuucugucucuauaguuuugccuuuugcagaauauauaaauaaucacuaagcacaguguguuugagguucauccacauuguugccuguaucaguaauuucauccuuuuuuauuggugagcuguauuccacugaauggauauaucaccauuucuuuaaccauuacccacuugagcgacaguuuuugaccauuacaaauaaagccacuauaaacauuugcauacagauuuuugugugaacauaaguuuccacuucauuuggauaaauaccuaggcauaagauuacuggcuugugugguuaauguauguuucacucuauuagaaacugccaauauauuuuucaaagugguuaugccauuuuguagcuccaccugcaggguaugaaaguuccaguuccucugcauccuuuccagcacuugguauugucaacauuuuguuguucugcuuuuguuuuuugaaguuuagcuauucuaauagguguuuaguggaauuucauuguaguuuucauuugcauuuaccuaaagucuaaugauauugaguauuucuucaugugcauauuugcuauccauguaucuuuuuuggugaagcgucuguucaagucuuucagccauuuuuuaaaacuuagaauauuugcuuucuuauuacugaagucugaaaguucuuuauucuguauauaaguccuuugucagauauaguuuuuaaauauugucucccagauuguggcuugucuuucaaaaagucucuuaauuugcaaaugcuuauuucauacauagcuucuuuauuuuaucgccaauacuucaugcaccguagauuucaugcagucccagaacuacauagcaagaaaguauaguggagcaugcaguauagagcuugcccaaaaaauggaauaggagagguguauuuaggauuuauuauucaaagccauggucuaggccaagagaaaaggcaguuguuauuuuuauugcucaucuguauccagaaacacaacucuccauguccaaccaguguacuuuuugaugggaauguguugucuuagcucaggggugaaaacagguccaggggagccucugcauagguaagaaugcaacuguguuguuuugcauguauguugcauguguguaugugcaugcagacaggagagaaagagagagccagagggacaaugagacugagacagagacagagguagaagaguuugguauuaauaguaugagauucaguccuuaugaccacaugcccugcugcugaagagggauagaauauauaacuccauaaauccugaaagcuuccauucugugcuuuguggacaauuuaaaugcuuuuccagcgguaucuuugauuguauacuuuuuuuucuuucaagccaguuuccuaauucuuacauuucauguuauuucauuguaacaagucagauuagagaaaauagaagugguuuuucagaaacuauuaucuguuuuagcagguccgaaauaaaauuuucccagugaguaauggagauguguagacuguacuccccuuaauauaauuuaacaucagcaaaaguccacuccuuuuguguuguucucucucuuuuggaguuauucugucuuauucuacccugccacccugcugacuguuucauccauacacuuucugacagugacaguggcucagggggaaucucuguuggguuuugccccuuuggaaacuuaggacuucauuuuuaaucauuauucacuuuuaucuuauaaaauauaagaauucauaaauuuuuaauacuggaggaaacuuuagagagaacuucuauuccaggccuucucuuuauggauaagaggaucaaggcccagaacuucgaagggacuccuaaucuuggagcuagaaugaauggcaaaauugaacacaggccucuuacuucccaguccuguguucuuuccaggcuguaacaaaaggaaaagcugcagauggugccuggaaaggggauguucaaaaguaugacucaaaugagcuuugggaagugccauuguauuuaagugugggaauaauuaagaaugaacuggugagacuguucaagaaguugucucaagcuuauagagaaagauagaaagcuuucaauucauuuaagggauuaaguugucauaucgagaguugaguguacagcaaccaaauaugauuuuaaaauaaauaaaccaauca

SEQ ID NO: 14808 - RNA, 1128 nt, Homo sapiens
gauggcagccaccacaggcucaguaguaaaagucccuugcaauuuccaacuguuggaagaacucgaagaaagccagaaaggaguaggagaugacacaguuagcuggggucuagaagauuacgaagacaugacacuuacaagauggacagggaugauaauugggccuccaggaacaauuuaugaaaaccgaauauacagccuuaaaauagaauauggaccuaaauacucagaagcaccccccuuuguaauauuuguaacaaaaaauuaauaugaauggaguuaauaguucuaauggagugguggacccaagagccauaccagugcuagcaaaauggcagaauucauauagcaucaaaguuguccugcaagaguuucggcgccuaaugaugucuaaagaaaauaugaaacucccucagccaccugaaggacaguguuagagcaauuaaccaaaaagaaaaaccacaggcccuuccccuuccccccaacauucgauuuaagcagucuucauuuuucaguaguaaauuuucuagauaugucuuguagaccucagaguacuggaaaggaagcucccauucaaaggaaguuaagauacuguaaaugauacuaauuuuuuguccauuugaaauauauaaguugugcuauaacaaaucauccugucaaguguagccacuguccauguaguugaacuucugggaucaagaaagucuguuuaaauugauuaccaucauaacugguggggcacaucuaacucaacugugaaaagacacaucacacagucauuuugcugcugauuacacggccuggggucucugccuucuccccuuacccucccaccucccacuuucccugcaacaacagccgucuagccuggggggcuuguuagaguagaugugaaggcuucaggucgcagccugugggacuacugcuggguguguggggugcuuugccugcaccccugguuuaagucuuaaaugaugccccuuccaagccaucauccuguccccacacuccuccacucccaccuuuggccaaagcauagauuguaacccuuccacucaccucugagauuggccuuuggugaggaauucagagcuuuccccauaucuucucucccccaccuuuaucgag

SEQ ID NO: 14809 - RNA, 123326 nt, Homo sapiens
ugauuguucggcugcgaggucggcgggacucuugcugcgcggaggagccgugcggaacccgaggcugcgcgcgcgcgcgcgcucucuggccgcggcguggggacagcgaggcgcacuggggccucccagcgcggggccggccgcgccguccagcccgaggucuacggcuuugcgcuccgagcccagaggaagaugccugccggcaccgagcucgggcugcggggcugaacgccugucuuccaggcgcagcggcagcacugcccucggccggugucgguagcggcacucggcgugccccgggcggacgaagagcgcaggcuggguacaccuugcccgaaucggcggaguucgcagcuagcgcgggcgggccggccggcccggaugggcgcgggguuugcggcccccgccgggugcuccggagcggcccgggcaccgggggcacgcugagugccggagccgcggccgcagagagaacuuggggcgggggccaugccccggugcggagucuagagccgagcggagcgccccgcgggcccgcccgcgucugcggccguucggguccucacaguccccgcgcccggaguucgcagcgcgcuccagacaagauggcgcggccgguccggggagggcucggggccccgcgccgcucgccuugccuucuccuucucuggcugcuuuugcuucggcuggagccggugaccgccgcggccggcccgcgggcgcccugcgcggccgccugcacuugcgcuggggacucgcuggacugcggugggcgcgggcuggcugcguugcccggggaccugcccuccuggacgcggagccugugagugccgcccuuuccgcccucucugcgccccggggcucugucacuuggggauggagcggcggggguucguacucagggagggggugcggacuggguuguguguguggaguugugcgugcuugugcguguuggaagacugucagguuggaguggcggaagggagauucugcguggagguccgggggaguaggcgugcgagagagccuggagaagaagagcgugccucguggggucuggagacgagcgagcgugggucguagagauuuggggguuagccagcacgcgucgugcgggccaucugggggugagugagugggagucuggagcugaguguguuugcgggugggugggugggaaacgucuggagaagagugugaagaagucuguggggguaugugggugcguuuccuuuuccucuccuguaauccaacuauuuggugucugagcuccuuggucuuccaguggguaaugaaugaaggugacuguuggguccagucuuucguuuacauuauuuauuaguugauaguguguguagccgucuccugauccccgaagaccgugguggccugacuugccucucugugcggggcagaaggcagucuucccccgaggaccccugaguuagagggcuuugacaguuccuggcgaccugugagugcugggaguuuguccuuuuacgccuguuuggcauuuuacggaacuguguuccagacccuuccuguguguucccuggggccccauugggcuugaugauccagugggguggggcccacccucaagacucucuccuccauaaauggugcaaaugaguuuuggagaagugcugcuucaggagagggugccaggggcuuggcugauuuaagcuguuuguuucacccgaaagagguucuuuucugugcugucaggaugugggcuuauuaggacuuagugggacacuucuuacaggagauuugacaggaaaaaaaaggcauuagacuucuguguaaacaugguagaauagaauagucuucuuuuacuucuaacaaaucuggugcaugagucaaaucccguucaguuauggguaauuagcaucucuguagaaccauuaguaccuuuccagaaaaggccuagcuuaaauaguccgcauuucgguugaauaauuggacauuuuuccuagaacauaggaaaggcacagcaguaaccuuaggcaugacuauggcuguuuuaaaaagagaaaacuggugucacaaguuguaaccagcaccuguggcuugaucgaagaaaauguggccuguguucugacuaccgugaagggaagaaaaguuaauuccuuuuaaauguaaagauccuguaccucucaaaauggggcacgaaucuuuaacuuggcccgagacacugcuccaugaacaaguacuacagaguucugaagacaaccaggaacccuuuaguuacaguuagguuuucaauaucuacuucuucuguggaauuuacugaguuagugaaaaucaguggucguaggguggaggcagagcuuuugugaaguacugggagauagagcccaguauuguccuuagguagucucuuauuuagucugggguauugugauuuuucccuuacauacgguaguuuuuuuuuuuuuuuuuaaauagaaucaugugggcaaaaucagauuaacuucuuaaguguucaccuguuggaagagugacucccaaugccaugugucaguggcauuguggggaaagcacuuaguuccacagaaguaacuucccagagagggcaggguguccucuuauuugcacuuuccuauggucacaagauccacuuugccuugcccuuuaauuuuuggagcaaaacauacugguuauuucuuuaggcuuucuguugccuaggagugacauuucacauggcauaaauaccuucaaaauugaaguccuucucuuuuacucacacauuugaugaucgagaaauaccaaaguggguauuuugagcaucaguagacuuuaguauacugauuaugguguugacugauucgauuuuaagauaugagcagcaugauuucugguuaguauguagcaacacaguaugcagugcaaaauggcuauccuuugaaaaauauuugugaaguuuucuuauuucugauuaaggacaaaucaagcaaauguguucuuuuuuucuagacuucagacuucugaauuuaaaucauuagucuccgugagucuuauucuggaauuuccauaagaguauuuauaugguuuguauuccuggcuaagauucagcaagacuuuaggggagaaagugucuguauaugauauaaugaaauaucuuguaguuucaccaaguuuacacgcucuaagcccacggugucuagaaaaugcuuugagcuaguuuauaaacccaugaacuggauuuacugcagcuaguucaaacaacuucaggcuguggguuugagauagcagaggaccuguggcuuuaugggaccuuuuuuuuuuuuuuuuuuuuuuuuguaaacagugcgucugauguggaaguugcuucuaggccugauauaagaaaaauaaaacuuuuaaauagugaauguaaaugcagugugaauagaagaaacagaauggauaaugauaaucgguucauuuuuggggccugaggauaacuuuucagcacaauaacuuacaguuguaguagucaagccauaauuuaagucucccagcccauuacguaggugagauuggcaugguccaacuagcacauucauaaauagcaccaagccacugccaagccuuauuccaacuucccagaaccugagaagaaguugaacuucuuagaacucagauauuugcuuucuuugaaauuauuuuugagagcauggcuucagaagcuauuuaagaaguauuaaauacaguuuaccuuagacucuuaccugugccguaaauuucagcaguguuuagucacaaaauguugcuaguuuaaauguccugagagcugaaugguagcccauugggauugggauuaggauuaggaaggcaggccuagaggaagaacaaacccugauuuuuguucucaguguggagugaagaugacagagcauucuaaagcaaggauauucacaaaaguguauaccaagugugguuauccuaagccacauuaagaugaguuuauugauuuugaucucuuuguacuauguguuugcaauaccagaucaguuagcuuaaaucuaaccuugccaguuuuggcaaagaagugguacuuaugauuaccuuagaaaauaaacaccaacugugguugccauugugguugggaagcaaagagggccuuugucuuucaaauuuuacagcugugcuggaaggcccaggugugcaggguguugugaauuaaggguuuggaaaauacuuuccauccuguuuaugcaaauuaaguuuaaagugcagaucaccaaauuguucuggaaccuaaacugagauucauguuuuuuuuuuaaaguagauuguuguauggaugguccugaaauauuuccuucuccauaucacuuaaacucaacagacuuugaaacaaaagucuuccgauuugugggacagggaagaaccuggguuguuuggaauagggagcauuuuaaacacagguuaauugccaagaauacagucugaaaggugcaagugcucuuagaguuucagggaacuuuagcuugagcucagaguccuuuucuuuugcaacaagugucuucccucuuguugggggauaacuugucuguugauagcucucugacaacuuuuuuugaguaaggugagauuucuggcaaauaauauugguugucgugagaaaaaggcacacuguuuaagucuugcugauaugaaauuguggccguaauaucuauucuuugaguacugcuaaaguaggaaguguccagagauucccagcgccccauguaaauuaacuguguauuggcacacaaugucccucuugccuuuaggacaugucagaacuguuccugccccgcuuuucaagggacuguuuuaaaaaguaguguauugucucuuugcauaauuauauuugguuacuagauuuuacagacuuuggacuuuugaacauauuaucagcaguaauucucggaaccaucuucagaaagaugaagaaaaauuaaguguagugugaugagagcugguuccuaguggauguccucaugucccaucuccccagcucugcaccguuagcugaaagcuuuccucccuccaguguuaauuacuuugccuggguucucccugcagcuucccugaguccauugggacggccucuggcugaccuuucucucccucagacaccaugaucacaaugaaagggccucucccgcuucugcaggggugucuccuuggugcaaagucuucagccuccucucuuucaggguggacaggaaugcaggagagagcacugggguuuugugugacuuaacaaugcaccuggcccagugcugugcaccugcuaaagcccugaaggucuguuagauaggaaggcuggguggagguuguuuaaaauagccuauaguuauuuaaaaaguggcaugcacaggagagggaaaucuagaagagggauucauugaauugaaaguuguuauaugcaguaaaggauguugguuguaucagagucuuucuuucuucuuuuccucguuuguuuaaaacauaaaagggauuccucugaccuaccccauagguagaaggacuuuaaguuucacgagcaagccuaacuuucaauuccuuuugaaugagcuaugugacauuuacucacuggguacguucccccuccucagugacugcaauuugaaacccugggggucuuuuaaaagcgaacagaacucugggccguguuaauauucagagcuguuuacaauggaugcaguuucaaaggcugauggcauugucuugagacaggagggaggacggguggaggaaaaauucccaggcagggaagggcaaauaucuaaaaaucuccaguguuuaccagccugugggaaauuuagggaccguuacuguuauuuuuuaugacuuaagcaugacacugagccacuaggguucauucuaucuaccucauggcuucaguucuuguaugucaguuaugugguuaucuugugcuuuuguuucaaguuaaaguguggaaauugguaagaaacucagaucuuaucuccucuggaaagaaauagagcacuuugaagaccagugguuaacauuuuuauaauaguuuaccucugggaccugcauuuauguuuugcucaaagaauuugauauagcugcacaguuuagaagagcagucccgacugaccaauuaauuguccaauuaugacuaggacugagaaguuuuuugcugaaauacuugauacaugaccauucuuauuaagcaaaaugaauggaucaauaaagauugcagaaaaaauuugcaguuuauugauggucuaauuucuaguugaaagucggcaauuugugucucuuuuuuguagggggugguggguaugcuugugaacuuuucuuauacaaaggcuuuuugcuuuauauguucuuauauucuuauauuuuguauaauuuguuaucaaugguuuuuaccuaaguacuuuaugcauagucuuuugaaacacaaguuauaacuucaaucuguucauagaaguccuucaguuuuuuaagcuguuucuccauuucacuggguuuuauacuuuucauuuccugccuuuaguucuuuauaucuucuaaaugggcauuugcuacccagcugucuccuggucuccauuuggguuauugacugggggagagaaugggcuagggacaaagcuuuccucaccuuuacuguguuaaauaugcaggggcucuugccgcugguggucacacccaacucacacucgucauuaaggaguggcggugaagggguugaaaguuaauucugugguccaucccuggcaccuccagucuacagcuacaugugugauuuugggcaaaccucuucaugucuaaaaagacagaaaaaugcucuaucuuauagaagcugugaggacaaaguuagaugaugccuauauuuagcuagguuccucaacuuggguccaucuacuuuaugaugauucuggagcacaauuugaagguuaaaggccucaguagcuccaauuuauuauccugucucacagccagucucuccaagccagauuccuuccuucuucccuuccccuucccucccccacucccuucccuucccucuuucucuuuuucucuuucuuuucuuuuucuuucuuucuuucucuguuuucuuuuucuuuuuucuuucucuccucccuucuuucuuuuuuuccuucuuucccucccucccucccuucgucuuucuuccuuucuuucucuuucucucucucucucuuuuuuuucuuucuuuccuuucuuucuuucuuuucuuucuuucgacaggguuucacucuguugcccacgcuggagugcaguggugcaaucaagacucacugcagccucagccucgugggcucaagcaguccucccaucucaguugccugaguagcugagacuagaaggcucaugcuaccacacccagcuuccaagccagauugcuggugacagaggcuuuccugggaaauguuuaccuuucugcugugaaggagucuuuuggaaugggaagauggcagccuucuccugugaguuuuggugauauguaugaagcggccuucucccauggauuuuuggugauauguaugaagugccacaagugaaccucauguacccuuggaaaucuuagccaaacaggcaggaagcuaugaacaguugcaacagauuauauaauuagcaaaaauuauugagguauuuuauaaaucuauuccaguuguacaaauaguuaugucuguuuaccacuauccuuuuggaagggaggcagguaugggaagguggcagggaagugagaggcccuuaaacuaaucauuuuauccuauuauuucccaggguuucauugaaacugagcccuaccaaggugcaaguagcaccucucagucaauagcuuggaaaaaugcaggugugcucuuccaaacaggguuaaguuacagacuuuagggcuaacugaauccucacuguacccgcuucucuuuggaaaaccuugagggaggagggaggagggaggacaggagacaauuguggaguuguaugcaaagaacauuuuucauuuguuuuggucuguuuggaauugcauaguaacuuuguaggggacacaggcggggaacacagggucauuugaggaaucuggcaaggaugccaccugaaaagcuguuuacuguuugcuaucacuccuugugcaccuguaccugaguuccuuccccagugaauggccaugauucacagccuugcccacgugaacggccacgauuguuuucgucuuuauuacuauuuaaucuagcauaaccgguaaggcccauugugcgaacaaccaaucuguucauuucugcaaguccuaauacauuuugguuuccuuaugaaccaggaugcagguucuaauuacugcuuguucaguuuguuuuggcaaaaggugacauuuagaggguuuaaagaaagcauggccucuuuuuaaguguuuugcguugauuaguuuuugaacuuuuguggucaaaaguucuaaucucuuaucuuuuaugaucugcauucucaagaucucacauuauugggaagaaaaugaaggaaaugagugaaggucucucuuacaagcagaauuagcuggacuuugagaaacacgaugaacguaaugcaggguuuuucuucuuuuuuuuagcugauuagaaaaaaaacaacucacaacuuuauuuucuaagacuccuuuaugcagcauuuaacagcuucccccucccuguuuugcuccuuccaccaauuuauaauuugccauugaaauauuuuacugcuuaucuuggucaaagcauacauugcacugaacuucuuuucuuccggauuaccuacuugaugauagccuguuaaaugcaaugagaaggauugaacacuucugaacuggaggauagauaaucuugcuguuguuucaaaucuuguaguuccagugcucuuuuguuugaaagcauuugucucucaagcauuagcacuuugggcuggauaacaagaaauuaacaagcugggcucugcuuagagaaaacuuacaacugauuagaaaguaagcuguugcagguacagcuucuuuuucuugagagaugaucugaaauacauagcuuuuagaaaaaauuuugaauuaagggaacaguugauaugcaggcagguaguuuaaauaaacuaacucacuucuguugcucuggaguguuuuuucuuaccuuuugaauauggagaaagguaaauaucuacacaaguggacagaauaauguaaugaacucuagguaucugucacccaucuucaacaaucaucagcugucuuauuugaucuauuucccaauaugcugcugcccuuccauguuauuuauuuauuuuuucuuuggaaauaaaucaaaggcauaucauuuuaucugcaaauguauagguuuuuuuuaaguuaacagcuuuauugagauauaauuuauauaccauacuauuuacuguagggugguuuuaagaaauuggaaguuuugaaaaaauugacauucauuuuaacuguguuuuuccaaagggcguuuugguaagcuauauauuuacagaauguuuauugggcacauucugugugcacccuaguuuauauguucucaaaauacagauuuuuuuucuuuuguaggagguguuuagcaagcucuuuugugcuaguccucugccagaaugugcaauucugauuaaccuuccacuuucuccacauagcucuuacuugggagguuucuaccaagcuauuaauuguugauuaaaauccauuagugaacaaacauaauuagaaauggaauagaucauuuaaaaagugaugucucagauacuguuguuuaguagagggauaauuagccguugguuguaguuaagucaugagucugaauugaguuaacuauuguuuacuuuguaaggccugacccuccagcuguggcuacuugaggcugcuuuaaauagaguuagaggcagccuguaagaaaaaucuucaaaaagcaaagaacuagguuccuggaacccucugugcuugauuuaaacuucacacagauuugaaaauguguucuccaaguagcugcugcaugguuuguuuuauuuuauaaaaguccauaguuuaauuucuccucaguccgguacuuuguuggugagggggcuucuuuagaauggauuuuuugcuagcugcagcuucauuuaggaaucugagugggaauuacuaguccuccaaauuccauucacuuuauccuaguuuuuggaaugacuuccaucuucuaucugugaaaaucaaauuccagguagauuauggaguguucgguggccuuaaaagcuguccaacauggucagguuaaacugguggaucugugaagcuuaauuaaauuuauaugauaaccgauuauacaccauuuacaguggguucucuguuuagaaaaguggaagcacgcuccaaugcauuuuuuuuuuuuaaauuauggggcagaaaagcuuaguauugagagauucuaugaaauuaagugcuguucugcaaauuaggagaacaccauucuuucaucugguuuuagcaguguggugguaccuugacccagcaucaugccuccgucuuaguuuucguuuuauuuuuaauuaagaagaauuuuucucugugucugugguuuccucccuccaccugggcuggugugaguuucuggcacacaagcucccagugcuugcaaaacuuauaaacagucagaagagcucguugcuuccaggaagugaauuguugaugcaaugaagugauggaugcagaggcugcagcucgaagggagcaggguuuccuuccaucuuggaggaggggagauccagaaaacaagcugacaugcccuguaguuauuaagaucugccucaucccaaauuccucugauuguuuucucagauuuggagucuguguaggacucuuugcuuugggugguuuggccuuauccagggcuaugcuuuacccaauggaaaaaucagagacucuucuauggagauuuuuggguucuuucacaaggucauuugaaacaauacuuagaaaugaguaaauuauauucauuucauuacuauccuaaaauaaagauuggcugaccuuauuauuuacuugggagaaacuuuaugugaagucguggugcucagaaugucuuucuggacagaaaggagaccacguuuucauggaguuucuuaaaggggugcuugcccaaagaggcauaaaaaugauucaccugagaggaaaaaauuaauuuucuuaaagucaugaaagugaggaugugguagaaugggaaacuagcucauggcugggccucaggagacguugggguuucgucccagcucugccacugauuggcagcauaaccuugggcuagucacuucauuuccugucuguaaagggauguauaauuucuaagaccccucauuuuuagguucaugauucuauucuaauugaagcaaaaagggaguaaacuuauauuucauuggaugguaagaauuaaauugaucuguaucuaggauacuuaaacauucucucucucucuguguguguguuagacacacacacacacacacacacacacauacacacaaagggucccacucugucacccagguuggagugcaguggcgcaaucauggcucacuauagccgugaccucccaggcucaagugauccuccuaccucagucuacugaguagcuaggacuacaggcaugugccaccacaccuggcuaguuuuuauuuuuugugaagaugggaucuugcuguguugcccagacuggucuugaucuccugggcucaagugauccuccugccuuggccucccaaagugcugggguuacagaugugagcuaccaugcuaggccaauguuugcuacuucugagugaaauucucagauggauaccauaagcagcaaagagaaaaaaggguaugugcaugcagagucucaaugagggacccuuuugugagccuugagauauuauugaggaggagugaauacuccacaaagaaaguggugcuuuccuucauuuuuaccuccuuuuccccucuggcccaaagaaaacuguggaggcugguacagauccacuuucgaucuuugauuuagaauuuuaagaacuuagguaaaaauuuaaagaaaaaaaaccaggaaaauaaauuacaggcauguuuucccaaaggguccuuucucagggccacugcaggcagcaucuuucucaggcaguccuucagugaauacuugccauaagugaaguuguaaaugaugcugagaaacugccuuuaaggacuggaugggccaccugucacauucuauagucauggccacaggaagggcagcuacucacugcacugccuguucuuucugggccagcuugccaucccuuuuaccagggagaucuuucguguaucccuuucaagauagaaacucagccaauuaacauguacagccuaguggcuuccuuuuucuuuuuugaggcagagucucacucugucgcccagguuggcgugcaguggugugaucucagcugacugcaaccucugccuuccuggcucaagugauucucuugccucagccucccaaagagcugggauuacaggcgccugccaccaagccaggcuaauuuuuuuuuuuuuguuuuuuuuuaguagagacaggguuuuaccauguuggccaggcugguuuugaacucaugacugaccucaagugauccauccaccucagcgucccaaagugcuaggauuacagaugugagccaccacgcccggcuguggcuuuuucuaauuuugaagucugacucuguuuuuggccaaauucauauuaaauuuacccaucuaccuagguuugcauugguuaccucuuaguuacacuguuuuugaaaaucuugaaaauuaugacaguaauuggacuccuuaaaauacuuuucauggagaaucuagaagcuuuuauuuucuuuguucuggauguccacuuuucuucgacguggaauuuguuagugccuucaguggaaauucuugggcuuuucuuuuccuuccacucauucuuuaucguguaaauuuucauaaaacgaaacuuccggauuuaaaauuuauuuuuauuuuuauuauuguuuuccggaacaaauucuuggaauuuggaguuuuguuuggggauacaacuaaaaugcaaugaaguuggaggaacaguuaguggucuggaacuucuugacagaaguuuaacaacaauuagggacuacuuuaggaauagaguguccaaaaaacuagacuuuacaaaaaaaauucucccuuuaagaaccaaagaugaccuuuuuccauugugcuuucugagcucaaaacaggccaaaugauguucccacccuucuucgagccucgugugucagugucacacacucucccuguuacucacuuggucucguucuggugaauuuauuguugacaucucguccuuucccggaggaaucucugagucuaucugauuagguaacucuucacacaucccuguauguguguauguguguguguguguuucucuccacuuagacuugaaagcagcagggaucauucaauuucauguaccuaggagucccuugauaauuauuuguuuauugccuuaccacuuugucuuggagcuugguacauucuuucagggcagaacggaucccccaguuucauuguuucucuaagggguucugagguuuaccccugaaguguaauuuuuccugauuggccuguguggaggacuucauaggaguguuuuuagaauuuaaauaucaggaguaaaaggccauuuucuuugugcugagggucuguuuuccccucuggagccagcggcuaaaugcagaggcuuucuucaauugcuguugcuucuugcaguguggccccucaaugagaagucauagcuugugguuugucugauuuuauaugucagaacuuuuagagagaauauuugaccuaaaacaaaaauuauggauaguccucucuuccuuucccauuucuccuuauuuucuacuuucugcuugagaaccacuucaaagaaucagauguguuggugccagacgccguggaguuauuguuagaagaauuuggaaauauaauugaaagcaaacuuuguugagcaaagcagaucuaggcaaguuuuuacuuugagggcgaagggaauuccaaguuuuuccucuauuuggagcugaugucucagaacacuuguucugugagaugaaucaucugugaauucuacaucugggaguuauauauugggaaauggcauucuuuuuaaauguagaagaaacacaaaagcguaaaguuacaguguaguuggaaaauucuagucagaguuuaaaauacuagcauugaggugaaauuggcagagugauuggacgugagucugugauaccuaaaauagacauguccauacauggaaaacaauacgauagccacacuuacuuauugugacccuuuucguuuguuuugagacauuuuuaaaaagucauaaacaucagcuauucagaaucauuaguugagucgauugugacuugagaaucagaauuuaagcguuugucuugagcucuuuaaguucaggugccuugcuaaccagugaaaagcccagagcagugcaguauuucagggucuucaggggaagauaauguuguguccuugucuucucagaguccugcauuccaggcaucugguuaugaggggccaugguuguggggaugcagcagcugugcgguucaugacgcacggugguuaagaggcagcucuggggccuggcugccugggugaccuuggcaauuuacuccacuucaguuuccuuuucuguaaaauggggauaauuguagugccgacuuccuuaagcuuguuauaaggaaaaaaaugaaauauuuaacacagggccuaacacacaagcagaagcuugaggaaggguagcuauaauguuauuauuauaacugucgcaauaauaguguaccuuucugcagcaggauauaucuguguuaacugaucaucaccaucuuaacucuaugaaaaauauugucucuguuguauacaugaggcccagaguaguugaaugacuuguuuagagucuagcacuugccaguuagaauucagaccugcguguacauguuuagaagaaaauacgguaagacuagcacugccuucuuucuggccucccuuugacgucucugaauuccuggaggccgauuggucuuugguggcuugaagcaccuaguguaguucuggcuguacagcuggugcucuauacauggugucuugaaugugaucuugaagagcguguuucuuuguugguaggcgugugugucagauccauuuuugguuugccuguuugguaaagggggugguaacaugcacauauguuuugccaucuguuguuuauuguuucuguuagguugugguuuguguuccuguuccauguuccuuugguuucuggagcaacugcgaauauuauaugcuuggggaucaaaaaaaguaaacuauuuauaaacaguaaaguauccuuggguuuggaaaguguuuuucucaaaugcguguauauuuguuggcuuuaugaucaucucacugaugaaucguuagauaauuugcagacugagacacaucuaaaagaugggcgagucaugguccagccuuguguaaccagcucacagacagccuuggugauaaggcccugguguuaacgcugacccgagugguguauuuuuaacucaagaacauauaaacaguuuagccugcugauggaguuuaugcaccgccugaaaucuuuggcaugccuuggauuuguggcucuguaagauguacguaguccugggagagugcuguggccgccagugacccacugcccccacccuucauucaaaagaaaaggaauguagcagcaagauggaaggagaaagguggaauuuaucaauaauuuuguaugauaauuuuuccuuuuuuuuuuuuuuuugagagggucuuaaucugucacccagguuggaguacaguggugugaucuugacucacugcaaccuuugccucacagguucaagcaauuuucccaccucagccuccugagcagcugaggcuacaggugugcaccaccaugccuggcuaauuuuuguauuuuuuggggguagagacaggguuucaucauguugccuaggcuggucucgaacaccugggcucaagcaaucgcuggccucggccucccaaaaugcugggauuacaggugugagccaccaugccuagccuguaguauaaauuuuaucuuaaauuuuuuuugucauuacuauuucacuuuguuaugcagacuuuagagggaggagagagcuuuuuacucacaucuguuugcaaccccuugcccccagcuguaggggucuuugcagaguugcaaauuggagcacaugaaucccauuguuuaaagcuguuacuguccaccugccccucaucgcgcuucuuaccuggccccaccugucccagccaccacguggggcuuuuuaaaaagacuuuuuaaauaccaccaugucccaugucccucacccaccauuuccucugucuggagaaugggucuucccucuucgccuugcagauuucuguucaucugucuuaaacguuucuccccauagaaaccauggcugacguucccuuuaaguuagauucccaucgugaggauucugcagugcuauguauagaaguuuugugugaauguuugauucguuucugacuaccccauuagucuguaagcucccugaaugcagugacuggcuuuguuuccaauccaccauuguauucccagaaucuagugugaagccugugacacauuaaaugcucgugacagauaccaguguagauagagauaguggcauucauucuguagaguccuguauguccuguggaaauaccucugccagauagaauaauucagaccucccaggcuucaucuguguauuuccugaauauaccuugcuuguuuaguagcuuccuauaccccucaccacccuccaccaaagucucuuaaguguugagaaacuuagaagaauggaaagaaagaagaaacaaauagaaccgaaguugaaaagaugacaggcuguuuaccugccacauuuagaauuggcggucuuuuuggucucucugaauuuuggaaaagucccauaugcaagaauugucacugaaguggcuuuguaguuaaagcagugcaugugaacuguccccacaugagguccucgggcgccucgucccugcuggauugcugguggcuguccuuggcaggugggccaggcucaggcgcucuccucuguguugcguuuggcgagggagcccgcggugcccuucccagcuguugacauggucucucaucugcucuuuugcuggagccgcguuuuggagccugcuuuuccagaguugacacugcaggggaggguggcuucuuccauagaccgaggcugucuagacacccuuccccuugugguuauucugcucaguuuaugcugagcccucgccaggcagcugguuucgguugcuugagcucuuacuuugcucaggccucugcuuugacaaaaaggaugaccaggccaagguagcuuuucucccucuuugcugcuggcagagagaaagacugcuuuccuugaccagagggagcugugagaacacuaaggacagguuacccugcccucuguggacccagcccaaguaacuauguaaauugauagaagcuucuauggcaggagacuucaggcagauacauuucuaaaucugggccuuuuuagcuuggacuucagaugugagacauuggcccccacccccauccucagacacgcaggaucuccauccauggcagagagagcacugcgaacccagcuggcagagcuccucucugggcagucucccaggcaugcuagcaaggggcaaugggaagcuguguucucccugaugagcucagccucacauguuucuuuuaauggcuaucgagaucuuggacugugaugcuguagggaagccuuuuguccccagugagcuggaauagucuaggcagauuacugucuugguggccuuacggggggugcuggagggggugcuauugaucuguuagccuaguuacuaugucuuuauuacuuuugauuuucuggugacaaauguuaggcauuuauugaauaaagaagaaaguacaaaagaaaaaacaacugauuucauuguucggugauaaauauuaucacuggauaguguauaaauuuccaguaaugugugaggcugaauaccuauuucaguuauguuuuaaagacucaauaucuugaauauuuucccugacuuuaagcaguuuuuaaaaugugcuuuaauauuuauuguauaauaaauuauuacacaacuuacauaaaacuuguaaaguuucucugauauugggcauuuaggcuuuuuccuaagcuuugauagacauccuuaugcauaaauguuuagccauuuauuuccuuaggaugaguuacccaauucagauagcgcuggauaugcagauucuuaauauuuucgguaccacugccucugagaaagaggcugccaacuuacaugugaacuugugcuugucccacacccucacaaacauuaaaugcuguuuauuucuguaaucauguaccaguuuaauggauggaaauugccucagauuauuuuaaucugcauuucuuuggauguugaggcugaagacuuuacacaggauacucccagauauuuccuuuuucaguuuccuuccuuuguugaugcucagcccaguacaucaucugcuguccuccacuguggucuuugggcuugagcacaguacaucucuuugguacuagggaagcuguguuucugagagagcacagguguaauugcauagaaaacugugcucucaacaggcaugucacauguuuugacucugaaccaggacaucuuuggguucuucuuaaacagauguggacgcguguugcggaggggacuguugcaguggcucuguugauccuguacugcugcagccuucugcagagccagccugccugugcccaggcugcccggucuguggccagggugccugguaccuacagcugguaggaaucagcgcagauuagcguggcugagaaccuuucaggaacagcuuccagcaaauggaaauuauuuuaaaacaaauuuaugugguuuuucugucaaaccuacuuggagcauaaacaagguugaauuguaagcugcuucccuucugcaagcgagcccauguuuagaauguggcuuucagcaaaguaaacauggucucgaaagugaguugucauuguaugcaugugcuuugaaaaguaaaaguagugcacugaacgagcauucucauagauaauugugauagaguuuuagacaucccuucucguuuauuugucuuccugccacaaagaucacuacuuccuguaaagguuuuaaagguaaggaguaauuugguauugaaaggauuaagggaaagaaaugccaggucaguuucuguggugagaagcauuuuaauuuugcuccuuugccauggggaauauaaaaaacaucuuuugaaauacuuaauucugugugcaugcguguguguauacacguguguguguguguguguguacauaaacccuccggucugugcaucuuugaauucucugccaauuucgaggugguuccccccacccuagggacaaugucggcuuuauuaaauugggcacagccucccuagaaggugaaacaaugcuuuuaauguucugauuauauauuaaugaacaaccaggccaaggggcacuugccaaaaaagcuacaaagugagaaagccaccaauaucagagugaacuuugcacucugaaagugugaaugauguugggugaaagaguuuauggcgcaaggggagcaacuggaaucucuuugauguuguguagcauccuggccccauuagacuuugggccuucccguuuaacugcaucuuugcuggcgagggcagugcugagguguggucugaaauauagagggaccucagccacagaggacuggcauaccugugcugggcagggggaccguuggccauuucuaucuguuuucaaucaacuucaacaaauuuuaaucuaacacugaaacauauaguuucacacccccacccucccagcuuuuacucuggagggacuuuccagaaauagcaugcuauuauucucaaauccgccugccccaaccacagaaaaggguuagaucuuaaucuuaaucuaacugauuuauuuucuccccauuguggugacauuuccuccugccuucuggcuuggucuuaauuuuugaauggccacugggagcccugcuuuccacagccuugcuaaauaauuucucaaaggaagaaaagaaaugcucuuucaaaaugccaagaauguguuuucugugggaggguaaacucuagcugagguuuucugcaucugauggacucauggacagagcuugggagcgaguauaggacaaucugggaagcacacagaagcugauguucuuucuggguguucuuuuggguguucauuuaucuccuggcacguagaggggcaguucuuucugcauuucugugguauggaaguagcuagguggcauuuucagucuggaauucugagagccugcuaaggugggcaacaggacuuuuuuuuuuuuuaaauagcuuuuuugagaugugauucaaauaccacaaaacucauccuuuucaaugauaggauucuggguuuuuaguauauucguagauuugcguaacuacuaaucuagaacauuuucaucaccccaaaauaaaacccuguacccauuagcacucccugccuauccuuccuuccucccaucccccggcaacaucuacuuucugucucuauagauuugucuguucuggacaauucauauaaauagaaucaugcaauauauggcccuuucuuuuacuuaguuacuuagcacaguguugucaugauucguccauauuauggcagguaucaguacuucauuaauuuuuauggcugaagaaugcuuccaucaugaggagagacuguauuuucuuuauccacucaucaguugguggacacuuuguuuauuuccacuuuuuggcuguaaugaacaaugcugcugugaacauuugugcguaaguuuuuguggugaauguauauuuucacuugaguauauaccucgggcauauaccgaggaguggaauuacugggucauauggcaauucuauguuugacuuuuugaggaacugcuagacuguuuccuggagaagcugugugcaccacguggcacauccaccagcaggguaugaagguucccauuucugcacuaccucaccagcacuugcuauuaucugucuuuuuaaauuuuagccauccuaguggguguguugugguaucuuguguugugguuuugauuugcauuuccauaaugacuaaugacacugagcaucuuuucauaugcuuauugaccauguguauaucuucuuuggagaaaugucuauucaguuucuuugcccguauuuuaacugaguccuuugucuuuuuauugcucagugguaagcagagcauguuuagaaaguacaauuucaagcagcuugggguauuccccugguugguagugugcuuuucucuaucuuccucaggcgagaagaguuuuuauuuuuaagacuuugaagaucuacagguagaaguguaaugccucauaacuugcccgucuguuuggaaucucaagggaaaaagaaaauguggcaggaaagagcagugguuuuccuugcagugaauccagacuacagacgcucuaggggagcuuauuacauagugucccuaggagaaugggagaauuugcucuccuguaaccuaaggaaauuggcugugcauaugcauuuauggaagagccugaccguuuucucugcauuuccucuguuccgaggcaggucugccuuugccgacggagcuuugcagcuauaaauuagacagaagugcaguauugaggcuguccaagugcaggcaggguaauugcucuggacagguuuacaauagggaggugugaagugcuugguggagaccagaagcugggggaagggaggacguauugaacuugggcggcugcagggugaugggcugacagagcuaauugaaaacuauggccccgguggcuuuuaaugggaaagggagccgaggccugcagugguuuccuuuagagcaagaaaccagaaggaaaauggcucauugagcuacucagggaguuaguacuaaaucucugcaggccucuggggguagagggucagguuuucugaguuuuguuuuuaauuucuuacuccuuagucccauucuagaugaacugacaggagggugguggugagcuugagaaaaggccugcggggacauacuggaaaaaaaagcugacccguacaguggagacccuuggagauccaugaguuagggagauggucagcgggcugaacugccuauagacaagugagauaauaaugacaugguagccucuguuaguccucuagucagaguuuauggugccagggccugggaaucugcauuguaaacagcuguuggaggaaauugcuuuggagucuuaaaugugagggcagacucccugaaggcacagccuaccuuauugaccugugugguccuccuggcacgcagcaggugcuuaauaaacaccugugugcuuauuuccaaaccaacugugaguuaccguuggguuuucuuucuugauaguauccaggacacugcuuucucaugucccugaaacuccugccugcgcacaccugucgagauaaccauggguuggcuguccuacacaucugcccuuaaguuaacuguuauuuucugccccauugggguuaacugguuaccuuuucaggaccaccuacaugcacugaaauuaguuguguauuaaaagcaaaaacguagaaccaaaaacuggauuuaucuccauuuauuuccaauuccaugguagcaacgugcagaaaguccuuuucaaaggcggcaaauaaacgguguggagaugguggaggugauaggauuuuccuugagaugugcugugguuaauguguaaccucuuucauaagacuuauguagauguugaugcggccuugaagccauugcaggcccacaaacucaggcugugugucguguguuuguagcaaguccauggcuuugcagcuaacucauacccccaagguuuaauuuuuuuuggucgaaacaacaaccaacaucuguuugguaauccuccuauccuacagcaggccacuccuauccuguagugcaucacucaaauaguugcuggagaaggcuuuauuagaucaccuccccuccucuccccucuuccucccccauaggugugucuccagcacaccuaugcgugauuuuacauuucuggcucugaugauaacaucuuuaaaaaugagagaaugaacuuaagugagauaaaggaagaaagguggaaaggauaagguuugaggcgagaggggauugggcccuccuuuuugaggaugacugaaguauaaaaacuuaucuucuccuuguaauaagacaucuuggucugaaguccagacaguuugccucuuggaugagguuauuccagcccuaccuacugcuccauugugccuuggcaucuuuggggauuguccauuuggaggggccagauuagaaaaggaagagcaugauuacagcaauguuuuaccagcaaacuaggaucaucuuguccuguauuuuugccuugccagaauuaccuguuuugucugagaagcaacauuaagcacaggaguuuggauaccguggaauccagagggcaaaugacccgggucguggugugucuggcucaagaaauaacauuuugaagugccaccuggcccuaauggcaacagcagccaucaguuaaaaaaaccagcuguuaaguaagagcaagaacaggaguguuugugcaaacaaccuuuaaauuuucugauccuugaugaauguuaguugguuugugaauuauuaacuucagcgugugugaggaaauacuggcugcuuaaguauauuuuuauguaagaaaaaaauaaaacugaccacacccucagcugcuaccauuuugggcucaguucuugccugcucucacucaacagacguauuuaaagcagagauaggaaugccugcuccucacagaccacaugugugucgugcgucacagugcaucaguugccaucacaauuucacuuugaagggaacggaaguguuuugcagccugcugggauguauaaguaggaugaucccuaccgggcugcacagaggauccagaguccucaugaggauuuugguauagauaccaguguaguugggaagaauccugcguauggaaucagaaaacuagguuuagugaauuauagaaagcuggcuugagaaauccauuuaaugucacucagccagcaacuuuuaaagaguguuuugaggcagguucuuuaaugugacccuggagagacagccaucuuuuucuagugcuuugauuuacacagcagugugucucgcaggaagaggccagcagauuugacugaggaacugcaguguggcaucuuggaaaaaggggauuugaggacuuugagagauaggaagagacuuggagaaauccauuugugaaccugguuuccacagcuguuuuucagaggucucuuggaccucuuaaaguugauacuaauggacuacuuauuucuuuugacuuuuaccugggaaagagaauugugauuaggcccuuaucugggggagaggagaggcuaagggaggaaggggugaaggauuaaggaguuggagagaauuggaacuggccagacagggcuauuugagcuucacauaccuuuggguauugguugcugaauuaauccugcaguguaagucacacuuagacaugccuaggugugacucuugggguucauuuacuuuacuacaggguuuaaucucugcgcauuucgagugaggaaaacaugcuugccaugggaaggaagaaagcaggugcucugucucccuuccccaccucuucauuguccucaguugcaaugccauuugauauagguaguucugaaauacauuguacgcuuuauucccaggcugcagggauuauugcugacauagaccauggguccugcagccagcccccuguguauggaaauggaagaaaagaaaucaagcuguaaagaaucucuguuuuggggcuuuguaguggcgaauuacgugaauaacugaauugaaaaggugccugguuuauaccaucgugaauacccaggccuuagauaaauauugacacuaguagugugacgggcaggccuaccauuugucucaugccccuaggaauaaacgaucuuuucucaggugcuugugaccuuauaaaccauccugacgaguuugugcaggugcuuucugcacuaguucuuugagaguggaugguuuucucccugugcuuaugugagcuuaaaccuaaccaaaucuaaagccacuuuggcuuauugauccugguucacuuugccacaaguaaacgcaguugucagcacaguuucgcagagucauguuuguguagccaugcggacuagaccugggauuggaacagcuuuuauuuacuuugauaauauuucaggacugagugugguggggaguaaggagaaaggaaagccaguuuggggagacuuagcuggaguacagguugcaucugauagcugagugccugccuuuuccagcaaacugcucucacccccaaccaccaccuuuuguuugguucccuauaucucagggcauagaacaaaacccacuuaauuuuguuagugugcaguaugcagacgcaagucauucuccacccuucuaccucccuaccaaugauagcauguuuauuggagggaagucauguuggagucacuugauuuaggacaggcuaggcagagacuuugacaaaccucgauuugucaaaggagugauugguagaaccugggagauuguguguucguuauauagcaaguguuaggcuaaguccuagcuguuuucauagggcagcugccucaauguagcugaucuuguggaugucucaauuugguaugaccagugggcuuggauuuucuguuuggaugugaagaugcucugugaauugaauggcucuugucucucucuagugcacagagaggcuguggaguaccuagaaguacacaugguguuucuuagauuucugccuguaacugaaacuccaaaaagaguuuacugauaauugacuuuugacaaggcucuuaaccaccuuugcuggugauuggcuuuaaaagaaagaacucauauuccacagguaccaguauucauuauuugguuaagauacaguuuagcaaguggaauuugccgcuaggguccacccuguaagacacauccuuugugaguaaaugaccuggaccugcaaaugggagugggaugguuggggaggggacaggcgugugguggggugaugcacccagccacauugaauguagauggggccgggugcuguggcugacaccuguaaucccagcacuuugggaggccgaggcgggcggaucaccugaggucaggaguucaagaccagccuggccaauguggugaaaccccguuucuacuaaaaauacaagaauuagcugggugcaguggcgggcgccuguaaucccagcuauucaggaggcugagauaggagcaucacuugaaccagggaggcaggguuugcagugagcugagaucacaccauugcacuccagccuguguggcaagagugaaacuccauuucaaaaaaaaaaaaaaagaacguagauggaccuuguggaagaggugaggcauuguuuuuagggacuuuggcgaaugauuuaaaaaaaagaaauaaaaguguguuguggccuagucauuuucacagccaguuuuccauuugacauaguaaaauuuuaguauguucaaggauggaggucgcaugcagcaucugcuauuuucugcuuguaauuucagugaaaaggaaguuccauguuuuaauagcagcauagucuguguacaauaaugcaugcugaaauacuuugugguuuuugaaucuugacuucgugucuucucagccauuucaacaaccagaaccagggaaaucaucacugcuccacgccucuaaacagggaaaaugaugugguagauggucuuuuaaauuuagaguguuucacgacgucuuaguacugcagaaagaaaaacuuagccuuuuggcuuuagcuaagcauuucaugacacacguaaacuuuaagaagcccaguggaaaaagugaacaggacgagaucccaagucgauaagcuagcuauuaaagucagugacuucacugugggccagacggcugaccuuuuaaaacuguguguuuucuuuaaaauacuuagcuagagauagucgcgugccucccuguaauacagcggauguauucuugaaaaguuguggguaaauucgcuuuucuaauuuggcugauuuaauaccagggaucugcugucuguauuuguaugaucugcauuguuuugaggcagcugagaaagagaggauaaaccuagaaaauaauauuggaaggaaccuuguacuuaauccauuuguaacgccgagcauuguggcaaaugcaaguaagcauggauuuuuauaugagcuuuauagauuuuggaugcuugggcuuugcacaggcaccaggagaccucacagagauguuagugagcugugggugugaugucacacaguugaaaaauaaaggacguguguaaguuccaguggaggcugauagaggacucccguacucuggggaacuucuggcuucccaggaaggguuuuucuuacaagcagcuccagccuggaaagguaguuacacccacuuaugucauuugucccuuaaaauuuuuuguggauggggaaugaaggagaugccaguagcacuaagguaagcuguuguuugugcagauguauuuguugaaaacaaaccacuuucauuuucuucuucaaauaggacauauaggaaaccuauacauugcucuuuuguaacccagaaggguauuugccuaaaauugcccuucucagucucuuuaaaaaacaacaaaaaccccuaaucacuacacguccagaagugagucaccacugaguuugcuuuuuuuuuaaucuucugacauacauuucuguaacaugagguuuuuguacuaauauuuucauugauuggauuauguuagagagugaauugucaaaaugagaguuaaaaaggcccaaaauguccgauccuuuccugguccuaggaaaguccuagacaagaguguuuagaauaguguguaaugaaugacucagauggagggaagggguuuuuuguuuugauguuuuaaucugugucugucgcacccagaggaaguaauauauuauuggagguuucauucuuaaagaaccaagagucacugcuauagaauuuucuuaucacuuuaucccagugaaauccgugguuguaccuucugccggaaaggcaggcuuggaauuuggccacccugcucucaugaccaggagcaauuuuaugggccuguguuaaaacagguauuuugcucuuugauagcaggguucaucucagggcccuuaggugugagcguguaguguguaaaaucacucaccguuaaguggugaaucauuucaguguaucggaacaggagauucaucacagcaucacuuacggguggugacugugccaaaguuuacgcaauucuguuguguggcacauggcagucgaagaagcuuuccuuguuaguuugcaucuuuccugugaccauccgaaguuaguguuuuuuuuuuuuuuuuuuuuuuuuuuuuuugagacagagucuugcucugucacccaggcuggagugcaguagugugaucucggcucacugcacgcuccgccucccggguucucgccauucuccugccucagccuccccagcagcugggacuacaggcgcccaccaccacgccaggcuaauuuuuuguauuuuuaguagagaugggauuucaucguguuagccaggauggucuugaucuccugaccucauggucugccugccuuggccucccaaagugcugggauuacaggcaugagccaccacgccuggcccgaaguuagugaauuuuaaagcugcaucacauuuucagaaacacccuggauuuugcauuggugguuucauaggaagcuaaucagucuccugaaaguggacauuuagcaggggccaggggcggauguggagggguaaagguggaaguuuuaggaaaggaaaacaguaauccgugaccagagaagcuuugguggacuuuacaaagcacuuggugaaccugggauuccaaauguauccaccagguuaauguguccuuuuucucaguuuuacccaucccauauuuccugucccuuuugccugacuuguuuucaguacuccagaagcaaaagucuccguuuucugccgcaguagagcgugguuuucauuuaugagaacccucugccauccuuuaacugagagaaccucuggguuuuaccucuggccgcccuucauccccgccaugcccuccgucccugcugguugggauggaugagccuuugcucucccugcagcggcuggggcccuaggcugucagggcaccucggggaagaguucagugggagcagggagcaccuggcuccaagguuccaaccccccucuguucugcagaaugacugggcucccaggagguaaagauucagcucuguuacuggauggggugaggauaggggggcuauugugcaggugaugaguuugccaaguccuguagagcuuaaggacuaugugaaaguuagugaauuaguguuucuuuuuggagaugauaaaguagagaauaggcgauccugaaugaccagacuucugacccaucucuucccgcuccccauuuccaagccucugcaaagcacuucucuaauagcaaagccaaaugguggcuguaggcaccucuugccugcugggguggccauggugauauucccuuuguggcaggucugugggagggucagccucuggcagcagcuauucccugcccaaauuccuuuugcuuguaaaguccccaccaacugcagagcugguguguuggagcgccucuucuuaauuaaauuaauuaaucuuuagggguuaaugaugcacauaccauauuaacaagagacuauuaugggaaauuugugggcuuuccucaguacuaaacugcacuaaagaugagacugcuuaaaguaaaacaaaacaaaacccauuauagcuaauuauuuuguuucuuuuuggccaaacuaagauuuuugguaggaaagauccuagaaucucccauuuuaagggguaguauagaaagcaaaugcuaacugccuucagugauggugagaaaacaaauugggccucuugauuaucuaguucagaacuuuuaaguaaaugaacaaggcgauacucuguucuuauggaaaucaacuuuaauggccccauagauuaauguucgugagggaccuggcacugggguuugcuaagguuuauauaacccuugacuuaaccgccugguggguugugggucuggcagcauggggcuauucuucucaacuuugcuguaaaaccauuugugucuugcccuuuccuuucuaggagguccugacuucuuggccuuuuuguuugcuuauuuuacuccaugcccuccauuccuuauuuuacuuuucuggccucguuucccaggacuccucuucaaaaaaacaugcucuucuucuaggcuuagcugaaaucuugcauuuucaauaaacguuucucauuacagcugaucuuuccugcucuggacgccaucuggccuucauucauguuauccaugcuagggaugacaaacucagaucucgggcugggaagauacugccggugaauaaagagggcaugggugagacaauaaggaguggugaggucuguggucauuggaaugcuugguaaaugcauguaguugauuguuucuguuaggaaugcuggcccuccgauuauuuucaagaaaagcugaaacuuuaguuuuuggugaaaacuuuagguuucuaccaacacuguucagucagaaacaagcaaguuucccugcagcccagcuuuguacccacaaacuaccaauuuguagcuacugaucuaccauuacagaaugcuugcaagugucagagccuuuggcuguguuauuuggucaguauucuuuuuuuuuuuuuuuuuuugguagggacagggucucacuauguugcccaggcuggucucaaauuccaggccuaaagugauuccccgacuuuagccuccgaaagugcugagauuuauaggcgugaaccaccacacccggccaggagucuuaacuugaccaguggguuguaaaccacuucaagucacagacuagaucuuauccuaauuuguuaucaguuuaucacagugcaguauaccuuguagacaauaaauauuugucaaauuugacauuuguugggugcuagagggaaaagauguagacuuguacucaaauuagcuacagaccaggaugacaugugugaacuaguaaggccgagaagcacauguaagaccuuaugggaucacagagguaggcaugaguuucuucucucaguuaacgucacgggcguuagacuucagaggcccacacugauuauuauagcugauuuuuaaggaguaaaaauaggcaaugagucuggguccauauauagcuguauguauauaguaucuccuauuuugagucacuguagguuucccuuauuugcauagauaauggucuauguaaaauuuucagaaauggaaauaacuggugacucauuacugacuuugugagauacaacugcccaaaagcuuacaaaaugagcuauuuguaucauguugagaucugagugauuuuuuucauuugauuauuugcagaauauguucuuuugccauagggaauauguggcugcuuagcuuacugaagagagguagcagcaaguacagaaccuucuccugaguggagauccuuggauaggauacuagaggaaugauuccaguucaagauacaauuuugucaucuuaauauaagccuuuaaugugcauuauccgcuuguucaguugugguuuuugguuaacaaggggaagcaucacaauacaaaaaaagguaagaacaucuaauauucugggauuugaacgaagucuuauucucuuuuauaaaaccuuacaacaugggaacauaauguggugauuucauuggagcuugauguguacuauguaauuccucagaaaguaaaaaugcagcagaaacagucuuaaaagcuuaaaggauuaaauaacuuaaacauuguugcauguucuuccuuauuugcacccgcugaaauuuugaaaggacgaaucaccuuuuuccaccuuuuucuggugagucccaagcaggcaauuuuuuaacgaguggcugacagugcacguucugagguugagaaagagaugaaucgccagagcccacggcucccaggccagagcugggugcccacuggugcucagaaguuggguuguuggauugccucacacuuacuuuccagcuguauuaaugcaguuuagcaaacaucugaaagcuuaaaauaugcaaaauacuguggcgcucaggaguccagacagaauugaguaaugggaaauaggcuagccuggaaaccaaaccaaguaugaaaaccucauucuucagggaaugcuugucacggauuuaggaccaauuccuuccacuuugaauuauucuguuaauguugaaaaauggagccauggguugcgcuccucuucacagugagagauuuugucuguguucgucaguggucugugagcaaugcuugcuuuuggggaugaagugauaauucuguugucuaacgaagugggguuguuuccucaccacagcuuacucaaaaguaaacaacuuuuuaucccucaacuuccaaggagucaaugaauuacuguucaccagcuuugaauaacauuugccaaguuuguaauaugugguucugguuguaauccaggaaggugcuugucagauuagauaaauaccguuuaagccuauagaauuauacucugagggcaguuuuuauuaagaaugucuuccucauaacuucaguuuuugaaggcucuuucccuuguugagaugguucagaacuuuuugugugcucaaaggacuuguguuaauaucaguguccaucccucaccacagccuuuuacauaguucucgaguuauuggguagcucagauuuguguuuuagauucaaguugcuucuguaggugacauuuaacuugaaauguuuguggauuauuucaugauauagauauauucguugguuauuuuguaauucagacacagcacaguuuaauagaaauuucagugcugauagaaauaaccucugucugcauuguacauuuugauagccacuagccacgugguacuguugaacacuugaaauauagcuaaugugggcugggcgugguggcucacgccuguaaucccagcacuuugggaggccgaggcgggcacaucacgaggucaggagaucaagaccauccuggcuaacacggugaaacccugucucuacuuaaaaaauacaaaaaauuagcugggcgugguggcaggugacuguagucccagcuacuggggaggcugaggcaggagaauggugugaacccaggagacggagcuuguagugagcggagaugcaccgcugcacgccagccugggcgacagagcgagacuccaucucaaaaaaaaaaaaaaaaaaaaauagcuaguguggccaaggaacugaauucuuaauuuuauguaauuuuaauuucauuuaaauauacauguaaauagccaguggcuacuaaauuggacagcacagauuuagauagugguggggauuuugcagcuauugaaggacuuuagcucuucggauuccuugggguuggggcaaggggacuuguuaggaaacgugcucagcgagcaaacuguuguugugcacugguaaacaguuugcuuuucagacacgccuggauaaaacuugagcuguccucugcagaggugccucuuguguguucagcgaacggugggcugaacggucaucuuucagcagauuagcugaaagaacaucuauugcugggcucaguuguucagagaucugcgcacccuuugugcaagagcagggaaaauuuguguuaugacaauggcugacagaauguuuaauuaaagcugcaauuggcaguaacuaaauucuccgagguuucuuuccucuccucuuugcuacugaaaggugcagaaaugcuuuugacagcaucuuuccuacugacagaugaauuguuuugacaggagaauuugaaaccuucaacugaagacacauucagaugucaggccugguacagggcgaucguguucauagaaauaagugagaugcuuuagaugugugugcaugucagcugccaccugaaagaaaggccucauuaaagauuuucacugauuaacucuuugauuguucuugggaucucagaugggaauucacgcugcuugcugcagagcucuugggcuaaguguauuuucuuaauuacugagaaaugcguguuaucaguaagcagugaaaagucuugaaaaaacuaaguaauuuuaaaaauuuggaaaaaaaauggcaauguugauagcaacaucauucacaauagccaaaaggaggaacaacccaaaugucaucugugaugaauggauacacaaaaugugguauauacauacaugggaauauuaguuagccuuaaaaagaaaugaaauucugccaggugcaguggcuuacuccgguaauccuaucacuuugggaggcugaggugggaggauugcuucaggccaggaguucaagacuagccugggcaauauagggagacccuccccccaccaugucuacuaaaaaaguaaaauuuagccaggugugguggugugugugccuguacucccagcuacuugggaggcugaaacaggaggaucacuugagcccaagaguuugaggcugcagugagccaugacugcaccacugcauuccagccugggugacagagugagacccugucucuaaaaaaaaugaaauucugacacaugugacaacauggaugaaucuugaagacauuauguuaagugaauuaagccacucacaaaaggacaaauauucuauaaucuaccaacaugagguacuuaagaguagucagauucuuagagacagaaguagaauggugguugccaggggcuaggacagaggggaaugaggagcuaguguucagugaguacagacuuucaguuugggauguugagaaacuucuaaaguucuggagauggacgguggugaugguugcacaacagugugaagguacucggugccacugaagaguacacuuaaaaaugguuacaaaggcaaauuuuauguuauauguauuuuaccacauuaaaaaaauuaugcucaggccgggcacgguggcucacaccuguaauccuagcacuuugggaggcugaggcagguggaucaccugaggucaggaguuugaaaccagccuggccaacauggugaaacccugucucuacuaaaaauacaaaaaaauuagccgggcaugguggcaggcaccuguaaucccagcuacucuggaggcugagguaggagaauugcuugaaaacaagagguggaggucacagugggccaagaucaugccacuacacuccagccugggcgacagagcaagacucgucucaaaaaaaaaaaaaaaaaaaaaaaaauuaugcucagaguuugucuucuugaauugggccaacaagaaagugucucugaggauuuuauuucauauuguaguuccuggggagaaugugguaacuauuuuccuuauuucccaauaaaccuauugaggaucuacagcuggcuccacucuuuaggcccacuugcuucucagacuuaaaaaccagaacagccccuuguccacagcagaaagggacgugagccuugguggcugucuucuuuuuugccaacaggugcucugagaggagaguuacccuuucuggguagcacccuaacacuugaauguugauagguggcuuuucuaguuaauuccagcugaccccgugaaaacuuaacguuuccacuucuaaguguguucaucucuguugcugcuuguuggcaucucaguguuaaguccugauacugcuaggcuucuagauaguacuggaauggaagacccuuugcucaaguagccuuaccuaaaaagcaaaauuuuuauaacauuuuugaaaugugaauacauuuugucugcucuuuaagggaaagacaaacccaaggguguugugacuuaaaugguuuuauaccaaguugcugaagacuuuggauacuugcugggugggaagugagggaaguuaucucauuucagauagucccaaaccgagccaucaguuuaauugcguaagaccuggugagcccuagcucuauccaggccacauguguaagccagaaacauauguucccuuugaaccuaauggccucaagagucaguggcccagaucagaggcaaaaacuggcgauccucaagccaaauggggccugcagauaugugaaaucuuuucaguuuuuuuuuuuuuuuuaaguaauaaagcaacccugaaugggccaaacaaaacaugaauucagaucgugagccucugagaagacgggucugcacuggcccuuguuucgggggacaagaagcaaaugccccuuuaggugugcggcaggcacuuccgugucagccuuguuacacacagggcaggcucaccagcccucucuuacuugcuuguccucuaagcucuugccuuugugguuucugaguauuucucuaauaucccuuccugcuucacaacuccuguuaccuaugaugauacaaaaguuacagucaucguaaacucccaguaucuuuacacccagaaacaauauuuccaucccccuuuuuaugauaaucugcucaaaauagaagaaaaucucagucuauuaaguccuuuuucuaaugugggagaauucucucaauuucuagauuuucuuucucaagucuaaguugggauuucuggguacccauuaacaaauacccccaggcacagacaagcucacacuugaguucaauaugcgguuuaaagcauuaccaccuucagucuuuaugguaacauaaucucuggacaaauugcuuuuaauucaggcuguacccaugaauacagaagugccauuaguuucaaguguaguuugacuuuuauuuagaugaacgucucugagcucacagugaaauggcucucagcucuagguuaguauugauugaaaugucucuggaguaaguuuaaaagauuguugccacaauacgugacacuuucugagacagacuuuaaacucaaaauuagucguacuguuaauuggcaguagugugaguggaauuaauagcugagaugaaaaauguuaaccucuuuggcaaacacggggcuggguagacuuuggaggcaaggaaagauuacuuucuggcaaagaaaguuagggcccauuuggaucacaucuuuguggcuucuguuccugaaagaugaagcugcucugguugagauugugguccccuaacagaauaguugcccagcuugcucuuuguccgccucuaaggguauggcuggguuaugaagcagggagaguuuuaauucugaaccauugacacagacgccaucaucuugagaaagcugcucaugugaggcuuucccugccugugguuaacacgaacaagaauuuccagcaacuggcccuuuucuccugugugacugucccucccgguuuauucaguguaggugggaauacuguguucauaaguagccuuaugauucaggaucuuacaguguuuacuuucuaaacacucacuugaacuuugacuauuugugcaauuuuuagucuuaagcucuuguguagaccaggguuuuucaaccucugaauccuaggauugacauuuagggccgcgcaguucucagucgugcagggcugccugugcauuguaagauauuuaacagcaucuuuggcuuguauccaccagaugccaguaacaccccccacucccugccaccaguugugacaaccaaaaaugucuccagacauugccaaguguccucuggggggcaaaaucaucccugguugagagccacugguuuagacaaugaagggguuuuuucccuuuucuccuuuacugcugcuugauguugaugcuacuaaaacauuaauuuaaaaaaaugccguuaagaauagccuuguacuugauagggugcaaagcauuuggaccaggacaccuuaauguagguagggagcugguuuaccuuagaauuucuuuccaaguuguuaaauagugaaaugauacugauagaaauucguuuggguuuucauagaguugcuuggagugccuuauuuauggauguagguggggaggggguaugucuguaaaucucaguaucaauacgguuacuuaauacaugaucaugggaugggggcuuggauuugagggugggggagccaggagaagagaagauuucugaauucuggguaugaugccagguuguugauuccguuuuuuucucucucugucuuuaccagaaaccugaguuacaacaaacucucugagauugacccugcugguuuugaggacuugccgaaccuacaggaagugugagucucccccuaaaccucugguggauggaaggauggagagcucuuugggaaaauccucuuguauugcagcaucgcucacuccccuagauccgcaguguaaacuuguaggaaggaacauuuguguauggacuguguugaugaauucuacuccugcuuaucucucccuuacuguaggcucuugaaggguguguuacaauucaguaggcauagagcuccuggaaauccugggcgcaugguggguguauagcagagucccuccauugugggaagccuuguaacuggagugacacauccugggcugguacuuucucacaguuccugcaccaccacgcccagcuaauuuuuguauuuuuaguagagaugagauuuugccguguuggccaggcuggucucgaacucuggccucaugugaucugcgcgccuuggccucccaaugugcugggauuacagguuaaucagcccacucaacaguggcaugugagccaccaaacguguauuucccaggaagugaaguuauagaaggauggacuauagaggcuuaccuguuccucuccaccuccaaacagagcuagguaugacugccuuuggagcucuaggcuugcugucccuugcagugucuuggaaaucaggcugcagucuuuccuucuuuuuaaugcauucuguuuuugauguggauguuaggauuaucaggaauuuuaguuucauggagacuuuauagaaaccuucacauauauguaguauacauauuguagaaaaauuggcaacuacagaaacgugugaagaaugaaaaucaccaguauucucacccaggcauacccauugugaacaccuagugaaaacuauuacauguacauauguaauuuuaggaucaaacuguacauugugguuuuauaucagucuuuccuacuuauccuuacauaagauacuuuaucauguaaauuaaaaguuuuugaauguccuguuuuagcuuuuauguaaaacuacuauacguggauauuucauauauuaccuacccaguacuucauuauuauuuuuauuagacauuauuagguaaguuuuuuacccauuuuuguuaugaguaacugauaaaagucuuauuuguuguuuuuuguuuguuuguuuguuuguuuaagacagggucucgcucuguugcccaggcuagagugcaguggcgugaucucagcucacuguaaccucugccucccggguucaagugauuuucacaccccagccuugugaguagcugggacuacaggugugugccaccacauccagcuaauuuuuuuaguagagaugguguuccgccauguuggucaggcuggucuugaacuccugaccucaagugauccuccugcuuuggccucccaaagugcugggguuauaggugugagccauugcacccaggcuuacuuguuauucuuugauuccauuauugaugacauaucuaaagaaauuuuaauuucaucagcugguacaauuugcaaaauacuugcauuccaaacccucaucuccagauucuccagauuggcguuuauaauuucugcuucuguuuaaaaaagguuuaggcuuccacaguuaaagaagcaucagaacaggaaggggccuuggaaaugguuucucuaggacucucauucucccagaggaucagugaguccauggcaggggaaaggaaguuugaagugggucacuguguuaguuugcuaaggcugcugccauaacaaacaaauagcacaggcugggugccuugaacagcagaaauucaucuucucacagucuggaagcaggaaguccaagaucaagguacuggcagguuugguuucuuccgaggccuugcacugugcccucacguggucucuccucugugugcauucauggugucucuguguguguccagauuuccucuucuuauaaagacaccagucauauuggaucagggcccaucaccucuucaaaggccccaucuccaaaugcagucacaugcugagguacuagggguuagagcuucagcauauggacccuaggggaacacaguucagcccaucauagucaccaagaugauaaacccaggccaucauggagcuuguuagguuuguaacccagugcuuucccugauccaagcugucuuuaaugcuugugguuagaauauauucaaauucuguguacaucuccaaacuuagugguuucuuuuaggacuggacaaaauuggagaauucccucuagcaucauucaagcuuucauugaauacuuacucgagcaucuccucuguccaggagcuauucugggugcuggggcuacaagagugaacaggacacagauagggcugggacuggggaggggcaagugaggcacccaacacaggcgcaaaauuuauggggacaccaaagacucagcagucaagauaaaggguauuuugauacaauauuuugaaagucaaaaugaauguaaaaaaaaaaugaugaguaaaauauaaaaagcuuagaucaagauaggauuaguauuacugauuucuuuccuuuugccuucaguuccaggauggcuucacacggugcuguugcugauuuugucuugauuuaaacuuuucauauuuuguucaucaugaauuuuguuuugcauucaucuucauauuuaaaaaauauugcauuaauauagucuuuguccucgugacuggguuuuuggcugucccuuaaauuuugugccccucccuacccaauuccagcccugcagacaaaccucuccucucacugaguuuacauuaaguugagggaagccauggacugaauaaggaaaccaguaagacuuauuggagauaagugguaugggggaaauagaacagaguaaugugggaguauuuuuuguaugaagaauuuuggaggcuugauaacggaaacagugugaucaggaagguccugagugagcaggugugaaugaugaggacagggagcacugcaaguacagagccucaagaagggaacaggcugaggaccacugugccuggcaugcacgauggaggggugcguggccagaggccagguccuuuuaugguuucaacccucacugaccccuaucuaucaggggcaggcaugguacaugcucuggugagcauuuucagugguguucuaacucccuguuccuguuguuccuugccuagacaggcuuuuaccuuucauuugauuuggcucccgugaccugcagccuguacucagcacuuguuagaguuuaugucccacccagcucuagaacugagcacucccaccuuuccuucauuggagauacugguuaugagucucaaaaauauauuucucacuuaggaacagucacaguaauuguagcagugugcuaauaaaccuuuggagaauacgacaucacuuaacccuaacaucaacucugugauauaaaacauuaucuuuuuuuuuuuuuuuugagauggaguuucgcucuuaucucccaggcuggagugcagugcaaucuugggucacugcaaccuccgccucuucgguucaagugauuccccugccuuagccucccagguagcugggauuacaggugccugcaaccgugcccagcuaauuuuuauauuuuagauagagaugagauuucaccauguuggccaggcugaucuugaacuccugacauuaggugauccacccgccuuggccucccaaaaugcuaggauuagaggcaugagccaccacgccuggccugauauaaaacauuuucuuucuuucuuuuuuuugagauggaguguugcucugucaccguggcuggagugcaguggcgugaccucagcucauugcagccuccaccuccuggguucaagugauucucaugccucaguuucccagguagcugggauuacagaugugcaccaccacgcccagcuaauuuuuguauuuuuaguagagaugggauuucgccguguuggccaggcuggucucgaagucuggccucaugugaucugccugccuuggccucccagugugcugggauuacagguaugagcccccacacccagccccuuaaaacauuuuccacccagccccuuaaaacauuuucuuuguaagcauuuucucagcugggugcagaaggaucacuugagcccaggaauuugagaccagcgugagcaacaaagugagacccugucucuacaaaaaauuagcuggacauaguggcccaugccuguagucccagguucuugggaggcugaggccucaagaucgcuugagcccaggagguugaggcuucagcgugccauguuugcaccaugcacuccacccaacagagcaagaccccaucucugaaaaaaaguaauaaaaauaaaaggaguuucucugcuuugcagaagaggaaacagauacuuagaaaaguuaaacuugcacagugucacaugguugguaaagcugagaguugaacucaaaaccugugcuaaccuuggcggcugcacuaccuuaaauuccuauauccuucaucuuaacucucacagucaacugaagaugaagaggaacugaggcaugggauuuggcugaaauugcgugauuagugagugguagaacuugacccauguucuccaguauaauccugguccacaccaucuauggcaacaguaccgucugagugugggggauguuaagacagaggucauaucuuagggauucaauaugauguggugggaaaaacucucauuuugguagcaaauagacucacguuugauuucugguucugccccuuacuaggguccugagacccuagacaaguuacuuagugccucagcguuugcuuucuuucuucuguaacauugacaucguaacacauuguugguguuacuguaguuauuaagaugaugcacagggccuugcacaugcgagaggcucacugaauauuaucccucuucucuccugcuacguuuggaacugcccagcccuccaagcugggugcauuguuuagaaaugaaucuuugcaggcugacugguugaaugucuuaccauugugccuccuaucccuagugucacucccuguucugugagauggaugagaugaauucccugcugccuagaacaguagaacuucucacugauaaaagacccaggccuuacccuaagggaauucuaaaaagucguggagacagaaagaggcuguuagguguugagggguggggagguggggaaggauauugaagaaaagaaaaaaaaucguagcugacaugcuacugcuucaaaauuaaccagucuccaguguugcccaggcgcugucagcucucccaaacuuuauagagccuucagucuggagcccucauugagaauggagccacaggcuggcagaacagcaggcagugguuuagcagugguuuuauucuggaggccucagaaccacaugacaucaugggccggcuggagagagaaggcgaggccccuggaggacaugaggacgcuugugcagcugcguccaagccacacggucuucacugcccacagcccugaggaaagcccaccagggagugccuccagcugggguccuggccagcaggcuccucuauuaauaaaaggggcuauuuauacaguccucuguagauacugccuucagaucacaguacugccgccuggcccgcgagugccugcuguggguguugccgugugcuugccagggccacugaccugguaaggaagccucaagugugcccugccugcuauuggguauuugugguucaucgcacugugucaggcugcugcuccccacagugggugugugugagcaggggugcgggggaugguaguauguuuagggagaggguaaaauaaugaggguugucguuuugggguacugccuuuuggcugugaauuacuaucacuuuuuuuuuuuuuuuuuuuuaagacaggaucucacucuguugcccaggcuagagugcagugguauggucauagcugacugcagccucaaauucccaggcucaagcgauccucgcaccucagccuccugaguagcuggaacuacaggcgugcacaaccacuccuggcuaauuuuuuguagagauggguuuugucauguugcccaggcuagucucgaacuacugggcuuaaaugauccuccugccuuggccucccaaagggcuggaauacaggugugagccaccaugccugguccuccugccaucucuuaagcauauccuguguaucugucaauauccugagaucuuagguuuaauuauuucagcuggauccucccaaaacccuacaaagcuggcacuuguauuauuuacauucuucagaagagggaaguaagggacagcaaggcugagugacaugcuuagcauuggauugauaaagggugcaauuggaguugagugaaccaagauaugucugauuuaaacaucugagcuauauaaucccauccuaauaaucccuguucuguaacugugccucaguuuccuuucuuaaggagaggugauaauuuaguacuuuccucaaaguguuagcaugucauucacugagauauugcacauagaaaacuuaggacagagucuggcacauaguagauguucaccuuuauuauuguuuauuuuguuaaaguaauuauauccuacgcuaaaauaauuuuaucuggcuaucuuguguagaaaccacguaucauaaagucucaccacaucaauuaguuaguauacauuauucucuaguaacuaaagcagaauacaguuauuaaguggcccugcuuccgaaacccauauuccuaugugauacugauggcuuucacccuuuuaagaaacaaaaccaacuacaguuucaacgcacugcccaacuuugacuacuauuaauugcagcucugucuguauuugggagcaaccaaagaaacagccacuaugucugccaguaguggauuggccagauaaauuaugguccauucauaccagcagaggacuacugugccaccaguuaaacgaauaguggagaccuccaagauauauuacuaaagagaaauggcgguacacaacagucuguuuaauacacguacauuugugcaaaagaaaaacacauacacaucucuaguagccagcagcaggagcugcccuuuggaggcagaccagaggauggaacugcaaagaagcuuuauguuuacuauguauucuuuuuugaaaugguuugaaaacuuuacucugugcuuauaccagcuauuuaaugaguaaauaaauaacagcaagaaaaauucaggcaugguggcucacgccuguaaucucagcacauugagaggccgagaagggcggaucaccugaggucaggaguucgagaccagccuggccaacaugacgaaaccccgugucuacuaaaaauaaaaaaauuagcugagugugguggccugugccuauaaucccagcuacucgggaggcugaggcaggagaaucgcuugaacccaggaggcagagguuacagugagccgagaucaugccaauguacuccagccugggccaccacagagcgagacuccgucucagaaaaaagacaagcacaauuucugcauugguuugacauuguugaagccaaauuugauuaagauugaugaugaugaugauguaguacuaugaaauagccuuuaucacauuuuguagcuuacaaaauguaaaacuucccuuaagucaauuaaauggaaguuuugggagaaaggugagggaccagaagguccaagcugaccuuacggauugaauugggaaaggacccaccccuagguucugcccugggguccggaauccuuuuaccuuagcuacaccuucucuagccccagggucuggccgugauucaugggucugaugcaucugaggcacuucuuaauccugaaucaucagaaaagguuuagaaauagagaccagacguuucagagagauuuuuagggccuuggauggaaguaaauuguggggagagaugggcgucggcaggggaaguaaauuggcggguagggggugagagaagacuguacaaucguagauauuuaaaaaaauuucaucaggcacaaucuuuacuuccuaaaauuucuuuauucauggagacucugcuaaacuuccugagugccuuuccccucaaagcuguagcugugcuauuuuugaccagucucuauuucagucuggcaagaaguucuuugcaucucagagugagcugggccucugcugccuucugaggagaguauucuuguuucaacaggggacagagugaacaaaaagggagccagcagugguggagcuaacagacuuacucugaauagcgguucuuuuuucaguagaaaugaucuggaaguaagcucacugugcagggccucuccugggggcuuugaguguccucccuguaagucaggcagcccuguugccaccagagcccacuguuucugacugagcccuugacucgggccugcucaucuagacauagaaggcccaguuaagcuccagcacugguccaccaccccucuaugcuccacuuccagcaguucugucacaauuugaaauaucaugaugcccgcuucccuuguucauuuauuucugugaaauuggguggagcaguuugucacagauacaguaggccuggccugagaccaggcucaucaggcguagcccccugcagagaaguccauacgcuuuguuucagguuuaaaaucaagugagauccuaagcuggcugaaaaacaacugugcuguuaccuaagggauuaugagcuuuccagcuggccuuugagcccgcugcucuccucugguuuguagucauacuuuuuucaggucuuggccauguccucucuaguagcaugacccuagaugagugacuuaaacuggccuagagaacuuaccgguaauguagagaaugguaguaguuaaccugguaccugauucaaaguuguugugauggugaaagugcacgaggcaugucgaguuuuugcugaaauaaagaaauagaagguaaugaggaaaaaccuagacuuuggggcuaggcacccugggccacugcaacuuauugcuggugaccuuggucaaauuacuuaacaucuguguuucaguuuccucauuggugcaguggaaauguuccugagaccuacuucugagggcuguagagaugcauuaauauacugaaaagcucuuagagcugugccuggcacauagucagccuucauuaauuuaccugcuuuuguuuuuguuacuaacauucucuguguuugagaagaaaucgcaagcaaugaaagaguucuuaggcaagcugccugauugacagcagguccccgaccuuaguuuuucuugcucugauaaaaccugggggucucuuguaauaauagguacguugauggguacuaugaaaaauuuauuagcugagauuaagacuaauggggaguuuucagugucccugagugaggaugggaaauggaucacagcaggguuggaggagauaaaaggugaagcagaaacaaucugauuuagggggcagucagauaagagacuguuaaaguaauuaauugucuauuucaacacacaaacaagggcccuuuaaguggagaaaagauuugccacaugauacggaucugccuucucucugccagaugcuucagccaugaagcuauugaaacaggcauucuaugucccacagcccaguaauugccaagcuucaucccuaacuggcuuuggcacugaagaaagcaaaugggauaauucaaggccuuuccuuuuuuuuuuccuucuccuauucacuucuauaaaagauggcagacaaccagauuauucucuucaagcacaugcuagcuguauacuuguaugaguacagcugugauuucaguugcuuugucuucaaacagaaacaggaugcucuguguuagacguaccucccuuaaaaaacugagaauaagaacccaguuuuauccccuugacuuugcaucgcaaguacaauuucuuucuagcccaucaccuggcagaaagccugaacacuuugcuuugguuuucuuaaggauuguugggcucacuuugcaagucugauuuuggauucucuucccagauuuggaaauacauguccauguaaggaggccagauugcacagccucugggggcagaccaggcgagccgugcuuugguucguggguuuccccuuccguuaagagauauuaacuauggaaauacauauuuggacuauuuuagcaggaagggagcuuggagagcaacucucgucuguggagaauuuucaaagugucuaugcgcaaaaguguguguauauauguucauuuuccugggggaugcauccagaggcuucaucagaguccagcuggaaccucaaauggaagagagucucugaguccaguucccuuguuauuucacagaugaggcacugaaauaauuggccccaugugucccaagccccucagaacuccaugugagccagggcgugagucucuggcucuuguuccacacauguugcccuuugacaggggcaaauuucggcccacggggaguguucucaccgauggucuuaggggcgcuuuugucccgaaccugccucuuggcuuguucucacuguuccuugucuugauuucugaguuugaugggaagcugaugggagacaggagaugcuuccccuuaguguuuguuucuagccaugggugugaucaguggcuaguuuuugugaucucaugugacuucuuucccuuuaaaaacucacugcuaaauucuuucucuuuucuccaacauuagaauauagguuuacuguggcagacuuagcagcguuuguuuauuucuguuguauguguaugauuucagacuaauucaaaugccuuacaugauuaauuucuuguuguuguuacagguaccucaauaauaaugaguugacagcgguaccaucccugggcgcugcuucaucacaugucgucucucucuuucuguaaguggugccguuugggggacucugggcugugugguggggccaugguguuuguugccuugcugauaccugguggcaggauaacuugaguucaugugcucgcuggugaagaaagaccuuucuucauguggcccucaugaucaugacaaacgcuuugcuugcuguuuugggauuugcagaauuaaacgcuggaaguuuuaccucaucuuuaauuugcaagaaaguaggucuuuugucuuuuuuuuuuuuaaugcgcagagguauauggaacuagauuucuugcuucugugguugguuaagcugcaacuuugaguaaaacuggaguuaaaggaagcugugucaguuauaagacagcaagcuaaucuuugugccagugaauuggguaaugugacucaguuuacuuuuguggcuuuaagaaaaagaaagugcccccaggccucuggaaucaacguaaaacuauguugucauggucaaguguuagauaagaugcgaucuauuuguucuagacagcacacuggaaaugaaaaagcagaugaagggccuuagcuaaaaagacaugaaggcacccauugggaauauuaucauuugugcuguuacaaaccuuugcuagagaacugagcacugauccuaccccuauuucuucagcagucagguggaggagcuugcuuguuuuaaacucacccagaagacuuuccagauaaaccagccaugaguccaacaguuuucucugccagauuuuauuggcagcuuccccagcagagcaccucccucuucacacugaauuuccuguuuccacuccaggcuuucauaguuuaauuuuauuuugauuuugcugguuuuauaauuaguuugcucaccuauaugaaucuuuucucaauacugaggcucggcaggcugagcagagaaacuuugcaagaaggugcuauuaauaagagugcuggcauagcuuacagaucucggaucuuuggcuggcagcaugcccuguguucaggaggugcugugucccugugaaacauggucuuggguuuaacccuuuucauggcauugugggauugcaggagagcgugggggguuagaauugcacuucacucugugcccuggacagaugaccuagucucucugaaccucguuucccucauuuacauaaugcauuuuugacccauuuuauacaugaggaaagugaggcccgggggaguggaauguauaugaagcucccagcauucugugggaguguuugacaaauggugguuacugucauuggcugguggcuaguugucacguagcuccuuggaucuuggcaggaucucaccuuuaaggccgcaggauuuaagagucagucucuguuucugugaagugcuggaaggaagguuuguggcccuuuguucccuugauggguaaaggucugacuuuauuuuguacccacuugguuugugggcccagcaucuggaagguguuuaauuuuuggcuuaaucaaugaguucgucuuaugugaggcugauagggaugugauaaccuguuguguguccauaaagcaaagcacuugaagaugcuaggagcuccuugcugcuuaaagcacaggucauggaccaucaguauugaguuagcuucgagcuuguuagaaaugcagaaccucaggcuuaaugccaacacuacuggaucagaagcuccauuuaacaagggcccuggccguuuguccacgaguucaaguuugagaaaugcugauguaacugcucuuguuccucacauagugaggaagcuagggccacagagaauaucucuguguugucagagaggaaacugagccucccuggaggucuuauaaguuguaaaagugagagguggaacugagaccagacacaaacgccuuugcaucacuccuuuaaccccaugcacucggggcaggagcguggcaggugacucugaaccacacugugccagaggcaggcagggcccccaguuugccccacgggccuguggcacuuagaauugcaccuugcucugcugacuaaaaauacauuucuguuccuuggcccaagugccaagagaaguggggcuguuuggccuuguuccugcuauuccauuagacagcauugaaguauguaaagcaggagagaaaaaaaagagaguuacucccuguuuggauucaguuuggaaaaugcagguuagcacuggcagccagcucuuuggccugaaguugggcaccaucugacuuggucagugauuucucugaaaugacagaaaccgaaggggcuuuaucuugguuuucucugaggugccuguguuccccauucuuagauuggaugccuggauucagugcuggcaaguuagguuagcagcaugacaucugggcagcuggauuauugauaaugcuucaugccuuuucuguauuucccaaguggaccgugcaaaggacaagggagaaaacaacagagcaggcaguggaugagcaucauuuuacagcccaaagaaccaccuuccucauccuaaucaaugaaggcagaagacuuagcagccccauccacaugaugauuccagucauccagguuuugaacagcagguuuugcugaugugucucuuacuuuucggaacuagugaacugaagggugucacguguucuguaaauauuuaguaggcacuuuuugugucccugcaguuguggcccagaggcugucccagggagaagcagaagccucaacacaucgucugaaaaugugguaguuaauaguuagaugcuuauaguccuuaauccucaaauucuuauuccguuuuugugggcagacagaggaucagaaaaaaauaaucaaaauaugcagagagaauagagcaaaugucugcugaggccaugugagugacaggagcccagacaacuuucuugggacaaguuuauagguagaugcaucacagaaaagucagggcuagguguggguccugcugucucuaauguaguugugaccugggauacauacguuacuuuuuuucucagaugaggaaguugaagcagaugguagaaguacccucgaagcuuguguauucucuuugugacccgaaaguugagaguaggggcaauaaugucacaaaagacauaguuacccucugaccaauaaccacuguuguugcuuucugucuuuucacagaaguaguggguuuguuaauuuucagcuuggacaccuauaauuauggacuuuugccucuggaaguuggcccuuucucucuguguuucauuuugcuuaugcagaauugagccgacuuccagacaccagagcccucccaagcuggguggcaccauugggagagccucaugggaagaggcauugcucugcaccuggcuuuuucugucaggucuucaaaagagacuuccauaguuuugggaacuggagucauagagcaaaauuucaguugguuaauacuuucugauuaaaggaaucuaauucaguuaacauauuugucaaagaacagauuuauuugcauuguguucugaggauaaugccggagccauuuguccuuaauaaacagaaagcauagaacucaaggaaagcucuuaauaagaauggguuccggugagggagcuaauuucauaaaauagugccgagaaaaagaaacagacuuuuguuaaaugggggcagaagcugccaguggauuuucacguuugagauuucuuucuuuuuuaauuuaaaauccaggacacucaaguuacgauucccacagcaacaguaauuuugucugaugcaucaaugacauuucuguugaggaaaaaucucuguuuuuccggugguguugcugcacuuguacugucgagaagauuggugacaguggaaaucguugaauuuuucaguccugggaguaaaaauguaugugguauaguuggucuuagcuuuugucuccugugcauggacuguagcauauuacccauaggguuggccuugucuaccuaacaacuucuccagcugguuuguucuagacuucaucccuuuauggugccuugucauuugcucucccacagccuguguccucaaccaggaggaagaccuaggcaaaacuuaggggcacacaauuaauugugacuuuguaauauugcuauuaaaauuccuuagguuuagguugcauuugaaaacacauugaaaugccuuuuacuucuaaucuugaaaaaauguuuuugaaaacuauuuuuuuuaaugagauaagauaaauguacccagggacauggggaggcaguguggggcuggucaauggguacaaaaaaauagaaugaagaccugcuauuugauagcauaacagggugacuauagccaauaauaacuuaauuguacauuuaaaaauaauuaagaguguaauuggauuguuuguaauacaaaggauaaaugcuugagggcauggaugccccauucuccaugaugugauuuuuauacacugcaugccuguuucaaaacagcucuuguacaccauaaauauauacaccuacuauguacucacaaaaaaaucagaaaauuuaaaaaaaugaacuuaccauuaacucaccauuuaaaagccacuuguaguacguucucaguguugugcaaccaucaccacuacagaaugcuaaaacauuuucaucaccccccaacccaccccgccccccaaaaaaccccauacuccuucaacagucacuucucauaucccucacccuagccccugguaaccacuuauuugaaaacuaauuuuuuuuuuuuugaggaaagcauuuuucucucauguuaacaaaugaaccuggaagacuucauuuauaaauaacuuaauaaaauaucugagguggcuuuaacuauauuuugcugugaccucuuagcugaagagaagugauuaaaugaaagggauaggaaggccgggcaugguggcucacaccuguaaucccagcaguuugggaggcugaggcagguggaucaccugaggucaggaguucgagaccagccuggccaaaauggcgaaacuccaucucuacuaaaaauacaaaaaucagccaggaguggugggaggugcagguaaucccagcuacucaggaggcugcagcaggagaaucacaugaaccugggaggcggagguugcagugagcuaagaucgcaccauugcacucuagccugggagagaagaacaaacucuuucucaaaaaaaaaaaaaaaaaaaaggcgggugggcgggagaggauaggauacuuaacagcccucuguuguaauuucuggagaauaaaacuuggaaggaaagaaacgcgguguccuaccugugaccaagcggggagguggucaccuucccccuuccccgggggugagugaagaguggacgaagcccugggugggguuggagggaucugaggcagcaaaggccugagcccucuucuuggcuggaucuguuggugaaguaaagucaauaggaauacuuaacucucugaguaccuagcaaacccucuggaaaaaaagaggggcgaaaucaaucuucuuuacaggcucguuaaugcaaagaucaguucgcauuaaaguguaauuaaagagugagccuuagagagaggcagcugugaucugcugcagcucagggcuggggggaauaaugagagucccuuagaaggcccaagcuggaagugaccuggagugcaacgucggaaaauuaggcucggccucaugaucugagcuaagguuguuaauaaucaggcuugaagcacaggugagauuauacugaggaacaggcagcggcuggcauucccacugcauguguguguggggaugggcagacuuauucuccaucuaaggagcuggguugagacgucuuguccuucucuucacugccugccuuuaaaacuuucuccauguugcaucuccugaagaaaggcauccuucacuggcauaauaaagaauugaugugaaacauuuuuccaugugauguuuaucuuuggagggaugaaauaagaauuugucuuuaaaaguugagugguaaucucagaugguggagcucuuugugcauuuauuccuagcuggaccugugggcaccauagguguguguacagucgaggugggcguagagauucuccccaagaccaaggguugccccauccuuccuucggaggaauuaucugcuggucccuccaccagucaccagauuaagaguggaccuaaucaaggguguuagaaaauaugaaaacaaguauauagguccccaugcuacuuuggacaggcuucccccgcguagcaaccugauuuagcuuuacuauugaaggauggccaguccguuuggguaaaaguaaaccuuacuuuaaaaaaaaaaaaccuuacuuuuaccauuuggguaaaaguaaaccgucaguguaaaaguaaaccuuaccugggcuacaggcauuuuauugcucuggcaauaaaaugaauucucauuaagaguguggaguuaagagugaaugacuccagcuacuuuaggaagaaaaugugagcaaagcuguuuuaaaaggcccaggcugaguucaagugaaugccuuuuguuccuuggguaguccgaagcuguuuugguucccagaugcuaaagggggaagauacaggccuagucaaaaaaaaccagcacaacagggaggaauuauauauauacacauacauauacacacguauauauauguguauauauguauauauauguauauagauagauacagauauguguguguguauauauauauauauauaauuaucuaaaguucugguccucuucugaguuuucaaagauguguucacuuccuucccuguuugcacagauuuuuguugaugugaacugauuguuucuucuggauaaaaccucaugcccuuucccuugggagaugccagccucugcucacugguagaccaccuguagggcuugcugagacacaagucacugggucuuacccucguuucuggcuugguucaacgggucugggaugggacaagagaauuugcuuugcucaugaguucccaggugaugaugccacugcugcuggccagguggcuuugagaaccacuccuggggcucauauggggcuggggggagccccaaggcucaugugucgguucugaccaagcuguuuaggccuugggggacaguaaauuuccacuccuaaugucaccagugugguggcaggcauuuguuugggacaguggggcucuauggcccugguaauggcuucugagaaaggcucuggggcagugggcagagugagcuccaguaccacggacagaacagaccuggguggcucaggguuggaggcccaugacuguuacauauuugcuugugcuuaauuugcuguuuguuggugaccacucaagucugcccagcagaccuucaccggcugcuguagagguggagagcgcuucgugagcagcccaacguggcaggagcccuguuacucucucagccggugggugcuggcagcucugcuuacaggugagcauccccucucccccggcaggagucaguuuuagcacacuuaccuuucuuuugauuaucagucacucguaucugaucagucuuuauccucagcuaagacuugaaugccaccucuuuuuccagauggaaguuaacaggcgugucugaaaggugggcauuuuuucccccacccuacugggguccccaccugccccauugcccuuuccuagcacugcauuguuuaugaccagauuacucuccucccauuuucccagccugggaacuguggucaggucaacagugggcaaaagagaugaaaauguggaggaagucucagcugguucaugguggagaccguggguuccucugcacggcugcugugaaguuggccagcacaugccccacucaaggccuuucgugagcaaacagaucggguccuaugggccuggaguuacugcccucaaggaacuggcagucuagcugcagaggaagaugggugaacagacaguugucauacaggggcuggggaaugucuaaggggcaccucacugcccgucacugaugggucacaugacagagaaguuucccagaugaagugacauuuuagcugaggcucccuguucugcaaaccuccuuucucuuccccuacacagagguguaaguuacagguguaaguaacacccuaaauguucagccaacacaguggguacuuggaggagcauucagaggaauaccaaaaggacauggcuaauuccaucuuuaggccaauuugugcacacacacacccccucacucaucccccgcccccucacucaucccccgccccucacucauccccugcccccaacacauacccucccuucccugccuuuuuucuuuuucaacaggcgggcuuuuaugaagagccagcaggccgcuguugcaguucuuagaacugcagccucaucagaugcuggauaccaccaaggagccucaaaauagaaaauuaaacacccaauuuacaaagaaagcagcucucugucccggaaacuucccagggauuccguagugcagacugccacuugcccccagucuaagcaagccuuucgcugggaaaagagcugcuguggccuccgcagccagccugccaaauuacacagucaugacuugucauuuuccuucucucuuuucuuuccuuuuuucuccuuucuuugagaguggggguggugagccagccagaugagagguacaucugcaagucauuugcugagaaagugaagggaacaccagcugugggguugggggagccgaggaaggggagaucccauggaauaggagcuuggucacagagaucacugccucuuuuggaaacucgguagcuuuuguugagcguagggcuuuuuuccuuuccaccaccccgcccgccucuuucucucuuucuuucccuuuuccugaugaccaugcaagcuuuaaauauagcccaagauccacuggggacccggguugcuccccaauguuggagaagcaguggauggucucggaggggaagugcugcuucuuccagcagugagugcugaaaacccuccagggcugcuugaaauggagccgggaagcggagcugcucugucauugcacaaucucccgugugaaagggguuggcuccagcccauaucaacagucucauuccaacugggaccauuuccuccuccuccuccuccuccuccucccccuccucacuuccugcagguggcuucuguaauccaguuaccacugggaagccucaugugcauaugcaccuaaucugaaaauggcuggcuugacuuugaccuguguggugaccuugcagagaaggcagggccuauugugucugcucacaccugggagccauuuucagcuuuuauagcccaaguggaagaaauguguuuguguuuaugccgggccuuuccuucauaaggccugucauuguugggccauacauagggaauauuggauucccccugcuuguuuaaaggcaagaguuuuuaaagauagaauaguugacucaguauauugagucccaugaaaucacuguuuguguuuuguucaguaguggucagacaucagcaaucuuguauuguucagccuuuugagaagaaaaaauagugaccgucagcauauaugguacacugauauuggcaggcguugcucuauggacuucccgggaccugucuuacugugucaccucugcaguccuaugagacacaggaucuguuaagcacaauuuacagaugaggcaccuaaagcacagagacggcaaguaacgugcucaacgucacagagcaaggaagcaucaaaguuggauccuguuauuucucuccaucucuggggcuuaugcucacuguacacuuggaaguauguggucugggugccuagaagggucuugucauuuuaagugcugacauuucaaacuguacuaggugugggaagccuugguauuguggcccagaggcuucgaugauacucuggaguguggagucagaggcuccuacccugcaaaugcagcaugcaucucccaaaguggugcugcgugccucuguaaugcccuugcuuuaaaagccucuuucugacccgaggugaacuugcuuuggguagcucuugguaugauuuucuuucacugaugcgaaguaacagaagguccuucccccuacuaucuuucccugucucucucucucaugucaauucagagcugauuaugccggccaucugugaaagguacagugaggaaaaacacucuugucgucaggucucggcagagcccaaacguguucgauugugccaguagauucucggauaguggcuaucugcccccgaagacaucacuucaaggcaaauuccucugcaguuuccucacuuccuggaugccuuucaaacccaaacagcugaaauaaaggugccaguuugugguuuuuuuucuucccaacuucaucaaccaggaggugaaaugugugcugugaagugugcagccccagagguacucaugggcugcccucucaggggccacuggcuucugcccaacuagcuguccuauuguagagucucuuugggggcucugauacuuuuuuuccucggggacagcugcugugacguuaguuuguaaauagcagggcuccuuuuccacguagcgguaggacaaagguagguacaaauggaucucuucaccuuacgcugauucaggcaucaugugggcuuuauagagagggggcauuuuugcacagugguuaagagaaggcucuguauccaucagaucuggguuugaguccugccugcaucaccuuugcuaugucaccugggcagguucucucaggccucaguuuucucacucauaaaaugauauuugcugauaagguggugguuaggauuaacuaaacaguauguguccucaguauagugucugguauauacugaacgugcacugaguguuagacacucuugcuaucucugacagcuuuguacugagcaccuuugggguugugggcaaggcaagccugcuuuugcugcugugcucugaggggcauugcugcugucuacacugaacccuggaggccgccugguauuggagacuggagaggggucuauuuacaucccauaaaaauggaucuuacuugcagauauccaucauggcucacccuccuauaaaccaguugaagcuuacagaaaacccucguauauguaucuguucauuccucuuacgggagcuguugaggacagcagcagaguuuauuuucucuccucucuugucaucuucuguuucucuaccugggguaggugcagcaagcagcaaagugcuaggcaaauguuuaagcgguggcucucacucauaguagaaugaccuagggagcuuaaaaaaaucuagaugucuacgucucagggcaguuaaaucaaaaccucgaguuagugggcuggggagcagagggggugaguguugggcccaggcguuguggugguuuuuuaaaaaagcucuccaggucauuucagugugcagccaaaagcuuuaauaagccacagcuggauaauugcaacugaaaggcauuguuccuccucuugucuccuccccucucauaacuaucauuuaaaauacccaggcucccccaccucccuccacuccuuuuuuucccccucuuucuuucucaccagguggaggggaaauaaauauugaggcuggccuucauuuuaguacuuaggacucuggggaucccuaguagagguuuuaguuuaccucuuuucacuguugauuuaauuugaagauacugugcaguuagccacagcgugaugaggaaguugcuuugguggugcgcgggugaggguguuuggucugauuagaccugcccaccuuauuuggagaucacagaauucaacuguggauuugccccuuaucugggucauucuuucuucugauagcccacccaacugucauuugcauucuaccuauaugucagaaaugucccaccaugaugguggaaaaaacucucuuuauaguaaaacaauaggcaaaacugacuuauucuaagcuccuuaaacaccuuuuucuuuauaacuucaaaaguaagacuuggcucuuuuuaaaaaaaaaaaaaaguaaauagaugauauagaaacugaaggaucucacccaaaagcuuuauuguaauauagcaaaguucuggugcuaaaauugaguuggauaauuguauaaugggauuuugugaagguuguguuuggaauuggaugcuagguuaaguugcaaagaguagaacuuuggaaaugagaaaaaaaauuccccuuggacuuuuuagaaugugacuuuucugcaaaucaaauguacuuuuuauaaggggaaaaacagugguuaucagcaugcauagugaaguuuuucugccucguaauuguuggguucuucucaaucggaaugagagcuggcguguugagaaagccagcaugggcuucgugggcugggcccggggaggccuuggcgcaguucuuccaggggcuccccuuccccauggccuugcagacagcugugauaaacccuuucaccaccuggcuuuccucacgggcuaggcuggccccugcucugucuuccucuccucuaguguguguuaacgagaacccugauuuggugaugcuauagcaacuauuugguuccaaguaagagcccagugccugucuucacuuucccccauucccuggaaaagagcuguagucccugagagauucaauacgucaucaaaggaaauggugauauggcagagaugugcauucccugccuugguggccucaugggucaccucuaggaagagaaagccaaaaggcgugaguuguuggcauaguggugaggaccagguggccucucacagcgccaucccuuugugggcauuucaguagagggcauugguccauuuuugcucaccuccaguugggugcuggaauuucugcagugguaucucugcugcaggggaagcccucucaccguccucuugucgggacguaacccaaggcucauuccaacucuugggaacugggaggaaacaucccuuccuggaguguacagggccuuuucccccuuguuagcaccaguaguguucagaggaacgagugucagggcacuuggcuuguggucccuacucugacauuauggauccauuauaggacguuucacaaaacacuucucuuugugacuucuguucccucaccuguaaggagaggggcugguucaguaucaaccauacucaaccaggguuaaaaacacacauggcugcuucccuacuggaggccugggcuguauguucuuuggaacagacucacaucccuaguugagaacugcuguugugggugacccuguaguucuggggccccagguuccuggcaggcucacauguuuaugaauucuguggagaaggccggcugagcugugugcucuauguugcagagucugcguggagugggacaggggguagcacccuagcaggcccuucggguccggugccaaaucugggcccugcaucucaucucuacagggguuccccaaggccuuggcucccaagcauccagauguggcucugaggcagcccucaucccuccccacuccacaccagccacccaaugaaguaccuucaucaauauuugacgaagacaugaaugaagggucccuucguggcuucccauccucuaugggacaaagucccagcucuuucagaguuggcccuggcuccauuucuuccuguucucccaccucuaaauugugcguaaggaaagcccacacugggugugucucuggauccuguaccugcuucauuuugcuaccuugaucuggaauagccgccccucuucugaccuccuccccccaugauguuguguuccccucugccacugcaccuaugacaucccucugucuccucuggggcuggggugaggggcugauggcacaguagccacguccgucuuuccuugcagcagcugcauguagcaggcaucccauccauguauggaugaaugacucugagggaccaaguggaagggucaucuuaaggauaagugauugugggguauggggcagacacuagguuguuuuagauacuuauucaagguggagagacaggcuugggcacguuauaguagaaguggccugcugaggggugcuggagggcguggcucuccagccaggggauaagucuugcuugccuggauuuacugaagaggcaggcagggugucaagggagaaaaaguauuaguggaaacugccaugugagaggccgccuggcccagagguggacagggcuugcccccagggcucauuauugggguuugaguccugguucugccauguucuagcagcagcuuuucaagccucuguuugcuuagaugagaaauugcucuuaccuuaccacagaugugucaaaaaagggcucucccagucucugcucgcuuguuugaggggccagcaggugguuugggaaaggcuuucugugaagcgaagguggagagucacugcagaucccugcaggcguccagcccaugcugggagaugccacccguuccccacugcagagacggaaggaaaaugagggaggugcagcaggcugcguaaaagaugacauuaaggagugccuggauucuagaggugccaguagauggcauugagggggaaaagagugcucuguguucagaaaguucagaaaacccagaguugaaggugagcaccuuucuuuccugcagaacauuucagagccuuuagugcuugauguucccuuugagucuccaaggacaagcagagaucuuccuaagaucauuucaucauagcucuauuauguuuucauuuucuuucagagguaggaagggagauuuugggagcaugagaggugcugaccuagagaaugauaaaauccacuccucacguuccccuggcaguagagagugcugcuucccugucucuaaaugcacauccaugaaguuuagacuucgcuaccacaggcauauauuccccccuccucuucaguucuuccugugcaggcuugucacaguuuggcuucauuuggaggcuggcaccagacccccgggcucugcguuguaugucuuuugaccucaaaugagggggagagacgugguguuucccacagauagugaguagugagccaccuggaauacuuguucugugggauguuaauggucguuucaugaaaaggauuuuguggucauguaaguuuagcaaaugccaaagcaagccgagugaaagguguuguuaucaucucuccuaagccgcuuuucuuugcugaccugcugagggagucugcaagaggcgggggaggaaaugccccuuccugagcuugccugcacccagcacccuuuccauggaacaccucccaaggccaguauacgaaggaugaugcuuugggaguguggugucuggcaaccugcgucugccacuuucugggcaugcacgucuggcacgucuuccuuggccaaguagugcuggaagaagacacagggcuggaugacaaccccugaugccaggcaagggccacgcuagcuguccucagcuuuaucagcaacacccuugucucuaggagucccagcccucagcccuuuccuaaaugaugggaaguaauuaaacaguucaugcauaucccuacauuucagaaaucacacagagcccagugguaguuggugcuuggcucugagaccucagucauacuguguaaguuucugcugguuugaaggauggcuggagacuaguaaaguagcaggaaggcugauuccacugggaacucccccagacuuuccaucugauuccaccgugaaugccaugacacuuuuguauuguuguuuuaaugauacuuagggauaauuguugauucacaugcaguuguaaaaaaaaaaaaaguaauauggggagaucccucacguacccuuaaacccaguuucucccaauggugacaucuuguacagcuuuucauaaccaggauauugacaucgaugcagucagaaugcagaauauuuguaucauugcaaggaucucuccccuuuauggccacagucauuuacuucuugcccucacacccuugguugucuuuuguuuucuuuuugagacagagucuugcucugccauccaggcuagagugcaguggugugaccuuggcucacugcaaccucagucuuccagguuuacgugauucuucugccucagccucccaaauaccugggauuacagguaugcaccaccacaccuggcuaauucuuguauuuuuguuuuuuguuuuuuguuuuuaguagagaugggguuucacccuguugggaaggcuggucucaaacuccugaccucaagugaucugccugccucggccucccaaagugcugggauuacaggcuugacccaccaugccuagcccccccugguugacuucuaauguguucuccaaauuuguaguuuuuucauuuagaguuuuauauaauggaauaauaaaguauggauaaccuuuugggauuggcuuuuuucacucagcguaauucccuggagguucaucuagguuauuguaugugucguuccauuccuuuuuaaucacagaguuguauuccauaauauggaugugccguacuuuaaccauucacccgaugaaggacaucuagaauguuuccaguuuggggcugcuuuuaaaaaauacugcuaugaacauuuguguuuggguuucuuuugugugugugaacauaaauuuucacuucucugggauaaaugcccaggagugcaauugacaggucauaugggaguugcauguuuaguuuuuuuaagaaaccgucagacucuuccagaauggccauaccauuugacauuucuaccggcaguguauaggcaauuccguuucuccacauuauggccagcauuuggugguguguuuuuuuuuuuuuuuuuuuaauuuuuuugagacagagucucgcucuguugcucaggcuggagugcaguggcaugauuucugcucacugcaaccucugccuccuggguucaagugauucuuaugccucagccuccccagaagcugggauugcaggcuuacgccaccaggccuggcuaauuuuuguauuuuuaguagagacaggguuucgccauguuggucaggcuggucuugaacuccugaccucaaaugauccacccgccucagccucccaaaguacugggauuacaggugugagcuaccgcgccugaccgugguguuguauuuuuuuaauuucagccauucugauaggugugcagugauagcucauuaugguuuucauuuuuauuugcaugaugaccaaugauguuaagcaucuuuucauuugcuuguuugccaccuguagauucuuuuugguaaaauguccauucaugccuuuugcccauuuucuaauuggauuuuuugguuguuuuuuguuguuguuuugcucuugaguuuugugagauguuuguauagucuggauauauauucuggauaccaguucuuuguuagauaugugauuuguaaauacuuucucucaaucuguagcuugucuuuucaucuuagcagagucuuucacugaacaaacauuuuuaauugugauaaagccuaauaaguguuaaguuuuccuuuuauggauugugcuuuuagcgucaggucuaagaauuuuaccuguagaucccaaagauuuucucuuguguuuucucuuaaaagaucuguaguuuuauguuuugcauguaaguucaugaugacauguuuuuaaaagccugaaauagggaagaaacuugaagcuugugguuccacaaaagaaacagcaagaauugcuucucauaggaccccagcauggacaaggcacggguugagaugguucugggguacagagaaggggugcugcagacagugccacuuugguguuguaacaaaucauuuuuggggugggugaggaagggcugcguuaaagggccaacuccucaaucccacccauacccauccuuaacccucccggagcacugucaggucauaugcugaaggcuugagaaauugcgugguaagagauauuguaaaucguaugauugggagaucaaagucuuucaguuggggcaggaagcaggccugguuuuauuuuuaaaggcacaucagugguaucccuccccagaggaggagaggaucuugucuuagaggcugcagccaagugcugaaacagcuuccuccuuugccuggaacugcagagcugucaggaagcuggcaugugaaucucagggaaugugccaguggccaguagaggugaggggcccauguguaaccucagagggagcuuuagcgcugcagcacccacaguccccucucugucuucauagccgcaggcugucuggucuggcuuacugugccacugucacuccagagagcggcacagccuggagucagaggauaccuaugcuugcaucuugguuagcugggugacuucauaccagggucuuaaccucucugauucuggaguaggugguggcuucucuggcguggugguaagcaaugagcgaacaaguuucuuuuguucccuggagagugcucaguucugugccuuuauacuuacugccugaggaaauaagagccacucucacccaccuguuuaggauggggacauggccgcugaccacuccagucauccuaaauauaaauagagguggucuggcugggcccucuggcaaugcuguguugacaugcugugggcugagggccuggaagccuacgugugggugugggccccuggcaggacuggggaugaacaguggcuugcgacaggacauuccccuucuuguucccucuguaucugcagagucagguccugccucugcuccagucacaugguguggccccaguguaggguuaucccugucccugguggaugccgagaagaggugggagguauggggugcuaucaagagaagcugucuuccucagguuucuucugcccgcuucccuggugaggcaguuccacauccugacuaggagugugggauauggauuccuguuccgggcuccagucccaacugcacugcuuacugcuguguaaccuucagcaagugaguugaccuuuccgugccuuagcauccccaucuguaaaauggggacgguaauaguggccgccucugggguugucaugaagauuaaaugagggaagauguuaagagcgaagccagcgccuagcuacugguaagcacuaacaaaauguuagauuuguucccacuguuccugccauuauggcuacuccugccaccccuucuacuggaaagaaaaugcagugugacuccuccauagcuaagcaucaagggcaagcucccuggacauccauggcccugugcagcauuggaaccacuuccuggaggccgcagaagcaccagggcuccauuccagacuccggcuacaaaggcccuuugaaguuugcaccaccuggagcaggcuuuugugccaugagagugucgggggcaggggguucaggaggagguucuguguggaaaacccuccuuugugccugguggacuggugguggaaugcucaggccacccugggcuguaccaacccuacacagcucuccaccacacuucuuagucugcucugcacuuaaggauuaggucccaaaguucauugucuacguuuucauuaacugcuuuguaaauauaaauuuaaugucacauaauugacaggcaguaugcaaaaugggguggggauuccauuaucaucguacugugagaacaacauccuguauucccuaucuuuuuuucuacguguaucuucuagagagggacagucaugugaauuggugggcugugugcccugcuuuugguuuagcaugguggcauggacagucuccaggugugugagugcugcagaccgcuuugcccaaggcugagauggaaggguggcugugagaaggagguucauucugcucccuuugggaauuuggcgugaggucagcauguuucucaacagugguuccauuuuuucagguccuaguuggugaggucagaggaacagaaaccacaauagcucaugucagagcucauuggucuuggacuccugggugacccccucccccaguugcugaccagucccuguggaacuugggcagaggagguccuugcugugugaagugcaguaucuccaucauuucacaccccugggcucgggacuucccaccucacccuaguuggcggagccuucuuuggaagaaaaccaugcauggcagccuccugauacccuccaacguggguagugcggacgcuucuugguuaaaauuucugggguuagucccuggccuuaagggacacucucaucaccucauucuugaucguugccaucucaccuuuucugcuuuucuuguccagaaacaguugcucagccccuggagucugguugaauccaugucucucauucuguguccugguuuucuuaccuccuucccucaaggggcagagcugaacaggcagggacacaugugcccugacaauuguaaugaaguauguuuagccuucuucucaaagggaaaucagagggguucaguucagcugugccguacccgggauccacgguugugccgggcuugcuggcuccacaugacacagcuugauagcccggugcucugccaacuuucaggguggggccugugcucuacgagggcugagagcuuguggcggggucucggugugguggagggaacaccaucagugugcuggggugugggguagcaggucaccagggaaaggaaaacaaagggggaagaaaauagggauguauugauacauuugggggaaaacacagcccugagagagaagcaagugucuauguuggcccugagcaaaagcgauaaauacguuuggcucuucugacccagaggugggcauauguggcugggaauucugguggaaguggcucauuguccaucucuggcccaacuugagccugguuuuucaucucuuagcccaaccugguacugcuuugccaugcccagaugccaagacagcugaccuccguguggacauggaacuaacuccucaagccccuuagaagucacugcccauguuaggauggcauagccuuucucccugggaaugugauccauauguggcuuguacagcuuccucgggucagcaguguccacguggaacucccaggggaggcguguggauggggaccucaggcagggccgagcuguggcuagaagugagugagggagagauuguuggccagccuuggauaagcauaauugucucaacauugcaagccagugagggccaguguuugggguucaauugaaugugggaaaugcguaaguaacccccaccccgugcuauuugaaaaucgaaaauccaucguauucgacauuugcuuuuaaauaggucugucagcuucccuaccuuuuuuaaaaaaguuaacuccacguugugucuuaaauuuuuuucuuuuuaaaaguuuuuaauuggaugguugguccugccucaguguuuuuuuuuuguuguuguuguuguuguuuuguuuuguuuuuccugaguaauguuccuugguucagguuuguuguggugaauguaagacauugaacuaaaguuguaauuuguuuguuuauucaacaaauauugauugaguaccuuuuaaguucuaagcguuauucugggggcuaaggcuauagcagucaauacgauagacuaaaaauuccuagccggugugcgguuuauauucuacccagucgagacugcaggacuacuuaauacuuuaggagguuuuguuuuguuuuguuuuuaauuaauggacuuuuauagcaguuguaaguuuacagaaauggaguggaaaguacggagaguucccauaugcccccgccaucucuucucucucccccucacacacacacacacacacacacccacccuguuuccccuauuguuaacaucuugcauuagugugguacauuuguuacaacugaugagucaauaucgauccauuauuacuaaaguuuauaguuuacauuagaguucagucuugguucugacaaauguauaaucacaugugcccaccauuacagugucauacagaauagcuucacugaccuaaaaaucuccugugcugaaccugcucaucucucucuacccagccucuggcaguuaaauauuguuacugucuccauaguuuugccuuucucagaaugucauacauuuggaaucauacaauugguagucuuuucagaugggcaucuuuuacucaacaauguguauuuccuuaggaguuuugcugcugcucuuguuuauuugugcaucuuaaaugcagaacauucugauaguuuggauuggguccugggucauucaugaguugggucacucuagacuucacagaacagugguggccagcuguugaucguaccuagauuuuuucguuucagggauccggggcuuucaguucaauggguguaaguugaugggugggagaaccaaaugggaucugcuguagcaaggucccugggguuagguagucucauggggaugggacauugggucgucuuugcaaggaguuaauggaagcuguuuguugaagacccaaaggggagggugacccuaaaggaagugaacggguugggagguugguugacacagcccaguccugccuuuggagagguugacccugccuggcggaggcuguuuaucccgccacugggcugcucuuguuuuuuauccagucuccaccugaauaaacagaucuggaacgucaucugcagccaggcugagaaucugccaaaauuccccagggaacuggugauucaccagcagcaggggaagagagagggaacaagcaagagagagagaccugcuuauucugauucucauuuccuguccagcaaauaacccaggcugggcuguuucuuacgagacagcaguucuuugaguaaaugaucaauuucugcaauagaacaaaugauuuugauuuuaauuuuuaagaagauggauguaaagcaggcuagagggaaaugguuucaacugucauucugagaagggagacuuuuauucaaguuggauuaggaaagcucuuccgcauucacuuguucuugaaaaaugucucaucuuaauuuucaaguucuguaugggcauugguccuggcacaagugcauuaucguaagcuguggacuuuagcaucaacauuauuucuugccaauuuugagacuuagaauuauucuuuuuuuuuugugaucauuaggcccucacuuauuuuaaaaaauucuacuggacaccugaagaagauuagauugagcuuggccauguucgguggccccaggcuauauuccuaauguguuuuuuggggaggggucagaaaggggacauaugagggcaguggcaucugagaauguggucaaaugaagcagcaugaaacagggcacuuggagcuaaugguuuucagauucauuucaacccugggggacuugauuuaaaagaaaacuaccagugucugcuaaggccagacauaugcaagcucaaugaccugaguagcaauuccaugccuggacauugcacgccugccaaaaaugcaugcagacaugcaccagaaagcaagugcagaagacaaguccguguucauagcugugauuuuugcaauagccugaauuggaaauaacucaauguccgucaacaauagaaagaaaaaauaaauugcuguauguucugucaauagaaauaucguacagugauagaaaagaauuaacuacugcuaaugcagcaacccagauggaucucauaaacaauguugaguggaaguagccaaauaaaaaaggguauguacagaacaguuuugugucuguacagcacagaaauaggcagaauuaauugugggugguagaaauuagagguuuccuuugggaggaauaacaaccaggagacaggaggagggaggcuucugggugcggaaauuuuucucuacauuuuguaaaaauccuuuauauuucaauaaaaauguuuacaaacaaaacaacugccagcauuuggccauauggccugucugauagugcugcaauuuuaaaaaaaauuuuuuuaagagaugagggucucacuguguugcccaggcuggucucgaacuccuggccgcaagcaguccuucuacuguuggcucccaaaguguugggauuacaggccagagucacugugcccagccugugucuucugacaaggagaaaucaucaccuucauguguguuuuugaaaugguuaauguuuuuuggcauuugcagucauaaaguacaccuccuuagguaggcaucagggcuggugugcccuguacuaaguuucaucuuccgucaguaauaugagggucucagauagucucacauuguguggauuccaggugugauauguuguuaagauacacuguagccucagaaggcauaugugaaugugugcacgccuucauucauuuugauuauuuugagugcgugcuguauguggguggugacagugagugugugaugcagagccuugguaagaauuccagugcagcaccaugaugggcagagugcugcaggguguggaguuugaugaaaccugucugccaggaucacuuuguugggguaaugggggccggggguguuagauuuuuuuuccccccagucuagggcuagauuaugugaaacuuauuuucuaaccggagguucaggcgaagcaaagagcuauuauguggauuucgcuuauucauuaaguaagacguguuaagauuugaucuugaaguaaaacugugguagauuugccauuucggugagaguccacacucagauaguugacuguggacuuugugaaucacuguaauugucuggaagggcggaagggcacagcuucuuagaucuuagggauggagagcuggccagcuucaguauguuucagacuaauuggcggaacugaaacgaggaaggauauaggauauacaguguggauuucugucuucuguaaaguaacccuguuugcccaucuaucuucacuggcuccaguaaggaaccugguugaucucuugaggaacauaacagugguagagagacuuauguuccauuucacuuucugaagagguagaaaagacauuggcagaaaagacugugauuagugaugucugacaugggcacuggagggacaaugggaaaguuuucucucugcaguuaagagguauuuccuuauuuugcaggugguuaaacgagguagagaaagagugauuuauacaugguuccaaaauugcaugacagcaagaauuagagucugggucucugcaccccaagaaacacaaacugguugccauaggguugacagggucagcacaccacagacaguggucccaauccuggcccacugcuuguuuuuguaaauaaaguuuuauuggaacauagccacacucauucauuuacauauugucuggcugcuuuuacauuauaacagcagaacugaguggucaugacagagacaguaugacccacaaagccuaaaaauuuaccaucuggcccaauguagaauaaguuugcuggccccugguguagaaaauaggugcauaauuucaggggucagaaauuacccacuugacccaccuugucccaacugccuuugaucuccuugcccuuucuuccuggcuguuaucugugacaugagaucuuuuccaccacuaacgggaauaccuuguaaaccaggcuuucacagaacuguaguggaacaaucacuuaugagaaaaaguuuuaaauguugguuucaaaugccuccaucuguuucacugucuaauuuaacaucagcucugaaaauguagccaacuggggagagcuuaucuugccugcuuuccgccuuugaagacugauuuuauuuuugaagccuuuaacagguguugguuuaauagacuucugcuguauuaaguucuccucgcuccagagggcagcccaagggguaaacugacacuguggauggaggcgaaugccacgugaccuggccaccacacacuucccccgguccccauaagugcagaaucacugguuuugucugguugcagagaaaggcugcgcuguuccuuugaugaggccaauaagaacuguuccuagcacaacacuguccucuugccuugcaccauccucacccuuuuuuguaaacuuaaguggaucccuuugcagcuuaccuucccuaacaauaaagauacuccuuccucccucgauggcagaucuuucaagaucucaaagaaacugcccuuuucuuuccauccagaacauucaaaguaaaaacuugagcuuuaucugccuuauuugcugagauucugucacaugaaguccugugcacauuugcuucucacacaggacucugggaagcuuguaugagagcugggccaccuggccgaggccaagcuacguagaacaggcugaguugacugagaaauggccagcuaauguucagauuuagccaagcuuuggaaguuuauggguggaaucugggccagugcccuuaaaguucugccaggagagccucucggacgggcuagauagggucaugcuucccugggcuugcaucccggcuccucuugcuucccagcugugugaccuugggcaagcuccagcagacuucugagccucaauuucuucaauugccuaaguauagaugcuucucaacugacaauggaguuauguccagauaaacccauccuaaguugaaaauaucauuaagcaaaaaaugcauuuaauaccucuaaccuccugaauaccacaaccuagccuagucuaccuuaaaugugcucagaacacucauauuaguccacaguugggcagaaucaucuaacacaaagcccauuuuauaauaaaguuuugaauaucuccuauaauuuauugaacacugaguggaaaacagaaugguuuuauggguacuugaaguacaauuucuauugaauguguauagcuuuugcaccauugugaaguccagaaaucguuaagcugaaccaucguaagucaggggcugccuauaaagauaauaguaccuaccuuguuagauugcugugugauggcauugaugcuuugcccaggaucuacuguguauauaauagguguucauuaauuggucagcuguugagaggcaauaaaaagagguauggaucuucuugggaacugugcaguuaguuauguuaaaggagugaaaaugaugaccacuuggguuugcauguggaauugaaaacauggauaguuuccugaagguggaaugccggguugagcgagggcagcagacacguuuccauggcaucaacucucaggcaggaggugggaaggcuucccugcagggguuugaaugccagcuguuuacucuaaccuucaugggggggagaccuagagaggguaucuuagaccagcaggcuaccucuggaauggugggguuggugggguuuggugggcuugggucagggacguggccucaguuccacuugcugugggaguggggguggggggugucauccagaugcuggggaaucugucagaugucuagccacccugaauccugcagaaguugcagucugggauuugcuuugaaacguggggucuucccaguggcuggguuugacacucuccagcuggagcaggcuucuuuuaugcuugaaguuaagagugagagcucugagucagcccuucguuccugagaggggagccagagcugcuuguuugcacugaaauaugucagaagaguagacaagaaccagucauuaauuuuauucuuuuuuccagagcaccuccuacagacuagauccuuagccuggcucugaugacacaagcaugacuacuaaaaacaagaacucauuuuauugagcaguuguuacgugucaggucauaucagcccauggggcauaugaacuucacacaucacuuuacagaggggcucuucugagguucacaccugugagugggauagcugggauuugaaccugggcaggaagacacucaaggcauauuguuccacagugcugugccauguuccacagcaggaagaacuccacaugugccuuggagaccauggacaggacuuacuugggagacacaagaaucaucauuugagauuuagacagaggagugcugugaacugagucacauuuuguuuuaauuuguuucuuuugagauggaguuuugcucuuguugcccaggcuggagugcgguggcgugaucuuggcucacuacaaccucugccucccagguucaagcaauucuccugccucagccucccgaguagcugggauuacaggcaugcgccaccaugcccggcuaauuuuuuauuuuuaguagagacaggguugcuccauguuggucaggcuggucucaaaacuccugaccuaaggugauccgcccaccucagccuccuaaagugcugggauuacaggcgugagccaccgugccuggccuuguuuuaauuuuaaauugugguaaaguacacauaacauaaaauuuaccaucugaaguauuuuuuaaaauguggaguucaaugguguuaaaugcauuuauguugugcaaccagucuccagaacuuuuuuccaucuugcaaaacuaaaacuucauaccuauuugauaugguuuggcugggaugaugucuacccagaucucaucuugaauuguaacuccuacaauucccaugugucaugggagggacccaguggcaggugauugaauuaugaggguggguccuuccugugcuguucucauaauagugaaugagucucacaagaucugaugguuuuaaaaacuggaguuucccugcacaaacucucuuuuugccugcugccauccauguaagaugugauuuguuccuccucgccuucugccaugauugugaggccucuccagccagguggaacuguguguccaauuaaaucucuuucuuuuguaaauugcccagucuuugugucuuuaucagcagcgugaaaaauaacuaagacaguaaauugguaccaguagagugggacauugcugaaaacauaccugaaaauguggaagugacuuuggaacuggauaacaggcagagguuggagcacuuuggagggcucagaaggcaggaagaugugggaaaguuuggaacuuccuagagacuuguugaauggcuuugacaagaaugcugauagugacaugaacaauaauguccaggcugagguggucucagauggaaaugaggaauuguugggaacuagagcaaaggugacucuuguuaugcuuuagcaaagagacuggcagcauuuugccccugcccuagagauuuguggaacuuugaacuugagagagaugauuuaggguaucugauggaauaaauuucuaagcaguaaagcauuaaagaugugacuugggugcuguuaaaggcauucaguuucaaaagggaaacagaacauaaaaguuuggaaaauuugcagccugacaaugcaauagaaaagaaaaucccauuuucugaggagaaauucaagcuggcugcaggaauuugcauaaguaaugaggagcugaauguuaaucaccaagacaauggggaauaugucuccagggcaugucagagauguuugcggcagccccucccaucacaggccuggaggccuaggaggaaaaagugguuucguggggcaggcucagggucccugugcugugugcagccuagagacaugguguccuguguuccagcugcuccagcuguagcugaaaggggcaacauagagcacggaccauggcuucaaaggguggaagccccaagucuuggcagcuuccauguggugcugagccugcagguaugcagaagucaacaguugagguuugggaaccucugccuagauuucagagcauguauggaaaugccuggaugcccagguagaaguuugcugcaggggcggggcccucaugaagaaccucugcuagggcaguguggaagggaaauaugguguggcccucaugaagaaugucugcuagggcagugugggaucccccacacagagucccuacugcggcacugccuagggaagcugugagaagagggccacuguccucuagaccccagaaugguagauccacugacagcuugcaccgggcaccuggaaaagccgcagacacucaacgccagccugugaaagcagcugggagggaggcuauacccugcaaagccauagggguggagcuuucccaagaccaugggaacccacgucuugcaucagcgugaucuggaugugagacaugacugccccgcuggauuuuggacuugcauggagccuguagccccuuuguuuuggucaauuucucccaguuggaauggcuauauuuacccaauacugauaccccuauuguaucuaugaaguaacuagcuugcuuuugauuuuacagguucauaggcagagggacuugcauugucucagaagagacuuuggacuguggacuuuugaguuaaugcugaaaugaguuaagacuuugggggacuguugggaaggcaugauugguuuugaaaugugaggaugugagauuugggaggggccaggggcagaaugauaugguuuggcuguguccccacccaaaucucaucuugaauugacucccacaauuccuaugugucauaggagggucccagugggaggugauugaguuaugggggcagguuuuuccuaugcuguucucaugauagugaaugagucucauaagaccugaugguuuuaaaaacaggaguuucccugcacaagcccuuuuuuuugccugcugccauccauguaagacauacuugcucuucuuugccuucugccaugauugugaggccuccccagccacguggaacugugaguccaauuaaaccucuuucuuucauaaauugcccagucucagguaugucuuuaucagcagcaugaaaauggacuaauacaccguuaaacaacagaucuuccuucugcggucuccccggucccuggacaccaccauucuacuuucuguuucaguggaucugacuacucuagcuaccucacauaaguggaccauacagcauuugucuuuuugugacaggcaucuuucacuuggcaucauguccgcaaugcucauccauucaguagcacguguuagaauuucuuuucuuuuuaaggcugaguaauaucucauugcauguauauacaacauugauggacauuugggcuguuccaccuuuggcuguggugagugaugcuucuaugaaugugaggauacacaugucucuuugaggucugcuuucaguuauuuagauaugcagaaguggaauugugggaucauauggugugccucuguuuaauuuuuugaggaaucuccauaaugucuucuucugcaggugcaccaccguuuuacauuucuaccacuggcauacaggguuucacucucuccacauccucacccacacuuguuauuuucuguuuguuuuuuuguuuuguuuuguuuuaauaguggccauccuagugggugugaggugacuucucauugugguugugguuuacauuucccuaaugaauggugauguugaucaucuucucaugugcuucuuggccauuuguguguuuucuuuggaacaauguucaauucuuggcucauuuuaaaaaucagguugguuguuuuuuguuguuguuguagagguucuuuauaucuggauauuagccccuuaucagaaaugugauuugcauauauuuucucuuauuccgugggaugccugaagugacuuauuuuuagcgggucucucuggcugcuggguugggaauagacuguaagugggcaaggauggaagggaaggucuagucaguagcccaugggcaugguuaucuuccauuuccaagcuagaacauuuugaaucauuauugaugccccuaguugucaucuccagcccccaccagggcaggguguuucaagguaggaugcugaaguugggaggagacagguggggagaggccagcagcuuugaucagaggguggagcugguaggguggguaggaccuaaucagagggucucuugugccugucucuguauugccgccaucucucuccuggcccacuguggcauccauucccaacuuguuagcuugggcugcgaggcauuugcuguugugguccugcccacccuacuagcucugcaaucugauccaagcuccuggcuucugccuaccugucuccuccuggccucagcauccuacccucagacauucgcccuggcaccuugugcacucccuugcuccucucacagacccugccacuguggcccucacucccacacacccuugucucccaucuccacggcugccucuucugccaaauggggaacuuucccagcgggugaaagagacuugucuucugcacaggguccuuuaugcagaguggggcccggauuguguuugauucagcgaaugaaaagacugacaaggagcaaaagguaccggaccacagacaaagacugaggagacagaggaggagguggggagaggacagaacuggcgugggagagauguugggccugcagcugucccacggcuucgcaauguaaggccucacccccucuuugugccuuucugggccgguggcgcccggcccuucuguccagcacagacccuuuuccuggcgcccugauaccacauucacaguucccggauaagacucagcucugucgccuuuauuucuuguuucuuuucuucccauacuuuacauaauaaagguuuucuuuucuuuuuuccuuuggagccagaaaacugaggagacuaucuuuauuaaagaacuuaauaaagaacucaaaggaaguggcuuugggggcuggggaggagaggaagggaaaggguccuuucaugccggggagguucugugugcagaguugcacccuuggaaauggacuuucgaguucagggccugggagacgcaugaaaaaaacaaaggaguccacgagaagccccagagcuucugggaaagagguccuuguuuaugccuguuggaacugauucggucaaguguuuguuuaaaggagaugccacuugguaagcgacgccuggcuuacuuguguuguguucaagaaugcuuugauuggccagagaugcugacacuguuuauucagaacuggcucgagugccagugccugcaaccuagaggcccagcgccaccacccagcagauuccuaagugucuaauauuggagugagggcugcagugguuugacucugccaggcggcgccaaacccacaacagggcgguuagcuaccucuagccuuggcuagcauucgucuuucucuugacuuauaacuguugcuuguuuauauaguggguuugacagaaaguagauuaaaggugcgcacaggccagcugugguggcucacgccuguaaucccaacauuuugggaggccaaggcggguggaucaugaggucaggagaucgagaccauccuggccaacacggugaaaccuugucucuacuaaaaaaaauuaaaaaauuagcugggugugguggcacgugccuguaaucccagcgaucugggaggcugaggcagaagaaucgcuugaacccaggaggcggagguugcagugagccaagauggcgccacugcacuccagccuggcgacagagcgagacucugucucaaaaacaaaaacaaaaacaaaacaaaaaaaaaacacaaguuacaguggaacauuccugucuugggagguggugaccacuaaacauuuaccuucagauuugccacaugcuuuaugugguuuuaggcuggaucgucccuaucccugaagugauggguuguggccccaucuuccaaaugagaaaaccgaggcacaaugcuuaauauuaaugguagagucgggagguucagggaacucaauuucaguuagacucagcagugagcuccucuuucccauuuuacauugucaggauuuugucguaaucuuuuuuuuuuuuucuuuuucuuuuuguuuaaauccucugugucugguauaugguagguguugguaaaaugugagguguguaaugauguguuaaacuggauuaaagugaacucugggcuguggugccuauggcucuuguaaguuaugaggcuggacuaggucugaggaugaugggugagaguuggacuggagcugucuggcugcacaggacagggcacauccuuuauggugagugcauccguggauucuggucaggucaugcuggucucacauggucuucagugucacugcuguguuguugcccuuggagagggaagccuagggauagaacuuugauaaacuugucccagauugaaaauccaauauucuccuagcaucuggccagcagguaauaacuugaugggaaaagaaacaggagaucucauuuuuaagagcgucacugcauuguaguuauauuggugggggguggggugcaggaauacuaguuucuuguaguuacuuugcaaaaagagaugcucaagucaccucccuuguuguguuucaggcagcacaacaagauucgcagcguggaggggagccagcugaaggccuaccuuuccuuagaaguguuagaucugaguuugaacaacaucacggaagugcggaacaccugcuuuccacacggaccgccuauaaaggagcuguaagugccucuguucugccaccuguggcuggcccgcuguguccagccagcuaacagcuucaccggcacccaguucuggaugcaggagggaugcuuccuucccuucucaaccacggcugggccgagucaguggggaugguucagaccuucccugagcagggcaggggcgagccccaugcauagagcacguccagauccugcagcauuauccugacauuacagacagacaagggacagaggcaggaaggacucagcacuccaagacgagagucuaggacucaagaacagaucgaucuugaccacaaagccugcuuuuuuucccauuuccuuggcugccucucagaaaugcuuccagaggagauucagggaggaugguuagaggauucacauuggaagccugucuaacagggcuuagcuuaucagugcuuaucuuucuagugucaugcacuguaaaacaagucauuggguuuguuugggggagggcaguuacucuauuauguggguuuucagcaccuuuuagauuugucuguuucucuuacccauauuaaugucccaucucacacacaauggaugguagacaggaaggaaaaaaaguuaaaaccuacuuaaucaacuacuuguugguaggaaaaguguuacucugggaaagaaacugcaaccccaggcuaaagagacguuuuccaauuccaggugaguuuucauuccgugugucauuacuguuccagaguuaacuuuggaacgcauucgcaaggcugguuuaggggucauugugacccaucuuuucagggagggugagguuuggcacauggauuuuccaaguaaauacugcaagaagaagagugauuucuuucuuagccugcauuagggcgccagaguugggaacaggaggccuuggcuuuugugaagccuccagugugggcccucaaaagguguccacgugacaccacuuugcuugggacagagaaaccauaacugcuacacuaaguugcucugaccucucccugcacaaaagugggagggacuuucuauuuuggcagcuauugggugauauaucuucaucacacaggcuguucuuuaaucugagguguugagaacaaacaguccagccccauuugcaaagaauccuuaugugccuuguccuaggccacuaucugcuggagagacaaaaagugccuugcucccuuccacccucuguggcagaaaauccucucuggucuuucuccuuuucacuuaggccagaaaaagcagcauuuguuuggggaaggcagaggagagguguuggaaaccacuucucacaggaaugccauauuguucuuccuuguacuuucuuuucuuuuuuauuacuugauauaauuugcauacagcaagaugcacagaucugagcugcagacuucugugccuuuugagaagcggugucugccuuuuuguauugucacgggagaugccccgacuuaaucacgcuguaaguguagguaccaugacauauugcuuguuuuacgaagggauucugcacaggucucuucagcuagaguguuucuuugaggcauuuacaauuacagaaaugaauugguuuauacauauguguuauguaguucauauagcaagacccaccucaaaacuaaaggcuauuucucuaaauuauuaaauuaacacugaccuugccuuucaguugauuuucugcuuucuaggaguuuucacgucaaccuugggcacuggguggugagaagaguccugcagguggcuccugacgcagggcuggugugucagugggcauggggguguuugacuuucacucccacccucuugggguggcccagcagcuucaaggacaguaugcuuucgacuaaaucggccuugcccucagggcuuaggugcacaguccuaacaccugcaucucucuagcuccccauccaaagccuguggcugauaaacaucucacuggaaaccugucccucuggugucuuaacucaucuucccaacucagacccagagaggucuggugucuauaaugaaaugaggaaggccuuugaccaaccaccacauuuucuuuucugaaucauuccagcaaccuggcaggcaaucggauuggcacccuggaguugggagcauuugauggucugucacggucgcugcuaacucuucgccugagcaaaaacaggaucacccagcuuccuguaagagcauucaagcuacccaggcugacacaacugugaguacagaaaccuacacuuuaauuaaggcuagccaaacuuuauggaggccagauuuccccaaggaccucguaccaaacgccacccuuuccuugcuccauuugguaaagcucuccauaaauuaccauuaauggcagcaccucauaaaagcaaauucggagcugggucuggugcuguggcugcuucagguugcugagaaagacauccacugaggucgcuuuucuucccugauguuuuccaaaauggaaucaggaguccugcugcuuagcugaugcuggcuaaugcugaggcugcauggguuuggguucuuauuuaucuuagauguuuuucuguauuuuuuuaagauacccguaaaaucuguaccuuggacauggugguguccgacacuucuugaacaguuugagaggaaguuaguguagcuggaguuaguaagcaaaagacaagccuuugucuucauaucuuuaaucuuacaagguaguugauuuauuauuauuauuauuuauuuauuuauuauuauuuuuuuuugcgacagucucgcucugucccccagguggggugcaguggugugaucucagcucacugcaagcuccgcccccgggguucacaccauucuccugccucagccuccagagcagcugggacuacaggcacccaccaccaugccuggcuaauuuuuuguauuuuuaguagagaugggguuucaccuuguuacccaggauggucucgaucuccugaccucgugauccgccugccuuggccucccaaagugcugggauuacaggcaugagccaccgcacccggccgauuuauuauuuuuguaaacaauuuaauuguuuaguuuacugauggaaggcugaguacccuucuagaaggcagaguuuuagauucaaguaaagcucuguuaaccagagccugacgaaggacuuuuuuucccugauuuuuuuuuuuccugugcccucuuuuuagcagaagaauguauuucaggaaaauaagacaguauuggaaauuuuguuucaacaaaacaaaauaauugucgagggccagguuggcggcacgacggggugugccuggcucucauccuaccuggguuucaccuccccuggguggggaguccuagacuuugccauuuucagucuguggagaaggucucagugauuccugagaagguuuguguggggcagcaucaugagacacugcagaaauauuuggggaaaaccaagggcuuucuggcugcucugccuccccuucccgcaggggugcuaauggaucuggcccacccagauuccugacaucuuuuggugaacugaggcuuugucauacuggggcuagaagccaaguguauaugacuuguggggugucucuaccccaucucccccugcccccaugugcaguaacuucucuccauaguggagaugcugugaaaugcccccaguggaaaguguuauugccauuugauacauagugguuugguuuuuccuggguugaggcaugugguguggauuucuguugcugagcucagagauaccucacauaagacauucaccccuugagucauacccacguccucacugcagagucacaaauggcacuggugcuacugggggaggagacgugagcacacacgcguucucuucugugcagcugugggccagccucggagcuggcuguggagagcuggccucacucaccccucuugccugcacuagguguggucagguggcagcaucagugccugcauggcagccgagacacauggugggcuccccuacacauccuggcuucccagggaucccugcacugggauuucuccucuggcuuggaaacuuagccaggacugcuucagaaugguugugggugggauaugcacauaagacacucugacccugcuggcuucaucucuuuagggaccucaaucggaacaggauucggcugauagagggccucaccuuccaggggcucaacagcuuggaggugcugaagcuucagcgaaacaacaucagcaaacugacagauggggccuucuggggacuguccaagaugcaugugcuguaagugcggaccagguuacuggcauugcuaaggauugcugugcgguguggugugauguggcgugugugugugugcgcaugcaugugcgcaccaacaccaacguugcuguguguugggugugugcgcccacaccagcauugcugugugguguggggugugugugcgugcgcgugugcacgugcgcgcccacaccagcauucagcugugcacugggcauggaguggggcaccagugcccagccccucucuccugaaggauucuucaagacuucagccggacccagcccccuucccuuugcagcuucaccugggcccaacucauugucuuggggaccgggccaaaccugaggguauuuuccuagcagauugggacauccacugaaauccacuugggggaaguuucagcggauugagucagauaaguugguugauggagauggaguuugggggccauucugccaggacugcuuuccacagcuugcauccacugcccccgccccugcuucuucggugaacguggggcugcggaacagaccccuccucacauccucuccacuccugaccacaggaaguuccuucucuccccuucuggguuugacagucuuuccugaggugcaggugggccaaaaauguagagcucaucuuaggagguuuauuucugucuugugagcuaaucaagacacugggugcagauguuuaaguuuuaucaagggagcagucucuucagccagauguguacagcagcagaaggggcuugccugcacgguaacgugaaacagcagggcagcauacagaaaaggcuuuuuaaacguugaaagccuuuuuaaacguuaauauuuauuuuuaaucaaaaguaauuugacuguauaguuaaauaaaaucagauaguaaagaaaagccaucacugcccaccccagccucccccgccaccacccccucauucucucuucaccccaguucuucucccaagaggcaagcacuucuaagccuuucucuuuuucguuuuucuguuuuuagcuuugcugguuguuccuuccaaguugauagacugacaccacugucuuuacuuauccacuugcgauuuccuccuugagagucaaugauuuaacuugcucauguccgccccuucuucuuccagucugggcaaauuauaucaugacucgaauguccuuuacugguuuucuuggcaguggaaacgagcuaggcccagguccauccacauguugugcugugucacucugauaaccgucucugcaugaccagcccucccuacucugugaacagugaggauguuuccugccgcugggcuucuugcucuacccauucuccacccuuuguuuuacauauucaaaaacguuucacuugaccuccuuaggcaugucauuuuggacuuggaaguccaagguggucaugugcuggguggacugaaguuaaaagagaauucucagaggaaaauggaguuagcaccuaccauuugguuuuuauguugaacagauuuguauaaauugagacugaugagcugccuuagagguuauuuauacauuaagugcuuaccuuuugagcaguagcagaaagaaagauggaaaaaagcaaaacucaguuacccaaagcccuuguaauacugaacacggagcaaaauucggguuacggacuuuuguugaagaggcgguugccugggcuggcgcuguccuuccuggcacaugcuguguugggaagcggggugcuagcacacuuacacggugggccugagagcucaggccuagagcugcacugaauccugauguacccuuguuuccuucuuauagugaccccauggagucagugcucuuggauaucuccauguuaguagaugugcagguuuauucagccagcaagcugcaaaauuaggauuuaaauccagguagucugacgccagagcuaaagcgggucuccuagcacaguggcacagaguccagccuuugguaggcagacccaggguugaauuaauucuagccccuucccuacuggcuaagcuguguaaagucuuagacagguuaccuggcuucucucagcagcacauuccucaugugugagaugcgggugauaauaagagccgccuccuauucgcucuccuuucuauuccuuuaaugggcuuugcccuugccuggaacuccugugcccguuuguuggccugggucacuuuuuguuuuguuuuugguagagaugggguuucgcuauauugcccuugcuggucucgaacucccgagcucaagcgauccuccuucuucggccuccccaaguacuggaugggcauaagccgccacacccagcccugguucacuuuuacucagccaaaaaagucacuucuaggaagcucccucuugcccuaugaacacucgagucggccuuggcaugugcugucauccauuuugauuugccugucuucucccagccccuacucacaugcacaugugugcgacuagacuccacaguucugucgugcacuguucuagccuuggugugaccgcagugucagguacagcguggcugcucauuugcugucuguccagugaagggagugaaagcuccucuucauccugugcauggcugucauugcaggcaccuggaguacaacagccugguagaagugaacagcggcucgcucuacggccucacggcccugcaucagcuccaccucagcaacaauuccaucgcucgcauucaccgcaagggcuggagcuucugccagaagcugcaugaguuguaaguguccucggcucugggcuguggcaguguuuuuagacacugcuuggaggugaaagugcuaggccugguucguuccaccacacaguggccucggggagggcucagagacaggccaguagcccuguucccaaaccagccaggcccaggguggaacccucagcgauuugagccccagucccuuccucaucuccccuucacuuccucugcauuuggauuagcaggggcuccaggaguagcagcuaggucccugcagggagccuuggcccccaagguccuguuggguuuggagacaguuccagggguagaaaguuccuggggaagggcagcuauggcagagugcucacaggagccauuuugagagugacuguguguuaauggccacaccaaauagcaugugcuucuucagugagggggucauuugggcucaaacagagacagugaaacgcugacuguggaugaauuuguguccucggagucgccaccuuccuuccuguagaugagcugcccagguucuuggccccuucccuuucucuguuuugcaccgcaguggccugcuggcagaggcuccugugcagucgugugcgugcuuaguucagagauguguggugugguccucuugcuccuuuuggagauuuccagacaggggucccagguugagacugagaacugagcuugucuugcccaaaguucugagauuaguagugacagacugucgccuggguagcgaugggcaguggcccuggccaccccaucaugucagggugggguuacuggacagugaacgcagcauuccuaaggacucagagaacaucuuuacaagucuauaguuuguguuuucacuguucuuuccauuugauaugcuccaguuuagucuacuguguuucuuuauuuuucacaagaguuggguggguuuuuuuguuuuguuuuguuuuuuucuuccuuuucuaggcuuggcuguuggaaaaaauucacccacugaagugaaugauuguuaagagugccaagccucagucuguccugucucucucuugaccucaccaggcaaacucaaggggaugcgugaaucuaauguggauucuugcagcugguguuugugucuggucuucuguguucuccucucucucccuguccuuccuucccuccuccucccccccuccccccaccacacacacacacacacacacacacacacacacacacacacacacacacugacuuggaguuuauauuuuggugacuccaucauuaucuaaugcaaaacacagugguccugccucuuuccuaacuuuucuuggauucugugaguguuaacccuuugguuucagcuuccuacgcuucagggccugcaguugugcauuccauguggugcuggauggcuccuuucaggcucuguagucaagcugugaccccaccaggggacuccugguuuuguuggucagggccgggaggugugggaagcaagagaggucuuuuaaguccccgaagccugagccaguccaauucuuaaagugaggggccauccucugacucaccaguguaucguggccccagggauggcaugcugucuucugcgggguccgggauccccucucuagcugguggaaggcaugaagcccucuuccaugcccucuagaaggggcagcaaagaucacagaagugcgcuugagcaguccuagcaguuugcaccauauccagguaaccucagaggcagauuugggauugcuucccagcauguguuucccaccccuccuuuaagcuaaauucuuuaauugcaggugaggauauaauuuugaucuccugccaggucuguuuaacugacagacacccugacuuauuuguccaggagggaaagaaugcugcuccuagcugccuuuaaaagcucauuaaucuucucugaguuuauuuuccaucuuccuaucccugccccagccccaauuuuucaacgauagaugaccaauaugucacguaagcaacccagaggugcaggagugcugggaggaagcuuugauucugagguucgggcaaagcaugugcuuuuaccgccugcaguaggggaucaugcucugagguccacguggaugggggcagggaggccugagcaggagccuccugcccugggggaguugccccacuaaggcaugaggcacaggugugguugucccacgcaggggcuaguggugcccucugcuggcagaugcagggagugugacuggggcucccuggcuugcugcggggucaucuccagaaucccaggcuucugcuaugagagaggucuuuuguagccugaaucaggagcugccuuggacagcaugaaggcgcuggagcuugagaguuguugugugucaugaccucguguguagucuucacaguuuaacagccacccuggccccugugaccuaugcacccauucuacgagucagacuaguguguugggcacugaugaguuucuagcugcauggccacuuuuacccccaggauucugugggugugggugugugugugcacgcacgcgcgugcgugugcaucugugucauuucccacugaaacccagcugacuguggcccaauuuccgguggggugggguuggggggcaaccacacuagauggugacauugcugcccucccuuuccucaggguccuguccuucaacaaccugacacggcuggacgaggagagccuggccgagcugagcagccugaguguccugcgucucagccacaauuccaucagccacauugcggagggugccuucaagggacucaggagccugcgagucuuguacgucucccacuacugacaggauaaagggguccccaguggggagagcagaauagagcaaaccaucugcuuuguugaacuccauuugcguuggcuucgagucagaauuggauccaaagcuggcuugcucuaugugcagagucucaaacuuuuauguaaucaacugaaaaagaacugguuaagcagaaaaaucucucauuuccccaggauggugccuagagagggauggcagcuccuaaaaaguaguuguucucaagcagugaugcccacguugugcuggacaggaugcuggcuccuaguguuggaaaaagcuuccccacgcugagcgccuggugcagccuccaguucggcagccgugggucagucuuucccaucuugagucuucagcugcaacuuccaaguccugaauauuuuuucucuaaaccaugggaauacugcagugcaucucucgucugagcauuugaacuucuucagcauaaccuguaccaagaugccuccuuuccaaaagcagcacuuagggaauccugugucucuccuuguaccucgucgggggucaguuaacaaaguggaggugcuaaugccauuucccuugaagucccuaauuagaugggguuggcaaaaguggcugcaggaugcuuuucugaggcuuguauaaaacuuuuccaugguuggcuucauagaacuuccaagcagcugucagcauaaaacccccagagaggggcaugcagguuucagaggacagugguggcggguucuagggucuccuucucaggcguaauccacugcacagagagggaucuguuccagugugacagggagggaggccuuugcacuugcaccuggcagagccggcuuuaauguggagccauugccagggagugugaaagaggccggagccaagcuauucaggccaggucagccugugagcccauacaaggcccaaauaacaaggcugggaacauucagacugagcgggccagaaaggagagaaaaacuuuggcagccagggcuaggagcagagagacaggcacacaaagccacagccccgggucccugguuccugguuuuuucaguaugcagaugauaggaaggaacccauugagaggagaagucccuuccagcagcagaaucuccacuauuugaccuuccugcugugacaagaaaggucaccgccagcauuucacucuucagucagagcugcccucucugcuggcagcauugauuccugcugcagcuucucacaggagacaagaguuccuuuucucucccuggccugugucugcaagggcucggggggaaaauuuaagaaccaagaaccuuguggaaaguuggagagggcaggaugggggccuggucuccaggugugaugucucgccugggcacugugaccugcuccuggaagcugggaagccauugagucaucggccaugggauuugcauuguuggaggggccugggcugaguuggccucaucccucugauccuggcgagugggucacaagucugacucagcacccagauguccucccuggcucagagucagcgcccugcaggccuugggaggagaugggcuccgggcuccagacccacuggcugguacggaggcgcccacgggccggcccugugccgggucucuuucuuccaugugcuuucugcaguuucucggucauguccagaaaagggacucugguugguaugagagcagacgggagccuuaaggaaccuuuuggguugauucucagugcuggggccagauguccgcucucucggggcagaauacagacugggcugucugcaccaccucccuucccuugaguguggccuccgcagacagggaggcagguggagcccagggaaguuucuugucuaaggcaugugucaucuugguuggaaggcugagaaacagggcuucccucccagggccacgugucucuucacccuacgucccggcugugccuccagggugcaugcacccaggggacuucagcuuccgagcagcaggcugggugagaguuugcuuucccuucacgccccgacugcucggugagcugcuuucuguccucuccccagggaucuggaccauaacgagauuucgggcacaauagaggacacgagcggcgccuucucagggcucgacagccucagcaagcugugaguauccgccgcacggagcuccgccggcaaaugcgcgggacacacuugggugggagauguuucuguggcgccccccgcgccucucugcucugggcccaggcggaagaggagcuggcuuuuguuuggggcagagcuuguuuuguuuguggagaagaguuugaagaagagggugggggacaccccacuccuugauggccuggguguuggguucuugggggcuggcaacccggcguuuggcggcugguggagcuucucuugggcuucacucacaacucacaugaaaacugcugaauuugcuguugcccuuuguacaaaggagucuugcccuguuacuggguuucucaaaguuguguaaaggucaguaaggugugagggcgguggggcuccugucaguacuuucgucauuaaccaucaucucaaauaaccacgucauuuccaagggucguaguagcagcuauuuugaauguaugguuuggggucuuuuucuuuuuuuuccuagcuagcuccuagauuuugccaguuaaucugccaagcaccuguguguguuguaccuaaugaucucaugagggcaggcucuguuaggcaaccucuuuauuaguugaggaaagagaagugaggggauuucgcccaaaacuacacggcuggcaaguggcaggcucaggauuugcuuguuuggcuccaaagcccacguucccuuccccuuggcccgcccuguuuucucugcguguaaccagcacuuucugcagaugccacccaaggaccgugcaggaaggggacgagagucauuauuacuguuuacuagcagcucggagggaagacuggaggagggcaagacagagaggacggcugccgcucgauucccccagcccguccccagugacggggagcucagcagagugcgagugucaaguaaauauuuggaaagcccuaguggagcucgaugauagaggagagccugugguagggagagucuuuuuauauaguagaugcuucugauuuguuuugaaaagcguggcuuuuugcaccuuuuauauacaaggguccugcuuaggaauaagcucuguuggcugucugaagaagguacuucuugagcguccuguacuccagcagcaugucggagaugcuuaucagugauucuucuccuuauugucccuaaaacaaugcugauuuuccccagccuuuaacccauacgugaccccuuuuuaucccauacggggcaaaccugggaagagccagaaguaccaagugggguggggcagaggccuucuuagcaagaagagcuccaggccugggauguggcugcugagguguucagcacuggcgccaccacucagcauaagccucccugaccucggccauaaccgauugaagggugaggguggugagagugggcagcacugccagguuccucguggggcgugucaguccggaggaaccuggagccguuuccugggugucauggcuuccaggaggcucugucucaauacagaaggcccgugaggugugccuggcccugggucgccugggcuuccagugcugcaugaguccgccacugccuuccugagugcccgcccucugugcccuggugcuuucuccuuugucccccugcuggacuaggcucagcucuuccaccugagccccaagaggucagcccaagccccugcuuuccucacucacauaauguuguuuguagugagcugguccugagacuccugggaacuuguuaaaaucgaagccucaccccacccagccacugagucagcaucuuggggcuggagacucuguguauguuugaaaaagggugagagagaaagacaugcauccaaguggggaagcugggacaauaaauaaacaagaauuccuuaauaugauuaaauauaugcaaucacuuauuuaagugugaugcuaucaugguuauguggcaaaagaaaaaaaugaaucauuuucuucuuggauaaagaaaaugguaugaugccuaugauuuggauuccauaaacuccugcuggguuugagaacgggcaguggcuagagguagagaugaggugagauuggcacgaccggaggaggauuggcacugugucacgggcacuugggguucaggauacuacuccgucuaccuagcaugguaugugcaaauuuccacauugaaagggaaccggagaaguaaaugcuucucauaugaucaugguacacagggcuauguaaaaacugcuguguuuggccuaucacagguguugagucgauguuuguugaaugaagggagggacagaggaagaacccagugccucuuugguccccuccccacccgccuacucagaacauuccaggaaaguucugcgcuguggcccuggcugagagaagugaccacagacagcacuguguugcucugugggaguggcccagugccggccuguuaggauccacugagaaguggggugcguguuagcacagagaagagccgccccucuagagcagcugauccguccuguggggagugcagccagugccugagucccuucauuugguguggguuuguuuuuggagagcucaaggagcuuguguucagggucugcccuaggaugggaagguagagaccccugccuucgcugaguuacucaaggaccuuggguccuucccaccaugcaagaggucagaccuaaauuaaaauguuuuccaagaaagggagaugugaguagcagagccauaaacggccucucugugaauuugggguggaugcugaccugcccuuaauuuuuccagcuuacgcacacagcuguguuggagaguuccucacacuggagcuucccagcagggugggaauguuccuagaccccagcgcaugccuuucuuccuaacuggucugggauucugcuguagacccacuccagggccuguuuccaaaugguugugcgguucccgggcuggggccugcacgauggcacagagucaguacgcgggagggaagggagaauuucuggaucccaaauuacaggcagagaggagcaguuagugaccuggguaugcgacuuccugcccagugguuccagcuggcuccauggcauuccucggagggaggggcagagucccacacagggcacaugggaaggggcauguuugggggaucuugcagagcugaugugagcgcagccuccaucccugccuaugugggggccgggccugcaguggaacucauugugugugugggugggaagcgggggcuagugcacaugucgcggcuacuuccaaggacaugaguacaaggacccaugugagcauugcccccaguaccugccacuugauuuggcaagcgcuaaccaggccuuuggagcuguuggcuggguuggccaggagauggaugggagguuugacaggugacucccgcaggucgcuuucuguuccagguuggugcuggggaggucaggccagguguuccuucugaaagggagcccggcugugguacagaaauaguguccucccagcccauaaucccgccucuccuuucuccuggcagcagccuuuuauuagagccaucccagucugcuggcugcagcuccccgucccagccccauaugucugcugggggaagguaaggacccugccuaaucuaccaacaagaugauuagccccugcauaauugagaauuugagaauuuauuuuauugcuauugucaccguuaaaaauaacagccugcccucauuguaaaacaggucaaugugacuaauauuuaauggaugaaauaaagcgcagcuuuuuccuggaucucauuuacaggagauuucacuaaacaguucaaugcguuuuuacugggaccuggggcacacagugccugggcggggggaucugaguaagaguagaaguuggcagugcucucugaagcgcucggggugcagugccccaugagcuguuacuugcuggcgaguuuugugguuaaagcgccuaaguuagcauggccaucagcuuuucuguguguuugguuuauuuguuuuaaaauaaaaguuucagacugaagagagguguggaaacgcuuucagaaugcgauuguuuucacauucaugcagacggccugaaagaaagaaaacgcagagggucucuggcccguuugccccuucaccguccggaggcaggaaacagagcuggcuuugucugagggcugagcuugcaguuagugcuggggucauccugaaugguggcccccagggagggagucuguuucugaugaaacggagggucaggcagccccuguggaguggcugcccuggaagcuggccacacggacugguggugccucccucuggcucugcugugagccuguguuuccaggaggcagccuccugguaccugcccaagcgguucccaggaggccuguugcagucaggaagaagcagcggcccguguggugggcaggucccaggcugcccugccaucuuugguuugcuucagggcuuauauuuccuuucuuuuccuccuuucaggaaggggcuggggcuucuuguuuucccuuaugggucccagucuuaaugcaggcugaagguggagauggcuucuaguccggucucuuccccgaugcuaggugagauccuggaccaagaguccccuucccaguagggggcugggccagaugggcuuucuccaggggcuuccucuccugcccaccugcaccccauugccuuggacagaccuguugacgcugagaaucaccaggaguuggcucccagcaaucgguauucuuagccagccuguuagauccugguguaccuuaagauugacaaguccacgaagcugauggucagcacugccuuugguuguucccugguagucuccugugccaucaggauuagagggaaugccuuugguggguucucaucagagaacaugauaacggggaggggaaaacucgauucucuucauucccaguguccacccuaggggcuucccugcagagagacaagcuucccuuuagaucacacagugugguggaggaggcacucauuucuuccauguguucugcaggggcgcagacuuugguuucugggagaacucuuaacaguuacugcuaaggcugggaucagaguugccuggaggcaggaaccccuuuuuaugagcaggcaguccaggaaggggacaggcacuagcgauaacguuggagguuggcccacugacaucauguaacgucuggggucuggcuuaagagccaaagcacuggggcaucuccugcaggcccugaggggucccucucguaggcagggacacagcucaccauggcugugugcuggcugccaggacaucucaggugcagacagcuguggagccagcuugauggaugccuauuuuacuguccucuucuugccucuuuugggaagcuuuauucccagaaugcacuuuucagaaguggguggcaguuuggggguuuuuguuuguuuuuuguuugagacaacaucccgcuauguugcccaggcuggagugcaguggcgcaaucauggcucacugcagccuccaccuccugggcucaagcaauccucccaccucagccuucuaaguagcuacgacuacuggugcgugucuccaugcccggauaauuuuuuaguuuuuguagagacaagguugcccuauguuguccaggucucaaacucuugggcucaagugauccuccugccucagccucccaaagugcugggauuacaggugugagccaccaugcccagucauggucagcaguuuuaauuccgaagauuuuucuuuccuuuuuugacucagcuuccucucacugaaaccauaaucagucucaucucuccaucacuaaacuucaccacccaaggguuggugguccuuggagagagacugggccagacaaggugauuucugccuaacacugggaggggccuuuuuuaggccagacggcacaugcaauuccagccuaucaucacuauuaaauucuaauaaagauaaaaguauuucauuucagaaaggggaaggccugcgugccucaaacccguaaucucagcgcaggucagcuuuccaccugccccucacuggacagacuuaucagguagcacuaccuuaauuguguguuuucuuuuucuuuuucuuucucucaacccuuccuguuucgcuuuccuucccuggccuuaauuucuggauguuuggaaacuacaggacucuguuuggaaacaagaucaagucuguggcuaagagagcauucucggggcuggaaggccuggagcaccugugaguaucucaccagcccugcccugaggcacagccugcugaaugcggcugccggggaguucugcuagcaauuuaaucgcaucuuuguaaacugagaaacaggcuauuuggaaacaccagcugcuuccuucucauuaugucagcuucagcuuuggccuuuauguugccuaugccaggaacaguuacagaacauauggccaguggaugugcucccaguuaauucaguugguauuuggauaaauacccuccccccuccugcugcgcagccuaaccccugcacuggcuccuucauggaccccuggccucauugccucuuccaccaacgcgcuuccuccuggccaagccuguugccuccauuaaagcagcuuaacaaugcagaguaggugcugggcugaaccaguuuggugugguugcuucugagacccugggaggaagggaacagagccacccgagacagucaugcuguugccaucuggggaggaugccucauguaugugauucuuaguuuguuuccucuuugaaucaaguuugacucuaacucuguugggaaagguuuugccuugcugagcaggccucagcccagcuuugauggugcccuaaggcuggcuuggcuccugagucauuccaugggcuuguguugcgauuugggaaacaacagccacuuauaguaguuaggacacaggucuggcuagucccugugggucaucugugaaaccaggacuguccugaaaaccccucagguguaccuaggguuucuuugcauaaguaauguauguucuguuucaggaaccuuggagggaaugcgaucagaucuguccaguuugaugccuuugugaagaugaagaaucuuaaagagcuguaaguaucuggauucccugggucugauuaaugguaguggagacuuucagaguaagaaacuucugcaauugcauuaugcucacuuguuaaaaguucacaugguacauauuuuggauuuugugggccacagagucucugucaugacuacuugauugcaucauugcagcagaaagcagccauagacauuacauaagcagguggguguggcuaugugcccauaaagucacauugacagaagcaggcagucgggccgcaggcugaagcuugcuaaccacuauucuaggcaaugugaaauauacucuccucuauaaaguggauaaucaccccuucaauuaugucagggccaaguuuucaucuuuugggcuugcuuacgauaaaggccuguguugagagggucuacuucagagccuggugggcugugagcaaggcagagcucuggaggggaugggaugcuuaggggugcaguggugucugcccauaccauuuccaagcuuucugggcacgguucacaggugguggugcugccacuguggacuuggacugugggcucuugggugacaagguuggaaaagcuucccuguauccuacucuggcaggggagcuagucuggguccucagguguaacacccaaguuuuccuuucugguuuuuuuuuuuuuuuuuuagcuagacaugaaucugauucuacagccaguaaguucuagccaugauaucaguucccugaagggguaacuuuugguuccuagaagugcugacagaauggcagaugccacaggacagucaucuuugugcccugaccucauccccauuccccgaggccacucuugaugaacccucaguuggggcagggaggcugggacuggggaaaugaggugcauuccccauagcugggaacugaagcgggccgggugacaccagacugagugaggagggaagguggccugggcacuugcccugugauguucagcaugcugugagccucaggccugcugaauagauaccguccuugcaaggguuggaucuuggagcgggugucugugacggguucauggagcucagggcucugcagacagcugcuccgugcccagggccuucccucuuccagccucagcagcucugccuccaucugucgggugagacggaacauacagaaaggauuccauggcucuccuuccagagcaggggaggagaugauuccagaccaccguggaagggaaggcuggacucagagguggacucgcaguaaagcaaguggaaugaaacauugguuguagaagacaagcgguggggcacaggagcauucacuguggaauucuuucaccuuuucugucuuugaaacuuucagauaugaugucaggacugaaaaauaccugauucaauuuaaacgggaagaagguauuuugagagaaggagggaggaggauaagauuuuccuugggaaguugggaggaacuggacccuuccagaagcuuggaccuccagcgugcuucugcaugguucuggaggcucagccucggucuccugccuggguuucccaucguugcugcauauaccucgcuggagccggcccugugcccaguccucagaugagagaaaugguuaauuccacuuggucgucuuuuucuccaucagaucaagucagguuguacugugcacuuagucauccucuggguaaauuuccacaagugaugauuagaaacacacuuugaguuggaaucgugaaaaugcaccaugugagccagcaaagcccugggauggcagcagaaggcaguagagccgauggcgcugugcucuccacggguggaagaagggcggcaggagccugcagagccuagggguuggaauccucgcuacugccuggccccaggcccuccccauguauccucucaguccuaacuugcuguuuaggaacaugcugucuccacccugaguacccacugucuuccuggagucuggccuccugucugagguggguuucaugguggaagaaguaggaaauccucaaaggcguuagccccacacguccagggcguguguaggaugaggcuuagcccuuucuacaugugucugaucaaagauaaaugucaaauuuguuuucccguuuguuccugugguucaaauggaauauguccuuguguccugcacaaaugcuuaacgucgcacagggauggcccagccuucucuccuaggcuuucgugaacagugcccaggcuguucugccugacugcacggaagugcccucuugcuggggagcuggaggugcuucugacagcggagaguucuccauccaggcugaguuccccccaugccuggcgcagccagcccugacccccaugcagggugcacuccugggagcugcccuccccaaacacugcaugggaauugaccauuuccucagggauggccguuacagcccuuccgccaccugcagugacuccacaguaggacagcccuccagauggcucucagcagaacgcuaccugcccgugaaauaaaaaugcaaacucucaugcugauuuuaagaucuaauaugggccagcaucccaguuauaauggccuugagauaaguuauuucuguuuuuggaaaagcacuuuccaaaauuauaauuauuuuaauaagaugcccaacucaucuaggggugauggggaacaugaggaagaguggauuuuacuuaauuuagccuugggucaucugcuuacacuucauucuuccuugcugugacaguuucucugcucauuagaaaucuggagagaaacagaagaaaauggaaggccaguccauuugguugcuuuguugaugucugaggacagugguggguggagaaggcagccaaagucgugcucuuggccugcaugauguuuuuggaauuucugcgcauaccugugccuccuguuugucaccauguaccagagacaguguauugcagggaagccugugugcucucuuucccagucuucccuuaucgugggccagccaucauucuuuagcucacagcucugaggucuuccaggaacaaggcagcuagacucuugguugacuuaucuucaagugacuccucaggaaggaauguccgcugagauggcgauuccgauuucuguuuaaaaagcuuauccuuaguugcugagaaaugaaaaagaaaauauucucuguuuugguuggagccccacaaagcuaaaguugugcauucucaugcucccugggcaguggcaauuaacuaacaagcacuauuuagggagcagagccgaauucugccggcccccugaagaauacuggugcaaagaucaaggcacaaacaagaggguggcacagugacggggcuuauuacauuuggaaguaagaaaacaugcagcuuugccaaauggaaaaggaacagccaugaggcaaaagagcccuccucggaacuuguugcagaauuuggaucaaagucucaggccgaguuuggaagcuccaaguaguuuaucaggaaagugggaaaaaccagaggggggaugguggcagcauagcacuguuggauguaucagaggucaggagaggucagaaggcagcccagggucacacaggaacagugucugucccagaacauggcauggauaagcuccacguugcugcugcuccaguugcgguccuugggucagcagccccagcaugauacgugaacuuguuagcagagucguggguuccacuccugacccacccaaucagcaacugcauuuuuucaaaaucuccagguggguuauaugcacugcccugggaaauuggagaggaagugugagaaaaaccauuucccccuuccagcuugcugauguucacuugagaagcugauuggaggcgacugaucauugugugugugaagggagugucccuccuuugcggcugcaccugaagcauccacuguuguguuucuuucagccauaucagcagcgacagcuuccugugugacugccagcugaaguggcugcccccguggcuaauuggcaggaugcugcaggccuuugugacagccaccugugcccacccagaaucacugaagggucagagcauuuucucugugccaccagagaguuucgugugcgguaagacugucuuuguaacuuuuucucuccuucaugaaggacaaggaagccaggagguacucuucauuaugggaguaauuccugugaucagaguaaaccccagcccgugguuacagaucagcugcuggaugcaauuuauuucuugcugaaaccacacacaguauuuaccguagaguugccucauuaugugguucuuggaggacaugcauuuaaucagaagggaguauaaguugguucaguuacaaaucagaauaaucaguuacaggaagauaguucuguuguuucagaagggcucuggugcccggguuuagcugcgaauguacuccgcguacgaggcuggcguuuuaauguguguuucuuuccgaccccaagaaugaaagguuaaauacaggaagaacaagucucaggagaacaguugcuguaguaaaaauaauuccuugauguugacuuguacucuugcuguuucuccaaaccacugaaaucugcacuugcagcuuuacauucuuuuugccuucugauuccuggagcguagcucuugccaucuuuuugacugggagucgggauccaaguuugguugcagagagcacagaaaaugcugaacagcugaaaacacacacgcaggcuagcucagacaggacugacacaggcucacggucaggaagacauggucaaaaaaugagaugaauuuugaguuuuuccuguuugcuugcucuaagcaggagcaagagugggauucccaggccugacuggaacugcugggcagguguuaagucccuccugccuuuugugcucacuggucucccuugagccuugagaucccugcugugaggauccuaaccaggaacucacccauccauauggcaacccuugugggccacuucugucuccuacuuucuggccauagcaauagccauugugccugcuggaguagccagugugccugcuggaggcaagaugugugugcccucuccaugcauccaccccuaccuucaccaucaccacuuuugagaacaggccugcugaacuuccucuggauccagaccagggacacgucuuaaacccacugcgaacauggcagcagcucuccaaacugacuuuucauaccgaucugucuuauggagccuucuguguggaaucuaaugcucgcacagcuccauuauccaggcacaaaauggcuguauaauccauuguucauuggcccauugucaucaaguccuugacccuuaaauuguuuauagaccucccucaaauaaagcuuuccaucgcucccuccccuuuccugccauagggcaggcuuucccucugggugagccagguaggacuuugguaaguucaccuagcccccagccuguggcccuggcauauucuggauugcaagaguuguuuauuucacaucugucauccccacccccacauuuuagcucaagcuucccccccucuaaaaacgucagguguuaaugggaaucaugaaaacacuuggcagaagaucaagguuucaggcuuuaugggagucucccacuccuuuuuuaaaaacggaaacauaagcacuccacauccacuaggacagcuagaauccaaaacucagauaauaacaaguguugcugaggauagggagaacccuccuacacugcuggugggaguguaaacuggggcagccacuuuggaaaacagucucggcaguuccucaguucaacauccaguuacgacaugaccuggcaguuccacucuuggguguauaccuaagagaaaugaauguauauguucacacagaaacuucuucaugaauguucauagcagcauuauucauaauggccaaaauaugggcacaacccagguaucaguggaugacuggauaaacaaaaggugguauagccauacaauggaauauucauuaggcugugaaagcaaucaguaguccugcaacaugaaugaacuuugacaaugucaugcuaaguggaagaagucagccacaaaagaccauuagauuauaugauuccauucauagaaauguccagaauggggaaaucuguggagguagagauuagguuaguaguaguuuaaggauggggagggauggaaagagagggguaauagcuaaaauguacagcauuucuuuuugaagugaugaaaauguuguaaaauugacuguagugaugguugcccauauuggugaguauacuaaaaaccauugaauuguauacuuuagaugagugaguuguaguguagaugaaguauucucaauaaagcugcuuuuaaaaagaaauauaauuuauauaucauaaaaauuuaccccuuuaaaauauauaaauugaugguuguuauaauagucacaacuguguaaccaucacuauuaucuaauuuuagaacauuuuuaucaccacuagaaggauccccauaccauuaguaaucacucccuauucucugcccccaggcccuugauagcacuaaucucauugugucuccaucauuugccuauucugggcauuuaauauaaauggaaccauacaguauacggucucuuguaacuggcuuuucucacuuagcauaauuuuuaagcauguaucaguacuucauuccuguuuuucauggcugaauaaauggguuuacauuuuauuuauccguuuaucagaugauggacauuagauuguccccacuuuuuggcuauuaugaauaaugcugcugugaaaauucauauacaggguuuugugugauucucuuggguacaaaccuaggaauggaauugcugggucauacgcuaacucugugcucagcuuuuuugagggacugccaaacuguuuuccagaguggcuucaugauuuuacaugcccaucaccaaugcaugagaauuccaauuucuccccauuuuugcuagcauguguuauuaacugucuuuuuuauuuuggauguacucgugaguguaaaauagagucucauggugguuuugauuugcacuucccuaaugauuaaugauguuaggcauguuuucaccugcuuauuggacauacauauauauauauaucuucuuuggaaaaacagcuauuuaaaucauuugccaguauucauuugucuuuucaauguuuaguuguaaaguucuuuauguauucuggauaugagaccuucauaagauacauguugugccaauauuuucucccagucugagggagggcuauuuuucauuuucuugauaguugaaaugcaaaaguuuuuaauuuuggugaaguucaauaucucuauuuuuucuuuuauuacguaugcuuuugaugucauaucaaagaaacuauuugccugagauaaggucacaaagauuuccuccuuuauuuucuucuaagaguuuuauaaccuuaguguuacaaagcccuuugauuuuauucuuuuucaaaauuguuuugucuauuauggaucccuugccauuuccuuacaauuuuuuggaucagcuugucaauuucugcaguaaaggaaagugggauguggguugcauugaaucuauagacuaaugugagaaguauugccaucuuaacaguauuaagucuucccaauccaugaagaugggcuguccacccuuuuuucuuagcuucuuaaaaauuucuuucagucauguuuugucacuuucaguguacacaucuucaacuacuguuaaagguauuucuguuuuuauucuuuuugcuauuguaaaugaaauccuuaauuucacuuuuggauuuucaaaaaugaaauauuuauugcaaguauacagaaauguaauugaauuuuguaucuugaucuuguauccugcauauauguugacaucauuuauucuaaguuuuucaguaaauuucuuaggauuuucuuuauaugugaucaucaugucauuugcaaaaagguaguuucacuucuucauuuccagucuggguggcuuucauuucuuucucuagccuguugcacuggcuagaagcucuaauacaaagaagagugaauuugugagaguuuuggugggaaaucaugagacauccaccuaaaaguccuaauuuggcuccaucugacuucuuuuuaguuauuaucuuuaaaaaucuuuaaagggcacccaauuuucuucaauuaauaauguaaaaaagacugcauugauaugucccaggacccucaguucuuuagggauggacuaaauggcugguaucaucacucaggagaguuucaaacuugauggagguuauguugagaaauaaaguuuauaauucgguuuuccaugaacuuuuugaaguccccucauaguguuguugaagucuucuguuuccuugaucuucugacuaguucuauccguuguugaaagugggguauugaaguguacaaacuauuauuguugcacuauuucuuccuuuaaucuggucagauuuuauguuuuguggcgcuccauuagguauauauguauuuaucauuuuuacguguuucugaugcauugacccuuuuacauuauaaaauauuauucugucucuguaguaaaaacuccugucuuaaagccuauuuugucuguuaguaguauggacacuuuaguucucuuuuggugacugcuuauuuguaucuuugaauccacacugugucucuuguaggcuauagcuggaucauaguuuuuuuuauccauuaugguaaucuuugccuuuugauuggaguguuuaauucauuuuccuuuaaugcauuuacuaauaagguagaguuugccccuuauuucuucuauguguccuaucuuuuuguuucauuguuuuuccaauacugacuaguuuuuuuauugaaaagauauuuucuguuguacuauuuuaauucccuguuuuuuaaauacacggguauuuuuuaguuauuuucuuaguuuugcccauaggaauuaaaauuaacaucuuacaacaaucuaguucaaauaaauaaugaaauuaacuucaguaauaugcaaaaauuauguuccuauuaagauccaguuuuauuccuuuguguuacuguugucguacacauuacauuuucauuaagcccaucaacacagccuuauaauuacugguuuauguaguugucuuuuaaaucaggagacgcgaguuacaaaaauacacguauccuguguguuguauuaccuguguaguuaccuuuaaugggauuuuuuauuucuugguguggauuggaguugcuauaugauguccuuucauuucagccauacuaaauacucuccuggauuucuuguggggcaggccugauaacagucaacuugcucuguguguguuuaaaauaaaaacaucggaauguuuuaauuuccccuucauuuuugaaggauagguuuuuuaauacauagaauucauaguugaacguuuuucuuucaguaauuugaauaucuuccuacugccuucuguucucuguggguucugguaagaaaucagccguuaauaauaaugaagaucccuugaaugugaugaguugcuccucuuuugcguuuucaagauucuuugucuuuggcaccugacagcuugacuaugaugaaucugcguuuggaucuuugaauuuacucuacuuggaguucauuaagauucuuggauguguggcugcacauuuuucaucaaauuuggggccauuguuuugcagauacuuuuucucuuccuuuuucuuucuucuccuucuuggacucccaugauuuguauguuguugugcuugaugcugucccacaagucucugugguucuuuucauuuuaccucauucuuuuuucuuuguuucucagacuacauaaucucaguugacugucucaaguucccugcccccuccuucugccagcucaguucugcugucaagccccucuagugaauuuuucauuucaguuauuguacuucuaaguuucaaaauuucuacuugguucauaucuauaauuucucuuuauugcuauaaaauuuucucauacuuuauccuuuuuuuuuuuuuuuuuuuuuuuuuugagacagagucuugcucugucacccaggcuggagggcaguggcgugaucuuggcucacugcaagcuccgccuccuggguucaugccauucuccugccucggccucccuaguagcugggacuacaggcaccugccaccacacccggcuaauuuuuuuuuuuuuuuuguauuuuuaguagagacaggguuuccccauguuagccaggauggucuugaucuccugaccucaugauccuccugccucagccucccaaagugcugggauuauaggcgugagccaccccaccuggccacuauccuucgauauuuuuuuuaagacaugguuuccuugagguguuugaauaugccuauaauugccgauuuaaaaaguuuauuuagugaaucuaagucugggcucccucagagacaguuucuguugacugcuuuuuuuccuguuugaguguuucauaauauuuuguugaaaauugggcauuuaaaauaaaauaauguggcaacucuggaaauuggauauucccuuucuccucccccaggauuugcugcuguugcuguuuauuguuacagcuugccuagugacuuuuccuggacaaaggcuauauaaaguccguccccuuaagucccugcuuguuuaguuuagugguuagcuaaugguuggacagagaagucaccacaaccacugucuccuauccuuuaccgacggcuuguguguuuguguuggggugugccaucacuuccuauuuguguagacagucaugcucagccacaggugacaaaugaggacccccucacgucuuuccugggugugcacauggccuugcaccugcauguggcugucuagauccccaggaauguauuggaccuuuucaaagcccaccauuaacacuguauuccccacauuuuccuuuauaguuuuuuggccagcugcuuguuugccccauggguauuguccccucagacagcugcgcuguugaacaguggcuacugauuguuguagucaugugcccuggggcuagggcuucuccugcucggcaaacuagaucagggcaaaucaaugcaaauccugugaauggggcuuuccguguugcugccagauaggccacauggugucaguucugaggauggggcuuuuggggagcccauucugacccuugagugguugcuaggcugcuggguuucaaggcuaccauggagcuggggagggaagaauggggcuuuggauaaguuaaaauaccacaaagcucacauuucugagauguugcuauuugcuugaaucaacaauccauggauuguuguaagccuuugguuuuccagaauucugaaaaaguugcuuuugaccauuuuuccagguguuuuccuuguuuuaauggaggugcagauuuuuggagguccuuauucugacauuuuggaaguguuuuacacccccuccuuuuggaguaagguuuguggguaagaucucugcagucaugaccaguggugccugacuguuuugugugaaagucagcaggcagagccaguugucuuaaggaaacugccggcuggcugguuugagaacugagaagugguggguuaauuucuaaucaaggagugugaucauaaaggugaucaguacucacagacuucuaauuagaugaggucagauguccauggugcaacucuuacggcaucugguugguggggcugaggaugcacagggaccucaagcucugguuccugcuuggugucugugucaguuucuguuagcaugaacagcagcugguuccucuguguaccaagaacccagcgcuuuacaguugacccuucucuccccagaugacuuccugaagccacagaucaucacccagccagaaaccaccauggcuauggugggcaaggacauccgguuuacaugcucagcagccagcagcagcagcucccccaugaccuuugccuggaagaaagacaaugaaguccugaccaaugcagacauggagaacuuuguccacguccacgcgcaggacggggaagugauggaguacaccaccauccugcaccuccgucaggucacuuucgggcacgagggccgcuaccaaugugucaucaccaaccacuuuggcuccaccuauucacauaaggccaggcucaccgugaaugguauggaaacaccaucuuuguuauaguaccagaauccuacaaagcacacuccugauugcccuuucagcuuuccauguagagaugacugagacaggacacacacaugcuucuguggggcacuguuaaauccuauuguugccuggguuugccccagagcaaguuuugcagauuucaaggguuauucacaaugaguuacuuguuuuuggugaguuuuaaaaaucuaguuauuggccgggugcuguggcucaugccuguaaucccagcaguugggagacugaggugggcagaucacuugaagccaggaguucgagacuaguguggccaacauagugaaaccccgucucuacuaaaaauacaaaaauuagccaggugugguggcacaugccuguaaucccagcuacuugggaggcugaggcacaagaauugcuugaacccaggagguggacguugcagugagccgagaucacuccacugcauuccagccugggugucaaagugagacugucucaaaaacaaaacaaaaacuaguuauuaagucaaauuguggagagcuaagccuuguuuuguccaguucuuauccucuauaagccaagagaucuggcuuccaaauuccaaauaccccuuagccuggggaagcugcuguucuuugaguagauggcacagcauuggagucagaggcuagcuacugcuccagagacuguggagugcaaggcuggugugagcccuggccugaaagacacaguguccuggcaguugacagguuuuuacucauuaaccagccuuggagcuugucaaggggaccauguguuauuguguguuuggaggagggggguggggaguagauagcuugaagaguuuacugucccaccccaguaaccuaaugggguuauccugauuacuaacucucuaguuaaaaagaauuggcuugagaaucaucagaaugguggaucugcuuugcucuuuaagcccccacagaucacagcgaaacaccuucuuuaccacacuguagugggguugucuuggcuuauuccaaguccucacagcuuccgaaagacucagcuguuuguuagacucuccccaaaauugacguugacaggaacucugguggugccugacacguggcuggaugcgucccacucugucaggacaucgaucuuuaggcugagcaagcuagcaagcugaaugcuuccugccuggguauacggcagugggcaggaacagccugggugaacaaccauccaaauggaugagccaucccauucaucccaugaacacccauccaaacggaugagccaucccauugcucucccaagguggaggcaugcccaccuucccucuguaauuccaucuccacagccucucucuugguggguaaagcaggcaagcaucaggccuaccuaguguggaugggcacccccugcaacucccguauaggcacugccauguagaguaaaagccuuugcuuugaagggacuauagccagccuaggguguacaaugcaaggcugaugggauggaaguguuccaacuguggugggagaagcuggggguuccugauucacagguggcaggagugguccugggcagacauugggagaaaagaagugaacuggcacugggcacagugacagguagguguuugccagaggacuuccugguuuugcaucuagcugucccguaacccgacccuguauacguauguuuuccaguguugccaucauucaccaaaacgccccacgacauaaccauccggaccaccaccauggcccgccucgaaugugcugccacaggucacccaaacccucagauugccuggcagaaggauggaggcacggauuuccccgcugcccgugagcgacgcaugcaugucaugccggaugacgacguguuuuucaucacugaugugaaaauagaugacgcagggguuuacagcuguacugcucagaacucagccgguucuauuucagcuaaugccacccugacuguccuagguuugccuauugcucuacugugugugugugugugugugugugagcgagagagagagacucucaaaugcucuguguggccaggggugguaugcguugugggccuuucgacccuguuugaaauuuggggcugcuuuuugaguugaguuaauuuuucuuaaacaaguguuucuaucucuuuaaaagaaaugauagcuggugaauuaagagucuucauaggguuuagcuacagaacauuuuaagaauuggacaggauggaugugggcuuggucaagagcuacagaacauuuuaagaauuggacaggauggaugugggcuuggucaagaauaaggacacaggccugacacaggacaguuagggaauagcaggggcuuuugucagcagagguucacugucccuguggaagccacucccagcauggagaugacucagucaaugaguugaagggucuucuccaaagcuugccacucugagacagaaucucagaugcaucucauugauauguuggauuguccguuguccagaagaccgggcagagccagagcaacggaggcccugagaaugacuaagaucucuguugcucucuuguagagaccccauccuuggugguccccuuggaagaccgugugguaucugugggagaaacaguggcccuccaaugcaaagccacggggaacccuccgccccgcaucaccugguucaagggggaccgcccgcugagccucacugagcggcaccacuugaccccugacaaccagcuccuggugguucagaacgugguggcagaggaugcgggccgauauaccugugagauguccaacacccugggcacggagcgagcucacagccagcugagcguccugcccgcagcaggcugcaggaaggaugggaccacgguaggcaucuucaccauugcugucgugagcagcaucguccugacgucacuggucugggugugcaucaucuaccagaccaggaagaagagugaagaguacagugucaccaacacaggucaggcccugccagcggagcugacuuucaaggagggaggaauggcagugaugcuggggaacugggccggguuccaguggcuuuugaaagaauugcacuguguucagaacuccugaggguuuagucccacuaauuccauuuuaacuuugaggaacuuaaccuuaaacaggaauacucucaaauuuaaccuuaaacaggaauacucacaaauacaaguaacugacgcaccaugcaguuuucccucuccuugcuaacucagaggccgccuaugcacaggcccugcugccacguaguagguuguuccugaaacagugcgguacuucugugagccccggcuuuccaucacuggucuccacuucuuguggcgucuggcaucugcuggcugcgcucuucacgcuggguguagaguaaagcugagcaggcucugggagggccuguugcguacauggacuccaugucaucucucugcacagcgcugauggucgucacugggaggauccccuuucugagcuugacagugaacgugugucugcauuucuugucacugagacccugguguucuauuuguucugucuccuugcagaugaaaccgucgugccaccagauguuccaagcuaccucucuucucaggggacccuuucugaccgacaagaaaccguggucaggaccgaggguggcccucaggccaaugggcacauugagagcaaugguaaggccucaguaacugugaagcagagcucugcugugacugugucucugggugcuggagguggccuccaggucuuuacagggcagguaccuggcauuagauggggcaaacuuggugaaguagaaggcgguaugacuaagggcugcuauuuuggacccagucuucaugaguucugcaagguuuuaaaguccuguccccucaggaagccacuggauugggcuuagcaucucccuggcaggauaaaguaggcuugccuggaguagcagcuggaaagggcauuacggugcaugaacccagccaacccauuccuuacauggggaacgugcccaggucugcucugugauccagucuuacacuggaaagcugucaccaggaugagguacuuccaacggugggggccucugagcacuugccugagacuguagaggcucacccugagacagcugcucauuucacaaggccagccugccugcugggaaguaguagcagaaaacacgcugcuugccagaccagcagccccaccgcucugaagaacuuuuuaaaaaaaaugacuguucuagcggccuugcucauuccuuucauaaggcuuacugugaaauaccaagcccagaguuucuaaucguguuggaauccacuugcagguguguguccaagagaugcaagccacuuuccagagcccgacacucacagcguugccugcaggcagccaaagcucugugcugggucugcguaucacaaagagccguggaaagcgauggagaaagcugaagggacaccugggccacauaagauggguaugagaugcuucccauuggaaguaguuucuuucugaaauggaaauuugggcugaccuagucacuacaucaaagggggagacacauuccuaguccacagcugucuccaaauuugguauucaguauauacaggggaagcucaggccuggcucucuuaauuccaggauaguuucuccuaaauaaaucuacgccaugguaagccugagcaugaauuuucuagauguauaagcaacuuaaauaaggggcaaggcacaaacgaaguauagaguuucagucagcacuuuuucaccagggcuauuuugaggcuuauuucuaauuguugaaaagacccaacacugcaugguaccuaaggcuaauggcuuuucccccgugaagcaguaagacuacauugucuaugaaauucacuguaaacacgaaagaccccacaguucaugagugacuugguguuugcccaguccuuucucuggggacauaguuggggaaaagaggaagcaugcauacaguguuugcagucaggguucucaccuugcacaguggagcugagcagccuguccucuguguggggacgaagacucccacagcagugacucuaacccaucuuuggcgcuguccuucagaacacgguggccgggucguaugcagugacugcaacaccgaaguggacuguuacuccaggggacaagccuuccacccccagccuguguccagagacagcgcacagccaagugcgccaaauggcccggagccgggugggagugaccaagagcauucuccacaucaccagugcagcaggacugccgcuggguccugccccgagugccaagggucgcucuaccccaguaaccacgauagaaugcugacggcugugaagaaaaagccaauggcaucucuagaugggaaagguaacuuuugacugucuucuaacagguggguugggagcugcuuaaacggucaagugggggucugacagguucguucuuuccuuguaggggauucuuccuggacuuuagcaagguuguaucacccggacuccacagagcuacagccugcaucuucauuaacuucaggcaguccagagcgcgcggaagcccaguacuugcuuguuuccaauggccaccuccccaaagcaugugacgccagucccgaguccacgccacugacaggacagcuccccgggaaacagagggugccacugcuguuggcaccaaaaagcuagguuuugucuaccucaguucuugucauaccaaucucuacgggaaagagagguaggagaggcugcgaggaagcuuggguucaagcgucacucaucuguacauaguuguaacucccauguggaguaucagucgcucacaggacuuggaucugaagcacaguaaacgcaagaggggauuuguguacaaaaggcaaaaaaaguauuugauaucauuguacauaagaguuuucagagauuucauauauaucuuuuacagaggcuauuuuaaucuuuagugcaugguuaacagaaaaaaauuauacaauuuugacaauauuauuuuucguaucagguugcuguuuaauuuuggaggggguggggaaauaguucuggugccuuaacgcauggcuggaauuuauagaggcuacaaccacauuuguucacaggaguuuuuggugcggggugggaaggauggaaggccuuggauuuauauugcacuucauagaccccuaggcugcugugcggugggacuccacaugcgccggaaggagcuucaggugagcacugcucauguguggaugccccugcaacaggcuucccugucuguagagccaggggugcaagugccauccacacuugcagugaauggcuuuuccuuuuagguuuaaguccugucugucuguaaggcguagaaucuguccgucuguaaggcguagaaugaggguuguuaauccaucacaagcaaaaggucagaacaguuaaacacugccuuuccuccuccucuuauuuuaugauaaaagcaaauguggccuucucaguaucauucgauugcuauuugagacuuuuaaauuaagguaaaggcugcugguguugguaccuguggauuuuucuauacugauguuuucguuuugccaauauaaugaguauuacauuggccuugggggacagaaaggaggaaguucugacuuuucagggcuaccuuauuucuacuaaggacccagagcaggccuguccaugccauuccuucgcacagaugaaacugagcugggacuggaaaggacagcccuugaccuggguucuggguauaauuugcacuuuugagacugguagcuaaccaucuuaugagugccaaugugucauuuaguaaaacuuaaauagaaacaagguccuucaaauguuccuuuggccaaaagcugaagggaguuacugagaaaauaguuaacaauuacugucaggugucaucacuguucaaaagguaagcacauuuagaauuuuguucuugacaguuaacugacuaaucuuacuuccacaaaauaugugaauuugcugcuucugagaggcaaugugaaagagggaguauuacuuuuauguacaaaguuauuuauuuauagaaauuuugguacaguguacauugaaaaccauguaaaauauugaagugucuaacaaauggcauugaagugucuuuaauaaagguucauuuauaaaugucaguauaguuggugguccuucuuuuacaaacgcagucauucugccuuuaauuaucuucccccaaaaaagaaaaaaaaaauaggcgaagcaaaaucacauacuguuuguuugcuccagggcagacaacacugcuagauuccugacauuuuguuuugaauuuuucuacaccuggagcuuguuagucaaggucuaaaaucccuaaguguggugaccuuuccauuucauccugccuuuucaaagcuggcccaggcccuccuuucagucugacaugagaauggcgagaauggcucacccaccgugcccuccugcacgaagccagcugggcccaccuagucacuugaguugcagcugcuuucucucacacaccacagggggcgcuggacacaucucuguaaaauaauacaauugugcguuuuuaugggugaaaucugaggguaauuaaaaccagcagccuaguuacccagaaagagugcuugcuaugcaccuguaguucaaucuuucuuucuuuuucaacaaagccuacccuuacacaacaggaauuaacuagggggagaaacacccacauacacaacucuuccccaagucuccuuuucccaaacaaacaaacaagcuauucuuuuagaauuauaaccaucuugccuucugcugaauccaccaucagguggcaggaaaugaaagaucagauacagaucaaaugaaagcucuaaaaggccuggccucagcauuaccaaacuuauuuauuaagagguucugaggaaauuguucagaguaccgccacagaccccguuuucuucucuuagcucucuggcauacaggccaaugacuucauaccagccagccuauaccacggauggcacaaucuccaugccgguaucuuagcacaacuggucuucagcacuggggccuauaguucagacagcugcucagcggaagaggguuugcacugcaggccccucucuugacagaaguggaggugaggcuugucucugcuucaaggacucuuucugccaacuuccaacagcaagcugugcguucggucauaagcccccagaaagaugaaaccucccagacugauggcugccauucgagggaagacaccugcaaauaaucua

SEQ ID NO: 14810 - RNA, 2077 nt, Homo sapiens
cugauuaaugguaguggagacuuucagaguaagaaacuucugcaauugcauuaugcucacuuguuaaaaguucacaugguacauauuuuggauuuugugggccacagagucucugucaugacuacuugauugcaucauugcagcagaaagcagccauagacauuacauaagcagguggguguggcuaugugcccauaaagucacauugacagaagcaggcagucgggccgcaggcugaagcuugcuaaccacuauucuaggcaaugugaaauauacucuccucuauaaaguggauaaucaccccuucaauuaugucagggccaaguuuucaucuuuugggcuugcuuacgauaaaggccuguguugagagggucuacuucagagccuggugggcugugagcaaggcagagcucuggaggggaugggaugcuuaggggugcaguggugucugcccauaccauuuccaagcuuucugggcacgguucacaggugguggugcugccacuguggacuuggacugugggcucuugggugacaagguuggaaaagcuucccuguauccuacucuggcaggggagcuagucuggguccucagguguaacacccaaguuuuccuuucugguuuuuuuuuuuuuuuuuuagcuagacaugaaucugauucuacagccaguaaguucuagccaugauaucaguucccugaagggguaacuuuugguuccuagaagugcugacagaauggcagaugccacaggacagucaucuuugugcccugaccucauccccauuccccgaggccacucuugaugaacccucaguuggggcagggaggcugggacuggggaaaugaggugcauuccccauagcugggaacugaagcgggccgggugacaccagacugagugaggagggaagguggccugggcacuugcccugugauguucagcaugcugugagccucaggccugcugaauagauaccguccuugcaaggguuggaucuuggagcgggugucugugacggguucauggagcucagggcucugcagacagcugcuccgugcccagggccuucccucuuccagccucagcagcucugccuccaucugucgggugagacggaacauacagaaaggauuccauggcucuccuuccagagcaggggaggagaugauuccagaccaccguggaagggaaggcuggacucagagguggacucgcaguaaagcaaguggaaugaaacauugguuguagaagacaagcgguggggcacaggagcauucacuguggaauucuuucaccuuuucugucuuugaaacuuucagauaugaugucaggacugaaaaauaccugauucaauuuaaacgggaagaagguauuuugagagaaggagggaggaggauaagauuuuccuugggaaguugggaggaacuggacccuuccagaagcuuggaccuccagcgugcuucugcaugguucuggaggcucagccucggucuccugccuggguuucccaucguugcugcauauaccucgcuggagccggcccugugcccaguccucagaugagagaaaugguuaauuccacuuggucgucuuuuucuccaucagaucaagucagguuguacugugcacuuagucauccucuggguaaauuuccacaagugaugauuagaaacacacuuugaguuggaaucgugaaaaugcaccaugugagccagcaaagcccugggauggcagcagaaggcaguagagccgauggcgcugugcucuccacggguggaagaagggcggcaggagccugcagagccuagggguuggaauccucgcuacugccuggccccaggcccuccccauguauccucucaguccuaacuugcuguuuaggaacaugcugucuccacccugaguacccacugucuuccuggagucuggccuccugucugagguggguuucaugguggaagaaguaggaaauccucaaaggcguuagccccacacguccagggcguguguaggaugaggcuuagcccuuucuacaugugucugaucaaagauaaaugucaaauuuguuuucccgu

SEQ ID NO: 14811 - RNA, 2832 nt, Homo sapiens
uagucuucuggcggaggagaacugucauucugaggggcugggguagggaaagcucuucaagugcgaauuuccccauuuuaggccucucuccuggcccccggcacauuuuuuuaccuuuuucuucuuccguaaacuuccugccagugacuagcuuccgguaugaaaucaagcucugcgugagagcuguaaaaccagaaaaauguggaaauggacaggagggcuguuguccaaaaaugcaaaggaaaucugacgucccacccugaagaaaaauaucacaaggcccaaaagcaaggcgucucugaugagucaccuaugacacccaauugaaauagcaucgccuuggccgggugcucugguuuccacagauuaacuuggucugguuacagcggcugcuuaggaucuucaacucccacuggugccuugcuuuucuagcacacccagagaacaccuguuccucacgugaacauuacaaggggauccaagaugcuuuacuuuuugcucuugggaaauggaggggauacaauacuaaguauuccggaauuuccuuugaaaaaauaccggaaugcccugagcccggagccagggaugauuacugaagcccuggcucuuuagucacuauaugugagaacugacauaagaccuuucaaccccugagcgcuuagauccuucaucuguaacgugaaguaauaguaauccguacuccauggauuucauaggcugcaaccuuuuggaaagaaaaucaaaauuuuacuguugacgaauuuuuauuuacucaucuuguguuucuaacaucuaacggggugccuggcacauuauagauguuucauauuuuaaaaauaaauguaaggugcaaaugagcuaacauugggaaugcuauuucuagauguuaaaauguaaggaaguaucagcgaaugggaagaauuucuaguagacauauaguuagcccgugugcauaacuuuucuagcacugaaaagaucaaaccguugaacuucuugauaaagaaaggaucuuggaauuuaaauugugauugagaaagagaaauaauuaugaaaaacaauucaguucugucuucuaggucugcugagaaauuuagaacuuaaaauacuauaaucccaugcaaguuaacaggaagugguguuuccucaugacugggguuucugcauauacauaugcacuuauaauuucuucuuugugaauguccuguaugcacguuucuggauagaugaaauugacuuaauuuugguuacucauaacuuuauuuuuucguuuuuaugauguugcuuucuaauuuauuaaaaugguagcacuuuaugacaauaugguuaguauugaggaaaaaaauggcguuaauccuuaggguuugacaacaucugacgauauugcaaauaaaaauacagggcaugcauuauuugagaaauauuuaaacugaaauaucauuuguuguuuaucugaaauuuaaauuuaauuggguguucuguauuuuaucuggcaaccuuuucaaaucuguuaaaauagaggaguuuuguuugugcuuuguuguuguuuuguagccaucuaucuauuuaagccuuaagaaacuuggccaauuuuuuaaaaauucaauucucaacuuaguaacaaacagacuugacaauauuguuugauuagugagaagacaguguucugauucuuugacccacaaagauuuauaaauuggagaugcagcagaauacaaagaacaaaagccaaucuaaaaauaaauagaaaaaaaauuauagguaaaaaguugccauuuauaugacacuguaaauggacuccauucuacugggcagauggcauuacauaguaaagauuuaaucaucacuaaaaugcauuuuuaaaaaacacagaauauguaggaggaucucgaaauucagucaguuguaccacaacaauucuuucucaaugaucuguaagaauacuggggagauuccuuuucaggauugauacuaaauagccaaagguuacagcuuuguuuucaaacaccucuaauuugaauuuuaguaaaaaccuccugaaucuacugcacaucuggaaagagcagcaaaaguaaaccaguuuucaucuuaagguauuaaguacuauauugcaauuuacuccuauauuuaaaguuuaaaguaaaaucaauuaaggauggaaacugaaaaacugaaccagaauauuugaagguccuauauuuaguucaaauuagacacuuagagcuuuauuauuuuaauauuuuuuuuuaccuaggaaucacaagcaaagagaauugcuauaaucaugguugcuugagagaagaaaaguuuuuacguuuaaauucuagcaaaaaugaaggauuaugaaagcaucaaauuuggaaaaugagaaauugaaggcuccuuguuuuuuucugcuuucauuucaagagaaugacuuuuagcaauuaucagcuauacccaggcuacucucaauaauaccacacaacacaagaaugauagcaacucugaugaagaagguguaaaagaaaauagaacuucacuucugcaaaucaauucugcaguuuuccaauuucccuguucaguacugguuggggcugugaaauugaccagagcuauauaaaaugaaaguaaagacagaauacuugaaacucauaccuuuuagcaacugacauccuuauauauuuauacuucucagccuacagcuacaaccuucuugauauuuucaaugugacuuuuuuuucuugcuuaaaacuucugcauuggcuagauaaaugaaacaacaaaagugauuauucaauauaaauuuaauaugacaucagauacacaaaguuuuuuaaaauuucuaaaacuuua

SEQ ID NO: 14812 - RNA, 280708 nt, Homo sapiens
ccgcgcccgcccuacugccccgugccgaguuuccuguuuaagauggcgucccccguagcagcgcaggccgggaagcuucugcgagcccuagcgcugcggccccgcuuccuggcggccgggucccaggugagcgugggggcaggagcugcgggcgccagcagcggcgccggccugcccgggcuucccucgcccccugcuacucuuggucuccgccugacccccugcgcggccccucgggcgccccacuucgggaggugacgcggcgccggguccaggcgcagcagggaaccccgcuccaguguggggcaggggcggcgcggcggcagccccgggugccucgggguaugagcgacccaacgcacuagagucuccgcugucugcccgcgcagacucauggcgaaggcgcugaagcaggcgcuggacgcaaguuuaagaaaaguuucuuggaccggguuuuggagcccugagguuuuauugucagcucuacuaauucugcuuuucaaacuucuggcacuaacccugagcacguuuagaccacgugauaaacaugccuggaaacccguuucagcccaacuaggaacucacccccuagggugaacuuccugcaggcuaccugcuuuugcagacuuuuaaugugccugaguuggucaaauccgugggucaaggagaaaaaugggaaacgaucuuucuccucuuuccaaugaaaaaucagggcugucacuaaaacgcauuagaccauugacccuguccauguccuccuuguugauggagaaugaaaucaaagagggucaguggugggcuggauagcgauuggaacuuggccucuagcagauuuuuaccuucugcagauggcaagcguuaaaauagucagaaggacuucaggaaaguuuugaguuggugaugacucuuguagaaaucacucaaccacugaacugguuagucuccguagacuaucucucuucccuuuuaaagaaagcacagucugggauucagccacagcagaguuaaugaccuugccuauuuccccauuuuuaauugaugagaggcaaauuaucacucauacaauuuuaaccaggaugugcauaguauaguuuuuuagaaaauuuaaaaaauagugauuaaugauuuuuugaguuccucuaaacuuugguuaugacaucugugagcuauuuuuaccccucuccuuucauuuccugccuccccauuucucuguuauuguuaauguaaauuuaaaaggugcuaauacuuacuacuguaauauucuuaauaggugcuugacaguauagugagguagcaaaaggaauggcaguuuugucuaauuaaaacucacuaauaacuguuguaauagaguaaggagaauagcucuaggagaugaaguccuauucauuauuuaaguguuagaaaaaacaagaacuagggugcuuaccaugaguguagacuugaauugaugagaaacauggggcccagggcagugaaaacucaugaauuguacagagaaacugaaaaugcagaguguuuagcugaaauaugugaagccuacuucccuaaccaagaaauaagaggcugaacgcaacacaggagaaaaucugguuggggagagauacucuugguuugucaagaaaacuggguaaaaagaucuguuagcacgccccaucugguuacugugauuuacauauuuguggaugauguguuuuucuguaaauucuuagaagguaaaaguagguuuuuuuaaagauagaaagguacacaguguccaagaacuggaaauggacauuagcaaucauuuaguccagccagcucauuucauggguagagaaauugaggccuaaagaaguucaaugacauauucaacgauacagugagaguuuguggcauuccagaguaaaggcuuaccuuuacguuuccguuacaccaugcuguuuccuggugaguauauacuuccucaugaaaauauauuauaucaacaugcaaauuaaucugcaugccaguaguaacuauauaacauccaagucauuagcaccacugacacauuuuuauuuuuuucuuuaugaccaucuuagaauuguccauaaaaauggugaguauugcuauuuucaaauucuugggugcuuccuaugaucuguuucauguacacugauuugauauuacguuuccauagucccuugcccguggcagacauugcaguuaaacauggcccacuucucucaucauacuuaagaauccucaccaagugucucagaaaucuguugccacucuuggcccagaccuauuuuauaccaccaggccuugugaaaaacuguugucuguacagaaauaaaagacccaguuucugcuuagagaaauaacuuuaacuggucucucaaagauacccauagaaugacauuuugucuaccuccucccuaugguuaaauuuaacauuugacacauauuccugaugcuuagugucauugaaguuuuuuuuuuuuuuucaccuuugcuguuagcuuuacuguuuugacuuuugauugauaguacguccuuaaaggguccacuuuagucauuucuuauuuuucauauaguuuuuauucagcccauaccauuuggcaggacuguuguaggcccugggguuuggggauggugaaugaggcaggcagagucuuuggccacgugauacuuuauuuuaauggaggugggagagagugagccaguacacauauaaccaauaaugaaaaugauuucagccaaugacagauucugugaagaaaaucagucagggucaugggauggagaauggauugcuucacagcaggguaguuuagacuggaugaucagaggagaccuauuugauaugguguguuuuugauuggcauaauuuuuuaaacugaaauauaagacauacugaaaaaugaacaauuacaaaugaacaacuugaugaauuuucauaaacugaaugcaaacccagcuaacuagguacagaugaagaaaacgaucauuuaacaacaacccagaggcccccuggugcuccugccugucacuaccuccacccuacaaagggucaccaguccccugacuuauaacgcugguuuuguucaguuuuguacuuuaggugaaauuauauguaggcauacacauacuucacauugcucagcauuauauguaagugauccuggagauggccuuuuugacauaugagcugagaccugagcgaugaaagguagccagcuaggugagacuaaggggaagaguguguuaggcagagcagacagcaagugcaaagacugagaugagaaugagcugggcaugucuagguaauuagagggggaaagugguaguagacuaggucugagaggaagacaagggccaaaucauguggagaccugcagggucugcuaaggagguuucagggguuuaaaccauacagaggcugaaucccaguccuggcagccaaagcacaggcauguaauuaauguacuguacacgcccccuguuauaaaucuaaguuaggcuggcuuugaaacuuuuagcagagugguguucagugaauuuagcaguaagggucuaaccaugguuagaagucuuuccaaagaccuaaauccugguagacaggggccauguugcuguguccauauagccaagugaaaagugugugcaguacuuggugguguaauauagccaggcacugccauggugggcaagauaugaguacauacugccagucaagucuuaggggaaauguuggcugagggcacugaguuugaaaugguucuuaagucuaagcacaguuuuguugucucuuaggguauuuccccucucuuuggcuaguggaaguucauggagcucucuuguaggagaagcacugccuuucaggucuccaauuuuauuuuacuuuuuuuuugaaagagagucucacucucacccaggcuggagugcgguggccugaucuuggcucacuacaaccuccuccuccuggguacaagcgauucuccugccucggcuuccugaguagcugguaccacagaugcacgccaccaugccuggcugauuuuuguauuuuuaguagagaugggguuucgccauguuggucagguuugucucaaacuccugaccucaagugaucugcccccuucagccucccaaaguguugggauuacagaugugggccacugugccuggccaggccuccuauuuuagaauccuuguuguauguuuucugugcagcccagagcuucuguccagggacuuacagaggaauguauguugucaaagaaacugcuuaaacccaugccccugcuguuguauacucagaaagaauggcuccagccuaauuuucugccuuuacggaagugggaggagaaagaugaaugcaugacuuuuguaagugaaggacuaaagguuaugggcaaguucuuaucagcuaaaugaggcuguggcggcugcauuggaaguugugacuuaccuguaucucccucuugccuaggagaauaaauauuugacuuuuuucuuuuuuuaaaaugaaguacagcugcaauuucugcuuuuagaaaagggaauccaucucaaauaauuuagaugcuaaacuauugaccuuccuuguggggaagaccguuaagugauagcuuuguccuaaauugguuuuguuugcuguaaauaaggcauuucuuuuaugggugagugauugagugcacagacccacaguagugagaacauuccugcccucguacccuggucuaguucugcaggcgcaaagcccagaaagucacugaaauauggcauauuugggggaggaaaagaaauuacauaaguaaccucagaucauuuguccuucagcugucuuuaccacucaaucugcaauugucacuugaugcaucacuuucuguuacuugauggaaaaguuuuacugaagaacuugagagauuuggaaauauuugaacaaaugauaauaucaguacacuaaugaaauuuggagauuaaucuugagaguuugugaggaagguggaggugaugaagaaggcaguccaggugaauucaugcagaggcagaggugagagaacagggggagaguaguuguagugagcaguuuaguauggagaagggagagguggauagcagaaguugagggacaauggcacuuuuggguauacaaagaagucuaaauggggcuucagaaagcccagaauucagcagggaauaaaauuaacccccacaacugaaaaaucaaacaaauaucauuuauguagcaaauauuuucugaaugcuuauuacagcucauucuuuauagaauguugggcagauaaauaugacugagugaaugcagacaggaauaagaaacacagcuccuaccuucagagggcacagagguacaacuggccuauaaaccuguaguuauacuaaaacauaguggguacugcaauugagcuguguucuuagccuucuaagauacuguuggccucugucaaccacuuacccugugucugcagaacuauucccucugaucauucauugccugaucucugucuucaucagcuuucugauucaacguugauucuucagauaggcuuuuuccuaauuaccuuacccagcccugccuuuccagggauuauucucuguacccuuaucugcuuuguucuuuauaacacuugacuguaccugguaguguuauuuguucauuggccgucuuccccgcucuccuacaaguuuaagaauguaagcuccacaaaggcaaagugauacagcuuaauguaacagcgugagugauuccccagcuggccggaguugguauucaguaagcauuuguggucucagucaaugaguagggugcacagagaagggagagggagguaaggaacaggagaaguugagggaugauguggcucauuucagcaaaugaggaagaaggaaggggcuauagaaauccuaguugugaaaggguccucauaaucauagaacuguuccuugggcauguaguauauaacaaggcugcgugaaguaaucuccacacauuauuucuuuaacccuuacaacaucacugcaggggagauuucacagucuccauguuuuauagaagcagucagaggcauagagaggcccuauagucauuugcuuaaaaucacagugccagggagucacccgccucaugcugauaaaggacuuaugcuguuaaauuauuaagcucugucacugaaagauccuaguugggcugaacuaggcaguuaaacugauugcuuaccuuuccccaucuuuuugcccuugagugacacucgccuuuggucauuuggacuugugcugaugaaggugugcugaucaacuuggcaugguugcccuuucuggacucuuauccaccuuccucucucucuggcuucagggucuugucaacagaguaguagggagauuaaagacacgaagucuggguucaaauucaacggaguucaaauucuuaugggaucucccauguucuuucucugcaaccuggagcaaauuauugaaccugacugagccucaauuuacuguuacuugaaaaggggaucauuugcacagauaguuacaaagauuaaauaagaugauauuuaagacauuuggcauaugacccgauggugggcccaggaugauuauuucucuugcacugaauuugaagcuaaauucgcuggucuuuuuaaaaggcuuuauugagcuagaauaauuuugcuuucccagauucaguaagcauuuaucaugugcugccaucucaggauuagucacuggcuuggugcuuccauacauuuuauuucacuucauccuugcaguagccaugugaaauaggaguuauuguucccagcuuacuucuggggaaucugaggcucagaggggugaagaucugccucccgggcucugauuaucuucaggauuccacaguugggaugaaugucuggugaggccugagguggcaguggggaggagcucauggggagcuuaauuguaccauccugguuauuacucauuucacaaacauuuacaugucucaguguugacuuaguagugacgacugcuggaccucgugcaucaaagauuugaggugagggaacacuuaaagaauuggcaguagccacagcaugaaccaacggccaacuggacaugacuuucacugugugcuuagcacaaacuacugcccucagcguuucaagaaugcuggagaaauugugaaaugucauugccuuugcagagugggcuuugggggaugguguuggaggauggaguuuccugguauucuggguucagacuuugaccaguguacugaguauggucagcuuuuacccuuucuagaaaugauuccaaaagaauaggacuuaggcaguagccauaaaugcauagauuucuaacauuuaccuuugaauuuuauuuuuauuuuaaaauucgagggauuugacauaauauaugaauuguuaauggagacauggcaaagcacaaggcaugguuuguguaaguuuggguccuguggguuggaguggggggacuagcaucuuuuuucugcucccauccauuucucccugugcuugcuguauuuccauuugugggcugucuuagucccagaguugugacuugagagcccuaaggagguucaggagggcugccuuguagaguuuacggugagaaaugaggccagagacaagagcaaggacaagaucgcugauccugguaggccugguaaugaagcuaagcuuguucuugaggagggcaauagggagccauugaaggguuuuagacagugaaguggcaagggcaguuuaaugcguagaguacucuuucuggauauaguguggagaggguuggagaaaugcaagaauggagaucauuugggcgacuuuggcaucgauucaaugcugugagucauuaugccaggauacuagacguacaccgugaguggaaucagacugcccggguuuaacucuugccuucagcacuccauagcuuugugaucuugugacaauuacuuauauuucuuuguaagauaccuuuuuuuuuucuuuuucacauuucagugucucugaaagcugaauuuauuuauuuuuauuuauauuuuuucagacagagucucacucucuugcccaggcuugagugcaguggugagaucuuggcucacugcacccuccaucuuccagguucaagugauucuccugacucagccucccaaguagcuggaauuacagguguacaccaccacaccuagcuaauuuuuguauuuuuaguagagauggaguuucaccauguuggccaggcuugucuucaacuccugaccucaggugguccacccaccuggccucacaaagugcugggauuaaggcgugagccaccgugcccggccaaacuuuauuguuucgauauugucugguuuuaaguaagggauccacccccaucuuauugucuguggcugaagucgggaggccuguggagaggaacagcaccaugcuuuccucccugccugaagcagggcucagggcucuggguacagugucuggggaguggccugauccauuuagggcaccauauucuccccuccccuccccucuccuccccuccccuccccugcccuccccuccauuccccucccuuccccgugcccacagcauugauuggcuugcccacagcauugaauagaaguagggaucagcauuauagcuuuaccagaaaauauuaagguuuucuccuuaucaauggagaucucuucacauuuuuauaaggaacuauuuuuuauccuuugcuuuuuguccccagcuucugcuuguacucucuuaccuguuguugagaugcuaugcuauaccaucuggacuugaaggacuuauuugaguuaguaaguccuuuccuaccuuugaaagaaagggggaaaaccaguucucauaggcauucucauuccagccugagggcuuacgugggccuuuaauaaguaauagaaaguggagaguuaugaauuauuuuugauuaagggaauaaacuauuaaugaugaguguuucuuuguuaagauucagggcucuuuuaaagugauguaucauuaaaauugaaagccaacaauacagggaaaaaaggaauuuuucagcuuuuaacuuuuuuauaauuaccauggaaaaaaauauacgugcuauuuggcacauuagaaaaacuaaguaaauuuugagauggugaaguuguaaacagauuauccucaugaauuuuaaaaugaugcagaaggacugaauggcugaguguugaauaggaugguuggaaauggaggcagaaggcuugugacuuguccuaagcgagggugggccugaggacgcuuuuaggauuggagucccacguccaaaacucacagcauagcauguugugagugucuaauggauccuuucuuuuuuguuugauaugaguauaugaugaggcuuuuaugaccaguauaaaauagcuuuuaugacuauauuuuguauaaaauauaauuuuaauauguggggagacuuacagaguuaaacuuuauaggaagaugagagaaaaauacuaaauuuucuuuauguuaaagggccccaagugagaauauuuaguagugguauuucauuuugcuuaauauuggcaguauaucaguaauguuacgcuuaugguaagccaagagucauaguguuccuuucuugaagauguguugucaugugcuacaggaugaaucuauuuccuccugcauacuucagaguccuucuuuucaggucaguggaauauuuuuccuggaauuuugauguuaagcaacauugucauaauuuagguaaaauuaauuauugacacaaagcaguguuuucugauugacuuuuaggguguugagggagguggcaaaagaauugcuuuuuugauuaaaaauuuggaucauuaaguuccuuuuuugucucugaaaccuuguuuuugauuuccaaagcuucuaaagauacuaaaaaauaugaauguguauauucuuuaauuuaaaauuuuuauuauauauuuauuauuguaguaaaauauacaugacauaaaauugaccauuuuaaccauuuuugccauuuuuaucauuuugccauuuuaaccauacucggacauuguuauauauucauauuguuaugcagccaucaccaucauccauuuccugaacuuauucauccuccccuacuaaaacucuguaccuauucaaugcuaacucccccaucuccccuuccccuagucccugccaaccacuguucuacuuuugaucucugugaauuugccuacucuaggaaccuuaucuaaaaagauucauacuauagcuauucuuuuaugacuggcuuauuucauuuagcauaaugucuucaaaguucaucuguguugcagcaugugcaaaaauuuccuuccuuauuaggcugaauaauauuccaugauauguguauauaucuuuuuuuuaauccauuaauuugucgguggacacuuggguugcuuucccuuuuuggcuaugugaauaaugcugcuaugaacaugaguguuccguggagguauaccuuauguuaacauucaccugaguagaaauguuguaucauauguagcuugggcuacauuuucaguuucccauguccaacuaaaaugucuauuaagaaauaucuuuccugauaauguuucuguuguauauucauauucauugauucuuucagugggucaaaugcagcacagguccacuauuaggcccacuauuaggcgguggcucacgccuguaaucccagcacuuugugaggcccagguggguggaucaccugaggucaggaguugaagacaagccuggccaacauggugaaacuccaucucuacuaaaaauacaaaaauuagccagguaugaugguguacaccuguaauuccagcuacuugggaggcugagucaggagaaucaguugaaccugggaggcggagguugcagaugguggguuuguaggaagcuuggggauaugagacaguugcugccuuuaaggaaccuacagucucauuuguuggagacugaugagaaaugggcaauuacagugagauguguuugguguugugagagcaccccagcccucuggggauacuguaaguccucacuaaagacauuccaauuuguucucugcuuccauacccauuccagcacugaauguaggaagaggauaagaaguuaauuauacagccuuggaggacagaaaugguuucaccauaaagcaaaccaguuuucuauaggcuaauugauguaaacaagaguuuuaaguucagcauacuucagguuacagaaacaucaucaaacuuccaaagaccaaaaacaccgcuaauauuaaacagugaauuaaauguaagcucuacuuacauuucaaaaagauuaauaaaaacaaguaagauaaugauuuacccaguuucuggugauaagugagugauggcggucguagucguuguaguuuaagucacagaauaaauguuugcaaagugaaaaugguagggagcaccuccuuucaccacaaaguucagaaacaaacacaaacacugaguacuuuuggaccacguuguuuaguguguuuuuaugauuauuguagacuugaugaauguuuauuugacaaucauuuacauucauucauuuuauuccaguuccgugucacagguggcagaugcccaucccaguagcucagggagcaaggcaggaaccuguuugccaggaaccaggaugccauucccuugcagggugccaucucucucacacacacacacacacacacacacacacacacagaguccuuuucuguuggacuugccuguacaauggcuauuaauggugucuggauaacacacacacacacagaguccuuuucugcuggacuugccuguacaauggcuauuaauggugucuggauaaccugaaaugaagcacauguacaaauagacaccugauguuuaucaagcacauucugugggccagguuuggugcugugcacuugaggaggauuaucauguugaguauucauggcagcccuaggaggaaggcauuauuauagccauugcuaagcucauuuuauuuucuuuacuuauuuauguagagauggggucuuguugugucauccaggcuggagugcaguggcaagaucguauaacagcucacugcauccuugaacuucugggcacaaugaauccucuguucucagccuccagauuagcugggacuacaggugcaugccacuaugccuggccaauuuuuuuuuuuuaaauuuuguagagacaaggucuugcuuuguugcccagguuggucuccaacuuguggccucaagugauccucccaccucagccuccuaaagugcugagauuacgggugugagccaccaugccuagcuacuaagcccauuuuaaagaguaacaaacugcggcucagagaucuuaaacaacuuccuuguugucacagcuguugcccugcacaucuccucaggaugccacucacguggguccacugaauuaugccugauaauggguggaauugugucccccacaaaauuccuauguugaaaucuaaccuucaguaucucagaaugugaccuaauguaauuugauuuucucuguaaagacucuaucuuuaaaggagauagaagguaagagauagauagaggaaaucaaguuaaaaugaggucguuagggagggcccuaauucaauaugauuggugucuuuauaaaaagagaaaauuuauacucgggcacacacgcccagggagaaagccaugugaagaugaaaguagugaugcuuuugcaagccaagaacaccaaagauugccugugaaccacuggaagcuaggagagaggcauggaccagauucucccucacagcccucagaagaaaccaacccuucugauaccuugaucucagacuuuaagccuccuaaacugcaagagaauaccuuucuguaguuucagccacccaguaugugguacuuuguaugccaguccuaggauacccaguaugugguacuuuguacgccaguccuaggauacuaauacacacaucaaugaacuuuuuguggucuguacauuugugaagaaugagagugacaaagucauccuaguauuauuaugaaaauaguuuugaccucacagaccuccagaaccacccugcauugagacaacgugggugugguugauuuuuuugaucaaacacaucugaaauuguagguuggugcaaaaguaauugcgguuuuugaaauuuguaacuuugcaccaaccuaauaugugaccagaugagccuuuguuuuuucaccuuggcacuucuggagucucugaacuuuugcuggagaugcaugcuuuucuggcugcuuggagagcuagcccauggaccacugccaugaguucuuuugcuuuaugcuuccagcacuuguuuuccaacuaaaacauuguuuccuacaccuuauuugcugguguuggauuugagaagcucugaccauuucuaugagugaaaucaacuuaaagacagacgaguugcaauugagaagaauaucccaaggaaaggggcacagguuuauugucauuucccaaauaggagcucuagaaauauuuuaaacaauagcaagagauuggaauaaaugcagagccuuguucagauguaucaauuuugguauuuuuuuauuuugauuuuaaguaaauccagcaaaccucauuauuauuuuuaaucucacuuaguuuuuaaccauucucuuuauccagacagcucacccaagguuaaacaaaaacacuaacauuuuacuaccuauguuccaggccuuuugaaaaacaguuuuguaacuuaauucagcugaucuuugguaaucagaagcuaacaccaagcacuguuuuucuucagcagucuaaaguugaaauuuaagaacaaucagcaugcaaucaaaagcugauuguaaaugaacaauaaugaacauaaaagugaaaucacuucugaggguucuaaugaaagaaaaaaaggaguaauagcaguaguugaaaaaggagcaugauaaaaagugggugcgguuaugccaauaggcaaauaguggugaaaauuagccagcaauaauauuccauggaaugcucaacgaguuuuggggagaauggggaaaacaaauguuauaagagaguaaaaaaucuauauaaauguguagauuuacugcuguagaugaagucaucuaggaagaaucguaguggauuuuuaggagugaaucacaucucuguucuagaugcaggcagaugguaugcagagaaaagguucaguugugccuguuucuggcccacugaucaacagcauggcuuuagggaagagacucaguuuccuuacuaaacucuguuuaacauucauuguacaucuaucauguaucagggauuaugcugugugccagauacaugcuuaacuuugcaaaauggcuguugaaacagugcugcccagagcacgggacacauccauuggcaguacacgagaugaguuuagguaacgcagggaugcagcauccaauaccagugagucacauagugcugaauucauuguuacugucuuuggaaccuuaggauuuugucacggagaaauuuucaguuuugugcuugugugcuuuuaagaucuucagcuuaggacuucauaccucaaauaaucagaauugaaucccuuuuauuuuuuaauuaugcuaucuccuucuacuuaaacaaacaguauagguagugcucuaaaguuuucucuaucuuuaaguuaaaauaaacaucauaaauaaacugauacugguauuaguguucucuagauguagcaagaauuguguaugagugauucuuguuuggggaaccuuggaccauaguaaccccaagacuuuucuuauuguucccuggucacacauccugagaaaaggauucaugugaaaguggcuuuucggggaggcauucucaggaaaaacucaaagggguuuagagaaguugaagggaaggaggcugagaaggguguguuauuaaacugaaucccaaagagggugacuuugcuuaauuccacaggacagcuauggaaacuguguagguuacaccucagaguuguaguuaggggcaagagaguugaaguauuuauauacccucuucaagguucuuuaagggcauguugucuucagcaucuuaagacaaagaccugccggggcugcucuugggaguaagagugcacagugagucuguauaaaaaugguggcgcgaucugaggccaugcggauggagcacugagagcaucugcugcaaggcucuuccauggcuaaugugacauguaagccacuuacuagcuuugugccucggacaacugguuuaacacuucggugccucaucuaggguaauaccucuucagggcuuuuugugauguuuaaguaucaauaucauugacuucacauuuuucuucuaaaucuauucacuauuaaaaauauuuaaauccacauuugagccccuccauaaguaauaguguccaugaaaguaugggcuugguaaauuacugauacauauacauuuuuuucgaauguacauuacaauaaauuacacagaagaaagccuugacagagcuuucuuuaaaaacaugccaggaacuauuauccguuaacugaagccagcucuucuuuucucuggacacauggcuguacuggaucucccagcuugccuugcagcuggacaaggccacggaauagcucuagauaguuaaucuagauaauuuuuuuuucuuauuuucuuaaacuucuaugagggaggaaguucuuccuauaaccuucccauuagacuuccucuagguuaucacugcuggggauuaggucauaugcucauugcugagccaguuauuggcaaaaauuggaaaucuccauuauuggcuaagcugcugaauaguuuagaaaaagauacuggcgagucacuuacaacauccgcuacaauuggguuacugcuuagugaccaagauaggauuugaacacccaccugucagacucccaagucuacgugauuucuucugugccuuacagccuuucuaaaucugucugcuugcuauaaaggcuuuccauugaauugauuuauuucuggaauuagacuuugaugaccaguaauuccaaauuauguucgauuguccacuugcuggcuuucuuuauccaccaaacuugccugucucucagcuguagggcaucuccugauccauggagcuccuagguaaggcaaaagaacuguguuugcauucagcugugugcugcccuauagcaguaugaacagcuucacacugucaacuaggaggugaaaugccaaguguagcuacaaucuggaaauguguugauguauaucagcuuggaaacaaugcagggggcagguuuugggccuuugcaguggagagaccaguccagagagggccacuaagugcuaggcauuccaauggcauuuucucuuugacacucagcagcaaucuguaacauagguacuaucauuaucauuaucuaucauuuaucuucauuuuacacaagaggaaacugaagcuuagagagguugagaaguuugucuaaacucauccaacuuguaaauaauagagucugaauuugaauucacagcugugagacuuagaagcuuacacucuucuuuaaagcuuuuuaaaauugugcaauguagcauaaaauacugaaaaaauacuuaucauauauguaguuuaacauguaauuauaaaguaaacagcacuuccuaggaccuaaguagaaauuuacuaguacuuaagaaaaucucccucuguucacucuuuuuuuguaacuucaugucuaauuuuaaugguugucauuuaguugggaaacuugcccucuguaauuauccuguuuaacuguccucuuauagcaagucauaaugugguauaggagaaagcuacauggaucaaaaguuacuggcauggaugcucccuuucugaacuggauuuaccuugggcaagucaucucucuccaaaaaagaaaggcagaguaccagauaacuuacggaaacgucaaccaccauuauccugauaaagaacugguucccuggagcaugaagaucagguuggagggcagccuuugcuugcuuuuuucuuuguuaauuuaguaguguauuuauauaaacccuuaacaauuucagugacagacuucacucauuuugaauagcaaguauuuuguugaauuauguaagucaguaaauugcccucacacuuuauugauuaaaauguccuagcuuuugaaggacucacaaguacaauuuuccugagacagacuguacuuucguuuuuuaaaauccaccguugaggacugugcaugauaaaguggaagcaagugguuauuaauuuuuuauugaaaucuucugaauaaguguuuucuccugguugguuucaaaaggagucauauuccugaaucuaauuagaggcaguucauauacugugggcuuauuaagauucaaggcacuuuuuuauuuuagccugucugauaucccuuuuuaauuucacuuaaauuugaauuacucuaaacaucaucugggcauauugaagaaacucaguaaucuuaauaaugaugauguugacaaaucuguccuuauucuucucaaguccuauaaccuuauacuugauucuggcuugugaauaccugagacugagcugccccucucucuuccugucguagacaucaauaaucacucaugaugcuguucugagugauuauugaugucuaccaugacaaagccuugaggucuuacuuucuacagcucccugggcagccauuuccagcuggucagaguuaagaggcucugccaucccuggucuggauguugucuguuuugggucugaacguuuauauccuccaccaggaucucugaguaaguuacauuaucagcugauucuaaaaaaaaaaaaaagauacugccagccaggcaugguggcucacaccuguaaucucagaacuuugggaggccgaggugggcagaucacgaggucaggagauuaagaccaucuuggcuaacacggugaaaccccgucucuacuaaaaauagaaaaaaaauuagccagguggcugggugcaguggcucacgccuguaaucccagcacuuugggaggccgaggcagguggaucacgaggucaggagaucgagaccauccuggcuaacacggugaaaccccgucucuacuaaaaacacaaaaaauuagccgggugcaguggcgggcgccuguagucccagcuacucgggaggcugaggcaggagaauggaaugaacccgggaggcagagcuugcagugagccgagauccugccacugcacuccagucugggugacagagcaagacucugucucaaaaaaaaaaaaaaaaaggauucugccuugguguccauuuuccuaccucuuugaaugagaaucuucuccuuuucuagacccuuucuauuaccauacuuuguguguguuuucauagcucucaggcugucugcauaguuuguucaucccaaacaagcuccuggacuuauucuuuggccagucuuuacccauuucuuuggaguuucugcuuggaagugacuuccucuccuaaggugaagacucuuugucauuuaauaggaugaacuuucaaaguauugucccuguucaugaguuaguguucccuggcuauguggaauagaaaagaacaucuccgcuugagcuugaaucccucuggaauaugugucauugacagauccuauuuccugugugaccauguaagcucuuaacagacugggcuuugcauagcuaguaacuaucugcuuuggagaaaauauaaaacaaguacuugaagguuuuggaaagugccaaaggcugggagacccuggaggggagucgaaacuggaaggaggggaguugaaaugggaaacaaaaggccugcuuugaguuuccaguuuuuacuuccagcuuuuacuuccagcuuuuuggucuugaugacagggugcaaugguggcuaaacuccgguagaaaaccuguagucuuuuugcacuggagaacugaaggacagaguucaggaucccuaagcagcgggaaacugggggugggagggugucucagaaaggagagagucagagaggaggaguccuggauucuguguauaaacugaccaaaucagaagguauuucaugaacaacacaugcauaaggcugacuguaaguggcccagcuaaaguaaaaaagaacuaaaguaagacuugagcugcugcccaagagacagaguuugcaguuugagucugaauaugugucacccaugaaucacucuucacugggaucucagcuuuuuucacuuaugucugauacacacaauguaaauauucucuuuucccacuguucaguugccugucucaguuucauaugcuuaguucacaguuguugggcuuugaaaggcaggcaagaggucugaaaaacugauaaccagugcaaagccucagccaaggcaggaauuugauaugaauuuuuaagggugaugguucugccacaguuccuaccucuuuugcacaauuacuggugugucaugaagauuuucgucauguauuugaauguccuaggucacuucauguuguuuugcuggcucuucaugaugauguuggaagcaguguugaauaucgcaaaaaucauaguauaauagaugagaauagcugauauuuucugagcucuccuuacgugacagaugcccuaagcacuuuacucauccuauucuccuagcaauccuguuuauuauucuuguuuuacaguugaggauuaaaggcacagagugguugaaugcacagcuauuaaguaguaaagccaggaacuaauaggaaaaggaagauugguuaguaugacauauacacacgugcacauucucaaacaugugguuagaauuggaagacagguauugucugcacugaguuucagcagauuccugaggaagauaaauaugaaaaauaccauuuucaugauacugugcccugucaaguuuacuggcaugaacuuggcagggaaaagacuaagaaauacuaaugagagcccaaagauugaaugaaccuuuaguuaaagagauaaauagugacugaguaguuugcuuauccagaugaguuagauucuguaggcaaugguuuacugacucuuguagcuagaauacugcugaaauuuucauucauauugaggagcaaauuauuaaguauaguuaauuagaaugaaaugaugaaaauaaacuuuauaagauaacuaauaguugacuuuguuugcaccagaauucuugaaaucugcuccaaaagaagcauauacucuuaaaaaaauuuuuuuuaaauuuuaauauaauuuuacaaauugagagugggucuugcucaagcaauccuccugccucggccucccaaagugcugggauuauaggugugagccacugugcccagcugaagaguccuacagacucuugauaguaaccuuggugaugguagugguccuggugaagaguuagcaaaggaaagagaauucccugccuguuguggcaccaaagagcuuuuuacaagacacugagcacugcaauauacuggcuaugaagaagcuagacgaugcaggaucauguggauacgaaaggaaguuguagcauuaggcuuagauaauauauggagggugucuacaguggggacaugauguuucagcucuguucuguauucaaccacaucugaaaauuuuaguuuucugaacaccaugguuauaaaaugaauacuuuauuccaggaauggaguagucuuauacuggauuaacagauaacagauaaaacagugauaacuuguggacaaaauauauaaaauauaagaaauauuuuaaaaauauuaaaauauuuuaaagucuuggaguguaacuaaaaguaggcagaaagcggagaggauuccauccuugaaggaaaggaaccacacugagcgagacccacauugacauggcuuuuccucugagggcccuucauagcccacagcgugcauuaaauaacuguccauuaaaauguuucugccuaacaaaguuuuguuuuauuauugccagguaaacuuauugaacauagacauugacaggaagcauuguucuuuaacuggcauuuacuacaacuagguauuuuccuggcauuucauuauggaauuuuuauuuaauuucauccaaaccuggggagcaaaucacuguaauuaugccuguuacauuauuuuauaggcuauagaacaugaagaaaucaaauacagaaugaaggagucaggguauaauaacucugacuuuugguuuagaacuugguguuugaaaacaugcagaccuugguuugcuuuuucuguauuugaaagguuugaccucuguguaaaugacuuuacuacagaaacugauugcaguguacuacauuguuuaugaauauugauauaauaaauauuuaauggauacauuuugcuaguaaguacuucaucuagcauaaaauuagagaaauuuuacuugagacagucugcaaaacagcccaaaaaaauaaucauguccuuuugaauaaccuuaaaaacauuuuacuuuucguuauuaauuuguucuugauuuuguuuucuggcuuaagcacauuaauuaaaaaaugcacuaccuguaccuucauccuccuacacuuguggauucuagcgaugagaauggugaaaagcaccguuggacaagcucagauuuauaucucaauaugaaggauuauaaaauaucuuuguacauguuagcuaaaucugugaaagaucaaaugaguucuuugcuugacaguguagaugauuauggugaugugauaguuauaaugaaagcauuuguugaguguguacuuuguguuagguacuguaauguauccucaaaagcaggaucucauugauuacacaugauaaccuggcagcaaagugauuaaggucauagacucuagaaguuagguuuguauccuugugaccuuggaaacauguguuaaucuuucugugccuccguuuuccaucugcaauuggagaucacccuuuaccuaccuuaugauuucaaaagcaauacgcugaaacagugccccauucccuggucagcuuguauuauuaauaagugguuguggucauuaucauaguggggccagggcucaaacaaguccgugauccaguguccaugaucuuaaccacaucacuguaugcuugagcaucacuggugcucaagcaugccaccugacacauaguagaugcucauuaaaaaaugagcuuugggccaggcacuguggcucacaucuuuaaucucaguacuuugggagggcaaggcgggcagaucacucgaggucacccauucaagaccagucuggccaacaugaugaaaccccgcuucuacuaaaaauacaaaaauuagcugggugugguggugcgugccuguagucccagcuacuugggagacugagacacgagaauugcuugaacccaagaaggggaggcuacagugagcagagaucgcaccagugcacuccagucuaggcgacagagugaaacugugucuaaaaaaaaaugaacucuggauuuucccuguagaauuugugcuugaacuggcuuauuugucuauuuauuuguacauaauauauggcucaaugcagagagaaacuuuuuagcuuugaagucuuagagauaaaugaugaugggcauaugggcugaaaucuguauuauucuggaaacacgauuacugaacuguuagcccugggaagugccugaccuugucuaauaauuuguugucacaggaaccauuauuauuugucugcuaugaaggcaagucaguggccccaguuuuagaucgagggucauuguguccuugggcuuuguaucuaauuaauuaauuaucauucaacaaauacuaaagaagcaccaggucugucccaggcaugggaaaugcauuggugaaugcaugagacaugguuugugccuuugagaccaucauagucucaugggacguggcagacacugacaaaucacccacauguauaauuacacauugagagguguuaugagguaaaaugagaggucaguaaacuuuuucuguagaugaccacguaguaaauacuuuauuuuuuuauuuuuuuugaaacggagucucacucuguugccuaggcuggaguguaguggugugaucucagcucacugcagccucugccucccagguucaaacgauuccuaugccucagccucccgaguagcugggauuacaggcguauccaccacgcccggcuacuuuuuguauuuuugguagagacgggguuucaccauguuggcaaggcuggucucaaacuccuggccucaaggaauccacccaccucggccuccuaaagugcugagaguacagguaugagcccucacacccggccauaguaaauacuuuauacuccugggccuuacauucccugcugcaaccauucaccucuaucacugcagguaacaagagggucaucuuuuccuguggucuaggccagugaggacgacuagcagggagauucugaugagagucagagagccuuaucauuugcuuaguaaagcaaaugucuucacauaccugcacugggaggcugcugaaugcugucaaguagcuagugaggaucuccugugggacucucagugcuguuguaagagagcaucagccugcaauuuccucaucuggacucucaagaaguuuaucugcaucuucuuauaggacauuggucuucuucauaggacauuggucugcaaacuuuuucuuaaaggaucggggaguagauacuuuagguuuugcaugagacuacucaaaagcaaaagcagcaauagacaguacauaaaggggcaggcauggcugcauuacaguaaaacuugcugaugcagggcuuuguaucguauguuaguucaggacaguugauuaaaguuuaguauucuaggcaaguagguucaccuuguauuucaacuccuguugaugguauccauguggaacacuguguaaugaggauugugaggcugaggucauucuuuugggaaaaggagacgauugacuagugaugucggucauagguucagcuugugggagcacugguugguacaagugcugggcaucuuuaauccuugcgacuaggagugccuugcgagcaaggauuuugccaucuaucuuuauacauaaggugcuuggcacaauuguuaguuuuaaaaggguuuaucaaaugaauggacauuuaucuugaugccuucccacaaaaccauauuuaaaucauuuauccuacacauaaguacuuacuaaaugcuuauagcguuaauggcaacaucuuuuuauuccaguuguuuucgaaagaaaggaaauucauugcauucuauguuuaauguccuugaccaucaguauuuaaucuucuauauaauagaaccaccaaagucuacaguuuaaaugauuuucuuuccuuguguccuuguuugugcuuaaggccuuuacauuucuuauagguaauauuaaacaacauaaugcaauuagaauuuguuuaacauuuauuuugaaauauguaagauagguaauuaaggaguuuuuuuuuucacauuugcuuuauaaaguagguuucauuccuuuaucguaaauagaguguacaguaccuuguauccucauaauacauuucucugaaaaguuuuuuuuuauuuuuagagacagcauaagaauccuuuuauaagcucaauaugcauuuccuggcuguaccacauaauuuaucuuuuguguuuuuaggguugcaagaugagaagggggcagagaguaggauuagagaaugcuguaaugaaagcugauuuuccuagcauguaaugugugguauaaugaauauauauauauuuggucaugguuccugguuccuggcacauaucuaaaacccugagugguaggagcuucuuuuguuacuuauaaaauguucuuuuguuauuuuuaagcuccuuucagccauaccuggguuuuuaugcuaaugaggugacugcugguggcccuuuaaauaguuuuaagggagggguuagccaugccaagaaggguggauaggacuuuuaguuuucaguccccuaccccaacaccucuaaguaggggagagaggcuggagauugaguucagucacgaauggccaauuucuuaaucauggcuaaguaaugaaaccuugauuaaacucugaaacacugacauuaggggagcuuccagguuggugaacacauaugggcgccccccccucccccauaucauguucuauugcaucucuuccauuuggccauuucugagguuuauccuuuauaauaaaccaguaaucauaaauauucucuagaguucugugaguuguucuagugacuuauugaaccugagcagugggaaccccugugugugcagguggccugccacccuguuugcagcuggcaucuggagugggagcagucugggggacugagcccuuaaccugugguguuugugcuaacucugggaguuagugugagaauugaauggaauuuuuggacaaccaguugguguuggauaauuggagaauucugaggaaauaacacauauuuggugucagaaaacaccacacaugacaucugucuuugccagugcuuaacucaauauggugcucagccucucuucauauucagcagaaaacguucuuacaccaaagcguaccgaacagauuaugcugcagguuucagagaagaaaugugaaggcaugcugaauccacaacaucuuuucucacgcauucucaucacaugugucuguucuuccuuguucucuuccccugucugccuuuucccgcugcucacugauaacguucuccuguguuaacauggagcaguucuugcuauauauaauucccaacuugcuguauuaguucauuuucacacugcaaauaaagagauauccgagacuggguaauuuauaaaggaaagagguuuaguggacucacaguuccacauggcuggggaggccucacaaucaugguggaaggcaaaggagaagcaaagcacauuuuacaggguggcaggcaagacagcaugugcagggaacucuccuuuauaaaaccaucagaucucaugagacuuacuaucaugaaaacagcaugggaaaaacccacccccaugauucaguuaccucccauugguaauuauggaggcuacaguucuaggugagauuugaguggggacagagccaaaccauaucaguuccauguccacucaccaaaaaguccuguggucagcuagacacccuucucuucgauggaaguuugcuuucuaucugugguuacuuaaacauacccucugggugucucauccacucaucccaaauaguguaucaaaauauuccuuacaauugcauauagggguaaaucuaccuuugaccaucuuauacauucauacucgccuucauucaauaaaaaacuaaaucgaaugccuacaaugucucaugcaguguucugggcacggggcacucaucagugaacaaaacaagugauugcccuguggagcugcucuagccauauacauauauaaaauuaguacacauaagaaaguaugaaacagggaaguauuuacuaaauuucuauguauuuauauaugucuuccuauuccugcuuuuaucauuugggguccaguuagaaagauagagacuaugcccauuauuuuaacagauaaaauuuaacauagagaauugaguaaagaaguauuggaggacuagaagggcaaaaaacuccaaaaaaaaccaccacuaacuaaaacagagauuauaacuugcaggaggcagugucccccacccccaacccaagauaaaaggaagagguugaagcucucuaagaacuugggaacuuggaacauagguccugcagagcugggaucuagaguuuucggaaaggcugcugcuuggcugguuucaguggcuccaaggcuggucagggagugcugguagcaccuguaaacuggaaccagcuagucuugaaaccagcuccuuuugccaggaugaggagcuguggggccaggggcuauggugacaaaacauuagaaaggagcagauaucaucucuaucugccagcccuuuagucucccuauagugugccccauaugggcagacccuaauaggaagccagauggcgaaagagaaaguaauuugcaggauuaucagccccgcagagcaaugaacaccuagaaaggagauuuuggagcugagacaaaauaacuucauaacuggcacgucacugauaauggcccaagucuagguccucuucaucuuucuuuugauuuacuacauugaaucccaaagaugcuguucagaucuaaugagaaaauaauugugaaauauccaaguaaaaguauuuucacacagaugugcaacagcuccaauuugcuucuauaugguguaugguuaguuguguacuuuguccuguuuugcagucuauggcauuucccaaaggaguaacuaauuccaugggauuuaaagcagaugccaaguaaaaauugguugggggauaacuaaauauaguuaaguagauuuuuuuuuuuaauggucaagcuccucagaaccucaaauaaagcauauaucgagaaccucuaagugaagaaaauaaaacuguauuucccagauauuugaccaugaaauccccccaucuucaauuucaagcucacugauuugucuucugguuauagucucucuacuuucaacccaucucuaguccuuuuuuaaaaacaaaaacauuucaaacuucuaguugaaaauuuuuugauacauauacuguccucucacgucugucugauguauuaugcuuuuuuuuuuuuuuuuuuuuuuugagacggagucucacucugucgcccaggcuggagugcaguggugcgaucucggcucacugcaagcuccgccuccgggguucacgccauucuucugccucagccucccauguagcugggacuacaggugcccgccaccacgcccagcuaauuuuuuguauuuuuaguagagaugggguuucaccguguuagccaggauggccucgauguccugaccucgugauucacccgcuuuggccucccaaagugcugggauuacaggcgugagcaacugcacccggcauguacuuuuaaaaagcaguuuugugcuauguccuccuucaacuuuuucuccuucagcguuaguucuucuauuuguuucucuuucaugauguuggucuguguuguuucaucauucuugcucuugugcccuagaccauccugucaccagugacugccaguaacuggucuuuuccuguuaguaguccccugaggcacuauuucaucucuugggcccguguacccuacaauugcuguuuuuguccagcauaccccuugcugcuuggugcugaucauuuugaugguugcccgagcccccgcucugcuccaugggugcccagccuucagacaaaagauaacccuaguggccgggugcaguggcucacgccuguaaucccagcacuuugagaggcugaagugggcagaucacgaggucaggagaucaagaccauccuggcuaacacggugaaaccccgucucuaguaaaaauacaaaaauuacucccagcuacucgggaggcugaggcaggagaauggcgugaacccgggaggcggagcuugcagugagcugagauggcgccacugcacuccagccugggcgacagagcgagacucaucucaaaaaaaaaaaaaauguaaauauauauauauguagcuacuccuacuuuggguacaacccuguccuaugcucuuuugacugugggauccuacuucaaucuaguucuuaucugcuuaccauucuccucuaccaggggcacuccauuaauuuuuuuccccuagugcugcuaugaauauagcagcuugguuuagacagcuugguccagucuuacauucauccuuucuguguccccacugugcuuagcacuagaucuuaccguguaguguaggugauacuugguguucagcagauugcuuuugggagggggcuuguucucaaggccucaguucauuuucccggccaucgguauacuuccuugggguguuucuucugcccugagaaggugaguagcuuucaugucuaguguuuucagaggcagcaggagcuucagagaucaauuuuaauuuugagcugacuguccuccuuuagaggcaaagguccucaagagaagagaguaauggccaauaagggagaguuguuuagaucuuucuccugcauuggguagcuaauuagaugcuggcuggaucuaccugguggaaggucauagaaccaaauccccacuguggugcauuucucaccucccugguguugcuucuugauccuggacgagguggaaaagagauuucacagaaaucuuucauuuuacuuugccagcaaacuuguaaggucauggugguugauauuugcaguuagcauaaacaaacagaggucaccugugaauaaauggcagggugaagaugacccaccgagccuucgaugccacucacuuaagcuuauuucucaauuaucaacucccagaacugucaucuugacauuacagcauacuuugauccuuucugccucauucucucuucacuucuaguuugggccaguuguuagcuuguagcaauaucaucuagcauuucacuauggguuccuaaaagaagagucauuaguauaaaacuuucuugauguuucuuagguucuucggcuccucugauuuuaagaggguauaguauguuuaggauauuguuuccuuugcugcuuagauacugugucagauugucuauuuguaagagucuuuuuguguguacuuuucugaggucuuugucaucacaguggacuuuucaaaugaaugacaguauguauuucacacauuuccuggacagugugacaggcucauuugacuaccgugcauucugcacuuggguauaaauuuuuuuuucagggauuauuuuaaaguuuccuuuucaugauaucuaguuuucugaaagcucaccuugaauuuaacuucuauggauuauucuuauagauaaaaguaauauuuggaugauuuacccucucccccucccuggcuaaagaaauucaaauuacuauaagagaagagaugacuaacauagauggaaaaauuuggcauguguuuuucuuuuuuauaacuagggcauuuuauguggaauauuggggagggccauggaauuuaaucaucaaaauuauuauuucuccuuaaauggagauuuugacaaugaaauugugaaagaaagggugcucucugcaauguuauauuuuucuuuaaaagcaucuaagaucaaguuuuccauagcaguaguauuuuauucaucaacaagaaugaaaugucuuucuaaacacaaauaguggacuucagaccucacagacaccaauuaucauucugcacagagaacauucaaaaugucagaugaucucaggaauuuccccagcgaaggucgcucauuuccuacucuacaagucauuucuuuggcaagccagugugacaggcaaacuugugagauugaguuagcuaggucacucaaaacugccgcuauaaagaagugaugagaagucucuugcuaucagguaaaucccauuaaacucaaauguauccuaaacuauuaagcacuauuagauccuuagaaggagcaggaguggguugauugaauaaagucugucccuugcaagcuuucaucuggauuuauuggaaaggacuguggggaguaauuuaaggagggcuaacaaauugcuaacugcaggguguggagaugguagcagggcccugugagacagucaaaucugaugcauugagaugacauguuugaccccugguaauggugauggugaaugugcacguagguucuuuaggguuuacaaagcaccuucacguacauuaucccagccacccuggaagcugguguuuugcuaauaucucugcuuuacccgcuuagugugcaagcucauuugagguagagaucuugaaaaacacugcuguuguuccucucacacuggugauguguuugggccacaugguugaauaaaaauaucuaguacuuucccuucucugaguauuguaaaggaucugcucugaugguguaguugggcggguuuuaaugaauaaugaauagccccagaacaagauuuuuuccccuuuuugaaaauuuaaagaaugaucccauggccuaguauuguacucuuuuuaauguuuucuuuucuuucuuauuuuuuguuucuuaagauggagucucacucugucauccaggcuggagugcaguggcucgaucuccacucacugcaagcaccgccucucggguucgcgccauucuccugccucagccuccugaguagcugggacuacaggcacccgccaucacgcccagcuaauuuuuuuguauuuuuaguagagaugggguuucacuguauuagccaguauggucucgauguccugaccucgugauucacccgcuuuggccucccaaagugcugggauuacaggcgugagccaccacgcccagccgcaauuuguuuucaaaugaacacuuugcauggagaugauucuuggaacacagacccucuuuugccaccacagagacucaccugaguggguggggggaaugacauauauauacacauacauacacauagguauauauauauauauuuaaaugagauggagcagugacuuaauuuucaggaaacaacuucuagaguuauuugugccacaagugagcagagacucaauuuuuaugaacaugaaccugacauaagaccaagcuacuuggcacaaauauccucgccuucuuccaugagcucaccuguucugcagagauguugucuuggcaggcugcaagggcagugccuaagcacagggaugggugcuuaaugcuggccuguugagggaguguccguuacucuuguaacuucaggccucaguuacucaugugucacauggacuuuuggccugucauaaucucagguuuccuucagaucuuauuaaucuuuucaaaguaguuagaaaauuauuaauuuuauuaaauguaauuagauuuuuuuucuuuuucuagcuugccuucuuucauuuuauuaauaaacccaucuuuggggaauuaaauguaguuauuaaauuaacuacaugaaauagauaacuuuuauucaggauaaaacagcguauagagauuaauaucacagucaucuguggguccaaugugaagaaguuccaacuacuauuuucucagauuugcucagaucacuuuaaaauaaaagacguaaaguauaagugaugaaaucgaagucuguuguugucucaucggaaaauccaugaucccuucugacccuuuaacauagucaguguccuaaacuuggcaugucaccuuccaaaugguuuugauauaucuauguauguaucuuccuaagauuguuuacuauuauuauuuucuauuuaagugugcauacucuuauguguuccucuuguucuaccacuugcuaguuuuuccccuguguuuugcuuuguaaauauauuugcauugacauauuucaagagcugguucauucauuggaaccauuuuacaguauuccauuggauaggccaaucuuauuaauccuuagcuuuaaugucuuugguuuuuguuauuucuauguagcaucucuguaaucaagggaggccuuguguucucuccuaggagagaaucucagaugggccacuguagcagauagagguacuguagccuguugcccgcugagauugauauuaaauaauggaagaaaguuauaagaucaaaggcccagcagcucugaugugguggaaugaugugcagaaaugucaauaauuaaauguaauacauaggccaugucuuaguucauuuucuguugcuuauaagagacagccugaaacuaggucauuuauaaagaaaaggaauuuauuucuuauaguuauggagccugaggaguccaaggucaaagggcuguaucuggugagggccuucuugcugaugagaccucuucugcauaguccccaagggaugcauggugaaggggcugagaguacuagcucucaucucucuucuuuuucuuagaaagccaccgauuucacucccaugauaauccauuaacccauuaauccauucauccuugaauggauugguccauucaugagggcaaagcucucagaacccaauuaccuguuauagaucccaccucucaauacugccacauuggagauuaagugccauaugacuuuuggagggaagaaacauucaaacuauaaggccaguuugggcaaaagauuugagguuaagauuguuuuuaaagaagugccuuuuuuaugacuagcagguacaucagauuuaccacaugcauaucaacuaacauuguaaagugugugugugucuaauacuagauuucuuuuuuuuuuccuuaaacccacaucuaauccacaaguaagcuuuaccucaucaccaaacuuuauccagaauccccucauuucuuucuguccccaccucuacugcccuucucuauagucuaguugagagaucagcacacuggccugcuagccaaauaaagcuuuauuggaacacagccaugccuauuaauuuauuuaugauugauggcuaguuugcacuacaaaggcagaguugaguaguugcaacagaguccaccuggccucaaagccuauaauauuuacuaucuggcucuuuauagaaaaaguuugcuaaccuuaaucugguuuaaugcagcucucucccaauugguuuuauucuccaaacagaaaacaguggcuuuucuaaaacgugaauuugaucuucucacuucccuguuuaaaacugagugaaugaagucuaaacucuguauuugccuuaccagcaccugcauuaucuggucccugcuggcauuuucaugcuccucugucaccauacucccuuguucgugcacgugccaaccccuuuccuaccccagagccuuggaacaugcuggccucucagccugcugugcuuugccucaguuccuucacagguauaccucuuuucugucuccagauuucugcacagaugucauuucuuuaaaggugaccacucagucuaaaauuggccugcacagcucaucaugugucuuucuuuucuuuuucuuuuuucuuucuuuuuuuuuuuuuuuuuuugagauggagucucacugugucacccaggcuggaguccaauggugcauucucguuucacugcaaccucugccuccugcguucaagcuguucuccugucucagccuccugaguaccugggauuaaaggugcgugccaccacgcccagcuaauuuuuguauuuuuaguagagacaagguuucaccaugugggccaugcuggucuugaacuccugaccucaggugauccaucugccuuggcuuccgaaagugcugggguuaacgggugugagccacugcacccggccucaucaugugugucuuucuuuucccucauagcauuugcugcucuguaauuacacucuucauuaauguguucaugucuuucuucccugccucuccuccuagggcaaaagcuugcugaccacaaagaacuugucugugcugauuacugcuagaucuuggaugucaaacacagugaccacauuauggaugcaguggaaaauuguuaaaugaaugaacaaaguauaggucugccaguuuccuugguaggaguuaaaugccaguauauguuuauauuaccuuaauuuguuuucuuuaucuauaaauaaaucuugccuacuucuguuugcaggguaaaauuaaggugauuuucuucuacaacaugauugagcuagcauacucuccaggagggaacagacaggcauucugaaaggauguuugguauuuuuagagccuuuuauacauuuguuucugcuguugugcuaauaugcuaauguuuaucaagguuguauuuuuuucccucccuuuucuuucuugcugcuggcagagcagcauuauagaguuaugcagcaaacucuccuuugggcauuugucauuacuacaaaguguuuuacauuucuuugcuccuuaaaauauaugcugcuuuucugcugaaccuaggauaaaaagaacaaggcaguaucuuugcgaaucuuaauucuuucgaguuagggaaaccgauccagcaaccucucuuucacaccuucccauuuucccagugaaccucauauucgguacagcucuguaccuuccugcagugaaaucuauaaaccagagccuccugcuucuuuugccccaguugacuucaaggcucagggcccaugguugugcacugggagauaauacaccagcacugccuaguuaaagggcacaggcuccucagucagacauaccuguauuugaaauauggcuuugccuccaaccagcugugucacccugagcaggcacuuaguuacucugaaccuucuuuugcuuaucuguaaaaugagcuucugcugguaucuuccuuuaauuggagaaucucacgagguaaugcuuuccaaguggaauaacacaguuucuggaauuucaugggacucagaaauguucacuaguauuugauuuggaucagcaacguaagacuuugccaaggcaccccaagaagaaugaauucuaaaauagcaaccugcugugauccaguuucuggauaaucugaaagcucaacugucaauucuuuuuuggaaguacagaugauuuuauuauuauuauuuuaaacugaugcugcuugcuuuacugcuagaggccuuagauaagacauguggcacuaucagagaugcguugucaauggaacaaaaauggucucggacgcuggucugauccuagucugauguccugugaagaauaacucaaguguuguuucucuugaugcgggaacuuuaaaguacuuuucuucucuagcuauccacucuaauuaaguuuuacaucccuucaacgcuggcuuuucagguaccauaucgucauuauuauuauuaccaauuugucagcugcuuuauuuguucauacuuuaaaauggaaaacaguaauuuuaggucaggaauggcaguauaguuuuugucuguggugguuccaaguaguuuuuaauugacacaggauuuacagacugacuaaaaagagaaaaagucagaugugauaauagaaagcucauggguuuuuuuuaggcagggggaccuggauucaaaucgugacucucucuuaaucagcugaguggccuuagacaagcuacuuaaccaaccugucucaccuucagacuucuucugugagauggggauaaccuaguucaaaugagaugaaaaguaaauuuacuuauaguaaguagcacauuuuuucuuuuugagacagaguuuuguucuguugccaggcuggagugcaauggcgagaucucggcucacugcaaccuccgccucugggguucaagcaauuuuccuguccccgccucccuguagcugggacuacaggcacgcaccaccacacccagcuaauuuuuguauucuuaguagagacgggcuuucaccauguuggccaggauggucucaaucucuugaccuugugaucuacccaccuuggccucccaaaaugcuuguauuacaggugugagccacugcgccuggcccuaaguagcacauuuuaagaugcuuucugaaugugagauuuuucuaguucuuccuuuugcaaauuacuguucuuuuucugugauuguugagugauucaaguauagaaauuccaugauuagaguuuaaaaauaucucuacaaauguauuuaaaacaaugagcagggcucagugggcacuauuaaaacaaaauuauuuauaugaucaccuacuauuuuuaucuuaaugauugccagguaucuacuuguuacaccuuuccuccucuuuuauauuucuggauuaaauaauaauagcuaacuuuuuuugaguacuugucaugggcacuguuccaguuuauuugcauauauuaacucauuuaaucuuuacaacagccuuugaagaugggccuguuaguauccucuauuuuauaaaugaggaagugaaacucaugucagcugccauuucugccauccauaggguagguaggaucucucuguaccccuucuagaguuuaagaacucagccacagggggcuaauuaauugguuaauucauuuucuuacagugugcaaaacagggagaacccaaguggagaguggugaagaguauugcagugcuaaacaaaagugacguucuguuuucaaaggugacuuccaaugaagacuacucuuuagccugaacauggagggaaaaagaacagugucaguacccacaguccuauucuuccuucuacaucugacauuauuauuuuuuuccuuuccauaggcuuaggcuucuaaucccgaugauuacuuuucuuaccuauuucuguagcauguuuucaugcugaaagagaaguugacgugcuguugucaucguauuaaggccuaagcagaacagcauuauugguauuauuauuuuuccucucacaaacaggauuccacuuaaucucuuuuaccggauggcacaguuaaagugccuucuucaucagagccuguuuuaaacaagcaggccuuuuauuuuaugacacuuauauugagacacauugaguuauaucugucuuuucauuugcaccaacacauuuauuugaggccucauauuuccuagguaacgugacuaagguagauuuaucggugcuaauuugcauacagaacaacauuggcaaaacuaaaauauaacaaacacauacuaacuuuugacuugccacagcccaccaagcaucugccuucauugccaugccuguaaugagagggaaauauauuuuccucugaguuuaaaucuaauuccuuguuuguauuccacugucgucacugcuguugagagcucgaagugagguuuaagagccucuucauaucuaacagcaggaguuuauauuagaggugguaguucuguauaacagaaaaugcggcuuuugcucacccaccucgauuucauaccacauuugaagaacccugcuacauuuaaguaaggggcaagcccuuuguuuugcacaaaaguuaauagagacuuaaggcuacaccauuguguuaaagccuggcuuuuauuucuuuuucucaauguugcuuuuaaguagauugauauuuauggcacaaauaauaaaugaauuuauuuaaaaauucauuauuaaaaaaauuuuuuuaaauuauagauuagguugaaauuucuuggucugcccuucccaaguuuacuggcaauagcuuggugaacaucaucuggaccuuuuccuauacauuuacuuaugcauguaucuguccuuagaagauacacauuauugcuucaugugugaacaugugugucuaauauauguucuucugcuguauguauuguucugcagcuugcugguuucuuuuagucuugugccuuguagaauaauuagugcuaccauguucagacuuaauaggcuagauuagucaaugcuguuaucaugaguuauuccuaagaucucagugguuaacacgucaaacguuuauuucucagucaugcacaugugggucaggugacaucccccauguuguaacucuuauaauccagccuaaucucaccugugauuccaccaucuccacauguggcuuccagguccuuguagccaacaaauagggcucuggaggguugcacauggucucuuaaaaguuuuggcauacuagcuacaagagaacugagaaauguagggguacacaugguuacuuggugauacuguguugccauagauaauguuaaauaguucacacagucagaauauauuauaguuuguuuugccagucuucuauuugaugggcauuuggaucauuuccaaucguauccuuuuguuauguacaauucuccagagaagauccuugcauguaucucugguacauguuuugcuaggauagauacccaggaaguagacuuuccaggucagagaaugggggugcuuuaguuuucauaaacacugucaaauuguuuuggaaggugguugcacuaguguucuguuguaaggauaguaucugagaaagugcauuucaccugaccuucaacaacaauagcaucagaucucguguguguguguguguguguguguguguguuuguguuuguguuuguguucaguggcaucuucauuccuuuuggcaaaauggcuucuuccguuuuguuugaguuucuauuuucuugauuacuaguaaguccugggcucuuucuaauacugcuuuaugcugccuucccaagugagcaguacuagugugcaaagucgagcugaagaaggcuggagcaagugcagagccaguggguagacgauuuucccuuucaggggugucgagcucagggacauuucuuuugauauucucuguugauucccccaccuccccaccccaggugcuauuucaguuguuucuacaccucuaauuuuaaaaccauggggcgaaggaugauuucuugggcaugucauuuuuuuuuuucuguguagcugucugguuuugugcuuggaguuuuuaugucaguuuuugcccacuuagccauugucuuguuaucuucugguucucuuuguccccugccucauuuuucauucuuuuucuucugcuucugcucccuuguucccauaggcccuuaaaucuuuauguguugcuuuucuuuuaaguuguauuuuuccccuuccccuccaagcuuagaaauguuugcucuaucaaagaaacgcaggaaggaagggaaugauggcaaggauauuguacaaguccaaagggaacaaaaccuaggugcccaccuaccccagcuaguuuaagaaugugaugcuguuccuaucacggucacuuugccaaaauccaugugaaggaaggaaaaaagcugggaauuaguccagcuuucaucaggccucuggcuuacuauaugaucccuaggcaagacacuuucccucaucaggccuccagguuccugacuguaaacugaggugauuggaccccaguggucccuuuauaucuugaaaccccaguauuugaaacaugugacuaacugggaaacuucuccaguauagggucccaaagaccuuuuuaaaaguggaucacugccauuccccuucaccuucagccugugaagcacugugucaguaagggccagucaggaagacagggauuuugugaggucauuuaauagaauuuaacaaagggccggaaagauuguaaggcacacaggcuugggaggcaacacagagauggauggacaacagcaggaaucuuccgugagccauaggagaggaaggaaaugguguuggccgagucuagggcuagcuguuacaagcagaagucacagcaggggagauagcaggagcuggaauguggaagagagggcugucuggagagaccuggagcuucagaggagaugcuguuacacccacaaagaggacaacaaagccuggugucuucccccuacuguucagucucugaacagagucucaaauuuaggcagaagagccuguggaaugguccugagggcaggcuggcaaaugacuggcagaaacaaucaaaaggcacuggggcagaugaucuuuauacuccauuccauuccuugcauucuagaauucauggauuaucugagagauucuucaugucuccugcagcaaagauguuauuuuuagggucauaacagguagcucuuccuaggaguugaaauaaacuucuaccauucuagcaucuuaggacaacaccuauucacaucuccaccucccucccucccaaagccuggaguaguuacauuuuaccuuacacgagcucugucagcauuucgugaaaguccuauuccugguagacuuuugacgaaagggacacuauuuuacuugucucuuaucucagucucuaucaccacagagccucugggaccagaauacaaacacagggaaccaauaguguuacccaguugauccagaaguuuuacuguuucagaguaacuugugaucuugggcaaguucagcccguuuccuaauuuguaacauggcuuuauuggucaguaaagccaauugggcaaaaagguugugcaauaguaacaaauaacccccagaauuucaguggcuaagaauccacaaagguguauuuuuuacuacacauuuacguaaagucacuugguauauguccauccuuauucuggucccuggcugauagaucagcuaccaucuugaauguugccauuccccauaucuagagagggcaaacuucgaugggguaggagggauggcaauuaaacguuggccugaaugugucacacaacauauguacucacaacuuacuggcuggaacuaguuaauugauaugauacugugauauaauaaaaaaaauacauauuuggucuuuaccccugguuccuggcacacaguuccuaagacccuugggauaucugaagugaugagugucuuuucuacccuaaugagaugacuagugguuggaguccacuagguagcuucaggauugugacugguuacuagaaagcccauagcauaauuagaggguugggacuuucgguuccauccucccagucucuggggaagagagcgggacuaaaaguugaguuaaucgccaauggcuaaugagguaacaaucaugccuauguaauaaaauaauaaaaucuuaagaggacaagguuuggagaguguccagauugccaaauauguggcgguaucugcaaggugguacccccagagagggcauggaagcuccaugggcauaccuuguuauguacaccucuuccaucuggcuguucaccagugucuuuugucauauccuuuauaaauaacugguaaaugucagcagugguuuuugugagcucuguuagccaucuuauaaaauuaguuaaacccgaggaggaggucuugggaacucccaauugauaacugguuggucagaagcacagguaaaauaaccuggggcuugugccuggcaucucaaguggguauaguccugugggacugagccucuaaccugggggaucuggugcuaacucuagguaguagauacggcaucgccuaacuucagcugaaguaaggaagugccuagaaggaagaagaccgaggauauuucuugauuugcacuaaugacagcuacagagagagauaauaauucuugacauuuccugauuguuuuaaccaugaaacaugaauauuuaauauaaugccuagcucauaagugcucaauuaauaguagauggaacuauuauuguuauuauuauucagcaguuuauauuacauuuccagcguacuuucuaccauccauuugcauagcagauuucuucucacccuuuuuuuacaacugagaaugcagaaguaaacauaaauuauacuucuguagauguaucacauuuuuuuuuguuuuuugagacugagucucacucuggcacccaagcuggagugcaguggcacaaucauagcucacugcagccucagccuuccaggcucaaguuguccuccagccucagccacccaauuagcugguacugugggcaugcacuaccacauccagcuaauguuuucacuuucuguagaggcagggucucacuauguugcccaggcuagucuugaacuacugggcucaagcaauccuccugccuccgccucucaagauguugggauuacaggugugaaccacugcgccugcccacacccagcuacaaauucuuaauaaguggaguugucuugaaguuuuagagccagucagggcccuaguuuuccaaguuuuggauugacaaaaauaggugauuauucuguaaaagaauuccuuuguggagugauagccgggugucaucaguggauuuggaacugugcucauuguccugguuuucaauuuaagagcaacagacuucaagcuggcuuucauuugagucaguguggaaacagucaauauauguuacaugucugugaagcuggccucuggaucaauugcaauuaguuuccagcagauugcauuaacauaucuaaaauuaauauggcgaguguucugaugaaaaggaauugaccacaaccacauuguggcuguuuuuagucucccucaaaugcucuuuucaaacuauauuuuuucuuucuuugguuaauggcuuuaaauuguuaugucaacguagacauaaucuauugauuguuccuauuugccuuuuaagagugguccuagauaauagcacacagcuaauguuuaauguuuucuuucacuaaggggcuuuuucgcuaaaugccuuaaacucguauuuuucuuuguauguuauauaacacgcuauuaagacuauaaagccuuugaguauguucauuuacagaauuuuguguuuuucaaauuacuaauguuucaucaagacuuaaaaaguaagauuaagaaauaauguguaguuaaaaaauaauauacgguaaaugaugugagcauugcuugucugacaauuuauuuuuaucccaguauuauuuauuucuaaagaagaaguauaggcaacuucaauauuaaaagcaaaaccaaaccaucauuaccagcagcuacaaggacggaacagagagcuaucuuuaggcuugaucauguugaaauuugaauuuuuuaccagcauguauacauuauauuauguuuauuucacaucuuaaggacuaacuuguacuuuuuuauuuuuagagguggccaguuucugggaaugaaaaauuguccauaucaggagacaaaaggcagaguugauucauuuggccauccaaguggcauuuuuugggugucuuucauaugucaagcacugucaccuucuucacagagauacagagaaguuuaaggcacacuuucuacccuuuaguggaacacagucuaguaguggggguauagagcuuugaaucacccuauuucaaaagagcuccaugaauacaucauagcuuggggauaccagaagaaaaugacauuuuaaggacacaguagaugucccaaaagguaauggcuccaugugaugaagcccugugggccucacuuuuaugaucugugugacacugccuuggacauccaccaaagccguggacagaagccaguagggauuguaucagaugauguccauguacuaccagucuugugauccaguugugugauugauuuuuuugguuugugcauuaacuguauugucauccuuccucuugugaguaauguuuccuuugcauaugacucauggauggaaaggaguuuacauuaaguguauucauuuuuccugguuuuuuuuuuuuuuccuucuuuuaaaaauggggcuuacagauuugguagggaauacuguugauauuauuggauaaaauguaaggaauuuauuuguucauguuauuguguccuuugacuguguccuuuuaacacagauaaacacguagugcauauuggaaaaccacuucuacuugaaacuuaagcaaauuuccuuuaauacacaaguugcaguuuaggaacuaguuuaauuaauagucagucuuucagguuauugcacucaaccuugguggaugaaagagauaaucucguuaaacacacaauggcccuacccagacucuguuaaaaacugugguaaagaaaugaauuagucuguggcccagugacuucagaguguuuaaacaaauuuccugaaaaaccuuacaaugauuaacagucuauauacaguuauuaaaauaaugcuaugcucuuuauuuauuuggggugagaaggggggagccauauccauguaauagaguccuuaacaguuuuuaaaauaacuuauguugaaauacuuguagacucaaaggaaguugcaaaaauaguauagcagccccauguacucuucauccagcuuccccuaaugcugacaccucauguaguugugguacaauaucaaaagcaagacauugauauuuguguauuacuguuaacuagaucacagagcucacucagcuuucagcauuuuuaaaaaaccugcauucauuuguguguguguaguuguccuuaacaguuuuuguuaaaaaauaauuaggcaugaauuuaaguggguuuuuuuuuucuuuugcuucucucaacucuggguugcagauugccagucaacaguaccucuaagacuggccauguagguugacuuuuauuuuucuugcuauuaaugaauguucuuaccucucuccuucaauuucuguaggcaguucaauuaaccuccagaagauggcugaaccugcaggaauaccagagcaagaaacugaugucugacaacggagugagaguucaaagauucuuuguagcagacacugcaaaugaagcucucgaggcugcuaagagacuaaguaagcugauucauaaugggugaaauacacuugcccaaaucagugaauucacagguaguggcuucccacuaguuaauuuuuuuuguuguggauuaaacugacagggacagauacaggggagagcuuagaacugcaaaagcaaaaaaguccagauugccucauguacauguguguaagugugcaggaaucacauggugacugcagcgugaagggaggggucugcuuucagagcuuugucccugugagucuucaguccugcugaccugggaggagauguggaaucacaggacagccuucagugugauggccuggguguaggagaauagagccuuucuucccuggcacaccuagagguuuccucuagacugggcccugccugacccaugcugcaugagauucacaggcaccucuguguccucaguuccgccaggaucacucacuggaggcacuuggccuaagugucaaaaaccuuagaacaggcucagugggguggcucaugccuauaaucucaguacuuugagaggcugaggagggaggaucacuugaguccaggaguuugagaccagccugggcaacauagcagaacccguuucuacaaaaacuaaaaaaauuagccuaguauggugguguaugccuguaguccuagcuacucuggaggcuuuggcaggaggaucacuugagcccacgaguuugagauugcagugggcuaugaucacucuaacauacucuagccugggcgccagagugagaccuucucucucuuaaaaaaaaaaaaaaaauuagaacaacaaacaacuucccuuucuuuucaguaucccuuagggaggguguauccucagaaauucuuacaguaugagcauuaggguguuuucaucccagcucuuuuugaaaugaagaauaguacaacaguggagcaucguucaauaaugugugcagggaguggauggaagccuucaacaauauuugauaacacaaaaaggaaauugugauccauguuaacuaauaaaggaaaugauaacugcaauuuaaaaaagcaaaaaacaucaauuuaggaaaacuuuauucuuuuaccugagauagcagcacaugggauguugcuucaugguaauuuuucagagauuuuagucacuauuucacccacuucugucagcuguggguuaguggcugggagaaacauggcugaagggcuugagaagccuuugcagggugagucaguugucgacauccuucuuuaagucccuuagaacauggggagagcacccucugagugacuggaggagaccaaagacaagggcaugacuuuaaagucaagcuaacuuugcuucaguguuuugccuucccuuuaccagcuuuguaauucugcagaaguaccuucuccguccuugccucaguuucuuuaggucaaagcuaauaguacuuauuucccaaugcuauugcgagucuuuaggaguguauuagucuauucucaugcuacuaauaaagacauaccugagacugggugauuuauaaaggaaagagauuuaguggacucacaguuccgcauggcuggggagaccucacaaucauaguggaagacaaaggaagagcaaagggaugucuuacaugguggcagacgagaacuugugcaggggaacucccauuuauaaaaccauuagaucucgugaggcuuacucacuaccauuagaacaguauggggaaaacugccccaaugauucaguuaucucccccuggccccacccuugacauguggagauuauuacaauucaaggugagauuuggguggggacagccaaaccauaucaaagggcgauuguugugugguagaacaucuagcucauuuuccuccuuacagauccagauauuagggaucagguccugcugucugccuuucagugagcauccccaccuguggcauacagacuuuguaggugucggucuggauugccacugucuaguaggaguauaaugugagccacgucaguauuuuaaaguuuucuaacagucacauuaaaaaaaugaaaaaaagggugaaauuaauguuaauaauauauucuguuuacuccaauauaucuaaaacaacaucauuucaacauguaauuaauauaaaaaguuaucaacaggauauuuuguguucauuuuuuugucccaaucuucagaaaccugguuggaaugcuacacuuccagcacaucucauuucagacuagucacauuucaggugcucaagagacugauguggcuaguggcuaccaucuaggacagugcacauuuggacacuagaaggauuugcaugugcauccuucagccuugggaaugcaguuauuucccacuaaaaauaaagaguugugcgucugcuacucagucuuguccagguaucaguagcacagguugagaguuuaggauagaagcacucuccauauuucaauauucuaauuuucuaugcucuuuuaagaguaagucgcagguacuuuagcuaguaauuguuguucuuugaacuuuuuaaaguucuaccagaugcuaauacaccagacccuuucuauguuaugucaguugaaauguauaugcauucucuucuggaacaaauauuuaucgagggucaaccauguacuaggcacuguggacacagcugugcaagacaggcaagcccuuuuucuucauagaauuuauguucuagaaagaaauuaauuugugacuuucagauguuaaauguagaaauugaagugacuuauauuuuaauaaaugaaaauugguuucauuuuuaaaagcuaucaagauugguuuuuacugugaaaaaaucccaguaaaauaagaucuaaaccuggaugagagcuccucagugaacuuugauaauagacucaguaaagguuaguacuguauuccagccuuuucauaagaaaggaucauuuuuguuuuauacucuugugguuuggggauugggaagugagagcaaagaaauguaaaguucaaguuggucuuugaucuucauuuccccauuauuuucuuaaauacagugaagcacuagcauugcagguauaacuaaguuuuuuaaagagaauucuggaggccagcugauuacuccccucaccccucuuaggcauaacaccuaaucucuuugagauauuccuggagauaugcacuuagugagcuaauugacuucuuaguuaugguuuuaugaacauuuauuuagccauuguauugugguuggggauuguguaccaugcuuuuuacuuguauuuauuuuuuacuucuuuuagagacagggucucacucugucacccagucuggagugcagugguguaaucauaguucagugcaaucucgaacuccugggcucgagugauccucccaccucagccuucagaguagguaggacuacaggcacacaccaccacaccuggcuaauuuuugugucuuuauuuuuuguagagauggggucucucuguguugcccaguuuggccucaagugaucuuccugccucagccucucaaagugcugagauuacaaccgagagccauugcaccuggcuguaucaugcuuuuaauagaauuucugcucuggaggaaugagcaauguugcauugacguguugggcugggacaagggagggaaaaaaagagacaauaaagcaauuugaaguaaaagaaaauuaguucuucagguaugcucucaagaaauacaaacuggauaaaggguugagaaugauaaaaggauugacaaaaucaagcuggauaaaggaauggagaaugaugcaugguugugugugugugcuuauaggagugugugagugugugugcaugcagguuucaccagugcauaucuaugaugcuccuuaaggugguauggccaacagagggccucccugugauucugucuagagcuaaacaggaauuuggaaaauucaagcuccuuauuuggugaaugaaugaguaauccuucccgaacucagugaguaguuuugguagaaggaaggucuccucugauuucuguuguugaauaguuuugaucuaaggggaaauuuauagcauuagaagaggauauggaaccaauucuaguugguuaaaagugaaauuaguugaucauaaauauaaaaauugugugcacaucacugagauuaccuggagagagcaaagcaagaagaaucuggcaaaacuucagaguauuuacauucuugucaccacaagauugacagaaccaagagcacgauugaaguuuuagcaaauagauuugagguuaagauuaaaacuggauuaugcacacaucuuccugauuguccugaaaaaaugggaucuucaccuuguaauuaugauaccaucaugggagaaaauugccuagaaugauuaugugucuaacacugagaaaguucuauauaagauuuuauugcuaucagcaucaucauuguugucaguggcagcaaauuccaggagguucacuacuguugugauucuaacucacagagagaccagagacaucguaauaacuauccuguuaaucauguguuaggagaguucauauuuuaauuagaaagauuuguaaauaauugaaagauauuugcuuaccuuccuacuuuauucauauuuugauguguuuugaaaugacauuuuauaaaauauuuugaaaauaaaugugacauuaaucauaucugugauuuccagggugacuucucugcggauugucucgcagaucucuuucuuugugccugaagcugcauuccuaguugucuguugaccacuuguucaugagugucuuuggcacaccugaccuaaauggaacuugucaucucuugguugcuucaaaccuucucuucuucucgccacccuacuuacccagcugaaauagcucugcaucauuaaugucucucaugucuacuauauucaguuggucgccaaauucagucauuguuuaugucauuuuacaagcaaggaaacaggcaagauaaaguuaaaaaacaugccgagauuguagagcuaaaugacaaagaugaugggauuuuaauccagucagauuagauuaaaucuccccuagcauuuuccuuuugcuaacuugaugaugauauuuuugggagauuuuuaugugugggucagcauuuuaaacauggaaaaugcauauuaauaaaauuagaagauuggauuaaaacuagauguggcagguuuuaaggugcaauauauagaaacugcaaucugcagauauuuucuuaaugauucauuugcuuuuaucucugagcaaauagaaccuuuugcuguguaguuauggaaagcuuguuaauuugaacauuuguuuaaaauggguaaugcauacauuuuguuucugaaacacuguucauaaugguaagauauugagugagauccucauuuucuugcauagaaaauggauuuaugucugagagagcaaauuuguuugaauuaaguuuuuaauguguggauaauauucauugcugcugccauuuaucggagccaccuuuuauaaucacgcuuuaaaggaggaguuguuuacguugcauacaauuuucuuaggaggcuuauaaguacauacuuuuuuucucuuauggauuaaauuaaugaauacagucaacagaucauuacagaauaccuacugugugaaugacugaucuucauguuaccuuuucaguucucuuugaaagugagugaaggauugugucucucauauaacuggaaauaccugucuuaaaaaaguauuuguauauaaacuuagaugaaacauaucuaggaucacuaucuuucaguuuuuagaaucucuacaauuuauuaauuauuccacacauguugacaugagacucuuaccauuugauuaagcaagaaaauugcguuucaaaagcucaguuuuauuuuuuguugggaaagaaaauugaacuaugaauggagaaauuaaucuucucuggccuaaugacaugcauccuaaaauggagauaaggagcuuuuauugaacuuggcuagcuuuugauugcuuucagcuauaacauguuuccauucgucaauaugauaacuuguucuuuugguauuauguaaucacauccuaaagccuggugaauuacuuaacaccauuaaggaauuguauuugauguaaaaaaagaacuguugugcauugacuacugauugauauguacuauuaaucccauagucaauuaaauacauugcaagccuccuugauuguuguggcuuuguccuaugacaugugguuaggaucuugcaaaaagaucuuaauauccuuuuuauugagaugacggucauuuuugucuuauaaugacagacaaggauaacauugauuuuugugaaguaaguuuuccuuuuaccaacauaucagcugcccauuauuuugacuuuggagucaauaauauaaagcugcuccuaggguaauggcauaugugguccaugagagguugaagcgguaucugcuuucuaggaauaacagugguguccucaccagacagaugguuccuguggugugauuugauugugugccugccugcuguuggccucuuugguuccuucccauuuuuuaagucugauuguccugccuucuuggugauuaugugagccucccaauuucuuuuucguaauuuaguucaugcuuauuugagcuagaguuaauuucuguugcuugcugcuaagaaccuggucucaugcagauagagugcuucucauagguccucagaggcaguaggugcucacgaauaaauauuguuauucagaaaauguucacuugcucaugcucgcuugcaaaugcuccuuaaaggagcaccugaauuuaaauuaaugguuuucccuaacuguauuuauaaagaggauaucccauucaacaaguuguagcuuuuaaugacauuuucuauuguauguauuuuugcaaagagaucccccuuuuauaaaauguucuuuuuucuucuuccuaagucugcaaauauaaauggucuucucuggucaucuccuuagaauuucucugugcuagaauaucuuuucccuaagugucuugugguauucacugaauaccacucugcaggagaccugcagagugaagggcgagaucaaggcggguugugggcaggcaggcuuuaugggaguguacauguagcuuccuuucaguuuucucagaaacaaaugagaacaguacuuugaaacucaaugccuuaacuucaauuuuaacagccuacuaaagcaaggauuaauucuucuuacacuuuuaccaauaaaaauaauaguggugguguuuaagcuuugggccuuuaccaugugccugguauugugcugagcauuucauaaauauuaucuccuggaaucuucaucuaaaccaaagggaaagacuuuccuuuaaggacugguacugagugucaccagaucucuucaugcccaugauuguguauccaugguaacuaacauaauuuuacuuucugucuuuuuggugugucauuaaugcaguuauguauuaucuuguuuuuauuuuuuuaauuuuuaauuuuuuaauuuuuugagacacuuuugcucugucgccccggcuggaguuggggggugcgaucuuagcucacugcaaucucugccucccagguucaggcgguucucaugacuuagccuccugaguaucugggauuacaggcgugcaccaccaugcccagcuaauuuuuauauuuuuaauagacacgggguuucgccauguuggccaggauggucucgaacuccuggccucgagugaucuucccacuuugaccucccaaauugcuggccuuugggaggccaaguugggaagauuauaggccuggccgacuuguuuuuuuaaagcuaccucauugagaaugggcaaagaaguuauguuggcauguggucucauuuuccaggacuuucccgugaaauauuuuacccugggggccuuugacucaccccauuguaaaguuuggcaguuuugaaaguucagaggguacuuuaugggcuauaaaugcagaaaaacagaaaaacuuuaccuaggguaaaugacauaggaccucacugcugugaucgcucugucuggguggauugccccuuuuaaagaaaucuuaaacauaauuagacaaaucuuuucugauuaucaaaggaacaugcucauuauuuugauauuggaaaauacagaaaauuacaaaaaaguaaaaaauaaguaaaaaauaucuucuaaucucauuacuuagaggaagccugugcuaauauuaacauauuuucuuucauuuuuguuuugcacacaugcauucagcaauauuaauuucuguguacauauguauaugacaucauugagagagaaugagcuuguuuauaaauuuggugagguacuaaguacaguuuuguuuauaauuuuuguuuuaaaauucuauauuauaaaaugaacauugucuaaauauuaaauuuuuuuccaaaauauuauuuuaagguuuuaugauaaucucuagauugacuguguuauuuccucuugugguuauuuuuggauuguuuuucucuguauuggcauauuagguagugcuagcuucugaagcacaugagcugccccauucucaguagccuggugcaagaagaaguuauuuccuauucacauacaaaucuagcaugauguucuuggucugccacaggaacccaggcuccuuuuguuuuucacucugcugucuuccacacauggcucccaaagaugaccuggaaaguaugcccauuccagccacucaaaaggcaaaaaaaccauggaggauugcauguagaaauuugcauggacugugucauuucagcuaaaaguaauugcaagaucucaaccaacuucaaggguggcugggaaauacaguuucaauccaugcuuaggaaaaagaagaaauggguuuggugaucauguaguggucucuucugaaaguaguguuuagaaucuugaaaaucuuugucucuuugcuucaaggcuuagaagaaacacaggcuauacagucagaacagagcucccaucccagcccuacuuugacugauuacccuaaaccacaauuuacuugacuauaaaauaggggauaauaauacauacuucaaggaaugauugagauggcaacaaagauaaacgaaacacauuucacacaaaugaggcacucaccaaguucucuuucuuuuuuucuucuuuuuuuggauugaacugagccaguguuuugagccgucaugaaagaaauacaaaacaacuauuaaaacaucaacagcagauaaaaauaaaaauuuucaauacuuuugcaauaacacccaagugugaagcuauguuuuuuuauacaacuugucagauaacuugauaaugaauauauaaugacuuguguacuguugguugauauuuucuaaguagaugaagauguaagucaaaaguugcauaauuuuuaaagaaaaugagcgucauacuuucuuuacauugcaacagaauaaauauuacauauggaauuaugcuuuuaagaugcuacacuauuccccaaggugguuguaacaggcauuggcaauguuuaacagauguucauaaauaguacuaaggcuguacuugaguuuucuagguuacggacaaaaaagucaggaaaugaauugagaagguuuaaaagaguuguguuacuugaucuaccuuaggaugaaaauuggguaaguaaacaagcuaucucagcuguguaauuuuuuuucuuucauucaacaucgaacaagcuaagagauuugggagucuauuucucucaaauuaaaugugagccaaguauuagaguuuuuuuuuuuuuuugucuucaggcuuuuauuugagcaaauauaccagucacuucagcauggggcagaggaaacagaugggacguggauaacagggggaaaauaacagugcuaaagguauuugaugugcaaaaaucaaauuguucccagaaucuucaggugcuagaugcagcacugaaaaacaacuuuacauaaauauauauuuucuuuauaaaugaucuguccauuagcaucauaaacaugagaaaaccuggaucccguugagacacucuugcucagaauuucuuacuacuguuccuuguuuaguggauucaguuuuaacucacuguggcauacacagucagcugugcaugacgcagucacaauuuaccuuucgcucauuguccucucuuuaugccuguuacccaguguguggccacaucaguuuccuuccugccuucguccaaauucuuucuuucauagugcaccuucuaauauggugaggaugacucuggaguucgccuugaauucaaaucuugcauuugcuccacgauagcuucacaacccuaggcaaguuacuuagccucuagaauccucaguuuccucaucuguaaaaugggcuuaguaauaaugauuccuaggagagccaggagagugaaaugagaucaugcuguguauaagguuuagcagaguuguauacccuaaaguuuccaauaauggguaguuaggaucauuaucauugucacgaucucccaguuuuuguggcucaucuuaucaccucuucagugaugucuuugagaaggcacugugguaguauuuaagaaggugggcucuggaagagacugccuuaguuugaagcauagucccauccuuuuuagcugugcuguaacuucucgaaggcuccauuuccucaucuguaaaaugugggaugucaguagugucuacucauggguuuggugggaggaaugaucuaggccuuaacagucucuggcucauaggaaacaucaguagaugaugugcuuuuugcuguuacgguaaauaguguguuccacaucacagcauacacugggugaugcagggguuguaauuuaaccuguugccucuguacccagaaagaggaaacauauuccuuacaacauaguugugaggugaccuuucacacgauacuuuucauauacaaaauaaaguauagguguuucuguaaaucuggacagguuucaagauucaucuggcauuuaagcuuagaauuucugucucuucgguguaggugaucaucccuauugguuugccugggacagacuuggauacaucuguuauuccagaacuauuauuaacugcaaaucccuuuuacucucaaaguugucuccauuuaaagaauaaaguuuuugguuaccugaauaagauuaaggaugacucuuugauagcagcugucuuuaacaggaagccuguuuuguaggaaagacagugagaguuuuggccgggcgugguggcucacaccuguaauccuagcacuuugggaggccgaggugggcguguugccugaguucaggaguucgagaacagccugggcaacacagugaaaccccgucucuacuaaaauacaaaaaaauuagcugggcauggcggcaugcgccuguagucccagcuacucaggaggcugaggcaggaaaauugcuggaacccaggaggcagagguugcagugagcugagauugugccacugcacuccacccugggcaacagaacaagacuccgucuccaaaaaaaaaggaaaaggaaaugagaguuuuuuguuguuguuguuuguuuguuuguuuuuugagauggagucucacucuguugcccaggcuggaaugcaggggcacgaucuuggcugacugcaaccucugccucccagguucaagcgauucuccucccucagccuccgggguagcugggacuacaggcacccgccaccgugccuggcuaauuuuuguauuuuucguagagauggaguuuuaccauauuggccaggcuggucucgaacuccugaccuugugauccacccgccuuggccucccaaagugcugggaccacagacgugagccacugcacccggccaaagaugagagcuuuaaauauuauuccaucaauucuugcagcuuuuaaaugaaggaugaacaagagaagaaagggccuuccagacaguuugggaugacuacugggagugggguacagaaauagauagggaggacgaggcuggauuuguuccagggcuaaaacuuucccauucaucuuugcauuccugguaccuggacuguagugugaauuccauaagugauuacugaauggaagaguuaauaagagaacaaagacauccaggaacccuccaucuaggcuaaaaguugccaagcaggacuucugguguauacauacccagugacuuucucuaaugucauugggucaugauuguaagcuuuguuuaagggagaagguaaaacuaaggaagcagcagcccugugggcaauggugggaaguugggaaauuaagaagggacacaucaacucggugucuuugccuguugccagccuuauguccaggguucucuucaggcugauccuccugucugaugccacagaacagccuuaguugaaauguggggaugguuaggucugguauuaccaggaaugaaucuccuuagacaaagacagcuucaccuucuguggguucucucugaucccuggcaggucauguuaacaaaagucccugguccauaguggcuuuuuguucuguuuacauugaugagcucuacuuucaguuauaggaucuuuggauaugugcucauuucaguuuaaaggugucccaaauaugcuuaucucagugccauuuuugucacugccuccccuacuucuggaaaaaacaucaguauugcucaguauuagacaguagcucuccauccuugccaguguuguguguguuauaagugaggggacuauaaggaaaccaugagagggcucaaaacccccugugauuuaaguaaccucuuuucaaugggacguuaauucauuuaacaguuauugaguaccugaaauaaucagguacugagguugguugggcacaaggaugacuacaaauaguuggugcuuccaagacguucacugcuugguagagagacagauguguaaacucauagggauacaggaguagugaaggugugcccagaugucauggcacgcagggaaaagggaugccuauuccacuguaaaugcuggguggucagggaagccuucuuggaagaggcaaaaacuacuuucccuuucugacucauuauuaaauauaauacauuuaacaaacagaguuuuuuucugacccagaauagaaaccuuguccuuaacuuucuuucuuucuccuggcucucaugaaaauuaucuuucaaaaugauuggcaggaaguuggcaauucuagcuuuaaacagagaaguaauaacugugaucaucuuacuguuuguauguaaagcuaguuacuuguguugaggggaagagagagguguuuuccgauggaaguguagaaggcugcuuucugagauagauccuauagacaacccgucaagggauacuacuuuaaauaaaccaaaccacuccuugccuuuuaggucaggaaacuuguggguacccacccagaguucaucaaacuaaggagguuggauguucaucaaccaagccugugagaaugauguauacaccagaaugccaauggcacauuuacaaaauggaaugauuuucucaugacuagaauguucagaucugccauccugaugucuuaggagacacauucaucuuguuuuaccuuuaugcaauucuuuuccuuuucaagacaaagagcacauuucaacaaaaccuuagacuuucauuuacuuaugcucucaucaaauauugaucuggugugugugcuaggugguagaaaauacaauggcugaaauguuuugaaaacucaguguaucuguaauaaacacuguuaaguguuuauccugcuuuaucucacugaauccucaugugcccuuccugagauaugccauuguccuaauccauaguuuauaaaauaaucaucuaagaggcccaggcacaauggagcuucucagagugauagagaaacagucaguggccuuugcuuccaagcccaaaguccagggaccagggccuccagcguccagagccauguucaugagguugcuuaccuucgcuuaggacgcagagccaucucuucacacccucuuucucccaaaggucaauucaaaacucccuauacugggcagacucccacccuggcacuccuuuccugcuugaggccuggcugacguucugugucuucccuucuuggggugauuuuauuagucaaaacucucagaagcccuggugccuccucaccucugucuuuaauacugcaagcagcccccuuuagcugaacaaggaacuggucuguuguguuucacauuacacagguauucucaauauagaaacacaccuacuuucacgauucacugccuuuuaacuucacaguguuuggaguuuaaaggggucuuuugugaacaucgaagucccugccaagaagugaauagcuaaaauuuuccacaugaccaguaguauggaaguauaacuaaugauagagaaugauacuuucauugcuuccguuuuuacuccugucacuaaaggcuuguaauuucauaccacaccaaacaaauuuuuauuuguucagcuuccuuugacuuaagcaaaguaguuuuuuugguggggaggggguaucguuauuggagucugaucuugagguauuauuucauuuggaaagacugauacaacuaaaaaucugguguaauucuuucugguuuuaaaaaaguuauguccagcuaacucuuaaaaaaucaaaccccuuuugaacuuuuaauuuaaaacaauaucaaugauugcuaaaagucaucuauagcuuuacuaucuuacugauuuucacuuucuguuuucaauaauaaaaaucuuuuacccaucacaccagaagguaccaggcuaagggauuuucugagcuuuuggguaccauucaauugguauccacuaacauaugcagaaaauaguuugaauauuugagcuuggugaggaugcagaguauaagcaaacaaauuagcaaauaauugacagauugugagaaauacugugacagaaauacacagauuucauguuauaggauagucaaggaaggcuucucugaggaggugauuuuuaagcugaccugugaggaugaacacgagccagucaugagaacugggaugaaaguguuucaagcacaggugacaggagaggccgagauccugaacuagaaacagcuuuaucaauuugauaaacagaaaggggaucggugagaaugaaguuuagaaaaggauaguauggugaggucuggcaaauggguuggagcccagaucauauaaggcuuugugcucagcuaaguauauuugauuuuauucuaagugaaaugggaagcuaccaaaagauuuggaugaaauccaugucaguuagguauugccucaacaacgcuagguaacaaaccauccccaaacucagggagucauuuguucuugcucaagugucugcauauuaguggguugagguggcccucucugggcuuggcugcaaacugcagguuggguccaggccuguaccacgugccucucauccuccucggacuugugggcuagguguggguauaguuuucacaaggaaguggcuggaaugcaagagagcaagcccaacugcaaguauguuucaagcuccuuguugcaucacaucugcuaauaucccauuguuggaauccaaagacaaggggucagggccucuagugggaagaacugcauagucacuuggaaaauggcauggauccagggagagaugaggaauuggggcuagugauuucugcaaugaccugaucuuaucuaucuuauaaaaaguucaccauagucgggggugaccaacugcucuugauugcucaaaaaugaggaguucccugaacaugggacuuucagugcuaaagcugagaaagccuaaggcaaaccaggaugagucggucacccuguggacuguccugugguaaauagauuaauggggcugcaggagaagugagaaagagaucagcugucauuauggucuuccaagugagagaagaugguggugugaaugagagguuuacacgggagaugugguggagcugaugucuuugagauguguuuuggauggacagcucgggacuuguugauguuugggaugggguaguugaagaaaggcauuggggauguguuagaccgauugaauaugcuauuugcuggauauacaauugaauguguuauauguguuagaccaauugaauaugcaaauauucuauaggguaggauaacaacuuuuaguuguuaggcauuggggauguguuagaccaauuaaauaugcuauuugcuggauacacaauugaaugugcuauauguguuagaccaauugaauaugcaaauauccuauaggguagaauaacaacuuuuaguuauuauugcgagaauauaauaacaagccacuauuugcaaauacauuauauauuauagacauguaaugugguaucuaucuuuaaaaccauguuaaagaaaucgauggaauaaauguggagguugacguauauccaccuggaccuauaguaauguacacaaauuguaucagaagaaugguugucacuaacaaaggucauuuuccuaauagccuucauuggcuaccuaggcucaccauagugguuugcuucuauaguaagcaaggaagccauggacauugggaaaugaguguauuuucuucauuuugauuugucaaggccuaacccaucaggauuuacaguuuauaauuacauuguggguuuuucuauacaguaucgugaggugacaguguaccuggugugguagaaacaauauuugaauaggauuuagaaggucuggauuugagcuguggcuuugauauucaguuuuuuuuuguuguuuuuuuuuuuuuuuuuuggaggaugugagaguuacauaugcuuacgauuagauauuaccaaugucuuuucccacuuguugaguugaugucuugaauaacaaggaggaccuauuccccagacuauuuggggaugcugguugaauuaauauugaauuaacaccuguucauauguggggaaugccacugaauacuuuuguaaucuugaauaacuugcucggcauauuuggucucuguuucuuucucuaugaacugggaauagcaauucagggacauugugaagagauaucauaugagagauuguauuugaaguugcuccauaaggucuuaucaauaagaucuucuuccuucucugcuaggauagugaguuuccaggccuggauucacauuagcuuuauuuguguuguuuguuuuuccuugcacccuugaaugugauaaugaugaacacagauuuguugaagggcuggcugaucaagugucaaguuccuggcaguucuucacucugugccuuacacucugaaccauuuggcugccucuauaaagccagaccuucuggguucuaaauacuuuucuucuaauuuucccacaugagaucuugggcaagcuucuuaacuuuccugugucuuaaguuuccccaucuaugaaaggaacuaaucauauuucuugaaucagauuguugcugaguccucauuaaauuaauagcgauaacucagaucaguguauggaaaucaaucaauacaaaagacaauaaauguuaacuccuuuauuauuauugcuguuauuauuuacagguagguuuccugcugcauuuauuugauuuguagacuugagagacaagguagaacuauuuaauuacauagaaaauuggaaaguucugauaugaugaacucuaaaggggaaugugauauagauuucuauuauuuaguuuuaggcaguuuaugauuuuuccacagugacuaguguacuccaugugauagaucuaacguauuguuguauuaguccguuuuuaugcugcugaugaagacauacccgagacugggaagaaaaaaagauuuaauuggacuuacaguuccacauggcuggggaggucucagaaacauggcuggaggugaaaggcacuucuuacaugguggcagcaagagaaaaaugaggaagaagcaaaagcagaacccccugauaaacccaucagaucuugugagacuuauucacuauaaugagaauagcaggggaaagacuggcccccaugauucaauuaccucuccugggucccucccacaacacgugaaaauucugggaaauacaauucaaggugagauuuggaugggggcacagcaaaaccauaucaguugugaaaagggguuuugacuuuuucaaucucaguccauugaaaacucauucuguuuucccuugcccugcagagucuguuucaucuacugcuauacccuaacccaccugccagcucauuuugcauuucucuuuguuuguccuagcuuccuuguaugcgcuguuugugcucuugauuuauuaaaucucugagaccauccuuucucuggaaugguaggaaaggcuucuagacagacagccagagagaucuaaaacagccccagggguauauuucuuguucaguucauuccagcaaccgauuagagaucaauaaaugcacagcauuaguguauauuauguacuuuuccuggaaaacaugucaguauucaauagacuaaauaggagaugagauauuuuuuaguuggcaccucucuacaacuguaaauaauuagaaaagguuuuuuuuuaauuuuuacuuuagaaauuuuuguuaaagaacucucucucucuuaauguccaaagucuuagacaguuggacaucuuuuccuucuggaaagaugugaaacuuuguagaauggagaagaaauguaaagaguacuuaacacuaaaagaaaaggcggugaaaagccaaacccuguuguguuagucuguucuuauguuguuuuaaagaaauagcugaggcuggguaauuuauacagaaaagagguuuaauuggcucaugguucugcaggcuguacaagaggcaugguaucagcaucugcucggcuucugggaaggccucgaggaacuuaauaucauggcagaaggcaaagcaggaguaggcaugucacauggugagagagggagcacgagugggaggugggaggugccauagucuuuuaaacaccagaucucacaugaacucagagugagaacucacucacgucugcaaggagggcaucaagccauucaugagggaucuucccccaugacccaaacaccucccaccagcucccaccuccaacauugggaauuacaguucaacaugagauuuggaggggacagacaccaaaaccauaucaccugucuaguucaaaaguuucucaaaagccacaguugccuuggaauuggugauggaaauuaucaucauucucacuugcuggaauacacagggagguaugugggaaagaacauaauagaaauauuuuaaaauuauguuuuuuauuuguauguauuguucuucacauaauauaagguguugacaggacaggaauuauuucucuuucugaaaugaggaaacagacucagugaacugagguacuugaucaaguucucagaguagcaguuaggccccaucccuaacauuuauaggaccagaggcagaaggacaaauagaggcccauacaccauauguucaaaauauaaaauuucauaaaugcauauauaaaucaagguaaugcuguaucaaguagacuaaaguauaucccaaauugaauaaaaugucuugcccugacaaacauaccuucagagugaccuguaaggccuggcuuccauuuugcauucccggacuuuguggaguuuagugcaggaacauguagcacagggauuagggauuaccucccccuagccugugguuccucuuuccgcccccagcuucacugugcguugugaggugccucaugaguauguguguucagguccauccaccucuccugcacacagccaccccuugagcauaggaguauaauuagaggacagcagaugcuucccuuggaaggccccaucuugaaaagaggcccacaaugggccauuucgguagacuucuggggaaugugcauggcaggggauauauaggcucuggacaaucccuuaggccuugaggacuuaucaccucauuccaugguuaagucuaauuaugaggccaguagugggguauccaagauacaaguuggauuccauuggauuguuuggccacuucaaucacauuauuagucaguuuaaugaaaagcaguuuguuccuucauuuagcagguauuauguacagguacuuggugcuggagauauaacuggaguaaggcaucucuugggagcggcuucgaauucuagugagagaagacagaaaaccauguaaagacuuacaauauaauguucucaaguuagcaaugcuaugaauaauauaaaagaggguagugagauagugauggaaaaauaagggugggaccaagggucggagaagucuucccuguggaaaugacauugugaugcaagaugugaaugcucaacagcugcaagaagaucuaagggaagggcauuccaaguggguggaucacauaggugauggccagguacuuggugacuucaagggacagaaagaugaucauggaggcauggcaucagggaguggaaggagaugggguuagagggaugggcagggucuuagaggucaccagagccuuguagacccuguaaggggcuuggauuuuguuccagugaaauccacuggauauuuuaaacaagggauuguuaggaaaacuucugaucaaauucaguacuuaacaguuaacccaaaguagccuguccaaauuguaaucauuuugccaauauuaaaugaaucccccugcuguacauaccccaucucuuagaguaguugaaugucaccaauauauuuuguagacauuuugaagacuuaaacauuggugcuccuggcaaguaaugugaaaaaguggucauauauuuagcuaucaaguuucaugucuuuugcuaaaaauguagaaccaagagagcucugagcauaaauacaggcaugcucuugguguuggguauuucauaacuauucuuaggugccaaaugucuucaucuucaugcaauuuauaguaauguaaguaauguguuggagacuaacaagucaaaaucucauuucggaugugugacacuaauguuguguugacuuauuguuucauguguuagauuucugauaaaauuacuaaaacaccuucuugaaaggaguaacaggaagaaacaguuggggugucagauauucagcuguguguacuuucuuauggauaggaguuuacugauuaauucuugauugcauuaaauagcauauuagaguaccucaauuuaggagcauuuagcaacuuaaaauuuuuugauagcaaaggacuuacaaguagcaugauacuuguuaagagaaaacaaagaccaauuuuaguucuuauuuauuauaaugauuuucauuuuacuauuaaagauguuucuucaacaguaaccagauguguaacauagaagcagcugcaugauauuuucauuuuuaugcauaauauuggaaaucuuagacaagguucauugucuguuauggaaaaugaaaugaucuuuucccagucugaacaucuguguaaaacagaaugcuagcaucuucuccugucucuaagugaccaucuguuuuuaugggauuugacagguaauuuauuaauuuuaagugguuuguuuuagggaaauuuuggcaaaugugcauguaacaaaguaguaggaaaauauuauaaagcucuggauuuuuuuagggccuguuuaaaggucugguagaagcuuuaagagucuuuuuuccuuuuuccuuauguguuuugaaauggauaaaaauauuugucaaugaaugaugccauagggacuggauuauaggcuuuggugacacauuugacagucguucugguuuuggcuaauuuagaaauauuaacuguacaauuaaaaaacuuauuuuuuuucuuucaguacaaucucauguuauuuuuguggucuuaauauaaaaauuaaacacaaaaaauaagugguaaguugcuuuuuaaacucuguccuccuccauuccagcugucacugcacuuuccuaggguccuucuggcaucuucucaaaucuuggaagaaaugccagcucuuuuucaacauucauuugucacuuuuaagguuucacugaauuagccaggcugaaugcagaacgaaaagaaaugccacgguuauuaugcugacugcagacgcaauaugggaauucuguaugauaggcccucacucaugucuuaauacuuuauuuauuccaaugugcuuagcaagccagcuuggccuuguuugucuccagguagaucagacggcuagaaacaguccuaccuauuuucauuugggaagcuuaaauauuuuuaagaugagugauaaugccaggcaaacagagccgagugucaccaguucugucucagccucucagucaccgagggaagcuaggagacguaaucauuuuuagcucaguuccccauucuguaaaaugaguuuuaugacauuuucuucccuaguucacuggaauagcauuagaaaaaugaauggauguggugacuguuuauuggaugacauuugcugaauguggcuuuuugguguucaagacuggauacauuaauaacaguuuuaauuguuaucuauaacauggcugucugauagugaugaugaugaugaggaggagcaggaggaggauagucgugguggugaugggugaacaguaacaguaaaugggaggcagcuuaggguacugacuaagcccauaggagucagacuaucuugguugagaucccuuucaugucaauuacuacuugugugaccuugaacaaguuacuuaaaucucugaacauaguaaaugucacauuuggaauuggaaccuccaccugucccagucuguguuccuaaccaccauacugugcugcuuuaagccaaaagcaacgaacuuuggucuagagcauuucaaaaggucauccaacagaacauauaaaaauagaagaagccagcaacauccuuaaucuucuuuauuuagaauacuuacuuuacuuacuuuuaaaaaauaccccauaggaucaugaacaucagaccaauugggaaggguagauuaauugacugccuaaggacugaaauuggcacauuagacucugcuacaaaacuuaccuguuucugaucucucgaaaucaaugaaucucauuauuauucauagcucuuccuuuaaaaaaaaugaaacacaucauuugcaaaaagaaaauuuugucccaugcagucuagguuguuccaggagcuuacugagaaacuacaacagcccucugagguuaacugguacuauucacugaacucucaaguuucugccuugugaaucugguggugggaaauuuggcuguaguaaagaaggagccucacuugaucucugcggaaaucauugagaauuacaaguaggaugcuucauccuuguuuaaaaaauagaaguaauuguuucuuuuggaaguagcaugcuauuuauuuaacugcacaaguaguucugauaaagugggugugauuuuuuuggcugguugaugucagcauuauuuuacaaauguggaggaaaaucuaucagggaaaauaauugaaauaaagcaggagucuuuguggguuugguuuuuuuuuuuuuuuuuuuuuuuuugaaauggagucuugcucuuuugcccaggcuggagugcaguggcaugaucucggcucacugcuaccuccaccuccuggguucgagcgauucuccugccucagccucccaaguagcuggaauuacaggcacccaccacauggaugcccggcuaauuuuuuguacuuuuaguagagaugggguuuugccaugucagccaggcuggucuugaacuucugaccucaagugaucugcccgccucagccucccaaaguucugggauuacagauaugagccacugcgcccagccuaaagcaguacucuugguggacaagggaacaugagugguagcugggagaagcaucagcaugauggugauauguacauuccugguguagucagcucuuacauucuaguggcuuauuggcauccaguggcagcuggagacagaugauggaauauccguguucugaagaauguccuuugccugcucucuaagcaucauaauacuuaacuuguaccaguauuuacagugccaucauuuuucauuauauguucccuuaucccauuggagcacaaagggagcagagaggagcacugaguguccgcuucauguucuuuccauggucaagaccauguguuuucacaacuaauuuaagagagaguuggagccaaagcaacuuuaaccuaauucgaaggacuggauuggugggaucaauuggaaaguuccugaggcaggaauguuccuggagguaucaggugauuagagaaagagagcaagcaagcugugggacaugaggugaaauuggagcauggagaauaaccuguagggcucuguaugcaacuagaggggugcuggcuuuugcaaugguuuuauuuauugauuuauuuuuaauuuucugacaagcuaauuaaguuauguauuguauaucauaaaauuuacccauuucaaguauauccuucaauggacaaaauguacuguauccauaggauaugguuuggcugugucccuaccuaaaucucaucuugaauuuuaguucccauaauccucaugugucuuggggagggacccggugggagguaauuuaaucaugggggcaguuacccucaugcuguucuugugauagugagugaguucgcaugagaucugaugguuuuauaaggggcucuuccugcuuugcccggcacuuccccuuccugccacuguguaaagaaagauguguuugcuucuucuucuaccaugauuguaaguuuccugaggccuccccagccauguggaacugugaguuaauuaaaccucuuuccuuuguaaauuacucagucucaggcaguucuuuauagcagcaguuaccagagaguauucaauuauauggacuaauacaccacacaauggaauacucuuuggcaacacaaagaacaaacuauuaauacauucaacaacaugaaugaaccucaaaaacaugguaucaugauauuaagugaaagaaguuuaguuccaugauguuuaguaaauuuaccaaguuauauaaccaucacuguaguccaguuuuaaaacauuucauccuccaauaagauuccuuaugcccuuuacuguuaaucccauuacuccugccagccccagcaaccauuaaucugcauugugucccuauagauuugucuuuucuuuaaauggaaugcuacagcauguggucucuugugucgagcuuccuucacuuaguaucauauuuuugagguuacuucauauuguugaauguauuaauaguuuguucuuuguguuaccgaagaguauuccauuguauagauacagcacauuuuguccauuuaccaauugguagauauuuauguugauuugaauuuuuggcuaucacgauuaaugcugcuaugaacacuuauguccaagucuuuauguggaauguauuuuuauuucucuugggugcugugauagacagaauucuggccccaagacuuuuaccccuaguuuugugcccuugaauaugugguauuacauggcaaaaaggacuuugcagauguaguugagguuacuaugcaguugaccuuaagaucaggagauuauccuggauuaacuagauggacccaguaugaucacauaagcccuuaaaagcacaagaggaaguagaggaagucagaagagaaguuuagagagguauagcagaaaucaaagacauuugaagccugagaaggauuugauguaccauuguuggcuucaagaugagggccuugugucaaggaacuggauaccucagucuuguagcugcaaggaacugaauucugccacuaacuaguaaggugggaagaagucucuaagcugcaaauaagaaucauaguuccagccaguagcuugauuuuagcuuggugagacucuaaacagaaaauccaguuacauccugccagacuucugaccugcaaacacugugagacaauaaaugagcauuguuuuaagccuuuacauuuguaauaaucugccacgacagcaaaaguaaacuaaaacagguagauccccagcagugaaauugcuagaucuuaugguaaauuaagacuuugagaaacugcagugguuuugagcucaaggugacaugauauuuuaaaaggauccuuucgcugagccgaaauuggccuguagggagccaagagcagaagcaggagaccagugaggaggcaggcaagcggggaggaugguggcucucccuaggguggcucuuccaaguuggaauuuggacagggcaauggaugacagaggcaucugcagcagguuuggcccucugcuggaaguggcauggccagagaugguguggcaggaggugguaucccagagccuuggugauugaacauaccaaggccacuggugagucucagugggaggcugaggcaucagaggagagggagguaugucauggacucagugguaaaagaaagacaguguaagguauuuucccuuuugucacugcauacaaguaacugccauucacuacccugagacaguugaguuacuggagggaggugauggaaguuugauggaagaaaacaaacaucaaaaugaauagacugagaguugccuuaugggagaauuaucgugugauguaauaaaagguguuuuuuuuggugggggaggggaaugucauuccaccaaaaugaaugguuuagaugugugguguagucagucagaauggcuacuaguaaaaagucaaaaauagcagaugcuggcaagauuuuggagagaggggaacacuuauacacugcuggugggaauguagauuaguucagccuuuguggaaaacaguuuggcgauuucucaaagaacuuaaaacagaacuaccuuucaaccagcaaucccaugauuggguauauacccaaaggaauguaaaucauucugccaugaagacacaugcacauauauguucauuguagcgcuauucacuauagcaaagacauggaaucaacuuaggugcccaucacugguagaccggauaaagaaaaugugguacauauauagcauggaauacuaugccaccauaaaaaagagcaagaacaugucucuuguagcaacaugcauggagcuggaagccguuauccuaagcaaacuauccuaaggaacagaaaaccaaauacugcauguucucacuuauaagugggagcuaaacauugaguacauauggacacaaagaagagaacaacagacacugaggccuacuugaaaauggaggguaggaggagggugaagauuggaaaacuaccuaucagguacuaugcuuauuaccuaggugacaaaaaaucuauauaacaaaccccugagacaugaaauuuaccuguauaacaaaacuguacauguaccccugaauguuaaauaaguuuuuuuuaaagaaauaugguauauuaauaugccaugcacauggcaaaauuucucugguacuuauuaaguguuaaguacaaaacuuucaaaggaucuagcuugguuuaaccugagaacuaaacagaguuccuaauuuggcuucuuaauuuggguauuguaaguuaauauuuagugcucugacuuuuugggagcuaauuuacaacucuuacugauuuaccauuucugcacauuaaaugcaugucuggugauuaacuguauuguuagaagucauccuuaccugacugaauccuauaaguugccuuaaauaccaccgggucuuucuauaauuauucuuuccucccguagguacuuuagugcucacaucuccuuagccuaauacuccaagaagugucucugacuuuccauacucgaguuaggcgucauuuugagaugcugccacugcacuuuauacaucaugcauucuuuugucuuuguuuucuuuucaucugucucccuaacuugauuuugagcuugaaaaguucaaggcucacuuuucaccaucacagcuuuggugcaaagaacuugcaacaggaaagugcucaguaaauacugauugaauuaaagcaaagaauugcagccaucacuucauugcaugcccuccucuucuaaaaaauacugaauguuuaaucucuuagagaaagauuaaguguccagagaaagucacuucucauugacagaccuuccaguccuuuugacaaacaaauauggcagaagacagccccauuauguugaccauagacaugugugugacacaucugcuuaccaagucuuauuuucaguauuaacaaauagcuggguacuacguacuuuugaucuugugccuucuuaauuuaucugcauuuuuggacuuuacucuugagaaaaagaccaccaugggaaugacuaaagaaagugcuaaccagcguuggugacaugcgcaguaacucccuuugcaucagcacacagagauacaugugugagaaauaucuuuauuagaaaagugacuggauauccaaguguuaaaagauuaaguauucuucagaagaaguuagcaccauuuaccuuacaagguaccagagagggaggauccuugauuucaggaacacaaacacaauucuuaauagauacagguggucauauuuucggaagguauuucccaggcuuccuguucauauacccauuuaggaugauugcauguuuucccccuauuauaaacagcucuaaacaauuucccacaaacagcucaauuuaauuugacauuuauuggguuacacuugacauuuccaagugcaauaggaauuuuuuuuucucccugacaacucacuugugaaauuaugauugacggucuauaauauucaacucaacuguguucaaaacugaccaaugauuuuggaagaugaaacagcuucaaauuuuaugacccauagguaacguucgcacccuggaaguagagauaauaguuaaucaagggacaaucucugccguuugccuguugucucaggcuucauuucuggacucagcuuuggccagcuuccauacaucucucccagugccccgaggaggcacuuagcaaauguugggugaaagaauaaagguagccacuuugaagauguaucuuucauuauauuuaucuuuuuagcacucuuuuccucaauuuaaucaaaaaaagcuuauugaaaaauuuuucaaaaaauaaaauaugaagaagaacagguaaaauuuucccacccagauguaaucacuuuugucaguuuguggugugaccuuccagacuuacauaugaauguguaagugcauacacacagccacgaaacauggcuguaucugucuguguuaugaaugaaauauauauaucauggcaacagguacuggugugggcuucuccuauguugcuuaucugaauaugcuagaaaaaaaagaggagggauuuuuacguuguauucuuuauuccaugaaguuugauuuuuaaaaauguauuaggauauaguuguauaguaguaacauaauuaagaaauaaagauggauaaaaccauaaaacauaaauauauugagauuugcuacaguauauucuaauuugaugguuucucauuuauuuuuauuuuuuucuuuuuguugacucaccuccuugauuuuuaagucuuguggaguuguacugacugacaucugugacuuaaauauuuaauaaugugucuuucuguuuauguaucucagaauaauagguaccauuuuaccuuguaacucaaugucauguguuuuccuauaaacaagguaaguuaauuuuuuuaaacauacuaacuuuauuucaaaggauaacaucguaguaucuuugauaucugacguggacuuuauuuuccauuacccuguucaaguuuaaaaaauuugauuuuuucuaacaccacccugauuuguuugaaagcuuuuaggugcuacacugaaggacguuagugcccagcuuggaauaucacugugcuccuagaacagacuuuccaaucagguagaaagagaagccaggacagagagaccccucugcaaguuucuugguuuguaauuuaguggcaguaagcuuauuaacaucuguucgaauuuuaccccugauuuuauauugcacguagucugaguaauaagauuuuuaaaaaaugaugggcaauaaaacuuguaguucugaagggcaggguguuagccuaugauuacuguguuagucucauccaacuucgaguuucaucucagaaaaacaaagcucuaugagcacuuggcauuaauuaaauuauguguagagaacuuauuucuacuuaaauuaaugccacuugacauucuaaauucuucuacucuuaaucuuguaauugccuuaucuugccaugauuuauaaauugugaauaugagcccuuuaacuuacuggaaacucaauuguaaaaugaucuauuaaugaggaaggaaaauuuuuauuuaagggugaaauaauuuuauuuucagcuuuauuuuaauuauaaauucugauauugcacauaacauacugaaauuccuaauuccuuucuuucugaggaaauuuuaggguugcaagauagaaauuuuagccuuuggaaaacaguaaaaaauccuagaaaauauucuguauguguuccaauugaugccaggccagguguuccuggaucuucuuagagagcggcaacacuggugccaggucaccccaaccucccuuggccucuccguguugcucuccugccugggaacccuuuuucuccucugaggcccagguucagucccaucagacccucugggucucaggcuguucccgcuaauguuugacugacuuugaccagugagagaagggagucagaaaaagccugcagauaaauuccuugccuugucuuucuuccucaucuccacccuucuuccuucagggaugauucccagacacagugguucguauggccucucuagagacacccaucucccauaaccaagcuuccggaaagcugugaucuccgguucagccguggucaccuaggcaacaucccauuuugcauuccuuuccuuccucccuggccucauugcccuguccccucucuuucuggcuucccugagauucuacucucacauaagauuuggcauacacauuuuucacaugcuuuugcuuucuagguaagucaaucuaagacauuuugaaaacauaaauucucauaauuauuuugucuaaguacuuauuggaaaauuaguuccagcaggcaccagcuuacucuugauuaguugccacuauuucuuuaccucuuggauauagaauaggcuuuaaaaucauauauauguauauauaugauuuuauauauauaaaauuuuauauauauaaaauuuuuuuauauaugauauauguaaaauuuuuuauauaugaaauauauauaaaauauauaauacauauuacucuguguuccuuauauuauugaguuuaugcuauuuauucauuguguaacuuauaaaucaaucaucuuaaccaaaaguagaugugauuuugaaguguuaggaguuaaaaauguugaccaaaucagagauaaaagcccagaaagaaaggaagauacaaaauaaaccccuggucuuccccccuuacuucaccugcucucaccaagcacucugcaacugaugaugcuuuuugaaauucagauuugacaccuucucuucuuccuauugcucuuaagaucuugagaggguauccuuccugaucuuggccuuuaggucuuugggcaaauggaacuauaauuccauuguucaguaaaauugaaugagaaagugcauauaaaauauguagcaugauggcugguaguguggaugccccuuuacaguagggguguaccuggcugcauaccacuuucugaggcucugaagaguuccuugccuucuuucuugccauuccugcccuuauuugaggaaaaggauccagggaagacagaggcucugguagagauucuuuuggcugccagauuuuugcccugagcaaaauguguuaggucuccacagguugaaaugccaccagauuuuaagaacucuauaauaugaaaagucuuuuauuuagcauuuaguagcugugaaaauuuaauguuuacaucagcucuccuccugugucauuuccauguaugucuucuuuuacuuagugcaauucguuuuuuuucucucuagcucaugauucuacuuaaacuuaugaaccaagcucugcucugaguccuaauuauuuuguaguagagaauauuccuuaaaaguccuuuuaucuuauuuguaacuucaguauaagcacuuaacuuuuuuuuuuguuuuuugagacagucugucucugucaccaaggcugaagugcaguggcaggaucucagcucacugcaaccuccaacuccuggguucaagcuuuucuccugccucagccucccgacugggaguacuggcaugugccaccaugcuugucuaauuuuuuuguacuuuuuaguagagaugagauuuugccauguuggccagugaucugcucaccucagccucccaaaaugcugggauuacaggugugagccacugcaccuggccagcacuucacuuuugaguguccuaguuggacuuaauucuuuccuuagaccaucuaccugggucgaucaaucaguagaguucuuuaaacucaggugguuaauccauuuugggcuuuuuguaaaaaaaaauaaaauaaaaauuaaaugacugauauugacaagugaaguuuauuugaagcauuugguuaucaauucuuagugaggauuagaaguguucaagcucugaaucaggugaaccuguaguauuuucugucuucucaacuuacaugcuuuucgccuccaacccaguuugagauauuuuuauuuaguuggcagagugagaguaacucucaacugaaauucacaaaaaucaacaguugggaaaaauguggcacucaguaaguuucuucgagaagguuucuauuuccuuaagaugaucuccaucuuacauagcagagcaguugucucaagcggaggguguucuugacauuucccuaaacuguugcagcucuucaagauugcucuggaaauuuaaauauauuuaucucaauucaucuauuuucuauuuaaagaggagaauguuucaacacacuugugaaugggaaauacuucugaaaacucuguucaauucugaaucaagaaaauuuccuaagucuaccuuuuuuuuuuccuguuaaaacuuggaccaauuguuuacuggcccacaugaaauacuucugugauuugcuuuauacaaauccuaccauggcauacugugucucucucuucagagagucgcuagguuauaaaggaacaauaucccugcaaacucaaugagccugucuuucagacaagucuugaucugggauuucuugagaacuguguugaccuguguuaucuguuugcuacucuguugauuggaguauuucuuaguuauuauucucauggcaauagucauguccacagaaacucugcuguggaaauagcaaggagacccaucuuuuccaauauauucauucagcugcaguuacauggaaauucaagauaaaaaggacucagcugucagugaaagaggauucccagucaaggccccugcauggagguaccuauauuucacgugacaagaauggccugaugauaagugccuaguuucucuguuucaguccuuuaggaauccagagaacagcugccccuagaauccacuagaauuccacuagauucauguuauaucacccauuuucuucaaaucugucuaaaugagauggacuuuuuuuauucuuagguucaguagcaauagcauaauuguaauaauuucccaagaacacaugcuuccuaccaggauaauucucauagguguccuuguuggcuagcuuucuuuuuuaauaaguuauucuuaaaacaacuuuauagaaaugcaguuuauguaucauuaauuuacccauuucaaguguauaauucagugauuuuuaguaacuucauugaguuccacaaccaucaccauaaauuacuuuuggaacauuuucacccucccauaagaucccuaaugccuguuugauguuaauugccauucucacccccagccccaggcaaccccucauucacuuucagucucuaaguuugccuuuucuggacauugcauauaaauggaaucauaugauauguggcucuuuguaucuggcuucauagcauacuguuuuugagguucuucuaugacuuggcauauaucaagaguuauuucuuuuguaaugcugaauaguauuuuauuauguggauaaucuguucaccaguugguggacauuuagauuguuugcacuuugaggcuauuauuaauaauacugcugugaauauucauguaagucuuugugaacaaauguuuucauuucucuugaauagauaccuaggauuggaauuauuggaugauauuagcucuaugguuaacuuuuugagaaacugccaaacuuuuuccaaaguagcuacaccauuuuacaguccccuuaucaaugcaugaaaguuucuauuucuuuauauccucacuaacuuuuguuguuuucugucucuuuaauuuuaacuacuguaguagguagagagugauauuucacugugguuuuaauuuaucuuuucuaacugacuaaugcaguugaauaucuuuucaugaacuuacugaccauucaucuaaauucuuugguaaauuaucuggccauauaguuugcccauuuuuugauugagguuugucuuauugaauuguaggaguuauucauaaauucuggagaaaaguccuuuauuagauauguauuuugcaaauacuuuuucccaguguguugcuugucauuucauguuucuaguagugccauuugaagucuauaaguugaauuuuaacaaaguccaacuuacuaauuuuuuucuguuuuggagaaugcuuuugauguuguaucuaaauuuuuuuuuaccugagucacaucucgaagauuuuucuacuguauguucuuguaaaaguuuauuauuuuagcuuuuacauuuaagucugugaaucuauuuggagucauuuuugugcaugguaugcggugagagucuaaguuaaaauugugcuauugucucuaccauuuuuugaacagaggauacauuccccaauaauugccuuggcaccuuugccaaaaaucaauugacuauaaauguaagaauuuauuucuggccucucgauucuguuccauugauuuauguaucuaucuuuauaccauguggucauuagaaaaguaguuccccaaagacguccaugucguaagcccuggaaccugugaauauguuauuuauguggcagaagggacuuuguagaugucuuaacaaguauaaacguuuagaugagagauuauccuggauuacuagggggacccaaucuaaucacaaguccuuaaaggcagaaaaccuuuccauuuuaggucagagaugagagaugaaaggaggaggagguauuugagcaugacaggggcuugaccugugguuacuggcuuugaaaaugguggaagggggccacuagccaaggaauguauguguccuccaguagcugagaacugucagcaaggaaacagggaucuuaguacuacaagcccaggaacugaauucuguuaaucaccugaaugagcaaugacacagaugcuacauagugccuccaggaaaaaauguagcccugcuguuguugcaggacuuuuccuuaguucagcuaaagauggggcucuuugucccacagccacaaaaauucaggcucgcagacaauuugaauggugaguaagacaggguuuuauugggugaaaaagaaaaaaaaagggggaaacaaggauucucaccaggccaagucccugauagagcgcuucccaccaggccguuugaaucccagguuucacacaggaaaaggaggggccaggcugcuuucugcuggaaagauccugaacuucucgaggcuguaccccagugggcagacuggguggaguuucuccagggacccccucccauguggcugucucacuaauaccuugauuuuagccuggugagaccaguguugaguuucugaccuacagaauuguaagauaauacauuguguuaagcuacuaaauuugugguaauuucuaauggaagcaaucaaauguaauauaugucagaaacauggugacgugauuacuguuaacuuuauuagaaaguuugaaauuugaaagugaaaauuuuucaauauucuuuuccuuuucaaauucguuuuggcaauucuagguguuuugcauuucuguauacauuuuaggaucugcuugucaauuucugaaaguaaaccugcugguguuuugauuagaguucauguugauccuguacaucaauugugggaguauggccaucuucacaauauugaaucuuccagucugugaacauggaauagcucuccauuuauuuagaucuuuauuucagcaauauuuugugguuuucaagcguaugucuuucauuucuuuuguuaaauuuauuucuaaguauuuuauuuuugaugcuacugugaauggcauuacuuuaauaauuucauuuuuagauuauucauugcuuguauguugaaauacaauugaucuuuguaucuuuuauuuuguauccugugaccuuccuuuucuuguuuauucaugcaaauuguguuuaaaauugauuccuuaacauuuucucuauacagaacuaugucuucugugaauaggccauguuaugucuuuuuguuuuuuuccagugugaaugccuuuuuuuuuccuuccuugccugcuugcaguggcucaaccucuacuaccauguugaguagaaucgguaagaggcgacuuccuuaccuugccuucuaucuuaggggaguagcauuaauucucucccaguaaguaugauauuugucauauuccuggcuguuuuaaccuguagucuguggugugguguugcaaaaugcagaguagcuuccugcuaguaagaaucuaaccuguucuuacugcucuggguuaaaucauucauuaacacugagagaguacauuuuuuuacugugcaggguauagcugcaagccaaguucuuuuguugaacaauuguguccugcauauauguuuguaagaacacugauauuuuaauguuguugaagcucaagcagaaauuaguaguacugcuauuuauaggcuaaagaacuauuuaauuauucauuuauuccuucuuguauuuguuccuccacuuggucuuguauuuuuucauccauuuggccaucuguaucucuuuucuuacauuuauccaagaaugaugaauuaacauauacagugugcuagguguugugauagguuggggaucugagggaaaaguuacuccuguuucuuggggaauucacuuuagauguaggauuguaggagacacagacacaaagggaauaaauuaaaccuuuuuaguucucagauauaauaugcauagauaggcauuugaccugaauaaugucugauguggggcaauuuguaauuuccuggaagaugaucauaaaggaaggagcugccuaccuggcaguugcauuucacaggugguuguauuagguggacuacaaucuccuuucuggauugcuugauuguuuccuuugucauugccucuuaugguaacucucauaugugauauaaacuuuguuucucugaagaaaauggacacacaaggaagccacccauaaguggugauaauggaaggaaagagcaacauguggucuugguaagagaagacaaauuuugcauagaaagaaacauuuaauuuguuaguagcccacauuuaugagauccaggaguccuacaucuguucuaaaccaaagaaaaagugauuugugaccuuuuaccaguaaucuagucagugcaaauauuuuuuauaaaauguuuuacauuguacaaggaaaauuaaaugauauagggugaacauuuagccaguguuuacuguggucuaaauaguuugcuaacuuguucuaauauauggucuuauuucuucuguaaauaauucuguggaauacaugcuauuuuaguuucauuuacaaaugagauaguugagggccaaggguuuggauauuugccugacauuaaacagaaguguuuuauguggaauuggcauuuggacacuggcccuuagaauucagggugcuauugucucacuacuccaagaguuguugucucagaccugggguucauccgguaaaugucaacagucuaaugcaggguuucuuaaaccugaugauguagacauuuuaggucagauaauucuuugcugugagggcuguccugugcauuguaggaugguuagcagcaucccuggccuccauccccuaggguggagguggaguacuaggugccaguagcaucccccaguuguaaccaccagaacuguguccagacauugccaaauguucucuucuguggggggcaaaauuuccucagguuuagaaucacuguaauuaccagguaaauuaggauuacauccugugguauacugagaaggaaggaaauuaugauuaacucuguuuaggguagauacaagaaauguugcugagauagugacaucugagguuucaucccuacauggaauuauccaaacugcaaaauuagagggcccagucuccaagacugucuuuacuuuucacacugacugcaagugugagguuuccccaaaacacccucaguuucaacaguuugcuaaaaggacccacaaaacucacugagugcucaugauuacuauuacauuacagggaaaagauaugaaaucagaucagucaaagaaagaggagacaacuaaguuggaguuuaggaggauucuguacaccagguuucuguguccucuccauauggagucaggaugcauuacccuccugucguuaauguguaacuguauguacagaguauugccagccagggaagcucacccgagccucaguguccagaguuuuuauugagagcuucacuauauaggcaugaucaauugccugauugcccaugugguugauuucagccucuguguuccccacuguaaaacacaugauugaucuuucugucaugcccagccccuaaccuaagacuauuggcuguagcuggccccaccuuaauuguucuuucccaagacuaacauauucccauagggaugacauggguugccuccuagaaguugaggacaaaagccagaccacccuuugggcaaggccagauuuucuacuacacagucccugacaaaaggaacaaaugugcauuuguagaugaaguagugugguacguugccacaggacuggcaauucagggagaauguaaauggcaggcauauuagucagcuagggcugccauaacaaaaugcuacccacugggugguuuaaauaacagaaguuuauuuuucauaguucugaaagcuagaaguccaagaucaagguauugauuccauucugaggccuuucuucuugacuugcagaugauuaccuccuugcuguguccucuuacggccuuucuucugggcacuccugucccugaugucucucccacuucuuauaaggacaucaucaucguauuggauuaggucccuuccuaauggcuuuauuuuaaauuaaucuccucuuuaaagacccugucucuaaauaugguuacacucugagguacuggggguugagaauucaauacgugaauuuagggagguuuacaaacagcccauagcauucugccuucugcaugcccccucccaucccugauuuguuuccucuugcauguaaaauacauucacccuaucccaacagcccccaaaaucuuaacccaucuagcaucagcucuaaguugaaaaucucaucuaaaucagccauggaugagacucuaggugugauacaucuugaagcagaauucuucucaagcugugaauuugugaaaccagacaaguuaucugcuucccaaauaggcgaacaggcauacaauaaacauucuaguccuaaagggacaaauuagaaggaagaaaggaauccuggggcccaagcaaguccaaaaccuagcaggacaaaguccauuguauuuuaaggcuugagaauaauucucuuuguuuccaugaugcucugccucugggcccacugaggccaaaguccagccuucuggguccacuugggcagcagccaugccccgguggcucugagugauagccccgccccuaagaguccaggugagaguaaauaugaucagaucuguguauaagaaaaagaaauauugaauccuacuugaucaaucuucauuugcuuggagguuacagucuacuuggggagacaggcaucugggcaaauaguuguaacaaacuaagaaauaguaaacucuaugagugcuagaaagauuauguccuaagaauuuagcauuuuuaaucuggaauauccucagggauauuuugagauuuuuguuggccauguaucuugcaggaaauuacugaguuaaugaaucaugaaaugagagaauuaaugcauuagcuuugguaagcuugauaauuucaggauuccaguuaggauagggguggggaucauaacugaaaagcucaacgguacaaucaucguuccuaaauauguuucuaauacaguuucaacuauaacaaucuuaacucugacuuaggaauugaaaacugaaaaaguggaaacuccauauagcucuaaauuuguucuuagagcuuucacucuuuauuuuauuuuauuuuauuuuuuuugagacggagucucgcucugucgcccaggcuggagugcaguggcgcgaucucggcucacugcaagcuccgccucccggguucacgccauucuccugccucagccuccccaguagcugggacuacaggcgcccgcuaccacgcccggcuaauuuuuuguauuuuuaguagagauggggcuucaccguguuagccaggauggucucgaucuccugaccucgugauccgcccgccucggccucccaaagugcugggauuacaggcgugagccaccgcgcccggcucacucuuuauuuuuuaaaagcuugcugcucuaggaagaaugagggaagguaauuuuaaugauuugaaguuuguguucagaaaauacuuaugcuuucuuuuaaaaagaugccacuuaaguuuucuuuaagaccaggauggaaaacauucauuuucucacguuuucucucucauuuaucucuuucuguguugcuguggaaucucagacuuacauaggaucaaagaaucauauuacuuuuuagucuuuuauuuauuuuuaucccuuccuuacuuugcuacuuuaaaaucuauucgaugcuuucccuucaguguuguagccagcugggugucuccacuuggcccaaaaccaugccccucagucuguuucauuugauggaucauuuuggauucuccuuauucucuugucuuuugugucacaugaauacccuuuucuucaguacauuuaagcccaacgaugaauguuucuuaaauuguaaccaguucagugacucuaauaccacaguucuuuugcuguccuggucucucucacacacacaacagaagucacugaagacuggucaccacgaugcccuuguucuuacauuuugguggaauuuaauuugugcagccauucuuaagagagcugaucagugcguaucuuuuucuuuugcugaggcggcuaacagcguugucaucaucaucuuuucucccucucugucuguuuuuagagucaaguacaauugaauuaacuuuguaaaaugauagcuucagaaaacauuuucacaagaauaaaaagacagauuuucuuuguauauaaauaaagaagacaguuuaugcugggaaaugaaucuuuuaauaaaacauugucccucuuccacuuuggcucaacuggggaaaaaucaauuuuagggucuucgaaugugaaaaaagaacaaaaggaaaugaaguuuuucuguauaagugggaauaaagaaggacuugaauauagugguugccaaaaaaguuuucagauuaccauuuuccuuuagucuuuaaauuccugacauaggaggcugggcaagguagcuuaugccuauaaucccagcacuuugggaaacugagguggcaggaucgcuugaggccaggaguuugagaccagccuggacaaaacguuaaaacgaaaaaaacuagccaggugugguggugugcaccuguagccccagcuacuagggaggcugagacaggaggacugauugaguccaggaguuugaggcugcagugagccaugauuacaucacuguacucuauccugggugacagagccauacccugucacuuaaaaaaaaaaaaaauccugauauaggaaguauaguucugccauauuaaaaugcagcauuacuuuauauuuaaaaguauuuuuaaguuuccauugauauuuuuccuccucccaccuuuuuuuuuucuuuugagacaggcucuuacucugucacccagguugagugcaguggcgcgaucuuggcgcacuacaacuucugccucccaggcucaagcaauccucccagcuuagccuuccgaguagcugggaccacaggcacacaccaccaugggcagcuaauuuuuuuguguuuugguagggauggguuuugccauguugccaggcuagucuugaauuccugagcucaagugaugcaccugccuuggccucccaaagugcugggauuacaggcgugugccaccaugcccagucuuucuugccuuuuaaaggagguuagacauacugcaauuaugaggcauaaaaacauaggauggaaggaaucuauaauuauaaaggaaacuauuaaucuuuaauguccuagguaauuguaucuuuuaaauuucuuaaaaguguaauuuauucaccacagagagaaacauagugguucaucuuuacuucugguauaugcguuuuucaugaauaagauauaauuuaaaauuguaagaaaagugaaucauuggaagauaguagaggaauuguuacuuugcaaaauccaccauaaagccgguuaagaaauuauguuuuuuacuuuagaagaaaagcaugcauuauuuucagaauuuuuauaaauaauacaugaucauaguugaaaaaguugaaacuccuuuaaguuauuuuucuguguggagauacauauguauaugugacuauuuucauauagauuuauuucacaaaauuuugauuauacuuuauacaguuguauucagcuuuuuuuaacauuaacaugguauaugagauuuuuuccauauuuuaaaauaucccccccaaauguaauucuaaugauuauacuaaagucucucauuugaugaauuaaaacguacuuaaccauuuucuuccuguaaaguuuuuaggaugauuuuaccacugcaaauuugcaaccugagaaguaaaaauauaacuuugugaggucaaagacagacuagaauguucaccguauucggaaaaucaguaagaucacagaaaggcucaucagcugccugaugcuugaguagcucacucaagugcuugucguugaaugcaaaaucuugucuuaaguggacaggugugugaauccuuccaccgcuauacucuccuugccugauugagucaagguuguuacuguggucccuggaacagagugugccucaguaaaucaaauauaacaaaaggaaggaaugauuuucagauaggauagacagcuaagaugaacaagacuuuuagaacauuuccaauuugagcagugaaucugccuuguggaagcucaaaauguacuuuaagugacagcugccguguaguguucaauucacccuuuuucaccaaugcauuuaguagaccauuguggagaggcuccaaggugcuaggcgcuagugagagugcuagggauacguugugaaugagacauuguuccugcaccugaggagcucacagguuauggaggaugacaaauuacucuuguacaauaugauaaacaucacaguggaaauuuggauaaauuauuguggcaaccagagaguuuacaaacuuuagcuagagagucagaaaugcuucucaggggcaguggcauaucucaugcuguuggcaaugaaggguauuuguuuauaugccaauguuacacaguuuguacuuaagccaguggccaaugaaauagguuaguuuuuaauuuuuuaaaaguauggcauauuuguauuuuaauagcuaauauuggguuauacaguugggguaagacugaaauaauaaaauaacuacuuuucacauagauauuuccaaggcacccuguagugcuacaguacauugauuuaaaagaagacuauauuguauuuaguagaguuuuuauuacuaacucuauauaaaucaggaacuauauagaguauaugugacuaaaucaaauaguuuaugaaauuauuuguguggaaugaccuuucuccccuagacauaauccuagugaaaucaaggaaccuguuuuauuugcuuccuuauacucagcaccuagugcagugaccagcacguagcacauauuuaauguguuucccugucaaaauacuauuuaaguuaagacuugauugagucuguuagguaccagagucacucacucauuacuuuaauuucaaaugcuacaguuugaaaacuuaauguaugcuugguuguuaaaaaaaaaaaagcagugggaagaauagaaguuguguuagaauacaagguacauuuuauuuucaccagaaaggaaaaauauuguucuaagauuauaaauagcacgaaaggcuuauuuuaauuauuuuaaaaauaugauaccuuuccacugcaguaccuggauuucaagcucugacucagggguguccagucuuuuggcuuccuugggccauaguggaagaagaauugucuugggccacauauaaaacacacuaacaauagauagcucaugaacuaaaaagaaaaaagugcaaaaaaaucucauaauguuuuaagaaaguuuucaaauuuguauugggccacauuuaaagcuguccugagcugcauguggccugugggccacagauuggacaagcuugcuaacuguuuuguauagaaucugaaacacagaugauuaagacagggaugcauaguaccugcaggagaggauuuuauuuaguaacucauguccauuuuggugaauguagaguuuauaccuguggcguuuuguuucuaacuaguuucacuaauacaguuugccaugcugacauauuuccuucucuguuuugguagauuacuuugcagguugcugaaagucuaagucaagguaaagugugagguaaagaucagagugaguacuauuaauagcgaggggaggggggaaagcuagugagcccuguagaucagcucaacaaaguguauaugcuggaauccaguacuuuggagauaaucuuccaaguggaaugcaguccaaaaaauggacacuauuacuuccugugcuggcagccgcucuguuuacagaaggaaagaguauguucgauuggucaaauuacauugcuguugcagauacacuugauuuuucuaguaggaaaaauuauaauauucuuaauguuuuucucuuuuuaucccucucccucuauucuuucacagauaucacuuaauuggcaaaagagagcuucagggacaacuaguacuucuuuucuuuuucuuuuuucuuuuuuuuuuuuuuuuuuugagacagagucucacucuguuguccaggcuggagugcagcagcgagaucuccgcucacugcaagcucgccucucggguucacgccauucuccugccucagccuccugaguagcugggacuacgggcaccugccaucacucccagcuaauuuuuuuuguauuuuuaguaaagacgggguuucaccguguuaaccaggauggucucgaucuccugaccuugugaucugcccgccuuggccucccaaagugcugggauuacagacaugagccaccgcgcccggccaacuaguaguacuucuuuucuagcauaugcuaaaguucaguugcaggcuccuuaagaaguuaagugagccccauucagccuaaaagggagcauauuguacauuguguucuguacuuugccauuuuuucacugaacaauauuuuagaggucaguguauagggaacagcuucauucuuuucaaacgcuucaugguguucuaguuuauggacguaucauauuuacuuacacauccucacugucucauuuuucucacuauuccuguuaaaggcuaaauguguuauucugagcuaguugaggacuugaaacuuagggaaugaggaacaauagagcauuuuacacaugacgggccuuguucaaagucagaacaagaggcuuggaacuccuuaagagaccauacuguuuuucacuguucacagcaguuagaaucccaaaacuaauuuucuaauauagcgauuucuggcucugguuuugggaguacccaagguauuuuccagucagauucugugguauugggacauuuucagagaauacauuaaaaaauguauguauuauauauuauguauauauguauuauauauuaaaauuauaaauaaacuauaauagaaauaauuaaaauaauaaauagaauguaaaucguacacauuauaauuccuaagcuauaucaaacauauaauuacuuuauuaauuuaaucauuaaaaugaaaaauguguaaauuauauaguuuuccauuuuagaaauuacgguauuaaaagauauagauaauuuuuuauauguguacauacauacacaguucacuaagguuugcaagacuuuuuagccuuaauaaggauaauacuaauagcaguaauaguagggacuaccaccuacugagcauuuaacuaugugccagauguuguauugaggcaauuuauaaaaaucaagucauuuaaauucuucagugucauuaugaggugaccagagugguugucuucuuacagacaaggaaauuaguguugaaaaaguguaugcaacuugccauacacuugaccauuaaccaucgugcugcaucuuuauuacauaaaauugggggaauguuuugccaaauaaaaucuaaauuggaggccgggcgcaguggcucacgccugugaucccagcacuuugggaggcugcggcagguggaucauuugaggccaggaguucgagaccagccuggccaacauggcgaaacccugucucuacuaaaaauacaaaauuuagcugggcaugguggccugugccuguaaucccagcuacuugggaagcugaggcaggagaaucacuugaaccugggaaguggagguugcaaugagccgagauggcacugcugcacuccagccuuggugacagagcaagacucugucucaaaaaaaaaaacaaacaaaaaaacugaauuggagaacuugggcuuuuaggguauauuuaaagugcaaacaugaaggaaugccacuaugacugaagauuacacaaggaagaguuuacagugagaauguuugugcucuacuggacucuacccuaagggaaggggggaugaauggucaauugaugucuuuaaguauuuacaguagucguucauccucucacugaccuguucccauuucccccaucaaaaaugcagaagggaguaggggcagggguguaggaagaggggccaaaaccuugcuggaaaccaaaggcuucauggauaagugacugauaaguagaggaggaaccuuuucaaaugauguauugagcuuuuaaaacccuacaguguaauagcaaacuagcaauacacaagauuuauuuguaagaacucugcauguaagugugugucaugugugcauuugucugccuuuugaacugguauguacaggaauaaagaauccuaggauacucaugauaaugacagcuauuuaauuuccuuugaauuuugauuaugcaccacugaaaagugaaacugcaagaauuucuuuagucauuuuuauggaagggaugggaauagaguaggggggcaaaaagaaagacaaaccaagagggaaugguugauugaauguugaagggggacuuguuuggccuaacauauuuuucuaaauauuuauuuuugcuggaauaugaagauacacuuaaucuuccagcucauuuuuuguuggaacgguuauuuagcaaagcaaguagggggcugcuguugcuaagcuuuuuguuauuauuuugccacacaagaggauauuuuuuaaauaguuguugggaacuuuaagacuugcugagcaggaaaugccacauguaaggaugucuuaauguuggcaguguuuuuaaugcaagaaagcaaaagauguuaaagacccacuucauuuucuuggugcucaucuguguccaccagcaugagaguaaauaaaugugguauuuaauguucauuaacccuuuacuacaaaaagauaauaggcacagugcuugcuacaguaguucugaccagugcaguuuguaggagucacuaaaacaaggugcaagcagccccugggaauaagauaaagcuaauauaauacuaaaugacugagaggauuguguuguucuuaccuuaaggaagaaaauguuagccaucaaagaggauuuuuuuguguucuuuuagcaucuuguggagucagaagccuagcauucuagaugagcaaaguacacaauugcguuaguauuaacuugcugaguuuguguuuguuaugcugguuuuauauucauuuugugagugugggugaggagggaaggaaaaaaauggaguugggaggggagcuuaucuguuuuaauugaucacugacaccuaaggcaucucaaggcuaggcagaaacuuccacgucuugcuguuuccuaaccugaaggagggggagaguuugugguuccagggauaugaaaaggaagaccuggugugauguucugugugugaaggaguuacuuggaggaggcacuagaaaagcagaugagguucucccacacucccaaaggcugaguuuacuccugggguugggggcauagugaagagaaccauuuagguauccuacacuuaccuagacaccaagacuuguacauuguaccucaccggcuuuguguauuaauaauugaacccccaccacaaugcugugaggaggcuuuacuuaccuuccugguugagagaggacaucuagcuuagagacaucucuugcauagcuagugguuggcagacucagggcuugaacccagaucucacguucuuuaccuaacauggcuauauuuauuuccuagggcugccauagcaaaguagcacaaacugggugaccugaacaacagaaauugauuguuucaugguucuggagguuagaagucccugcucaaggugguggcaggguuggcccuucugaggcugugaagcagagucucccaaauuucucauuuuuuaaaagauacuauuguauuggauuauggccuacccuaaugaugccauuuuagcuaacugcaucuucaacaacucaaucuccaaauaagaucacauucucaguuucuggggauuaggacuucaacaacugaauuuucagagguccugagacacaguucaacuccuaacauggacuuagaguuuuucuuccuuguagccauuauauagauauauuuuaaagauuuaauuuuuuagagaaguuuuagguucauaacaaaauugagaggaagguacagaguucccauauaccccucccccgacaacugcacagccucccccaauaccaacaucccccaccagcaugguacauucauuacgauugaugaaccuacauugacacaucaucaggccaaguucauaauuuacauuaggguuuacucuugguguuguacauucuauggguuuggacaaaugucuaauuauauauauuuguccuuauagcauuauacagaguaguuuuauugcccugaaaauucucugugaaaaauucucugccauuauaauuuuuauugguaaaaauuuugaugucaguuucacaaaguuucaccucugauaauuuuauuuuuuucuuuacaguaaacauauagaugguagucuggcucuguccucaccaauauuucaucuugcauugaaauccgaauuggaguccccucccuguauggagggaggaauuuggugggaggugauuggaucauggcggugguuuccccuaugcuguucucaugauggugagugaguucucacaagaucugaugguuuuaaaguguggcacuuccuugugcuaucucucucuccugcuaccuugugaagaagguauuugcuucuccuucaccuucugccaugauuguaaguuuccugagaccuccccagccaugcggaacagugagucaguuaaaccucuuuccuuuauaaauuacccagucucagguaguauauuuauagcauugugaaaacagacuaauacagguaguuuucuuacucguucauacuacaaucgaaaaagaccucugaccucuuacucuaccuucucaugguuccuucugccacccuugugcacguauguuagcuguagaagggauuugucauaaaauaaaaaauaaugagauuuagucauguuuucagcaacguaguuaagguauucuuuagaguaaaucuauuaauacauugugauauuauuugcucccacauaaaaacuugauaguuuuaagaguugaaaccuauaugaaagacuaauaaaaucaaggauuuuuauuuuuugucacacugcuuaucuugaauagggucuugauauguuucauuuuuuauuuuuuaaccucccagcugaugauuuuaauaaaauagggcccuugggaauuaacaaaauuauaccauaugguaaggguaaaaggaucauugaucugguuaacaaaccagccugaguuuccaggggagcgacccuuucuccagcccuccucagccuuggacaguuacauuauugcuuaacaaucaucaucugcuuuuaguggaacugcuuauuuuucuccuuggcuugggcagauugccccaguguuucagauacugccuuuuggaaacggaucaguaggaaauuucuauuaccggaaaucaucuguuucugaaggagacaaacuauucuuuucaacucaacucacucuugugaaacagaaagcccagcacuuucucacagcugcucuaagacaguccagcaggguaagaacagugaggaaucaaauguacuacaagccaggugggaccauaguccaccacggccaagcaagaaacuggaauauccaugccacaaauguggaaaguggggcaucuucuuucuagagagcuaccgaggcuguucaaauuucaauuuucucuguggcauguaaaccguauuuuuuuuuuuuuuuuuggugucaaagaauagaaaauuaguuuuaauuguuucuuaugaggcaccauauggcuacucuauaauuuuggcuuuccauggagcugcaugugcauauggaaaaugaaauuaauuggaaaucacacccugaaaucuauuauuaaguuaauauagcuaacagcuugugggguguccucacacucagcaugauguaauugcacauaauaauaaguaacuauaaacucauauaggagacaagccggaauaaacagaggucaaagggacaggcuuuggaagggaagagcauuaauaauggauggugcagcaaacguuucaguuccucaccauucacaaacccaggguagagggaagcaguuuaaucauauucaaaugaauuaaucagcagucuugugaauuucacagccaagggacugauuguuauuuugcaaacuaguguucugcaagccuaaggucacucuugguagaaucagugacagugauuuuucaggggugcccaaacuugccugugcaucaaaacccucuguggaacucuuagaaacacugaacucugaaucuaauuccugggauuuugauucauuugcuuuggauuucucaauuauuaagaugcacuacaagugauucugaugccgcucagccauggaccauggaaaccacugauuucagugauauaucauacagcucuauauauuuaaaugauaaagacuacagcuaguuuguguucaguuucccuaaugugguuccuaaccuuauaacagaauaaaguaaguucaaauaaaaacaugaggucugcaacuucauuugguaagcccagaaauagugaacaaauaauuugaugucaucugugcuuuuuaugaaauuuguuaguuuaugggucugucuccuugggcucagugagggcacuggcuguuuuauucaccuugguggucaggacgugguaggaauucaauaaauguuuauggaauauaaauuugaauaugaaaaggagcaaaaagguuauucucuucauuagaaacaucagaacgaucucuguucaucucaaauugaugcuaagagccauguuacgucuauguaauaugugauauuaguauuucuuaaaaugucaccugaguauuguagagguagaguugcaugcauuugauacuaggaaggagauucuuccuauccuuuauuccucuuccagugagggagaagucugcaaacauuaaguuauacuuaaaagaaacaugucuagaauucuaguugggagauucauugaccagacuuuuggaauaaacacuagucaucaugcuagcgacagguggucuugugcaugguagaaaggcaguccaagccuaugucucugaaaccugcucucauuucuguuuucuacuuuacgauuuauguuaucucauacuccccauguugccuguucuccaguuuuuuuacuuguguuauuuccauucuucuauuccugcucaauuucugccucagggcagaauuguguccaacagcucuuaaaugcagcgcagaaacugugauguuaaaaacaucuuguuauccggccccaaaacauguuguccuugguaacucuuacugguuuguacauaaagcagguugggaucucauugaugggcuagugggaaggagauaaugguguuauagcaaaaaacugcagcagagacaaugggaagaaggucugugacuuuagagcugaacaaagccaagaaauauaugcagauacaguaggauguuuuguggcuugaccagcagacaccacuagcugucucucagggcucccgcucuuccugaauaauagagccuugauauuuuaaaaauuuaauucucuauuuugaaauaaauucaagcuuagggaaaaauuccaaguacaauauagacaucucccauaucauuuucauccugauuccucaaccguuagcauuugagaggaagcuacaaacgugauacugcauuucugcuaaacauuguggguauguauuuccuaaauagugaaaacacucuccuacaccaucagcauucagcccuccaagucaggaaacaguguugaugcacugcugccccccaggacacaaagcccacugaaaggucaccagcuaucccaguggcgauuguccuucuuuucugacccaggauuucagucaggaacacaugucacauuuaguuaucaugucuauuggaucucuucuacucuggaacauuucuuugaucuuucccugucuuucuagucuuugauaguuuuaaaaaaaagucaggucuuuuucuguuuagaacgucucucaaccuggauccauccagugucuccacauggccagaaucaggucccccacucggggaaaaugccauagaaaugauagucaaguguuuauauaugucccaucagaaggcacauggccugucccacucuguucacauugguacaugccagguuucuccaccuuagauuugacauuuuuccuuuguaagugauuugaauuuuguggggagauguucugagauuaugccaauaucaugguccuugucuaccuuccacccaccagucuuggcuuucaugggguugucaauugguauucucauuuccaucauuugcugguugguauuuuaguauaaggaagagccuguucuucuaccuuauuuauaucaucaaagacuuacgaauucuuguuuuauucaguggauugucuuucauuucuaagccuuuuugacauggcuucaucauuucuuuaaccacuuccuuacuuuauggcacaagauaucucaaugucaacuuaucccuuuuuugucccagcccugguaucagccauuucucuaagaaacccugguuguuuuugggaaagauuguauuuagaaacuaagaucugggcacuuguuugugaucauuacuguugaggcauuacugcuuuuaggccaucucaggagguaguauguguguauagacauacacaaacacacauauauguauauguaaguauacacacaaauauauaugaguauaaaauauacacauucauuuuacccucccuauguacauuuacauacauaaacaugcaucugcaaccauuuauuugucuaccuguguuaccaaaaauauuggguuuauauugauacuuccaauuucauuccuaaaucucaggguucuuucuagccuccuaccuuuccauauuuggaaguuccuccaacagcaagaaacuugcucucauccucuauauauuauuuccuuaauuuacuguuauuaaucagugugaucaguuucccagcuguucugucucuucugcccacaacccccgugcucuccaacaucuucaguuuuggggugcugucagauaugcuacuaccgugucuuugugaggaagcuccccaacaucccucagugccuggguacuugaucuccaguaugcaugcugccaguaucuucacaacacuucuucuaccccucagcacuuguccucacguacuaggggaccugucacuuuuucacugaauauauggcuaccuggaauaaauuauuucccaaccucccuuguaacuaguugugggcgugugauuuuauuauggcuacugguagccaguaugaccaugaaguggaagccauauguugacgaacugugaucauuaugaaauugcaacuccagcccuauaacucaccuugggacuucaugugagagaaacagaaacuucucucucuuauguaaaguuuucaacguauuauuuuaauuuuuuggucccuuaacagccaaaccgaauuauaacuaauauugccccuucuagacaagaaggaaaugaaaauaauucugaauucagucaggcaguaaagaaauucauaaaggaguguagcaccaaauuuauugagguuacagugagggguuugaauuuaaaucucccuaaaucaagugacacaauuuauagaaguuuguaagaauuacagcugaguguaaagaauucuauugcaugacaucaagguucucaggcaauuagaaagcaacugaaauuccuaacaacaacaacaacacuccaacaaaacaacauucacaugguuaaguaaauguaauagcuuuagccuuacagaggguagcugacuucucucugccaaaaucagacagaauuugguaaaaacauguaguagcacauccugagggaaccccgggaugccaucuuugagaucacucuguauggggcuucccauuugucuuggcaacugguaaagauagcuccaaccuggcuaucaagagcaugcaaaaaaucacaccuaccccgaccgagagggcuaccccagcuccuuagaguugugaccuugucuaugacaugggauucaaaaguauuuaguuacugguuauguuacuuuuaacccaaggaagguuuagaauuuaguaaacaugauaaaauuucugaaacccaugauaauuaaugcuuaucaauuauuaguaaucugcguacauuuuuuaguugauguguuucuacuguuuaagauaacucggaauauuaaaguaacugacaaaguagauauugauucuacuuucuauguuuaguugaguaguuaccauuacucuuguaauuuuuauguugaaagauaaaguuuuugacaaagauuauaaacaauauugcaaugcuuuuaaaguauauggaaucuuuuauuuuaauuuguuagggaguuacuggugcaauuuaauacuuaguagauuuugcuuuccaggucagaaauugaaguacuuuaagaaaagaaaauggguauaaugaguuuguaaaugcaguuuaaaauguuuaagaaaaauuaaaaauuaaauuaaauuuguaaaugauacugauuacuuaagggaguuuaguguaucuaacuugaauuauuuaaguccaaaagcccccuugaaagugaauuacauuuuaaacuuauaauuuucagcuuauaaguagaaugauaagauuugcaaguugaacucaaaggcuacaaaaaagaugaaguuuuaaacauuugucacuuuauuaaagcaaauauuuaacugaagaccacaaguggacccuuuguggcaaagccaccauggacaaagggaacaauucccugcugcaguggccaugauggaagaucugugguggacaagagugcugucuucacaggggcuggaugccacauuggaugccaaagcuaauuucuagugucauugucugggcuaagauggcaagauuagggauugucagccuucaguaccugaucucgaugcccugggcagcaagauaacauucauauccacuucuugguugggaugggagaugucauagaaaaagcaugggcugucuuacugucuguugaauucugguguuuuuaacaauuaauugaugacaauaauuucuaaauuaugugauuaguggguggauuagaaguaauacacauacaaagcauucaguauauuucuuaucaccuaacagguguucagacaacaguugcauuuuuuaaagaaagaugaugagacugcugaaauagcuuacaaaugauuuggggccaaaucagauaauuuaagguauaaaacacacaguaguuuacauuuaucagucacuugaaauguugccagacauugugcaaagucuuuacauagauugcauccuugaauucucccaauaaaccaugagauauuuauuguuauacucuguuuugcagaugaagaaacugagguuuauggagguuaagugacuuauccaguuuuacacagcuaaguagaaagaguugaacuggaauggcaauccacaaaaucuaaugcuagacuacugaacucaaauccacguucucguauuccuauguuauagacauccaugucugcaguaacaguguugcagagaaguuaagaccagccaguauugccuuuacuuugcagaauugcucucugacuuuuguaccucaucaauucagacuacugucuuuuuuuacaugcauaauaaaaguacuacaugaauacaccaauagagugggccuuguuuuauuauaauuugguauauuaagucacaaaaauguuugguuaaauagacaguaaaaggaauuguccuugaagccauuaauacaugugagauacgugaugggcacagccuuucauauagcuugaaaggaaagguuuuuguuuugcuauuauugggucauuguguuuuccccauuuuuucuuuuuucuuuuuuuuuuuuuuuuuuuugagauggaguuuugcucuguugcccaggcuggagugcaaguguuuucuccauuuuaauugacagucaguuuccccagaagccaucaucaggaguucuggucauauuugauacuggguggcguggcuucuugcugaccacugucacaucauguucccaccaacuucuuauauucaccugagcuugaauaggugagaguuguggguggccucuuagcaccauacuaaggugguguggauaagguuucagcucuggcuggaucuugugcucuggaguugacagcugugugauauugggcaagugacuuuauuucuuaaguuuccucauguagaggacugcugugaagauaaacgaggugagguuuguaauguccuuugaauagcuccuggugcauagccaguggugaguauguggucuccuuaagacacagaacaacagucccaaccauuauaguaacaauaauggcaacaucaguaauggcacugaaggacagauagcuguguaugcucacucugcuccacaaaacgccagccaagcuucagugucugguugcuucccagcucauuuucccucccucccaggcugccacagggcuggaucagucccugcaucgauguugggggagggaugugcugugcugauauaagccucagccugcuaaugaggcccaaaguugagcagcuccagacggaaucaaguguuguguucucugccagaaaaugugguggauuuccaaggccaccagcacuagcggcagccauggauaucaaaagggagacuaucgaaaagcaagacaagacacaggccuugggucaaaacaaacuaucaaaacauaaauaaaaacauggugugcauuuguagcaggcgaauccuaucaaggauccagagguacucauuuuacacauaaaagcauuaguccaucagaagguggcagggcaguacuaaaugucuuuagaauuugggcagcuuuugaaggcaucuaacccuuuuuaacuuuguacugucucaucaaccaucucaucaaccaugagcacauuuuacuuauuucugaauacuugcaaaaaauacaagacgugaguguuuuauauauucuuaacacuuggcaaaagucaguaauagauuacuuauuacaaaaauuauuuugcccaauaggcaacauauuuaucauuaucaucuaccauuuacuugauauguauaaguauaagccaguauacaccaaguauuguguuaaguauuuuccaugcauuucugccgccgccccugcccccaccccccguuuaauacucauaguaacucuuaaacguaagcacuuuuauuaucagcuucauuuuguagauaagaaaaucaaggcucuauucacuuggccaaagccgcucagaccccuagaaggggacaaagcgugaguucuaauccaaggccaucuggccugcagcucaugaacuuauccacugcaccuaauuaucucugguaagguaucuucuuuaggagaaauuuaagacagaugguaaacuugguaagacagauguacacagaaaggagacgguuuggcugggugugauggcugacaccuauaaccccagcacuugggaggcuuaaguccaggaguuugaggccagccuggaccacauggcaaaaccccaucucuauaaaaaacaaaaaaaauuuccaggcaugguggugugcacuuguguucucagcuacucccaguuacuugggaggcugagggaggaucacuugaacccgggaguucgaggcugcagugagccaugaucauuucacuguaccccagccugggugauagagugagacccugucucaaggaaaaaagaaaaaacaaaaaaaaggaagauguguuaacaauccuguuuauagaucuuagauguugguguugggggacaccucaagagagugcaucaccccuuucugcuucacgaaaggagucaaugacuugagaugcaguaauguggccugagucucacagagaccaaucauguuacccgcauggagcaggucagcuaauucuggcaagugcagauguaugugccccaggcccagggaagaauacggcugguguucaaucagaggauuagcagcugaauucagaagugucaauuuugcccguuacuuuauuuugagucacuccucccaugaaaugaagaagugguuuaagcccaguagagcugaauggugucuguguacacaucucaggcagcugauuuaaucuaauacguaauaagcuuauuuaaaaauaacugucauuuuccccauuugcagauacaauauacguuccuuguagcaaauuugcaguuuaaaaaaaaaagaaaaaauuuauccauuacaaccuuucucuaccaguaaucagaguuaauaucuuggcauauuucauuccagauuuauccucaguuauagauuuguauauguacauauauuuagugguauauauuuugcacuaugcuaagcuuuucccccucauaacaauguacuguuacuccucuuaccaggucaaagaaacaucuuuuauuuaaauuugaaaauaguuuuucucucauuauaaauagucauuguaaagaacgcagauuauaacaaaacuauaaagaaggagguaaagaucaaccccuauucccuauagauaaccacuguugaugugggcuuuauauuaauaucauuucagacuuuguuuagacauuugugucuauauuuucuaaaguuugcaaaaaguaauguacucuaguuuguaccacagauauguuuuggcuuuuaucuucuaaguacuuucuggugguuuccuuucaaaaauccugcaggcuuaucaaaagucuggagucccaugauguuaagcuucaggcaggugacagugacauugauagcguagaaaagcuuuugguuaaagauagucguuuucgucacuucauugcuuaaguaucagucuuaagcuccagguaucauccuggcuuuucuggagguugcaaguauuuccaggaaaauucaaucccuuguugaaaauggaagagccacacagaaauacuugggcaagcguggugcaaggaaacuuguggaugcagcuauuuuugauaauuuccacugagcuuacacaacaucauuacuauaaaaaacuuauauauaaauaaugaauuguuucuauuucuaaagaguuacuauguucauggcuuaaaaaaaauucccauuugaacucaguauuuugcauauaauugacugugacugauuuaggaguguuucaagcaguauucugauuuggaagugguaaugggggaagcugauuccuuuuuuauacgccuuuggauagucucauaccuguugggugccucuuguaggccaggcauuggacauugcgcuuugugcuaagguguauaaauuaaauauuuuguuaugcuuagucucaguaaguauuuaggaagagacuugugaucccuauugucaauauuuucgcucauuuguccuaaggauacucuuguaauauguucucagaaacaauaauagauuuauugauuugggaauugagucauacaaguauaugcauuuguuaaaacuuauugauugguacacaugagauuuggguauuucacugaaauuaaauuuuaccucuuccccaaaggaacuguaccuuauuugguucuuaauguuuauuauaaauuaauauuuuuaaacucuaauauuuuuaaacucuaauaacugauauggauacugaagaguuuaacuguacugaugcacggaacuuacucugaauugcaugaaaaaauaagauggguugugcuggauugagagaugugacaaagcacauguacaaaaugugaacaguuguagaucuagguuauauguggauauuuacuagucauuugacauuucuaugugauuggaaauuuuaauaauagaacauuggggaaaaaucaguaauaaggcucuaugugaggaaguuaaagcacagucucucaaauaaucuuucuggcuuaaaaaucucaacucuguuucuuccuagcuguaugacuccaggaaacucccuuaacuucaauugggucauuugcuaaauagaaauagugaauacgcucagcacaaaucuuauuuuucaguaagcuccuagcaaacacugugauuaugauuucauagaguaaaggaagugaugauugugaaugaaugaccguaugcugagggccugcuaugugccugguacuggucauuuucaggagaaugaggcgauuuuguuuugcaucaugcugugucguccuucgguagaaacuuucauacuggaggcgguguaaggggugugauuagcaaaacuggagaguggcuucauuagguuugacagaaucucucccuggcuucauggaucccccuugcuguagcaucuccuuugaacuccaagggccuucagaggagagguggcaucugcuuuguuagacuugguagcauucccaagucaguguuaauuuaguugauucgugaaaauuguucccuuugcauaaggcuaggacaucuucuuuucuggaguuauucuguuuuuagcuuuuuggacagguauccugggaaauucuucuaggguagcaagaucugcccccuccccacagucaaaucauguuuaugcauuaugacagacuguuccaccuccugcugggaggcaaugagaaagggucaggaaccuggaagaggcugcagcuggauuuaagggcaccagugcuugaggacgaaggagaguauuucagguaauucuauagauguauuguuuacuucuggauguccauguugcugaaaacuaaaguagaaaauagaguaaaacacuauguguucagggaguaucuuaguucauucuggcugccguaaggaaauaccagagacuggguggccuauaaacaacagaaauuuguuucucauagcuuuaggggcugggaagucuaagaccaaggcugaugcagugucugaggcgagccugcuuucuccuuaacacauauugccuucuagcuguguccucacgugguagaagggaugagggaacucucuggggucccauuuagaagggcacuaaucccaugcaggaggucucugcccccaccucccaguacuaucaccuggggguuaggauaucaacuuaugaauuuugggguacaagagacccaaacauucagaccauagcagagaauguggggguauagaaaaaacauuagccauauuagcaagcuguguguggauaggaggaauagacuuauaugcuagcuuuccagcugugaugaugcaauaugaaucuuuuuuguuuguuuauuuuuugggauggagucucacucuguaacccaggcuggagugcagugguacaaucucagcucgcugcaaccucugccuccccgguuccagcaauucuccugccucagccucccaaguagcugggauuacaggcaccugccaccaugcucagcuaauuuuguuuguuuguuuugagacagagucuuacucuguggcccaggcuggagugcaguggcacaaucucggcucgcugcaaccuccaccuccccgguuccagcuauucuucugccucagucucccgaguagcugggauuauaggcgugugcuaccacgcccggcuaauuuuuguauuuuuaguagagacgggguuucaccauguuggccaggcuggucucgaacuccuggccucaagugauccaccugccuuggccucccaaagugcugggauuacaggugugagccacccugcccggccugaaauaugaaucauuagugcaaauuucuuguaaugauuggaauuucaaaggguauccuccuguaggacugcuugguucauaugaaacaggacuugauuucugugccacacuaauaccauuggagaacuacuuaaaagcugccaaauuuuauuucaguuuuaccagauauggaugcuagcucuuaaguauuuuccugugcugucuugggugguauaauuccaaacucaagucaaaaaauuuuguauucuuuuacuccaagaaguaaaauuuauaccagcuuguuaauucccucauuucccauuuauaacacuuggccugacuucccccaguaugaauucuagcucaagccaggcauugaaaaauaagaugcagaaagugccagaagagauuugaaugcucacauauaaucagaaaugucguuuugaaaacaguccaagaaaguagguucagguuuuauggcuucugugguuagguguagcacauugauaaugaguguuccaauucacagggauuuaaguggauacauucuuauuugggagugguucugugggagaguguaauggaggguagaauuugaaguaaauguggaucucucuggcugcuggaacugaaauuaguuaucugagauauagucaaacaugcaaauuaaauaacuuggaaguauugcagggaagcaggugggaaaaggaagaaugaaaaggagagaggaaaggagggaggagggagaaaggaagaaagcaugaggcagggaaggagagaaggaggaaaccaaagaaaguggcauaaagagaaaaggaaauagcuauuucucaggccuucacaacccuugaaagccaaauauaaacucuuccaaguucauugauacugcucaguuucauccuccaggauguaaucuaaaguccccucuguguuuaacauucgagcaauagacuuagauuucaaaaacaaugaaugcaucaagacaggcaauaaaagagcaagacauugcaauuuaaaacucagugcaauuugaaagcagcauaacaguuaugcuggaccucaguagauguguguaucaugggaaagugguucugagaucuuucaucucucuugggguaggucauuccuggcuucugcuuaacuccagcaugucauugaccacuuuacaaacuuuaaaauugaagacaaaugccuccuggauuccuuuuuauggcaacaacaucaagcuguugucuggaauucuguaucucuagcauuuggaauuauagcagauuuaaaguauggaauauguguuucuuugcaggaugggaggaggggagcguauacuuuauuauuguugcuacuaaauaaugcuuaguaugaaucucacugaccccuugaggaacuuuuauaggagaguuagcuuaccuggcugggggcuguuuuaucugagaguuagcuuaccugguugggagcuguuuugagacuggcaugauaaaauuauuagagcucuuaaaaguauuugggguaaaauaucuaaauuuaacaaagaugaucaauguauuuucuauuuauaugcuguucuugaacauagggaaauaaacuuuaaucuguagaaguuuucugaauaucugaaauagcaaauuugaaugauuuauagugcaggauccuggcaugauuugcugcuuuauuugaaguggugcuauagugauuucuaguuuaaacagcaaaccaugaaagccaaacagaaauaaauagaaaagcaaaguagccuuuuuuuaguuguuuuucacuccauguccuugcucuccagucccaucuuccuagaagucucacagcucuuccucaugacguuggccaaguacucuucucuuuauagcuguauugguccauucucacacugcuucccugagacuaguaauuuauaaaggaaagagguuuaauugacucacaguuccgcguggcuggggaggccucaggaaacuuacaaucaugguggaaggcgaaggggaagcaagcacuuucuucacaagcugggaggagagaaagagagugaaguggggagugccacuuuuaaaccaucauaucuuguaagaacuuacccacuaucaugagaacagcauggaggaaaucauccccaugauccaaucaccucccacuaggucccucccuucacaacaggggauuacaauuugagaugacauuuggguggggacacagagccaaaccauaucaauaguucuuccguccuuuuuccuucucagcuuuacuugacaccauuuccccuuccuaauuugcuucuuaaugcuuauuauaaauuaaaaauuuucaguaauuuguuugugucuauuucuuccagucaauuuuaaguuuacaaaaggcaaugaccaugacauuuaaaaaaauuuuuugaauucccauagaauaaguaagugcucacuaauauuuuaaaagggcaaaacauuuuccugccacucccaguuuucuugcgugacucuuuaggaggucauguuauaagguauucagccauguguccuuaagauaucuucuagaggcuuccucaaauauaaacaccccgaccccaugugguaaaaugguaaaggcugauacagaaaugaguauuuaaauauucaagacaaacuacuaugaauuaacugcccacauuuaauucacagcuuuuaaacucuuuuuauuuuucugacacauaauugcaaaauaauuaagucaacauagaaaagauauaauguuguacccauaauacuacucccuagccacuuaagguaaccucaguuaauaguuugguuguugcucauuuauuuauuuguuuuugagacagggucucacucuuuugcccacacuagagugcagugacauaaucauggcucacugcagccgcaaccuccugggcucaagggauccucccaccucagccuccugaguagcuuggacuacagguaugccacuaugccaggcuaauuuuuguacuuuuuguagagacaggguuucaccauguugcccaggcuugucucgaacuccugggcucaagcaacccaccugucucagccucccaaaucaacccaccugccucggccucacaaaguggcuuacaggcaugagccaccacacccaaccuugguuauuuagauuuuauuacgacuauguaacuguuuacagguguauuuuuuaaaaaaugcuagucauuaaggucagcuuaaagcuuaguuugugcaugggcauuuucugacauuuacacuuaaaaauauacuuaauuuauccaguagucauuccggagcagguuguugaauuuccauguaguugugugauuuugagugaguuucuuacuccugaguucuaauuugauugcacuguggucugagacacuguuaugauuuccauucuuuugcauuugcugaggaauguuuuacuuccaauuauguggucaguuuuggaauaaguacaaugugguggugagaagaauguauauucuguugauuggggguggagaguucuguagaugucuauuaggucugcuugguccaaagcugaguucaaguccugaauauccuuguuaauuuucugucucauugaccuaauauugacagugggauguuaaagucucccacuauuauugugugggaguccaagugucuuuguaggucucuaagcauuugcuuuaugcaucugggugcucuuguuuugggugcauauauauugaggaugguuagcucuucuuguugcauuggucccuuuaucauuauguaaugcccuucuuugucucuuuugaucuuuguuaguuuaaagucuguuuuaccccagacuaggauuacaaccccugcuuuuguuugcuuuccauuugcuugguaaauauuccuccaucccuuuauuuugagccuauuugcacgugagacgggucuccugaauacagcacacugaugggucuugacucuuuauccagugugccagccugugucuuuuaauuggggcauuuaccucauuuacauuuaagguuaauauuguuuugugugaauuugauccuguuguuaugaugcuagcugguuauuuugcccguuaguugaugcaguuucuucauaguguugauggucuuuacaauuugguauguuuuugcaguggcuguuccggguuuuugcuuuccauauuuagugcuuccuucaggagcucuuguaaggcaggccuggugguaacaaaaucucucagcauuuacuucucuguaaaggauuuuauuucuccuucguuuaugaaacuuaguuuggcuggauaugaaauucuggguugaaaauucuuuucuuuaagaauguugagggccgggcaugguggcucacgccuguaaucccagcacuuugggaggcugagguggguggaucaccugagguugggaguuugagaccaaccugaccuacauggagaaaccccgucucuacuaaaaaauacaaaauuagccaggugugguggugcaugccuguaaucccagcucagcuacuugggaggcugaggcaggagaacugcuugaacccaggaggaggagguugcagcgagccaagauuguaccauugcacuccagccugggcaacaagagcaaaacuccgucucaaaaaaaaaaaaagaaaaagaauguugaauauuggccucucuguucuagcuuacaggguuucugcagagagauccacuguuagucugaugggcuucucuuuguggguaacccgacuuuucucucuggcugcccuuaacauuuuuuccuucauuucaaccuuggugaaucugacaauuaugugucuugggguugcucuucucaaggaguaucuuugugguguucucuguauuucuugaauuugaauuuuggccugccuugcuagguuggggaaguauuccuggauaacauccugaagaguguuuuccaacuugguuccauucucccugucaguuucagguacaccaaucaaacguagguuuggucuuuuuacguagucccauauuuuuuggaggcuuuguuuguugcuuuucacucuuuuuucuguaaucuucauugaguugaucuucaaucucugauauccuuucuuccacuugaucgaucuagcuauugauacuuguguauccuucagcuccauuaggucauuuauguucuucucaaaacugguuauucuaguuagcaauucaucuaaccuuuucucaagguucuuagcuucuuugcacuggguuauaacgugcuucuuuaguucagaggaguuuguuaauacccaccuucugaaaccuacuucugucaauucaucaaacucauucuucauccaguuuuuuucccuugguggcaaggaguugugauccuuugaaggaaaagagguguucugguuuuuggaauuuucagccuuuuuguacugguucuuccuuaucuucguggauuuaucuaacuuuggucuuugauguuggucaccuuuggaugggauuucugaguggaugucccuguuguugauguuuauacuauuccuuucuguuuguuaguuuuucuucuaacagucaguccccucugcuacagucuacauuucugcuggaauuugcuggcgguccacuacagaaccuguuugccugaguaucacuaguggaggaugcagaacagcaaagacugcuguguguuccuuccucuggaagcuuugucccagaggggcaccccccagaugccagccggagcucuccuguaugaggugucugucgaccccugcuggaggugucucccaguaagggggcacagggaucagggacccacuagaggaggcagucugucccuuagcacagcuccagcagugugcugggagauccacugcucuauucagagccgggaggcaggaacuuuuaaguuugcugaagcugugcccacagccgccccuucuggcaggugcucuaucccagggagaugggaguuugaucuauaagucccugacuggggcugcugccuugcuuucagagaugcccugcccagagaggaggaaucuagacaggcagucuggcuacagugacuuugccacgcugcggugggcucugcccagucagaacuuccaagcagcuuuguuuauacuacuaggggaaaaccaccuacucaagccucaguaauggcagaugccccuccucccaccaagcaccccagguggacuucagacugaugugcuggcggugugaauuucaagccaguggauaaauaaguucuuugaaaccaaugagaacaaagacacaacguaccagaauuucugggacacagcuaaggcagugaguguuuagagagaaauuuauagcacuaaaugcccacaggagaaagcaagaaagagcuaaaaucgacacccuaacaucacaauuaaaagaacuagagaagcaacagcaaacaaauucaaaagcaagcagaagacaagaaauaacuaagaucagagcagaacugaaggagauggagacacgaaaagcccuuaaaaaaaucaaugaauccgggagcuguuuuuuuugaaaaggcuaacaaaauagauagucugcuagccagacuaauaaaaaaagagagaagaaucaaauagacacaauaaaaaaugauaaaggggauaucaccacugaucccacagaaauacaaacuaaagucagagaauacuauaaacaccucugugcaaauaaacuagaaagucuggaagaaauggaugaauuccuggucacauacaccuucccaugacuaaaccaggaagaacuugaaucccugaauauaccaauaacaaguucugaaauugaggcaguaauuaauagccuaccaaccaaaaaaagccuaggacaagauggauucacagcugacuucugccguagguacaaagaggagcugguaccauuccuucugaaacuauuccaaacaauagaaaaggagggacucgucccuaacucauuuuaugaugccagcaucauccugauaccaaaaccuggcagagacacaacaaaaaaagaaaauuucaggccaacaucccugaugaacaucgaugcuaaaauccucaauaaaauacuggcaaaccgaauucagcagcacaacaaaaagcuuauccaccacgaugaaguaggcuucaucccugggaugccaagcugguucaacauacacaaaucaauuaacauaauccaucacauaaacagaaccaaagacaaaaaccacaugauuaucucaauagaugcagaaaaggccuuugauaaaaaucaacaccgguucgugcuaaaaacucucaauaaacuagguauugauggaacauaucucaaaauaauaagaucuguuuaugaaaaacccacagccaauaucauauugaaugggcaaaagcaggaagcauuuccuuugaaaauuggcacaagacaaggaugcccucucucaccacuccuauucaacauaguauuagaagauguggccaggacaaucaggcaagggaaggaaauaaaagguauucaaauaggaagagaggaagucagauugucucuguuugcagaugacaugauuguauauuuagaaaaccccaucgucucugcccaaaauucccuuaagcugauaaggaacuucagcgaagucucaggauacaaagucaaugugcaaaaaucacaagcauuccuauacaccauuaauagacaaacaaagagccaaaucaugagugaacucacauucacaauugcuacaaagggaauaaaauaccuagauauacaacuacaagguuugugaaggaccucuucaaggaggacuacaaaccacugcucaaggaaauaagagaggauacaaacaaauggaaaaacauuccaugcuuauggauaggaagaaucaauauugugaaaauggccauacugcccaaaguaauuuauagauugaaugcuauccccaugaagcuaccauugacuuucuucagagaauuaguaaaaacuacuuuaacuuucauauggaaccaggaaagggccccuaaaacaaagacaauccuaagcaaaaagaacaaagcugaaggcaucacucuaccugacuucaaacugcacuacaaggcuacaggaaccaaaacagcaugguacugguacgaaaacagagauauagaccaacagaggccuccgaaauaacaccacacaucuacaaccaucugauuuuugacaaaccugacaaauacaaacaauggggaaagaauucccucuuccuaaaggguguugggaaaauugguaagccauaugcagaaaacugaaacuggaccccuuccuuacgccuuacacaaaaauuaacucaagauggaguaaagacuuaaacauaagaccuaaaacgaucaaaacccuacaagaaagccuaggcaauaccauucaggacauaggcaugggcagagacuucaugacuaaaacgccaaagcaauagcaacaaaagccaaaauugaaaaaugggcucuaauuaaacuaaagagcuucuguacagcaaaagaaacuaccauccgagugaacaggcagccuacagagugggagaacauuuuuugcagucuauccaucugacaaagggcuaauauccagaaucugcaaggaacuuaaacaaauuuacaagaaagaagaaaacaaacccaucaaaaagugggugaaggauaugaacagacacuucucaaaagaagauguuuauguggccaacaaacaugaaaaaaagcuuaucaucacuggucuuuagagaaaugcaaaucaaaaccacaaugagauaucaucucacgccaguuagaauggcaaccauuaaaaagucaggaaauaauagaugcuggagaggauguggagaaauaggaacacuucuacacuguugaugggaguguaaauuaguucaaccauuguagaagagaguguggcgauuccucaaggaucuagaacuagaaauugccauuugaccaagcaaucccauuacugggcguauacccaaaggauuauaaaucauucuacuauauagacacaugcacacguauguuuauuucggcacugugcacaauagcaaagacuuggaaccaacccaaaugcccaucagugauaggcugaauaaagaaaauguggcacauauaaauuauggaauacuaugcagccauaaaaaaggaugaguucauguccuuuucagggacauggaugaagcuggaaacaaucauucucagcaaaguaacacaggaacaguaaaccacacagugcauguacucacucauaagugggaguugagcaaugagaacacauggacacagggaggggaacaucacacacuggggccugucgguggguuggggguaggggagggucugagaggggaacggauuuaaauaacagaaaauuaggagaaauaucuaagguagaugacugguugaugggugcagcaaaccaccauugcucauguauaccuauguaacaaaccagcaggcucugcauauauaucccagaaccuaaaguauaauuuuaaaaaguauacuuaauuauuguuaaugacuguacauaugguguuuuauuguuucauuauuuggauacauaaaauuuauuuucccaauaguguccaaauguugguggacauuuggauuauuucuaguuuuuucacuauuauaacuacauugcaaugaaaaucuuuaguucucuugucaauuuucauggaaguaggauugcgcuaucaaaggauuuucugugagcccuaagcagauggcccuccuaauugccuucaaagauuccagguacuuuuuaacuguugugcauuuuucagcuguaugaaauaaguugcccagccugaauccuugauuuguacugggcucaggagucugugagagggaguuugauuucagucugcauuggcugucuggagaaugaguuccucuaaagagcagaacagguuggagaggugaaggguuccugauggaugaugugucuaaaugagaagaagacgacugggcagcagggcuuggugauuugcaggcacagaggucucagguuuagugugaaaacuggcaggaguaugguccagagaccauaggcagugaaugauggcagugaacagacagcagggcaaagauucuggacaguaguugugauugccugugagggcgccuaucaccaauggaggagggucugagagaggaacagauuuaaauaacagaaaauaaggaaaauacaagauuucuauucaagaagguagaugaucucugaaauuaguaauauugcuguaaaagugaaacgaacaucuuuaaauauaggugcagccagacaguguauauauugcauacauuuuaaauuucauggucauuccaauuggcucugaaaaugaaaccuucaugaguuuauguuccaccagcaggauaugagugugugcacaccaagagcuguucuggcuguugccaccuuuuguucuucccuuccucaucacugguuauggucgacgagagaauccccuuaaugucaaguagccuucaauaauaugcaacuaaaggagagguggauucucaagcaacucagaaacguuucagagcuguucauuuucaacccgcaacacuugugggcucugcugucagauguuauagcuaucaggugugaugacuuguacugugucaccuuguuuagcuggaacugcguuuuccagaauccccuucccuguguaguuuuggguuugaguugacuaaaagaggaguuugcacagaauuugugauuacucccugcaguucauugugauuagguagugacagacagauguggagauguuagcaagaggcuccagccuuuucuugcucuucucugcauuguguccagcuguuugucccaagugcugauccugcugagccauauggacccaggcccauccugagaugcuuggugucuuagucuauuuaguguugcuguaaaagaguaccugaggauggguaauucauuuauuuauuuauuuuuaaauuuaauuuucuuuuaaguuccagguaaucuauucauaagggaucgucucccgugacccaagcaccucccauuaggccuguccuccaacacuggaggucagauuucaacgagagauuuuguggggacaagcauccaaacuguagcacuuggcagcaagucccaaguccuuuuccccagcuccuccuuugccauccacuucuccaucuggaggugcugauuccucugcuuggcuggcuggggacuccuaggacccuccaaccucacuuuuagacgugccuuuucucagcuccucuuguaagugugcaagcuucgauuccuauaauaaaucccuugucuauaagucauaguaguucugccuccuuaauugaacccuggcugacucacaucuuucguuugaaaaucagggggagacaugauuuuuuuauagcuaguuuuccuuaacuuccuuuaaauacauacacauaauacaguagaaauacuuuuggcuuucauaaaugcuuuucaucuuccaugacuguuuccagcaccucuugaaauuacaaguguuacacagguauuuuuacugucaauguauaucauaauaggauugcuuuguccuguaauuaaucaguagagauuucuucuggaaguuuguucuuuugaagaaacuuguauuuuucugaaaaacugucauuucuucaaguggcuucauuugcaaaagauuuguuuaauguccugugguuucauucuuacaauguuagaaauucuuuaauuaguuacagguguugaaugaugucacaugggcauuuuuuuuuuuuuuuuuuuuuuuuuuuuuuuugccaucaguguuagggaguucuguccuaaggcuuuuuuguagaaauauaucuuuuaauauaauugacacaauguaagauuggcuuacuaguauuaaacuacaugaaaagagcaagauuguaucuuuuacugagaauaguaagauguuacaacugaauuggguuuuucuagagauaauuuuuauuuaccuuuaaaaauuuuaucaccaacaaaauguguauuaacgguuaugaaagcaguaaguaagauuagugacaagaucagaggaguagccuaauuuauauuacagauuuuaauguggcccauaauauaguaauaaauauacaauauuuuuaagcauauggcaaauaugaaaaaacugugauuuaauaaacuuuaauuuaggaauuuuuauagggacuaaaauuaaaauuauuccgucgaaagcauaaauacauuuuuuguuaagauauuaucauuuuuaaauaaucaaacucuucaaaauggcuuuaucaugcccccacaguauccaaagaaaggauuuuuuuucauaauagggaaucauauucaaagggaaguuuuagauuuaaaacuuacaugaaagccuuaucagucaagaauuucuugauuugaaauaauaucucccuggauaacuuccuauuuguaucauaaaauccuuguccuggagaugguucuauuucugucuuguacuuauacuugaaaguggcuguuuuagacauacacgauucaaaucucugaugggcagcagucuacuggagagccauguaucuccagucucauucagucaaaugaugugaccaauggugaaaugguuuauucuaaugugcuguguguuugaaacucucugucccaaauuugaaaaguccaugucagacauguugaaagcugaaauaauuauuucagucucaaagaugccuuuugacauauggagaauuauuacaguaucaucuuauucccauugacccaguuacaacuugaggaaauaugugucauucuauaggugauaucauaguaaugauugaagauugguaacucucuauuuuuauguuuggguucugaagucguaacgcaaacauagaagugagcucauuuccuuugagaaauuggcaccaaggccucuaacuuaucucuauauaauuguauauucuuuauuaaaguucaucuuuacacaauaccuuuugacucuucucuugccuuccacuuugccuucuccuugccuucugguaauagguaaaucugaaauucugaaauacaauuuaacuuucucaauuaggaauucuaucaacucucagggaaggugauugccaugcuacauauuacacgaugcaguugugcugagaacuggauauuccaauuuugcuccagucagugaaccacagaaaucaguuucugcaaguccaauauuauugacuccaaauagaugaucauuguaguagucaucucauugcaguaucagugauacauuuagcauuuaggaaaguauuauaauuuagaaaagagcaaugcugaauaaaaaccagcucaguaacacaaauaguugacucaucacugaacuguuuuuaaaaaauaguugaaaauaacuuacuuuugucaauauauuugauuaacauuucagacauuuacuaugauuccuauuauggcucugaaauaugucuugugagcauuacuuuguguaaauauguuuucagaaagccaucucuaagaaaauuaagugaaccacauuuuacaaagcuugcuuaauuaaaaauguguauucuauuuagauuaugcuuuucuuaaugauuugauuuuuuucccuuuagaccuacugcuuccaagaauguuuauuaucuagcaugugacuauuggggaucuauaaaaauugcuauaaaacugcauuauaauuagaauaacacuugugguaaagaaugaaaagaaaauauuuguaaaagcauuguuauaauucagcugauagacuaaaaaaagaccacagaguaagguuuugcuuagacuuuuuaaaucgcucuaaauauuguucucuuaagugauacuguguuugagagucuuacauauuuauaaguuugucagauaugucuuacaguguuuucuacuaaaauauauguaaauucuaauaaacugguuccuauuaaacugagugaaaaccuaaccaugaguacugguuauuuucagaaacucacuaagaaaggaacaaaauuuagugaagacguugcauacuuaggcuacugcguauaaaaauagcaauuaagagcaaagacuuuggaguuauccagacccaaguuauaccaacucagaguccaauaauauaauuaucaaugucuagguuguugucuacuucuauauaaaaucuauuuuaugccuguaauccuagcacuuugggaggcugaggugggcagauugccugagcucaggaguuugagaccagcuggagcaacaugggaaaccucaucucugcuaaaaauacaaaaaauuagcugggcaugguggcaugugccuguaaccccagcuacucagaaggcugaggcaggagaaccgcuugaacccgggaggcagagguugcagugggccaagaucacaccacugcacuccagccugggugacaaagugagacucugucuaaaacaaaaaacaaaaauaaaaccccaacucauauuagaguuaauuuuuuccucuguccuuuuagcuuguuuuucuaaaggaugguuaagucgucuuauucagacaaaaauugcauuucauauaugggauuuuuuuuucuuuucuaauaccguucaggauuggggcaagaggcaauguuaaauaaaaacagaaauuugaguuuugggagagaucagaucuuuaaauaaauagaaacagugacauuuaguacaugugaaucaauuugguaaauacugaaugaagagacgaguuacuguugagugggauuugucaucuuaauuuucagcaccuugaguaaauaagccuugaauuaaauuacuucaugagaguuuuucucaagaugagaaaaacuugcuuuacuuugggcugcugacuugcugacuuacuauauugauuuagcacuugagauguaaucagaagagaugauuuuagugaacucauuuuuggccugggguguauguugcagaugugcguagguuguugucuuuuucuauuuguccugaucucugguuucauagucucugaacugguugcuuguucuaccaacacuguuuugcauggaauacuuugacuggaggucaaauggcgacacguuuaauugacaacacuucauugaggauacaacucuuucugugucuugaugguuagugacuaaagcugaucuaaucaagccuauguagugccaauuaacaaugcccaauuagguauucucucuggcuuucaaguuuugcugcuggaaagcucagagaggaaagcaucucuucaggaugacaaggauaugaaaaaugauaauggcaauggaaugccaguuauguaaagaauuugaagugaucacaauuaaaaauuugaguagacagcaaaaaguauuuuuuccacuugaugucuuccaaagaaaaacaggaaaugucuuccugugugccauuuuuucuuaauugcugaaaauuauuauaauguugauagcuaucauauuuugacuuuaaaaaaaugugccaggcacuuuacuguauuucauuuauucuucacaucauccuuacacuguagacuucuuuaauaugacuacuuuacagaagggcaugcuacuuuuaccuuucugaaucucaguuguuucuucucuacaaagaaagugauagguagaguuggagauuuuaaccaggucuguuuaacuccaauauccuugcucuuacuacuguucuugcaguaagcuaaauaugcaauguauucauuuuacuugguugcuuuccuugugaguuucugacaauuaauuugucuucuacucagcuugauggaaaccaguuuauuauaagacagggcuugaccaauguugugaugguucguauccagggcagaaauuauugccagaggguacacaggacagccuucuaagaaaaaacuguguuugcuucugagaagaaggugggcuucagcuuucugaguguaagcaaauauaggagacaagaagacuaaccaaugaaggcagugaaggagccucaauggugugacaucagcuggcugaaugccuucuguaaaauacuucuguagcuccccauugccuugaugauaaaaccuuccacagcucuuuccguuugaaccuuuaccugcuugccuguggguaacaaugaugaugacagugacaguaauagcugaaauaaccaaacuuaauggagcgcuuguuaguuuuuugguuuagccaucucuguaaugauuccuuucauucuuuacaauauacaaagguaauaaaugaacuaacuggucgaggcaauaguuuuuaauuaaucacaaguuuucaggcucugggauaaagcauucauguguguucauuuaauuuuuaaaacaacccuugucaucauuucacaguugaauaaaccgaguuucagagacauuaaguaacuugccuaaugucacacagcugggugagggaugaaggccagauugaaaccuggguuugcagauucuaaaucugguauacugaaccagaauacucucauggccuuauaggggaucagcuggguucugugauuuuaaauaaagaugacucacaaacagaggauaucagcuguggucugcaguugugugcuauuugguuuauuaaacauauuugauuuggaggcaguuuuuuguuuguuguuguuuuguuuuguuuuggugguuggggaggggagcuacccuguuugcuaaaggccccauuugucacugggcuacuucaugcacccaacuucccugcaagggaagauauuuguguuaauaacucucgucuaaaaagucaagauuagagaguucuuucauucguggagugugaugagaaacaaagauuccacaaccacuuucccccaggauauuuuguuaccuugccaaugauuuuaaaauauugcuugcuuuuaguuuuaauccauuuccuccucccuuucccaacccuaucaguauauagaacaacugcucagaaaacuguugguuuccaauaaugcaguuauuaacuaugaccuuugugucuugucuuuaaaccuucccccgcauaauccagucuucccuuugacaucucugaugguuagcuccucuuacuggccaacuggugccucugccacaugggagugccauuacacaguaaaauuaauaccuccuuccaggauuuauuuagcuucuucugacacacucaaaagagcaagggaacacaugucuugcuuucccuugggaaggucaaguauuagaugauuaaacugguaggaagcauuugaauauccucaguaaacaagcuuuguauuuaggcucauagauguuuuuuugaaguucuucauugcauuuauuuucaaaguuaguuugagagagcuuuuaccaguuacuuggaaguuaugugccauuauugcuuuccuuauugcuuaaaaaacaaaaaaagaauuuaaaaucagcuaccaacucuggauuuuucuuuuucagaugcaaaagaaauuguuuuaaaagcccagaucuuagcuggaggaagaggaaaaggugucuucaauagugguuugaaaggagguguucauuuaacaaaagaguaagucuggagguuguuauuccuugucuuuuggccaagcaguuauggaagaucuugcucaagauugaaaggcacacugagguugguuguggugggguaggagcgggccaaagcaacuagaagaaacugaaaucauagguagagggcucuggcagugcccuaguuuuccuucugcccccacaaaaugauuuuucuuacuaauuggugaaaacuugacaguccuucuguccuaaacaaucaaugauucaucauaaauguuggaaaugauaccacuuccaacugaaaugcuacuuccauaaugucacuccucuauucaaggaccugaagggacuccccauuaccaguggcaucugggguaccuccccucugauaguccaagccuuccuuuauuugagccugucuuuucaacuucaucuccugcaucuccuagcacugaacacuuuccucuccucccuguuccugucacacaccuuuuuacuauuuacuuugaucuuuacccucuuccuuucccucucauuguucaauaucuccccaguuuuccacugucggaucuucagucaacccuuaucugaaucuggugugcauuucagcauucucucuuuacuaugacuguaacuuuuuugggugaagaggucacaaagcaucuuuuguuucauuuauucauucaugaacucacuuuuauuuugcucucagugagccucuaguacagugcuaaacacgcagcacauaagcagaaagacucauggauuuugugagggugaaggugaacccuuugcaguguagacaugaggcucuguguaaggacucucauuuaaaugauuuucaacaaacauucauuuucugcuuguuuucucuuucucuuagcccuaauguugugggacagcuggcuaaacagaugauuggguacaaucuagcgacaaaacaaacuccaaaagaaggugugaaaguuaacaagguaauauggauacuuugggucauuuucuauauauguguuaaaaaauagaaaagaaaaccauccuucaguuuuugacagaaucuaaugaaguacugcucuuuggcagugugccauuuuauuuuuuaaagcucaucuaaucuguuuaguaaguaguaugucuuggaggagaaauaaaaagggcucuaugauaguaauauuauuuauuaucauuagcauuuagcaaaaagugggugagggugagugaccgagcaauggcuuucccucugagaacacagaugcauucuauuuaguugagaagcgcuugcugugacagccuuauacucagugagggacauucgcugcucccacacaguggcccucaaccccaggcgugucugucagaauuaccuauugugguuguuuuucuaaaugccccauuccuuauuuuaggaugacuguaauuuugagccauuuuuauugcuggggguauauugcauuaggaaggucagcugaaguacccaaguauguauagcauguggacacacaccccucauccacacauagaaaauaaagcccagaggaaaguggccugccucagucaugaaauugugagugguagagcugagaccagaaccuaacucucccuccugccaaucuaccuuucaccaucccuuuuguguauccagacacuagaacuagcuaccuggguugcagaauccagugccaaauaaaaaggcagggacccguguuaaaauuucaagacagcuauagcuaaacauuaaaucccuuuacaacuacacagaucacaugugucagcccugaaaagcauccaugguuagaagauccuguccuaacagcgaauuaggguccugcauuuugggguggcagcugucugcucuguugacauagcgucacagaucaguggucucuaccaaugcaccaugcugcaggacacugcaguggugacauccuguuuuuacuuuucagggagaguuuuguggaaaacucuuaaguuguuguauuuaucaguauuuaguuccauuuucuuuuguuaauuuuuguggguacauaguagguguauauauuuauaagguacaugagauguuuugauauaggcauacaauguguaauaaucccguuacaguccuuuuucuugcuauguagcaaucuaugauauggauguaccuaccacaguuuguuuaaccaucaucuguugaaagacaucuggguugguucguuuuuggcuauuacaaauaaagccacucuagacauucaugaacagguuuuugguauaaauauaaaucuucauuuugggggauaauuguuggguuauguggaaguuguauaauuaguuuuuuuaagaaacugaugaauguuuuccagcauggcuguuccauuuuacauugccaucagcaauguguaaguggucaggguucuccacauucuagcccgcauuuggugguggugguauuauuuuagccauucuuauggguguguagugauauuucauugugauuuuaauuugcauuucccuaauggcuaaagauguugaacaucuuuucaugugcuuauuugccaucuguagauugugguuggugaauugucuguucauggaugcuauggucugaaugcucccuccaaaaugcauguugaaauuuaauccccauugugguuugcauuaagaggcagagccuuuugggaagugauuagucaugaaggcucugcccucaugaauggauuagugcaggcuuguccaacccacggcccacaggccacaggcaucccaggauggcuuugaaaguggcccaagacaaauuuguaaccuuucuaaacauuaugagauuuuuuuugcaauuuuaguuucuuagcucagcuauuguuaguguuaguguauuuuaugugcggcccaagacaauccuucuuaugccauuguggcccagggaagccaaaauauuggacaucccugguagugcuuuauaaaagggcugaagggaacuagcuuagaccuguuuugcauuuccacuuucugccaugugaggaugaagcaagaaaggccauaucacuaaauggcggugcacugaucuuggacuucccagccuccagaacugugaaacaauauauuuuuguccuuuauaaaugaccaaaucucagguauuuuguaacagcagcaugaagagacaaagcaaauuucuuuuggccauuuucuaauuagauuauguuuuuacuauugaguuuugaguuauucuagguacuaguccacuguuggauaugugcuuuguaaguauuaucuguuacacuauauaacguauauauucauuuuuucaacagggucauuugcagggcaaaaguguuuaauuuugaugaaguccaauacgucaauauuuccuuuauggauuauaccuuuuuaguaucaggucuaaguccucuuuacguugcccuacauaauaaaaauuuucucauguuuuuuucuagauguuuuauaguuuuauguuuuauauuuagguuugugauccauuuugaguugacuuuugaauaaguugugagacuuaggucaagguuauuuuuuaaggggcaaaagggcuaugauauucaauuacuccugcaccauuuuuugaaaaggcuuaucuuuucuccauugaauugcuuuuacaucuuugucaaaauucagcugggcauauuucuuugggucuguuuugggguucucuguuuuguuccauugaucuuuguggcugucccgccaccaauaucacagagucuuaauuacuguauuuauauaaauucugaaauugaguagaauaacucuugucacuuuauucuucuuuuccaaaacaguuuuaccuguucuaguuccuauaccuuuuuauguacaaucuagaacaauuuuaucuuuacgaaaaaaucuugcuaagauuuugauaggaaucuuauuaaaccuguauaugaauuuggagggaauugguuuuuuguuauguuaagccuugcaacccaugaguaugauaugucucuccuucuuuuaggucuccuuugauuuauuucaucagcauuguauuguuuucagcauauacguuugguauauguuuugucagucuuacacauacauuguucucuuuuaaagcaauuacaaguggcauuggauucuuaauuucaguguccaacaugcucauuguuaauugguguugauuucuuuuuaaaugcuuggugaaguucccuagugaaaccaugugagccuggagauuuauuugucugugccuguuaauguuuuuggguugcuggcuucucuagcacccagcacccugccugagauuuaugaggccaaagaaaacauaggagacucacuaccauacgcuuccuuggaccucaagcucccuagcuagucucccuucuucucuauaacuuucagagucaccuuaaguuuuauguauauauauguccaaggcuuuuauuuguacuuagcgggaagaauagggaaaaacaugucuacuccaucuucucaaaaguauaaguccccagauuauagaaccuuuugauucuaaauuuauuucagaagcuauuuaaacacauacacacauuuauacacaucagauauuuguuuucuaagucugugccaauguguuauguauuccuggggcuaguacuagggccugugagacagugcuacucaucaugcgguccaggauucaguaccaauagugguuacugcucuguaaucaauuuaaaauucgagaauguacuuuuaaucuucucuguucauggguguguuacaaauaguuuguacgcuagcacucaucuccugaccacaauuccaguagcaugauauuuuuaaggaaacagauucagcaguagauaggucaaagaaaguuaaaaagcuuucuauacugguggacuccacaaagacgaugugucaacauauucuuuguguaacucacaggugaagcucuuuugaaauguuucuaauggaguugcuccgggaugaguguuuguggauuccauuuagauuucucuguaacacuuccuaauauacucugucauccucggucauuuggaaggcaugacgaugucaacaaacuggucuuuguuguauaaaauuucuugaauuaucucuugauaauuaucauuuuccuggugacauuuucuuaaagagucaugcauuauuccugugaagcaagagcuguuucagacaguagcugggcuucacaaauagaaauuugguggaauacagagcacgucugucaacauuuuugaagauuaagaauaggacucuugaaugacacuuauccuaaaaaguuauaauuuuguguugccucuaagaauaacuacugaaagucauuaaguauuauucucuaaacuaacucugcauuagaaaaugaacaguauuaugccaguagaccugaaagcauauaccaaacacacuccucauuuuguauuuugugccaaucaaauuucuuaaaacagcuuucucuucuagagaaaguuuuagaagaaaugauuaucuuaauuucuuaaaauguuuguauuaauguugaugcuuagaaaggcagacuuuauguuauuucuauaaacgacaaguuguuacuguauuuuauaaggaaagaauagggcuaaguauuuuugcuucaaauauuguccuaccccucaaucagaaauucugaaagaauuuacgguuucaagcaaccugaagacugggagaauuaggcacugacugaugguuugaccuucauuguuggugagaacaaccaacuugaaaucagaaugguucugugcuaauucuaacaccaugugcugagaaacaguuuuuauauacuuaugaacuuccauuucugauaaaucaauaugaagaccuauauauuuuauuuuuaacuaaugguaaauucaacaaaaguuugaaaaagaggaguucuauauucauuccauuauagcuuuuuagaucauuauauauuuaucccauuucaugugaccuaaaacuuaaguguuuuugugguaucugaguaguuaaaaucuaaugcuacuuaaucuguaacuuuuuuuuguggaacccaucacuaaacuacuuguaaaaaaagcaauguggccgggugcguuggcucacacuuguaauccgagcacuuuggaggcggaggugggcgaaucacgaggucaggagauugagaccauggugaaaccccgucucuacuaaaaauacaaaacaauuaggccaggcacgguggcucaugccuguaaucccagcacuuugggaggccgaggcgggcggaucacgaggucaggagauugagaccaucuggcuaacauggugaaaccccgucuccacuaaaaaauacaaaaaaauuagccgggugugguggcgggcaccuguagucccagcuacuugggaggcugaggcaggagaauggcguaaaucugguaggcagagcuugcagugagccgagaucgcgccacugcacuccagccugggcgacagagcgagacucugucucaacaaaaaaaaaaaaaaaaagaaagaaaagcaauguuagugcuuucauuguuuucacaucuauuacugauuauuuaugggauuguuuuuauauucuuuaaacauccaagauaucuuucacuguucuuguuaggugcguaaguuggaacaaccucucucaagcacuuugacaguacuuaucaacauuuuaaauauucacaguuuaaaaccuagacauuucacuuuuaggauacuuaucuacagggauacuaaaagaaaugaacaaagauacauguacaaaaauacucacuaaaguagcauuuuaggaaaauugaaguucauguaaaugucugucagcaggccaggcaccaugacucaugccuguaaucccaacacuuugggaaucuuaggcgaguguauugcuugaguccaggaguuugagaucagccugggcaacauagcaagaccccaucucuacaaaaaauaaagcaaaaauuaaguggcuauggaggcacgugccuguaguuucagcuacucaggagauucguuugaaccugggaggucaaggcugcagugagccacgauugugccauugcacuccagccugagagcaacacagcaagaccaucucaaaaugaauaaacaaauaaauaaauagauaaauaaauaaauaaaugcaggaacaugguuaaauaaauauugucauauaaauaccauguaaucacaaugaagagagaagaccuuagaaagauauuuaaguuguaguauuaagauuuuaaaaaagaggccaggcgugguggcuuaccucuguaaucccagcaguuugguaggcugaggcagguagauacuugaagucagcaguucaagaccagccuggccaacauggugaauccccaucucuacuaaaaauacaaaaauuagccaagcaugguggcaggcaccuguaagcccagcuacucgggaggcugaagcaugagaauugcuugaacaugggaggcagagguugcagggaggcagagguuguagggagcugagaucgugccacugcacuacagccucagugacagagugagacucugucuuuuuuuaaaaaaaaaaaagauuaaaaaaaagaaaggcauccuguuguauauaaugugcuuccacauguaggauuauuccauuacugcaaugcuugcagauacauagaaaaggacuagaaugucagcagugguuuuuccugguggggcuguuacaugaaauucaaguccuacagagcaaaaggacaccuggcugaggcagugaguccccacucacuuguggaauugaaugacauucuuccaucccacuuguccccugucuagucauggcccuggcaaaugaccacauauucccagaggaaggggugccuuuuucuaguuaucacggagguuccugguaggcucguaucugcccugacuccuggggcccgaggguuuauuugagguagagcugugcagcaggaagcugcuuucacuuucucauuuauauauuuuugguaucguuugcauuauuuuugaacaagcaaauauucuuuuuauaaauuaaaaggaaguauaaaaugaaguaaaauauagugaucgaagagacagaaauacacaaacauaugaagcaucagacauacuguaaaagaauccgucuguggcaaucaugcuugguuuuccaccagugaaaucugagaaaagucaguguaguaauauauauguguacuguuaauaucucaaauuaaaauaacagccacuucucuaggguauuucuuaagugacacaguuucuugaggaaggacaaaaaagaagauuaaagugggaagguuccuugaggcaaacgaaauaccugucacucgaacaaguuaaugggaucaaaauuaaggaggugaaaaugggcauugugugcaccaugagagcagaacucucaaagcucugcaaacucacucccugggcuguaagagccugaaaaugaagccauuugauucguguagcaaguuuguauagauuuccaaguagaaaucagcuuaaugcugaauuaauuugacuuucccacuaaugugguaggugaugguugcugaagccuuggauauuuccagagaaaccuaccuggcaauucugauggaccgguccugcaauggccccgugcuggugggcagcccccaggggggcgucgacauugaagagguggcugcuucaaacccggagcucauuuuuaagguauguuuaaauuccgggcuaccugcuauuaauugauuguuauuguagaagcuguuaaauauuuaauggggagucuaaggccaggagcacuaaaucugucucuacaauuuaagguaagaagaugcugagcccuuuuucuuucuggguauccaguugaaaguuggguggaaucaagguauucaguguucaaggacuuuuuaucuuugcuuuucccacccuuccuucuuuacuucuuccugccuuuucuuccucccugauuccuuuccauccaaucuuccucaagaauuaaccaaugggagaggacugcuauauuuucauuucuuaugguuaacucucuuucauuuaauauuauauaugauccggaaauucucuccuaggagaugaaugaauucucuuuuagcagaugugaacuagaaacugucuugaguucucucaguacucuugauguaaacuagaaucuuuaugaagucuagauucuaucaguuuuuuucaauccuugaaaucuugacucauuuauugauauuaagauuaguuucaagucagagaucugaggucaaauuuaaucagagcacaaguuucucaaagucuccaaaccucauuuuuaaaucaguaaaaugaacauggggugauuucuaccaugugagauuauaaggauuaaaugaggugauguguauaaagugcuucuuaaccuacgucagcuaugaggagaaaaacauaaguuuucagaacuaaaauugaaguuuuuaaucuggguucuuggggucaaaauuacauuacaauuuuccaccagaaacauucauuauuucuuuuagaaaaugauuuuuuuguuucccuuugagaaggggagauuuuauuucuuaaaucucuuugucuaaauaauguacaauaaacacccacuuagcauccucaacagguucuuggaaacugcgacuugaauggaaacgauguauaaggaaaccaauguuaccauacauaggcuaauugauauaaacaagaguuaaguuccuauagcauauuucugcucacagaacaucacucaacuccuaaauaaagaccagcacacuucuaauguuacacauuaaaauaaauaggagcuauauguacguuucagaaagauuucauaaaaacaaguaagauaauuguuuauccaguuuuuccagcuuagggucucugauggcuggagcacagggugcaagguaagagcccacccuggaugggacaccaucccauugcagagcacacuuacacaccacacccacucagacugggacuguguauacaugccaguugaccuaacauguacagauuugggaugugggagaaaaccgggggacccagagaaaaccuacucagacaagaggggaauguguagacuacacagagacaguggccuuggcugggaauugauuuuuuuuuuucucaaccuuauaacaaaacgaccuugaaugaaguaacguuauuugaagaccugcuguacucauacugcagugauugguuuuaaaauauuuucacuaauauuauauaauaaguuaauuaccuuggaaacugaauugagacuuuauaugcagacuuaccaacaacaccuagcuguuuucaaaguucacauuauuuaaagcaggccauuccauuuguuaagagaaugcaugaaauaauguauagugacagugcucggugucuuugagacaauaucauuuuguagagcuaagguaacaguaauaauuaucaucaauagaguguuuaaaucauaagguaauauuuaaccuaucuaugacaggcuuuaaacuuaacuacuaguaggcaggaaaaccuuacuuuggaaaccuuccaaaagaugucaaaaaauuaacugacuaaauauucaucaaugccaucuguauaguaauuaaaagugaaaacuggcaucagauuuucuugucagcaugccaccaugaagaauuauauaguuuuuggaagggcuuuuuuauagauggucugcuaauuaaaacauacccuacaggcaucugcgguagcccugcucagagaucucuggauagaugccacacuuuaauuacucauuugcaaauaaauacuaagcauuuucuuuugagguuguaaaucuucucaguugacugucugaauuuuguuuauuugauuuauuuuuacuaggagcaaauugacauuuuugaaggaauaaaggacagccaagcucagcggauggccgaaaaucuaggcuucguugggccuuugaaaagccagguauauaagccauugggggauggugugucugacuuguuucagaaaacauuugggaacuugcuucauugccucuaguguuugugauuaccaggaaacaggauuauuuauuguuuuauaauuuuuuccuccagcuguuuaugaugaagaaaaauauuucccugauguuuuaaaagaggauguuuaugaugugucuuugaauguguuuugguaugugugugcauguguauugcauguggacacauacacuucaugauagaugguaaucucuauuuuuucuguagcauugcugguacuuagccaccuggcaggcaugugauacagcucauucgaacuuuaguuucaucaucuauaaaaugggaaugaugacaacucccgagaggcuuauuguggggauucaguagaauaauguguaaaaguccuuauuguacugcuccauaaaggucuguucuuaaugguauuaauauuaauaauacauguuauuuagcuaauugcuauucuuucauagcuaaugggcauuugaaaugaauauugauggcauaaacuugauauuuuauugagaacagcuuaaaauaugccaauuuuguaauaauaucccuuggcuucaaagaccaaaacauuggccucagagcuguugagggacagaaucugucuuaguaucguccccugcucugccuuuguuccagcccauggcaccugauuaugugucuaguggggcaagcuuccuagucccacagcuaaaucagauaaacuuacuuguuccuuccucuguuacucagagaggccaccuuaauggcccuagauuguguguaugugugcauguguguauguucucuggccuggggcuuuaugaaaagguuacagaguauguccuuuaauuugguugggcagcacuauucccauaagacaguacaugaugcacucuuuucuuucugucuugucuuuuucuuuugauugacucucucuggaaguuuaauggcaacaguaggcaagucaaagagggauaaaacagaauaagguuuuaaaaaauauauaugcuuaaaugaagggaaaccacuuacuugaaaaugaauaaaggcucacuuugaaagcaaaagauugaagaugguagaauggaacagggucaucuggaacuaaaccucaggaugagagagaaagggccaggauucgauggacaguuagaggaacuaauugccauuucugagacuagcaaagagaugccaggaaagugaucuguugaaaggaagauccuggaagauuccugaauaugugcuacagugguugguuucaccuccugagaaugaggauaccagcuacauuagccauucauuugauguuuauuaaggggcuucuccuguagcagugguggucaccaagagcccguuuuccauacagccacuguggucuagcugcacugucuggcagucagcuccagaguugcacagugacccugucugccuccuccauaucacuuuggacaucuguauauuucucuuauuuauuugcagucaccuuugcuagauccuaaucuuuaccacggcagggacuuuguccauccuacucacugcuguguugccagcagcuggcaaagugcuuggcaucuauuuuuauugcccaagaaacauuugucaugugcaugacuaggugaaacaacacuucuagguguccacuuugaagaaguuccuagaggcucagcaauagguggcuuuucauggcagauaaauaaaucuggagugggcaaaaucugcugaccacauauuuaaaagcucaggaggugaacauaauagagaguucuagagaaguuaauaacaguauaauguacaucacaagauacugcccccucacuacauauuauacgagaaaauuaagaguuauuuacagcucuuaaauggcuuauucuuguuuuccugguaccugaaacacucuagguuuuaaaugaguuaccuauggaaggaagacgaauaugugagaacugagggauaaguaaguggccauauugucaguauaccuuugaauuaauuuaucgaggaaaggaaauaaaauguuuuaauuuguuuuuuucuuuuuucacugcuaacuccaugaaaggcuuuaaaucuucauuuucucagcagcuuggaaugagcacugauagggugcugcucagucugcugugccuuggggaaaagagacaaugaaaaauaaccauuguuccucaggggcucacagaccgguagauaucugccugcuggcugagaggauacaggaagagggacggauaaaggaaugugaaggagagagugggggagggggcagcgggcagagggagagagagguugaucucagcuguagacauguuggaaguuguucaucuagggacaccugaguguauuucuacaguagaagggauauauggcuugggaucccagggaaagcugugcauuagaguuguaggcuugggaaucucugcuuuauggggcuugcucaagcuguggggauuagugaaaugcucuagagggccaguguacaaugagcagaugggacaguguagaagggaaaacauuuaaacaaucaucaaugaucuuuuccuaaggaaauaguaucuuagagguaccuuagguucaacgugacuuugaaaguuaaguuacuuaauuuucaucuaggaugugguuuaggcauuuggagguaccucacucaugguugaauaucauauaaaaugauagucuuauaaaauuauuaauaucuuuccugugacucaugccuguugucucuaaaaugugaugaauauuagacauaacaaaaauaaagaugauacuuugcuuuacauaaaaauuaccaguguuuguucccaaccaaagucucuuucugugagaauuuguugaaaaacguuaagacauaggaaagcuuaauauaguaguucccccuuaucuguggaggauacgucccaagacuuccaguggaugccugaagcuuaccuacuaccaaacccuauauauacucuuuuuuucuggauauucuagauauuuauacuuaggauaaauuuugacuuauaaauuagguacaguaagauauuaacaacaguaugaaauagaacaauagcaauauacuguaauaaaagugaugugaauauggucucuuucucaaaauaccucauuguacuguacucacccuucuugcgaugaugugagaugaugcaaugucuacaugguaagacguggggugagugaugugagcauugcgauguagcauugggcuucucaugaccuccuggcaauacuucgugagggacaucuacuuuggaugauccuggaucaucaaaccaugggugucaauggcuggaugucaggaacagaugaugucaauggucagggauccuggauagcugaagguuuuucaccacaaccuuuuagaagaacaucauaauuagaaguuugucucuuucuuuuuaggucaucuaaguguggcuguagagguuguaauccgucagugacuuuagugcuguguuccauccaaggaucuuauuccauaauuuuguccuuuccauuuaauaacuuggaccucaguagaccauggguaacuaaaaccacagaaagggaaacugaggauaaagggugacuauuguaugacugaaacuuacaaguuugucaagugugucuuaauuaucaucuauacuguucauuucugaaaacaugagugccacgaauugucaacaugugccucuaagguuuaggcugaugaaaagaucggaugguccaagucagugcaagaucacuaacaccucuugaagugguuuguacuucuggcuagauuugagaggcguacgugaauauugaugauaauuucuggaaugcaagaaaaauauuuaaaauucuuaaccuguugagauuuuuguuugauuaauagacgauuuauuucagcaagaauacacauagucaucauugccagacuuaauaugagauguuaaauguuugauccaauuuuccuuccuggauaaguuuuucuuuccuauuccugucaguuuugaauacaucauaccagaagaacaggugccuaauuccacacaaagcucccaagagugaguuuuuaggggugaaauuaggauagacauuugcugaucuugcauagguccaacaaaucaaggcaggaucuucaaugagccgucagcaguuagggucguuguacugaagcaaguacugcuguuucagcugugcucuuauggccaaccgcucggcuugcgccugcuggguuuccagggauaugucguauuccgcuggguagagggucgaggguggaguggccaggcgcgauggaguauacuuugggaauggcaucuuggcgaugcagcgcacaacugugccugcacgauucugaggccauuccuccuuaugcuccuuuugagacauuuuuaaagauuuuuauaaacuugucagauuuucauguacguauauuugauuuuacgaauuuuaauuuuuaaaaauuacuuaacagacaaaauaacaauugauggcaaaagugcagaaaaacuuuuuguacgcagugguuaugagcugagaaauagauggcaguaguaagcgacugacugcaaguugaccaggagaauguuuucuuugaccugugcuuauuuuuaacuuuuguagaaagugggaauacuaaucucaacuugccacaugccaugccauucccuguuacaccuggucacacacauucugucugcuuagcccuuauaaccauuuagugaauagccucuggaauaagacaucuuacaaggguuugucauugugagaucuacaagggagaaccagcuugguuuggagaugucuccaagaucagauuauguuuuagucuugcucaaaaaaauuauggucugccuuugugcaacaguaaaaauuaaaacagaaaauauccccaaaaugcugugcuaauguauaauuacaaugggauuaaugugcagaaaaugcagccuuguacuaagcaaaauugguguaggcuuaagaaguucugaaacaauuuaaguguguaucuguggaugaauggauaaacaaaaugugguauauacuauaauggaacuuuacugaaccuuguaaaagaagauucugacacaugcugcaguauggauggggcuugaggacauuaugcuaagugaaauaagccaguuacaaaaagacaaacacuggaugauuccacagguaucuaguguauguauauauaugcauaucuuuuauuuuauguauguauguauauagagaucucuaauaucucuauauaucugguaucuauauauaucuauacguauuaucuauauacauauauauggagauauauauggagagauauauaugugcguauauauagaggggggugugugugugugaaaauauauauauauauggagauggagagagaggcagagagagagaugcuaucuagaauagucaaauuuauagacacaaaguagaaugauguugccagaggcagugggaagagaagaacgggaguuuguuuagcgauacagagugugagggaagaugaagaaguucuaggaauugguugcacagcaaugugaauguaccaacuugacccugcagaacuguguagacaaaaaugguugagauauggugaauuuuauguuuuguauauuuuaucacaauuuuuuaaaaaggaaguuuugaaguagcuggauuagauuauacauauauauauauauguguacccagaaguuauuucuauuauguaguccccacuuagaacugaauuaaucuuuaauucaaccgauauuuaucgaguguugacucugcagagguuguaucacuacaguggaugccaaggugcccaggauacauaagaugccugccccaugcaacucacauugcaaggucacauugaugaccuagaaaacccccuaaaauacaaaaaauauuccgcaaugaaguauuugcuggcuucgcacuuuaacucaaauuuuauuuggauuaaaaaaauggaagaaauuauaaagaauacuagaaaaaauaaugggagaauuuuuaaaaauacucucagaaugggacuagccuuuuaaaagucugacacaaagccagaagccauauaagagugacauuauugugaaauuuccauguggcaaaaguaacaaaagcauguucaaaagguaaauguuaaaggggcugagacaagaggauugcuugagaccaggaauucaagagcagccuggguaacauagcgagacccccaucucuagaaaaaauuaaaauaaaaaauuagcucagccuaguggcaugugccuguaguccagcuauuugaaaggcugaggugggaggaucaucugagcccaggaguucaaggcugcagugagccaugauuaugccaguacgcuccagucuaggugacaaagcaacacucucuuguacacacacacacacccccccacacacgcacacucacacucuuccuauaaauuaauaagggaccaaaaucucaauagaaaaauaggcaaaauucacacaaaaaaaauaagaugucucuuaaacucauagaauaaugccuaaacucauucauaauaaaauaaauucaaauuaaaacuauaugugaguguacucgucuguucucacgcugauaauaaagacauacccgugacuggauaauuuaugaaggaaagagguuuaauuuacuuacaauuccacauggcuggggaagccucacaaucaugguggaagacgaaggaagagugaagggacuucuuacaugguggcaggcaagagagcuugugcagaggaacccccccuuuauaaaaccaccagaucucgugagacuuacucacuaucaugagaacagcaugggaaaaucccguccccaugauucaguuaccucccacugggucccuccugcaacacgugggaauuauuacaauucaaggugagauuuggauggggacacagagcccaaccauaccagugagauacccuuuuucaccuaacacacugacaaagauacaaauggcuaaugauugugaauuggaaaauagugucucugauaauuuucacuuuuuaggaguggaaaucagggacagcuucuaugaagaacaauuuaggccgggcgcaguggcucaugccuguaaucccagcaccuuugggaggcugaggugggcagauuacgaggucaggagauugagaccauccuggccaacguggugaaaacccgucucuacuaaaauauaaaaaauuagccaggcuugguggcacaccuguaguccuagcuacucgggaggcugaggcaggggaauugcuugaacccggcagguggagguugcagugagcugagaucgcgccauugcacuccaggcuggcaacacugcaagucucggucucaaaaaaaaaaaaaaaaaaaagaacaauuuaacagaaccuuuugauguuuaaaauggcuacauuccuuuuugcuucacucuggguaauuuauccuacaaauguuuaaucacauguauguuaaauauacagagauaaauaaggcagugcuguaaugucaaccuauuagaaacaaugcaguuggucauuauuuaagugaaagguuaaaggaauuauagcauaucaauacaguaagauauuauuuagucaauuaaaaagauaugauugaucuaccuguguugcugaugaagugucucuaaaauucuguuaaguaaagagguauuggaacaaguuugcuuuuuuaagacagaugaaggaggaaugcguacuguguuaggcauagacugucucucauaugaaggcuaaauuuaugaguuggcugccacugggggccugugugguugagugguacaaucagggaaaacccuuaaguucuucgggaauuuuguaucauauacauguauuaucuaccuaugcaaauauuuaauauuaaaaauauuuaaucauacucauuauguggguucguuuauaucuacuagcccucaaauuuggauuuaaaaauguuuguagguguuuauaaaauacauuaagauagcaugaauuaaaucuggaguucuucagucaaaucuggaaccacuugcaauauuuacaccaguggggauuuacuuuagggauguguuucauaggcgcugcaagagcugaguacuuuaagaguugacagaaaggcaaccuaaagcauauccaaccacaugcuccaggaacaaaaaugaggcagugguguuacuggaccuuguauacagaagcuagagcccuggugggcuucuccagugggagcaacagccagaggaggaggugcugcccagauagaaagagaggaguggaaguacccuggcucuucccuucuucccaccuccaucucucaccacugcuugccauuggcugaccccagcuggaaaccagcugacccaggaaccuagaaaacucagccuguaagagucaccuucucugauauacagaguagaguuggagaacugaaaacggaucugcugcaaguaauccgaggcuggcacaaugagugaaauguggcagugggaaaacuuuggcuuggaaaauggagcugggaaugagacugauaccuaauucuucuccacgauccacccucuugcucugugcaucacaugcuccuuuuguuauugccaggagcuuuccaggguaggggcauggcucauucaugcucuuauuucaagcgccagcucacaagauaccagcuugcugugucauaggcaguggagaaauguugguugaaaagaaugaaugaaugaaugagugaauuucaagcagaggugagaaaaaugaagucagggcauaacagggcaaccuuggauauucuugcccuuugugguuaaugccuuugggacaagcuauuuucaguuugaacuugugcuguucaguaacuacacuauuaagcacuuucaucuuccuguuuugcaacaauuuucauuagacacucaguaauuguuguuucacagauuauggguuggauugaugaauauaauaacuguuuuauuucagcacaauaaggaaaaccuagucauuauaaacucucaaaaucauguuuaccuuuuacuuaaauggagcuuguuuguauuaaugauuguaauuuauauugcagcauaacucugcuaauagagacaugauaauuuacaaaaagauuaacaacguuuuaggccguacugaaaauauuuucuuuucuugauaauggucucuucuggugucuagaggagagcugagcaauuccuuuuaaugaauagcaguggaaauuaaaauaauuaugcuuuucuguuuuucccuucagaaaaccuaacugaaaauaaagacauaacuugcuauuuuuaagguuucauuaauccagcaaaauaaauuuucuuuuacugcuuugguguaauucuauuucacuugaucacauuuaggcugcagaucaaauuacgaagcuguauaaucucuuccugaaaauugaugcuacucagguggaagugaaucccuuuggugaaacuccagaaggacaagguaaaaaaaaaaaagaauugagaaaacaaaugaauguauuauaauuauuuaugcaaacuauaaauugcacaaaagacuguagcagcagcuuugcauaaauuucuuucaguaauuuaauuucugccauaguuugaaaugcucccaugaugcaguugaacauuucagcacuuagguuuguuuguagccaaaugccaagccucuaaggaagcuacugcuuguuuuacuuaaaaacauucaggcuuggugugguggcucaugccuguaaucccagcacuuugggaggacaaggcgggaggaucacuugaggccaagacuuugagacuagccuggguaacauauugagacccugucucuacaaaaauaauaauaauaauaauaaauaauaaaaggaaagaaacauucguucaccucuuucucuccaccuuauuuuuuuaggcccaucacugcugcuacuaagguaaagauuuguguagaaaugggagccacacacuuggguguaaugaaggcauaugccuuuauggaacuggaacuuuucgaacgucuuuaguuugccuaaaucuguauauaauuucaccuuguguucugggcuggauuuauaucaccuugguaaagccccaagucccccccaguugaacucuuucaccuuacuuggagagcaguuucugcuucaggcaggaggagguggcauuuuuguggugaagguuucuccuauccaucagguaguuguagaguauaaauaacuuuuauauaucaguaccuaccaccacugcacuguuucuugcauacagcaaauauuccauaaguucuuauuaauuugauagcaaaagcuuguaaaugugugugugguaagggguaaaguggaguucuacacacaaauucacaagcuuuugcugucaaaacaguggaauggcagguggauaggauagggauaccagacuguaagcaccaugaaccuuuucuuuuuuaguacauuucaccuccggugucuugcauguugucuagcuuguuacagucaguaaauaguaauuugcauugaauuguuaacuggggugaaucauuauguguaaacacaucaacuuuuggaccaagacggaugagacaauauuuucuccuuagcacauuucagagauucuguagcuagacucagagaaacuacacuaucauuuccuucgaacccagagaggccuaaguauaaauucuguaucugccauguuuuggcuacggaucugggcaaguuauuuagccugccuaaguuucaggucuuuuuuuuuuuuuucaaucuuuucaaucaaauaagugguagaaaugaugucuagcucauagaguguugugaaaauaagaugaaaucauauaugaguaugcaugcagugucagauacaaaauaggcuagucccuaacauucauaaaaugaaauuccucuucucagguagucucagaguagcccaggaauaguauagauuucagacgagaacaagcaaagauuuuauguuuaggaagccauugaagauaauauauuucaugauuuauacagaugaccauccgauagaaaucugugcuugcucauuuauaaacaagcuaccuuuauucauaaauauuuuuuuuaaaguugcuauggcuaucaaauuguguguauuuuauaaagcuaagaaaggaaggggaagaagcuguuucuugagcuuauaugccagacacugugauaagcuuauaccuauauucuuucauauuguuuaccacaacccugaaaaauuaggaguuguuauccccauuuuauagaggauugagaaaccauugugacugucccaggggcuagucagaaguuacaaaagcugggauuugaacccaugucccucugaguccagcgugcauauugauucugauacuccagacucaacugcagcuaccugccuuuucuacuuucucccauuuaaacuacuuauuugcuuucacguacaugaccuagaaguagucuccaguuuggcagggaauaccagucagaauucauguugacaauuaaauccaagaaaugaaggagaagguuuaacaaaaguucuuaaaggucauauauugcuuuuucaacuaguauacacaagcagccugguugcuuugcaugaagaaaaauggaaauguagcuguagcuauggagugggauaaaaauggcugcaauacauuuuuuauucaacccuuugggaagcagucacgagcuguguucucgcuucagggaacagggguaugggaaccuuuucuuagacuguguuuauaaaacgucaugagucugaaguuugauuuuuaauuauuaagagaauggaagagucuugagauuuuuuuuuaagggaaucaucauaaaacauuauauacaguucauuaaaacauaagucuuaugugauauuuuuaagagcaaaauuaucuuuaguuauuaauuuguucauuguaccauaaaaguucagcaauugaauuauaaucacaauuaaaugaguauguugguuuauaacucuaaugagcaguagucaaauuaaacccaauuaggaaauggugauuaaugaccaaauguacaaauugaucuucaucauuaucacaguccccucaagcuaucuuuuauuuagaagcuguaaaagcagucauuuauauuuuagcaauauugauaaucuuaauauuuauaaucugaguauuuguuaguucuguuuagaucaguaguagcagaacauuucacgguaaaauuuccacauugaaacuuugauuuaauaauuauucuuuaaauuuaaaaguuuaaggagcucagcaucacauuguaccagcucuuuuuuguuguuguuguuucuuuuucuuuuucuuuuucuuuuuuauuuuugagacagggucucacucugucgccaaggcuggagugcagugguacagccucagcucacugcagccuccaccucccgaguucaagugauucuccuacgucagccucccgaguaucugggauuacaggcgcccaccaccgcgcccagcuaauuuuuguauuuuuaguagagacgggguuucaccacguuggccaggcuggucucgaacuccugaccucaggugauccacccaccucggccucccaaagugcugggauuacaggugugauccauugugccuggccuguacccaccucuuuguaggaaacuuuuuuugaccuuccauuggucagugagugcuauuuuuaauaauucagguuauuguucauauauuuguacaacaagugaugccguguugagugaagaacaagggccuugauaacaucuaugcugcuaagucacccauagggaauuuuugacacggagaaagaacugcaguccaagagcucuuuuuuccuaugugauuaauaaucugauucaaaaaauauaauuugacacuacuaacugcaauguaguuuagugacucuuagcuaggauuauaaugguugcuaaugacagaaaguuauauuagcuuuguuuuuguuaaaaaguuauauuccuguaacagggaagucuaagguguggacuggcuuaaggccugaagagaaucagggauuugcugguucuccagcccugcuugccuccaaauuggcuucuuucucagccaggcucucagaagcuggcagcaaagauggcucccagugcuccauaacucucccucagcagccccauaaaucccuucaaaugauucucauugacccugcuugggucacaugucuaugcccaugccagccacugagcaagaaucauaugguauaggagacauacaguuucuuaauggaagaagggacacugagucaaaacaugccuaccagaaagaugcaaccuuauugaaacaaaaauaaacuguuacuuagucaauagaaauuaaucguuauuuuccuuguuuguccaaaugcagugccaauucauucauuaauucugcagccaagcaagaagcaauguuuuaucauuauuuauuuauuuaucuaccugcgcauucauguauucauucauucauuuugcuagccacugugaaauuucaugucauauuucuucucaccuucagccagcucuaucuguacacagacuccuuuuucugaugucuuuaaagcaaguuguacuccaugggaagggugggcauuuugucccccagggaacauuuuuagucaucacaacuuggaggcuaugcuacuggcguggauaaugcuaaacuacaacgcacaggauggucccuguucacagagaacgaccucacccaaucuguccauagucuagagauuaagaauucuugcuuuggggcaucuucaucaguuggaagcugaaauccauucacugggccaaaggaaugagauccaauuugaagcagugacuaucuggcuaagauuccgugagaauuaaagcugggugauccacaguuaacuggcacaucaaauuccuuucuuucuucggauugauuucccuaaauaaccaccccguugcuucuuguuagcaagugcccauguuguugguggguguuucucuguuucugucuuuauacacaagacucuauuuucaagaacauuuucgguucucuaccucccccaaccccccuacccaccccauaccuauuuucucuuuucacagccacuaaaaaaaaguucuaaaaaguauacaacucucagaacaucaauauuuaaugggaagugggacuaauuugaaaguaucagcauuuuaaggccauuuuggcaaggcguguuucaauaguacauuaugguuauuuaucacaaaucaaacgcaguacguugcuugaagacagauuauuuuucaaacuaauuaugauagucuuauuuccugcuguuuuauguuccuuuuauguguaaguuuccccucugaaauguauucuucuuuuguuuaauucugugacacauucuucuguuaaaauucuagggucagaggccucuaacugccagucauguuuucuaucgagauuguugaauuagcagcucacagaaucucacgccacuaaacaaaacaacaaaacacccuaugcauauaaguaccacagcuuucuuugauauucguucagaaggaaaauacauuuguauaaucuaucaagcauguaacaaugugcuuuugauggugaaaauuguuuuauaaauauuaauagguauguuucuuucacccacuuuguauaaaaaauggccuuuguucaagaugaauuuucuuuagaauugaguuucauuaaugugacguugacaaucuuaagguccggaccaagcucagcaccucugaaaaugcauuuuguauuguuuguuguuuuauuaaaugagaaagcuaaggguuuaagcaggcaaguuuauuuuaucgcccugcuguugacauagacaucaauccauuuuuaacacgucaauucaagaagugcauuuagaagcgucuuacaggaggaaauaagcauguaagagucaguuaguauuccaggauuaaucuacuccuuuugcguagccacagguuuuuauuuauuuucuuuguuauuuuacuuuuuuuuugguuuucauguuaauggaaugcacuuuuucuaaguuucuccuucacuauaaaauaugacaccuguguaucuaucacuugguucacacaaguggauacaagugugagaacugugacuuagcagggauuggcaaacuuuuucugucaaggaccaguuaguaaauauuuggggguuugcgggccauacagucuguauugcaacuacucaccucugcuuuugucuugggaaggcagccauaggcaauaugaacgaggcuauguuccaaucuguuauucauaaaaauagggcuggcuugagggucuuaguugcuacccuuugcuuagaucuucauuuggagcuauucuguaccaaucuuuagccuuggccuuaugcacaggugugaugugauuugagagucaccaacagccuauuuuacccuuaucuuuuagccaaaaaucuuguuuucuacuauuuaugaugccuaaaaugccaacuauuaauauucuuccuuugggaaaauucuuauucauucagaagauggcuuuuuauugaaaaccauggguaaccuguacauauguaaacuaugggagacauuugcuuagauuugcucuaaacagaaaucucagauuauaaaggaacagauaauuuuuauuguuaggaagagaggagaguucuguagccugggcuacaauaaugggaagcucuuaaguauaaaaaagcaugugcauauuagagggugguguggucgucuaacaaccugcuaguacccacugucuaggaagcuaagcgcuuugcauacaaucucuccugccaccaacaccuagaguagaacauacucugauccccauuguauagacaaggcucggguuuaagagagguuaaugugcuuaaggauagcuggcuaggaagugccaggaguugucauuuauacccugauauuuuugaugccagucuauauuaaguggucagguucaaggaaaaucauuuagauggcacaacauuguagauaguaagauaggaaagcacuuuguuuguuugguacuauguauaauagggaaaaacaaacauuuuucuccuaccaaacucucaacacagaagaacacuucuuggaccagaugugugaguuuuuccaacacugacuaaucucugacacuagcuagguauccuaugauucaauucaauucuuuuaccaucuaccuggaauuagagucagaucccauagguuaaggggucagucuuaucagacugacuccacuuuggaugucauuuguaagaccaagccucugguacuucugaugaaccagcuguaaauuggggguucuuaggacucccuccuugugccccaucauuuacuagaauggcucucagaacccagggaagcacuuuacuuacuacugcugauuuauuauaaagguuauuuuauuuuuuaucuuauuuuuuuauaaaggauauuuuaaaugauacaaaggaauagccagaugaagagguauauggggcaggguaugcaugaaggggugacaagcuucccuguacuccacaggugagccacccuguagcaccucccuguguuuggcaaccuguaagcucuccaguccccuggaguugagaaauuuuuauggaggcuuuauuacauagggaugaucuguuauucuuucuggagcauggagguggggcugaaauuuccaagcuucuaaucauaguuuggucuuucuggcgaccagccccauacagaagccuccaccaagacuuaccuuaauagaacaaaagacucuccuaucucccagaaaaucccaagggauuaggagcucugcaucaggaaucagggucaaaggccaaauguuagaacacaagauucuccuagcaccccuauugcuuaggaaaucacaaggguuuuagagcucuaugcuaggaauuagggaugaagaccaaaauaauauauuuauuauaaaucacaguaucacagacuacuuuuaaaauauaaaacaggcguaacaaauaugugucugaaagaaucccuuuacauccuuaaaguuuuucuucccuuacccacuaaguaaagacuggggucuugaagguggcaguucaauuugaauccccuuucuuaaguccuaaguccucuaaauaaauuacuucauauuuagguaguguuuuuaacuucccaaaacacuuagacauacaugcaaugauccaauuagguuguuuaguuuucucuacaaauuaacagucggcacaggaccguuguagauauacaccccuuuuaucccauagucaccaucuugaagcucuggguuaacugcaaaguucugucaagauuguucccuggagagaacgucauaccacagaaaaacauccucugaaaaucuagcuuugcaggcauuuaguugggauugccuuuugaacuuugaauacauacccauuaauuauucucucucugaagcagcuuguaacuguagucuuuguaaggagcaaaggucagcuugaaacuauuuugauuuacuuguuuauugaucucaaccaagaauuccuuuauuugaaacucuucccuuaggaagucaauuugauaaccuuagcccauucauuuugaaggugucaguuauaaguagucuugccaaugaguaauggaggagcuaaaauuacuaauaaauuaauuagaaugcauuuauaaaccuaguggaaagccauguacgaaguugcuuuuuuauugauuauuauaccagucauuaacugcugagaaaauuccccuguagcaagcagagaacauuggccaauucguuugguaauuguaggauucugucaauaagcuuucaauauuuuggaaaguaauuacucauucacuccaaccauucacaauguguggacaaagugguugggcauuuuggggcaagacuaaggauuuaagcagacauuaacuuccauauaagauucucucuugucgcucagugcuacuuuaagucaugugcggucuauauauauacuuauaacaaguauucuuagauguuaauaugcuggucuacacagauuuguaucaaagugcuugaauauugugguagggaaacccuuggagaaaacccucuaccuggggucucuaacgccaagaugccauauacagccauguuuuauuuucauaagaagcaaguauaauuaggagauuauagccacugcuuuucagugagugagaaauguucuguggcuguuucccuuucaagagucaggugccugucagcaaugcuggaggagaauagguaguaucuguaaauuauuguucaaagauuccuggcuaucaauaucccaaguuaaguaaaagaacauuggccaggugcaguggcucacaccuguaaucccagcacuuugggaggcugaggugggcagaucacaaggucaggagaucgagaccauccuggcuaacacggugaaaccccaucuguacuaaaaauacaaaaaauuaccugggcaugguggcacaugccuguagucccagcugcuugggagacugaggcaggagaaucgcuugaaccugggagguggagguuauagugagccgagauugcgccacugcacuccagccugggcagcagagugagacucugucuccgaaauaaauaaauaaauaaauaaauaaacaaacaaacaaacauuaugaugacauggcaucacagaacacuaauuucuacacuaagagagauaauaaaaggggucagauacccagauaccaauaaugccacccucuccacugcagucucucccugauuguauguauaggagaucuguaaaucaaggaaagugcccuguagucugucuccuauuauggaaugaguuuugcuggguccaggagauuuccaccagcuccagaaacuagagacaauugugcuaauaaugccuggcauccuggcuuugugacugaccagucuuggucuuuucgugucuuauaacuugaaucugaagcaccauaagaugguccugcacgaaucaagggcauggcccuuguuuuaaggauuguuauugccauuuuuuccaauuaaaaaaccaaggcccagagaagaacuagguuauuuuaucaagguuacagaguuaguaauguaugcuggaaauugcuaaaaguauauauuuuaagugcucucccacaccaaaaagaaaaaccaaaaacuauaugagaagauggauguguuaauuugcuucaguguaguaaucauuucacuguguuuaauuauuucacuguguuauauguauaucaaaacaugauguuguaugcuuuaaauacacaguugucccucaauauaugcagggaaucgguuccaggaaucucagauauaccaaacuucguucauauugcacaauuccugcaguuggccuugcagaacccauguaugugaaaagucgacccucuggggcuuuacaucuugagaauaaaaauccagcuauaaguggacccucacaguucaaacccauguuguucaagacucaaguguauacaauuuuuauuuuuaauaaauguuacagaguuaguuaaggaucaaauaaaaaucgagcgauucuagucuggcauucuuuccacuaaaucuuuuggaaauacuagacaggauacugauucaauaaaaauuucacuuuaccauaucaagaaaaggacaauaggggacaaaauaauuaauaauauugucuagucucucuuuacauagaagagaaaggugauaauuagugguuaaauacuaaaaauauauaauaaaaauaaugaaucaaagcuguaucuaugaagcugugccagucuguaacuuuuaaugguugauggcaacuuuugggguuauucuauugaaaugagaacaacagguagaaauuacuauguucuuuacuagaacguaagucccuugacaacagggaccaaacccuaaaauuuaaaggucaagaaagccaaagcagccucuccugccuguaacaugugaaaaaaaaugacaguacuuaacuuucccuucgcuugugccuaccagccugaagaacuuaauuuauagauccucaagagauauucaaguaugauuguuuucuucuuuauuuaguugucuguuuugaugccaagauaaacuuugaugacaacgcagaauuccgacaaaaagacauauuugcuauggacgacaaaucagagaaugagcccauugaaaaugaagcugccaaauaugaucuaaaauacauaggacuagaugggaacauugccugcuuugguaagaagcaguuauaucaaaagaaugcuuuguggauucuuauagaauuuaggaaaccuugauuucugaaaugucacuuaccaagaagaaguaagcacauaaguuuuuuuguagcugaaaagucuuaggaaaguauccaaguuucuucucaaaguuguuuugauuaauggucacugguguaaagcagaauuucucaacucuggcacuauugggaguuugggugggauaauucuuuacuguccuguacaucauaagauguuuagcauccuaaccucuagauacuacuaacaacccccacuugugaagacaaauaaacccauguaaaucaauaaauuaaaauaaaugucuucagacaguuccaaauggcugugguaugcaaaaaucaccccaacugagaaauauugacuuaaaacaucucaguuaaacuuugcuuaguaaaaaauuagaaccuuugcugcucaacucaguauuaauaugcagaacucuucugaaauuuagguuuaaaacaaaauuccuuuaucagaggaaauagaagaggacauacacuuuaaucacguugcuaaaguuucagguucugugauaaccaaaggaugaaauguuuaauccauuaugcuaguuuauuaauaaaacaauugauuuuaucacacucaucuaaauuugugaaaauggcuucuucagcugagauaagaaugucuguagaagcaauacaguuucuauuauuguucacagcuuauagugcucagauuuauaugcuucugacuuaauugcacaagacuguguuucugguagaaucaauucauuguacuggaaacugaggucuuaaucuuaauggaauuaaaauaaaaaugauuuguagcucauuaaaccagcaauaucauuguauucagaacugaagagaccucauccaagagguggcuguucaauacaauagaaaaugacauccaauuacaagugauaccaaaagcucuugcuuuguauuggagcaauaacuauaauguaccagaucacucacaucauucugauccugauaagcuaaugcacucucaauauuuguaggcauuuagaaaggggaaagguauauggguuuaaaccaaauuaaauacagauuauuuauagccucuguaggaaugugcaugguuugaccacauagcagccucaaaaucuaugauuuacacauuucaaauuguuuuaagauucuguguaaaccauuuuuauuuuaguuacuccaaauuuaauuagucacagucauaggcuuuucuagggaauuggagggucagaaaaaugaaagguacuuuaccuugugaguuucugcuguguucuggaguuuuuuuuuucucucucaaggaaaguaauuuuauauaauuaagcuuaagaagcaaaauaagugcaauugaucaauaaaacuuagcucuggaaaacaagacuuuugauauuaaaacucucuaccuacuuucuuaagaaaggcuccuaagauguuggcacauuuugguuccaguuuuaacgguuggguugcuggugagcauugcuuauauuaauuugaaagaggaacaaggggauaagaauauuguuuuugugcagucauuuguucauuuguuucuaaguuuauccagguaacauuauguaaacauguaugacuguacuaaguguaaaaaaguauaaaaucccacugaaguugggaagccugugguucaaucccacagaugccacauucaaaggaccauauucucagcaaacaaaacauugagaauuccauucuuuacuccugucucuuaaaguauauuaaaaagaauguaauucauagguccuagcaacuuccaauagcuuguuucucugccuccugauucucuuaagcuuacacuuugcagaaccuaaaacuuccuuuuuuacuacuggcccaaaucgguuacuuacuuaaaccuuuccuucuuucuguuuuucagauugauuuaacuucccaauacauccuguuccucauuccuaagucuuuuuuguuucauuguuugcauauacauguccugauucuuuauccuaaaagucuaugaacuaaucugguuuaauggaauuccaaacaggauauaaauuggccuggcaaugacagaguucucucuuggcaauaugggggagggaaaauguuuauggaccauuucauguugcuaaauguagccugucuugugucccauuugcauuucacagugaauggugcugggcucgccauggcuacuugugauaucauuuuccuuaauggugggaagccagccaacuucuuggaucuuggaggugguguaaaggaagcucaaguauaucaagcauucaaauugcucacagcugauccuaagguaaccuuucucuuuguagggagauuauaugccaguuuuaauuucucaccgucaagagcucacuuguucuuccuggugagaguugauaagucaauauguguacucugcagccccagaugcaacuucuaucuuuuuuuuuuuuuuuugagacggagucuuacuccguugcccaggcuggaguacaguggcgcgaucuuggcucacugcaaccuccgucuccuggguucaagcgauucuucuuccucagccucuugaguagcugggauuacagucacacgccacaacgcccagcuaacuuuuguauuuuuaauagagacaggguuucucauguuggccaggcuggucucaaacucccuaccucguggucugcccgccuaggccuccaaaagugcugaaauuacaggcaugagccaccgcgcccagcccacaacuucugucuuauaucacauuggaauacgugaugauuuaacucguuuuggguaaaaggcuugggaucuuauuucagagguuguguguacaguccugagagguggaaggaaauaaaaaagauacagugugccagucgaaacauugguuggcaugaacuuuauuuggguaauuuacacagaagugacugguccuaugcuuacaugauuuagagggaagaguacuaugauuccuuccauaaagaugcugaagguauuaccauauauuggaaaauuuuaggguuaugggaucaaaaaucacugggaaauaauggccccaccuucuuuuguaugcuuucuaauuuuuaucucugaccauuaguuuguaacauauguacuaaguagcaaauaacuguaccugguuucauaguuacuauugcugcuucaugugcaucuuuuuaacuugaggguagcuaacuagaauguagcuaccacacccaugcuaggggcagugugggcauucaauuaauauuuaaucagcuaguuuaguaaggaaguuaaauaucaguaugcuuuguuucaccuguagauacucaguugacuauaacaugguuuagguagaugcuuguuauguagaaagaccaaaauauuuugaaagucuaauguacacgguuuucauucauucuuuuaacaggccugugaaguacguauaugccacaacaauuugauauaaaacuuuuucuuuaauuuuuugauuauuuuuuuuuagagacagggucucguucugucacccagaccggagugcugugguguuaucauaguucacuguagccucaaucuccugggcccaagguauccuccucgcacagccucuugaguagcuaggacuacaggugcaugccaccaugccuggccaauuuuuuuuuauuuuuugucuugcuguguugcucaggcuggucucaaacucgugaccucaagugauccuccuaccucaggcccucagaucuuggagauuacaggcgugagccaucacaauuggccuaaacuuuuauuugagaaucauugucucaauauuguuagaguaucuaauauauugaguugguuacuaaaauaucugaagaugugggaaaucugaauuguuacuaagagaaugauaaaugaaaauaauaccagauuuuuuaaaaaagaaauguggucugaacuaaauauggaagcuucccauuaauaaauauacuggcaauagccuguuuuguuuugcaugcauaaaauuuugucuuauauugguaguacacuugucuguuuuccucaugacuuacauaguugguggccuuauguuuuugcuugucuuuucuucugacucacaaaacagacggcaagguauuauuagcacuuaucuucaguucuccagugccguucaggaauagccaaguuauugaaguucaaaggcagccagccauaaggaagguauucgcaaaaagaacaauguuuccacuuacauaagcacuuuguuuucauugguuagguagaaacaccuaucaguggcucucuaaucauguauuaauucacuuauucuuucuuccuacugcuuucuaagggaagaaucauuuuccucccagagauucccaaaccaauugaaaucuguaaauaccgagacacacagcuccuuaagcugcuugaaccacacaguacccagaggacagacgauuguaauaaaauacugaacuuuuagcgucuacugaaacucugugcaaaggauaauagagagccacugagagaugaaaucuaccaggacaaucauuggauuucguugaaauagcuuuucuuaguggcucaccucaaauuuuaauuuuguaaaaccuguaggauggggagggauaguggaaaaauuacugucagagccauuuuucuuuuaaaaaaaccacucucuuccaaaauuuugacuuuauggaacauuuucaaaugcuuggauuauuucaacuuuuuuugagauuaacugucaucuuggguagauaaagguaugugggaguuauuuuauuuuucucaugcuauaucaggaaaaugaaugcacagcucaucucacaguacuuuuuccaaaucuugaaauuucaaaaccaguuaaaaaacauagaaauguaaugaguauuuucaauccuggcuucguuucacaaaauuuagagaacagaaccuaaaaaauaguauagaugaguugaugugauuuugcaagcaaacuggcuguaguuuuggcaguaauuauuucguguccaccugcccaaaaguagagguuccugagagcccaaagcuaauuauuucaaaggugucaauugucuuguuagauguaaggauuaguuaguugaauacacagaaagucaaaauuacagaacaccaguuuuuguuaaacuuuuaucaacugauauuuacaacugcuuauuugcagugugucuaagauaauucuguuuaguaaacacgucauucaauaaaauuauuacagguugacauauauuuccacucaugaugucagucauagagcugaaaauuuuaguuauuuugcuugacuguuaacccaaaugcugauuuucacuuggaccuaacacaaguaucucuacaacuaauacguuucuuauuauuuuaucauauauaugaaaugaaguuccucuaccaagcugaauaaaacaagagucuuuuucaagauaaacucacuuacugaacugaauucauauaaaguauaucauuaaauauuuuauaauucucuuauuuuccagcugagcuugagaugagagaaaaguaauagaguuuguucugcugguggucuucaucauuuugauuuaaagaauucuaagcauuaguauucuuuaaaucauaaagagcaaaaauguauaaaauaggaaauagaaguaggguuuugugguuuucuguuaagaauuuaaagacauuuaaaagaaaagcacuauauagaauguuaaccuuggguuuuuguuuuccaaauuauacucugguuuguauuuuaauucugaacuuagaauuccaaagguguagcaaauguaacaucuggaauauguuguguucacuuacacaaaacaccuaguguucacuuacacgaaacaucuugugaagugaauacaaggaaaggacacuuggcacgaaucucuccaugaccccaacucuguuggccaaagauaagcaaaucuuuugcucucuggaggccuaguuuugaaaagcaaaaguacacgauuggcauuaguaaaggcaccucauuggauuugauuguacuuccugguuuagauccaacuuugaaucauauuuucuaagcccuugaaauaucuaggaagaaaugugcuaccuaagcaccaaagacaaguugaagaauggaagggacucuuagugggauucuuaugccagacugccuggguuccagucuugucuuuaccaguuacugguugugggaccuugggcaugcuauuuaacuucugugugccuugguauccucguuuauaaagugguaauaauagcaguacuuaccucagaggguuguuuuauuacacauauugagacacacacgcacacuuuucauuuagagggaaaauaauuucauaugacaguaucauuuaaaaaauuuaauaaacuuauuaaaguauaaucuccauacagaacaguauacaaauuuuaaguauacagcuugaugaauuauuacaaagugaacauaucaucuaaccuccagccagaucaagaaauagaacauggcuggaugcgguggcucaugccuguaaucucagcacuuugggaggccgaagugggcagaaggucgggauuucaagagcagccuggccaaaaugguaaaaccccgucucuacuuaaaaugcaaaaauuagccaggcgugguugcaggcaccuauaauuccagcuacuugggaggcugaggcaggagaauugcuugaacgcaggaggcggagguugcagugagccgagauugugccauugcacuccagccugggagacaagagcgagacuucgucuggaaaaaaaaaaaaaaaaaaaguaaaagaaaaagaaauaaaacauaacagggauccuggaagccuccuccucaugcaguccccaucauuuuccuacccugcuuucucuccacagguaauuucuuuucuuuucucucuuuuuuuuuuuuuuuucuucugacuuagccuccugaguagcugggacuaaaggcgucugccaccaugcccggcuaauuuuuguauuuuuaguagagauggguuuaccuuguugcgcaggcuggucucaaacuccugaucucaagggguccucccgccugggccucccaaagugcuuggguuacaggcaguagccacuguguucggcccucaaagguaauuucuaauaucacagauuuguuuuaccuauuuuuaaacuuaauaucacuggaaucauguacuguauacucuuuugcauuuguuaucuuuuacuuuacuuuugcuacugguuagucuuuucaauuuuagucauucagguaaguaugaggcauuaucucauuauggccuuucugucaugacuaaugagguugagcaccuuuucauguauuuauuagccauuugaauauacucuguaaacuuguauuaccucaucuauagacaugaaaauaauaccuuaaagcauuguuuuaaguaccaacuugcaaaccuuucuaaagcauagugaaaacuuuggcuuuuuauauuuucugaguguuucauuccauuaucacuuccaaaacuuagauuuagaauaaaugcacaucucagaaaugggaggugucugauacagguucagugauaaucaguguuacuucauguguuguuuugaaauugauggaagguguaagugacucagcuuacaaugauucucuacucagacaaccaaggaaacaguuaauaaagggaggauuaaauucauguuugaaagaagaacaaaauauaauuuguuauaaauuugagaagaggccagcucuuuuugugcucuaugguauauguuucagaaacuuuagaaugugaagccagagaaguaaaacugcaugccauauuuucagaaucagguauaugcaaaugccuuacguuuuaauauauuuuaggauucacuugugcugucucauauuuuuaaauuauugcacauuuagaguuuauuuaaguacaaagaagaauauccuguuuucuuucagauacaugcguauaacugaggcacagagcuguuuaaacuuaaacugaggugccguaaaauugucaggaguugauuugaauaaccagugauucacggauugagcagcuccaaaccaaaagugcuuccagggcuccaucaaaagaaugugaagggaagacuuuuauagggcaaacacgaaaguaaagcaaagaaaauacuggauugguuacaguuauacuguugccuuauuuggucuauccuccuggaaaguucuaguuauguaaccauaaguuagauaacuagaacuuucugcuuccaauugguuagccuuaaguuucauuuuucuguaacauaggcauuuacaagaaauagcucaaguuuuguuuaugucugcaaaucaagcagaguuaagaucacuuaugaggccuaacuggcuuugucugcucagagauucuucaggucugguguccauuuuaauuuauuguaacaaagcaaaacccauuucauuacacaccacauguguuugcugaaauaccuuaucugcaagcgacuguuuucuuuguagggaaguagaacucuuguaggaauuuauuuucgaauauagugcucaauacuuuauacaacacaagcauuauuuuugaaaugacuacccugcauuucuauucuugcagguuugcuugaaaauauguauuuuuuucauauagaguggaaaagauuaaaauuccaggcagccauucuuucuagugguagucgaccugauagucuagucuguggagaaugauuaauuuuguguugaucagcuggucauuuagucuccacuuccacuuagaauagcucuuuauuuagggaagucacucugcauaagcuagaggauggaaaaccaucuaccacucugggcccuuuucuuuuuucccccggcaguaguuuucccagugugaggaauucauaaauguugauuuuugcauaucuuuuccugaugucuaguuaauuaaaauuuccaagaauaucuggcccuccuugcccaccucacauuuguuccauuuuaccugccaauacuucucaguaauaaguggguccuggugacugcauuugguuuugugucuuccacaugaucgguguaucugcuagcuaccacauuuucaaaccaucccuaauagaacacucaaaaucuauuuacaugcuccucacugacauacccucagaaacaagccaaaaauaagauuuuuacucuuuacucugucuucaaaauccagguuuuaaugcaaccuacuuuguuuuaugguaagugacuugaauaauuuaacagauuuggggcuuaguaaauuuugucguuagucccagcaagcuccggaauugauuacgaguccucuguguagaugccuuuguagaguguuaaagagaaauggaccaugaaucaaaguauaaugccauauaguuuggaaaaauauauaauuauuagaagaguuaggguuguuguuuuccuuaauguuauugcauagagaaaaugaagcauugaaugcaacaauuagaaaacagugcauuucucagcaagacaaucaauaauggucgggaauaaugucaagaaucucugcaucuuaagaauaaucuuauguggcagggcaucugaaaguuguacuauuaguauuuuugagauguuacuuuaaaauucagauaaagccugguaaaggcaucauuagauguggguagugaacuuaggaaaaucauucagaagaacaaggcugaaauccuuuggacugauuccuuuccuguauagcagaggugagauguagucuggugggaugugccccauggauucaggagauugcagauacugugaauccuuuuuuuccucuuuccaugcugccccacccacugucagagaauuaggaauuaggaaagauggucucauuccuaaacgagcaacauguccauaugggcuugccuaagaaauuggcucgacuuaguaguuugcuaaauagucuuuuguccuuauuuuagguuauuuuauaaauaguagucccuuuuccuaauuauuaaaauaaggacaaacaaaagagaaaauuauaaaauagauuacacagauauauuuauauauaccuuuuuaaaaaauauauauauauacacacacuaguuuugacaaaacuagacuuauaucauauaauugacaauauuauauagucugcuuucuuucuuuuuuuuauguguuuugccuguccuaguacaguucucuauaacauuuucaguggcggaaugguauuuacuuguauggauauacaaguuuacuuaaccuagugcucuguuauuugauauucaggguguuacaaauuuaaaauaaugccaugaaccuccuuguucucauaacuuuacauaaagcugggauuauucauauaagauaaauuccuagaaguguaagggucaaaauguaugcacauuuuaagguuuucacaugcauugcugaauuaccucaguaauaguugaaggacuuguagagggcuaacaucagugaguugacugcccauuuauuuucccaugucuuggcuaucauugcuguaauucuuuaccaacaggagagguagcauuuuuaaauucuuuuucuucuauucagcauuuguaaugccucuuuaugacuugccuuuucuuuuuuuuugucuaguuuuccauuauuacauaauucucacagugauuuagaacacaggacucuguguguguguuuguguguguguguguguguauauguguguuugagaucaagggaaugggcaguuuuauuuaugucaucagucauguuuucccacaucuugacucuugucuuuaaauuuguuuauauaaauuuugaugucucacuauaauaaaguauguacacuugaaauacuauuguguagaguauauugagaucaccucaugcauguuagugucuuuuacuaugauuuacuuaguuucccaugaaacuuguuuuuagaguuuuaaaauuugugauuucaugaaucaacauaccaugguacaauuucaagucaaaaaugguauuccccccaccccucccacaaaggaaacaguucuccuggucuguuuaaagcaagaugaauauuaggaucagaaguggcauguuccucuaguuauuaauaagauucuuuuuauuuccaaggaaugcuuuuagaguguuggaggaauuucacuguaaucuaaucuacauuguuuucucuuaguauucuugguauaguugaucauuauuugcuuguucuguauuuggaaauucgccugugugcuaaaauuaauuuguacuccaaaagucauuuguaauuccacagcacuuucaaggucauucaaggcaaugugcagaguggugaaaaauuuuagucacccaaugcacauguucccaaaugagaucaaaaaggcaauccucugccuucuuguuucagcuuucauacuguaaaacguguccuuuugcagucuauuuauggccauguuuuuugcauuuuuguccuuuuuuguguguaugauuucacuguuggcccccaagcauaguauugaaugcuuucuagcauuccuaagugucagaagccugggauguacccuacagagagcauacaggugcuagauaagcuucauucggcaugaguuaauaaugcuguuggccaugagaagcaacaauauauauuaaauaaggugucuuuaaacagaagcauacuuaaaacaaaguuaggaauugaucugcugaugaaaauauugugacuagaggcucauaaaaauguaacuguguuuuuccgcuaagaacaaugguugaguauuugcuaauucagugguuuuagugacuguauagaccauaacuacuguggauaaugagaauugccuggguaguguuuuggauaauuaugagcagcuuuucauagauuauaugauagagacaccuuuucuuucucuuucuuuccuucuucuuucuuuuucuuucuucuuucuugacugucuuuucucacagggucucauucugucacccaggcuggaguguaguggugugaucacagcucacugcagccucggccuccugggcucaagagauccucccaccucagccuccugaguugcuaggacuacaggugcaugacacugcaccuggcuaauugaauuuuguuuuguagagacaggguuuguugcccugccuggucucaaacuccugggcucaagcgaucugccucuuagccucccaaagugcugggauuacagacaugagccacaacgccaagcugagacacuuuuaaagaaaggacaaucagaaacccccagucuaaauguaaaguaaaaaacuuuucuuaucauaguuuacuuguuccccuaaaggaaggauuugauuaugagaaccuuuagaauaugccaguaauggcuuuuuagacauacugccuuuauagcuauggaaugauuaaaguuugaggaaauuuuaguuuuucaacguuucaguuaagaaugcuuuccuuacaaauuuagguuauuuucacuuuauguuuuuggaaguuuuuaaauauuaaauaaugaucgcuguuucaccuuuacgaauuuacauuuccuacuaaaagugugauauuuuaaaaaauuuccuaauuguauuccuguaauacaaccacuauuaucauuuuaaaaaauuuucuuccagcauuaugugucauugccugaugaacaucuucucauguuguuagucuucuugaucaucauuuuccuagcaguauaauggaccuuuuaauuuuagauauuuauuuaaagaagccuaacauauaaaauaucuuucaaaaagcauguggaacuuuguaaaccagauuugcuuaaagcagggaauuauacagucagaaaucaaauauaauaguaacaaguaugaagagcuuuguuucacaguaagccauaagacuuaggaaagaaaaagaaaagcuuuggggguacauaacaguuuuauaacaauaaaaaaggaaaauuaacauaauucaggaccaagcuacauauuuuuuauguauuuuauacaauuacuaccucuguggacuucuaauuugaguuaguuuuaauuaucucagaauuaacggcaagucauuuauuaauauuugacacagucccucuaaguugcugggaugcuaaacuaccuaagaauuccagagguggcugaaugcaccuuccgaguuuuucaguuuaauaucuuccuguucaaugucuuccugguauauucaggucagugagguuaggaggcgucaagaaugagacuugguacuggucagaaaaugaacucaccuuuauuuuuccauucucuuucuugcuagaauccucaaaugauuuauuuuaccaaaaaccucuuaagauuccacugauuucucugugcauucccaccaaacuuucugucuuuguaaaggagcaacauacuccaggugaacuucuaaauuaagcgucuuuuuaaucuuuauaaccaucaucagauguauccuuggggauaauuugugccuaucuccuuuuucuuuuucaugugauauuuacaauuuacaguccucaccgcugaauaaucucuuuauuuauucacuucuuuuuaaaaauucuguaaaauugcucagaaauauuauaguuuguuugcccccuuccccauccccacauuucuuguugcuuuuugcuccauauucuuuaaaaauacccaagguauagagcuuuccugaauuuucuccccauucaagguuuuuguuuuaugcaacuauuguauacuucauuaucuguagccccuguaaugguacauagaacaugguagaugccccaaaaauaucuuuuuagaacaaacucauauugucagccuauuuuuuuauuuccauauaagucaucuagcugaauauucucagccaggaagaaaagcguaauaagucaaugaguugcccuucugaaacgauucaguuuccaggcuagaugccaaugccaugugucuggcaagacuguaauacaauggggcagucuggugggggccauacucuaggacuagacuuguucaccagagucaggcaagcauuggaaggaaggacucuuugcagagagugggaugagguuccauccagcagccagaggcaaugcguacaggaaaugguugguuguacaggaaggauuguggcaguagggaggggccuuaccugaaagcagcauguuagaagauagccagagcacacacagagggaggcaauucccaaacaacauauagguaauucuuuuaacaaauagccaguaccaccaaucccacacuagugcaagggccaaacuccauucauggcaagccuccuguaagccaaagcuugguucuagggagacucaaguaccaggcagauaacuaagccaggaacucagccauagguacaagucagggugucaaccaugagcucaagauucauuccacagcaagaaugacuugaguagguagggggguguucuccagcaugucagggggcagcucugcaaagaccccuuugugaaaucaguuacuaguuccucagaccacagaaugacuaaacuggauuaaaagccauuuagaaacaucagccaaacaagaauauauuaagugucaucccugccaggcauucuuauaggcacugaggauaaagcagugagugaaauacaucucgucuuguucacuggaggugccauuuuaaagaggauagaaaaucguuuacacuggugaguaacuaguaaaagaaaauuaugcaauauaucugcuggugcugucugcuaguuugaaauauaaaaaugaaagggggcuugaaaaugccagguguuuguuauuucugauagauuuguccaagcagaccucucugauaguugaccuuagagaaagaaaugucaucgccguuccaugauuuggaguuggaguuuguggguaaugacaugaaugcuaucaaugaaagaaucugccccucggaguuguccuccuuucucuugucuugaccuaccaaaguguucugagcaauguugcuugcuuuauuacagauuuuuuuuuuuuaaguuuuguccacuuaaauaguuuacgcagcaacuuuacccuaauuuggguggcaacucucucgcaauuagagguccuuucugaauaucaauggauauuucaucugcauacccaggaaccucuccugagaaugcuucauuuccaccuuugaggucuucugaaauggagcacugcaaacacacauauuagcauucccaagggccaucugguacaaauccgaguuaauuauuuuucuuccagcuuaucuguggguuuuuucauuaauuguuaucucuaaguauucuggacacauccuuuuuucucaauuagaacucaauagaaaguuuuugagcaaacguuuaggugucugcucuaauacugaaaggccugaagaucguaaacagcaagcagaaaauccauuuggagcuuuaacccuugaccuucuagguuucacuugcucguuaaucccaaguagcacauuucucugagagggagacaaaagugacuuagaaucuuccgugugucauuaugauccaagagucuuggcauuuggguagcaggugugagagaaaacaccaaaaucaccucauauuuagaugauuucugauauuuucuguguuuuauaaccugugaucaguaguugcauuucaugaguggagccuucuucuccauuaagcugaacgaccaaauaguuaauccaaaugcugacagugcugaccaaauuccaaagaauagauauuugguauucaaauaagaagggugaaugaagcuaaaguaaaaaaauacaaaaguauagaaacaugaagagaacuuauacugaaagaacaaauucuuugauucaguuuuucuauacagguacuuccuuaaaggcacugccaauugaaaguugcaccaauuuauccuacagugugaaauaccuuaaauaagguauaggacggaaagugaagccccaucagcauacuauauuucucuucuagugguuacagcuugguauuucugcauccagccugcaaucaacaauucuuucuuccuucccucccucccucucuuccuuccuuccuuccuuccuuccuucuuauugagauagucucacucugucacucaggcuggagugcaguggcaugaucuuggcucacugcaaccuccaccucccagguucgagggauucuccugccucagccuucugaguagcugggacuacaggagagugccaccaugcccagcuaauuuuuguauuuuuuaguagacacagggcuucgccuuguuggccaggcuggucucaaacuccugaccucaggugguccgcccgccucggccucacaaagugcugggauuacaggcgugagccaccacgcccugccaacaauuauuucuugagcaccuacuaugugucaaguuaggagcuaaucgagaaaguaggaaaccauccgauauuugaugcuauugguuccaauggggcuuuccuuaucaauuuuuuucugauuguaauaaucucuuuaaagcagagaaagguagguaccugaaugacagauguagucuuuucugcagucuuuuuaaggcucaauaaaaacccaguauagagcaauauuauacuuaaggucacauaccagucucuagguuuacugagauuugucugugaaggcuuacuaaucagaaugucagccauggacugucaguguugacaacaauuuuuaagcuguuagaaaugcacagucuguguuuucaugggaucuccaggugauugcugugcacguuagaguuugaaaagcccuggucuaaaguagggacagacaaacuacaguccauggccaaguccuggccaaugccuguuuuuguaaauaaaguuguaccggaauacagcugugcucauucacuuucuuaaggaguuaagaaguugugaccaagaaguccugguccacguggucuagagcaguaaugcucgaaagugugugguuggacccaugccaguuuauguaccagugccuguuugugagcuguuuuagguuugugauaaguacagauacugagaauaagcauuuagaaacuuguauugcuaauuacccuugccaugacaugcaagaggaauaucaauuuuuuaguaauuugcauuauuacauuuuauaauaauacaagucaaugaguuagggaauuauuuuuaaaaauucauucaucaucacagauuauguaagaagcagcacucuaugaguguagaugauauguuuguaaaaaaaacagugucauaagugaaugugauuguacaucuugaugccaaagugaacuuccuuaugggcugcgguaaucacauuguccuauucuuugcucacccugcuuuuccaugaaucuuccucuugucucuuuggggauacuuccuugaccuuggugaugcuguaaaaugugaugccuucuuucucucuguaugucuucacuuggauccugucuucccuagcuacugcucacagaguaagcuuucgcccaggccaggccaauugcuuuacugcaucccugccauuguagguuacuuucagggauggucucuggccacaagucccucaagcuaguuagaaccuuccccagggguuuucuguggaagcucaugaaagaggccaccuaccucugggaucaugaaagaaaauaauguggcccaggaggcuacauucccuaguagcuggugaaagccuguguaagcuccaggagcaaagcuccugccaugcuaugauggaggcuccugccaucauagggcuuaguuccucuagccuagguuuccaugacuccaugguuuucaaaagugugguuggacuagcagcaucagcaucaucugguaaucugugagaaaugcagauucuugggcuccaccccagaccuucagagucagaaacucugggaugaggccccggaaucugaguuuuaacaagccuucuagaugauucucguguuugcuugcauuugagaaugucuacuacagcucuauagcuccuccuuauuucugugaguuacuuuagcauccuucccagguguaagccaacugguucccuuuaaccccuuaaauuagaguugauuuucggucacugacaacacagaaaguccuguuucacauaccaugaguacuauucuuaaccaaaccgagaauaugccucagcacacucuugcguccuaugguggcccagagcucaccucuguuaacacuuauuuuuauuuccuuccccauacgcuuuauaaccccuuauauuugaagauuuuuauucucuucuauuucuguuucaaaaucugucccugaaaugcagaggacuguauccauucuaaagugacuuuguuacccagaugagaauuaaggauaaucuuccagauaauagguagaguucaucaaugugguuuguaaaugcauuuuucuaaagaucaacucccucauggaggacuuuuauuuuccuucucuccaaaaguagacuacaucaaguuguguaauuuuuaagugacuuucuauaaacuuuaugaaauuaccucaucuugagcucagucaucgagguagaucuaauucauuuuuguccccguuaaguuaccaucaacugcuucuuuucacaagagauuucuuuccuauuacugcucuucgugcauuuaaucacucuuagcgcuuucuuuccgccucuugauuuauaaguguuuugcugugauucagucuccugucuauucuugcuacagaguacaaccuucauuuguuaucuguguuccuugugcugucuggggaaaaggacaguggucagaucuuucaguauuugacaaacaucgugauaauagaguguuucaagauggagauguugaaucaacuuugauguuuggucaagaaaauugauucauaaugauaugugacauaaggucuuugcugaguuuuuccucgguauguaugaggaaugaaaaaaccacugcuuuuuuuaaaaauagaauuuaauguuuucuuuuguuguuuuuuuuuuuuacuuugauggcucuuuguacaagcuccuuuuacagauuacucuguggucagagaaucagcaugugacuuuuucuagauauuggauaaauagucuuuaugucaacuaccauuugggaauugagauuugaaugcuuuucuuuuauuucauacguucacuaucaagaugagacuucauugcuguuucuuccaccucugagguuauaucauguuauuggauguucaugucugucuuagagagugggccagagaagacaugacuugagcuacuuuuaauucccauuuguagauccugggcaucucuagcucuguguagccacugcacagugguguuacacccuauaugagggugaaggucuaaagacaguucuuaaggcacaacauauuuacuaucaucauuaacuuugaaaauucuuuaagugacccauacauuuuagugccuuuaagcacaagagucccaguaguauggugagacgcugacccgaugaggguauguagagcucauucucuuccuucugucucaggaacucguguacuuugaauggaauagcaguugcaaccucccacuagauuuuauucguuaauuuugguucuuucccacucacuuacuuguucugucucugugccugaauaguuggauuuacauaaauuaaauguguaugugaugcaacuuugacguaugauacuacauaacauguuaaugaaaguacggagagaacagugaaaacaaccagggaucaaggaauuguugaaggguauucuugucaugcauauuaguuuuccauuuuuaggauuuuucauuuguuuguuuaauauucaauuauccaaccgaaagggucauuauauauguugauugagagcuugcacuucaaugacagacagaggucuguucaguuccuucucagccaguuucuggcuuuuugaccuugggcaaguugaucagaaucucuucaccucgcuuguuuggucuguacgaugcaguuaauccauuauuagaggaaauaacacgugaagugcucagcagugucugguacuuuguugucauuccauaaaauuguggccgugguggccgucuucagggcuauggguauuguggucauuuauauggaaggggcgguuaaguggccucucccaccggccaggcauuguugagcuagcugauaagagaagggauucuagagccagguugccuaaguuugaauccugguggcucugccacuaacugcuuggccuugggcaacuuaaucuaugugugccuuaguuucuucaucuauaaaguagacaugauaauaguaccuaucguagguuuguugugauuaauagauguguuaauauuuguaaagcuguuaaaacaguuucuggcaaacagugucuguguaagugcuagcugcuguuauuuuuauuuuuauuuuuucacuguagaucaguuaauuucuuuuauuccacaaaauaaguauucauucuguaccauauuucugcugcucuuugaggaauggggauguggugaacaaaagagagauaauuccuaauuguauggagcauacagugucgugggucagacagacuuaguaaaaccuccacuaguuuucuuucuuuuuugagacagagucuugcucugucacccaggcuggagugcaguggcuugaucucagaucacugcaaccucugccucucggguucaagugauucuccugccucagccucccaaguagcugggauuacaggcaccugccaccauggccagcuaauuuuuguauuuuuaauagagacgggguuuugccauguuggccacccuggccuugaacuccugaccuccaguuaucugccugccucggccucccaaagugcugggauuacaggcaugagcaaccacacccagccucucaccaguuuucuaauuacagacugauugugagaaguacugugaagaggacacugagaaucaggagaugacuaagaucuagaguuugccuuuaggggaaaaaaaagucagccaaaugguggagcuuguacacauuagaagcaucugaggggaguuuucagcacuccacauacccagaccuuacuccagagcaauuaaaucaacuucuugggaugggggagguagugaggcaucgggacuuuugaagcuguucaggugaugccacagugcggccacuuugagaaggagugauacagagggugauaacccugagcauaugggaggcagguacagauagauacaagcagaauuuacauauauuuguagauucaagaaucaugacaguuguucaggggguaauagauaacgguuauucuggcuccagagaccuccucaagguuaucacaagaaaauuuucauggcgucuccacaagaccagaaucagaguuggaaucagcuaucccugguuuugcuaaguauggaaucauguagacgccauugauuuaaaauauccaccaguuuccauuuuuuccuguuaucuuccacugcugcagucucuggaauuauuaacucaugccaccugaaguuuuuggaauuaaugaauugccuagccugguagcuacauuguuaggagaauauuaugagacaaauccaguucuuaucuuacauuauuaguucccaaccauuuugguaccagggacugguuucauggaagacaguuuuucuacugagugaggguccaagggugcaggguugcgggggaagagguggugauuuggggaugauucaagugcauuacauuuauugugcacuuuguuucuguuauuauuaauuguaauauguaaugaaauaauuauacagcucaccauaauguagaaucagugggcacuuugagcuuguuuuccuacuagaucgucccaucugguagugaugggagagaaugacagaucaucaggcauuagauucucauaaggagcgcacaaccuugaucccucacaugcacaguucacaauagggaucaugcucaugggaaucuaaucccgccacugaucggacaggaggcagaauucaggugguaaugcgagccauggggagcagcuguacauacagaugaagcuucguuugcuugcccacugcucaccuccugcugugcggcccaguuccuaacaggccauggaccaguacugguccauggcuuggggauuagggacagcuguauaacaugaaugugcaccugacucuugguuucucagaaucaacauauaaaacauuaaagguuaacauuguguuuauaaauuaguuacacauaaauugaaucccauugaaauuuuauuaaauugauaggcaaaauuagcuugugagagagagagagagagagagagagggagaaggaaagggaaggaauacucaaauucugugguuuuaaauuggccuuucuauaucauacuucaaugauguuauccuuccaggcaguauuucagguuuauaacuguacacacuugcaaaagggaaacauuuuuguugggcaugguggcugaugacuguaaucccagcacuuugggaggccgaggugggaggaucauuugagaccaggaguuugagacaagccugggcaguguagcaaaacuccaucucgcucucaaaaaaaaaaaaggaggggaaggaaaaucaauuauggggcagcggaagcgaggugaacacauaaaagaaaaugccuauguaaagucgguaugucauagugggugauagcaccugaaugcuucaugcucagcaaaucauuugauuuaaagguuuggaccacaagacaugucuuuugauugaaaacuuauaauaggacauuucauugggcuggcaaguuacaggaucucuuuggaaauguuuaauuucugcaugucccuuagaggcuguccccuugagugccugccucuuuggggaugugcucucagaauugugacagauucgccuuuaaucagaacuuccaaccagcacagcuuuucuuagguggaguagaaacucaaaguuuccuugccauuuuugcaaugaagagaaaucacucaguuuucuuacaaaugaaaaacauuuucuuuggugagcccuuaaugucuuguuucaguuagguaggguuuaauaucguuuucauucuuucuguuuugcuaauaggcaguugacuuaacuacauucuccuacagugucaggaguugccaacucaugauuugggaacucugaguuguauguaggguaauauuuuguugaucacuuaugccauucacuuaugugacacuaauacaaaagauaugacauuaagacuacaaugcuugcauuuuuauucauuucugggaagcaugauuuuuccucucuuuuuuuuuuuuuagaccaggaaaggaaauaaggguuggagcuggacacucacaccuuguuggcaucaugagugagcaauucugaggguugggaaaguagagccuacuuauguugguguuguagggaccacuaucuccagagcuagaaagagaugaaggcacaacccauacgccuguggaaagcugggaauagggcuucccuaagagaaaucucuggaguuuaaaagacuuguaagaauugugaaugcccuggacauguguaugggcauuuuuuaaaacugcaaauaaccaggacaaaauucaguaaagauaaauuaaaggaagguugcauucagccaguaaaguguguguuuaaauuuaaagugaagcuucuuaaaaaacuauuuuaaaacuuuauauguaacaguauuuuagaauuacaugagcccuucuaaaugugaaagaaagcaauaucauaaugcaaguuaaauuugagcaaauauaggaagacuuggcauauucuucugaaagggggccaagucauuuauagucaccaaucaaaucacgucuugucucaucucugucagcuacuugguauagccacagaaaucuauagaaugagaccggcgaaaaaguagcaaauaagcuucauuugggggcauuauuuugcggcauuuuaucacaguaauauucaucucuucaauauauagaaauuaagcucuagaaaauguuagucuguuaguguauucuuuuucuuucuuucuuucuuuuuuuuuugagauggagucucccucugucacccagucuggagugcaguggcgcaaucucggcucacugcaagcuccaccucccagguucacgccauucuccugccucagccuccugaguaucugggacuacaggcgccugccaccaugcccggauaauuuuguuuuuguauuuuuaguaaagacggguuucaccguguuagcaaggauggucuugaucuccugaccucgugaucauccugccuuggccucccaaagugcugggauuacagucgugagccaccaugccugaccuguuaguguauucuuuaaacucagugaccacaagaagaugauguugaccuuguacccguuuuccaucacuaaggauaacagcaguagccuccuucagagaagagcugagcuggcaugauaagagaaguugggaggugaugugaaugauaaacucuuacuccauuuacuuaaagcaagugguuuuaauuaaacacaguuuauaccuuuaucgcugcacuuggcaaguuuugggaaguuaaagacuggugguacugcuacucggaaguuaucuguagaaaacagccuuaagucuuuuccaaacaaaauaucauuuuaaaaugaaguugggucaaaauucaaauaaaacucccucuaaaaugaagugugcaauauccacucuuaauguguguuguaucguguagucaaaagacucuuaaugauugccugggagguugguacagaagggauuuuuauuuuuaacagucucuaaaacacaccuuuuaauacucauucuuuuuggaauucuaaguuaauuucuauucuucaucacuggugcuuuuaaaaaaaaaaucacaaauuucagaauuaagugucugagggauuuauuuccuaaauaauugagcuccauaauguaauccuuuacaauagucauuacaaaggauuuggaauacagaaaaguacacaaauaaagucaucaagcuaggugggagaaacaccuuaguccgggaggucaaggcuguagugggcugagaucacaccaguguacuccagccugggcaacuggaguaagacccugucucaaaaaaaauaaauaaaaauaaagucauccauaauuccuuagcucagaaauaacaacuauuaaaauuugacuuaucuacuuccaguauuuucuuuucauuucuguauaaaugcauauuuuuaaaaauuaaagucuagaucauacuguuuuuuccacuuaauaacauacugaagucauuuuaugacaucauuaaauauuuuucugaaacaagauuuuuaguggccauuuuauuuuccauuauaugauuacacccuuauacuuuuagucauuuccccauguuuaagauacuuagcugccuuccugucuuuuugcugucaccaucaucuuagauacguuuaguaguauacauuuauaaauggaauuugaaguauaucauuauccccacuccagcccgccuuggagacaugggacuacauugaauguuuguuuuuuuaacccuacaccuacaaguuggaagaauuuuauuuuuugcuauccuucccuaaaauaguccucuggugaccauuuaguuaauuaagauugauuggcuucugucaucugcugaacaaugcauuuugcuaaaugaucccaaauauuaaauaaaaaccuauuaacaaguauaauagauauuuagacauuaacagauggcuucagagggucugcauauaauuaaaguaaauaaaucuaaguguaauagugacaguuggguaaaaauaaauuauuuucaucaagaauauuucauuauaagauaacccagaaaacagccauugugauaaaauguaaaaauuauagaguaaaauccaguauaucauguaauaugucuaugauuaccagauuccuaaucuagaucuaacacaugacacuuugugguugcuacagacuucauucacauccagcaugaaaggaaacauggucuuguuuuuuaaaaaaauauuuuuuaauguacaagucaguaguaaaauauggacaugugaauuuuuuagacaucaccuuuuccauguauagaauaaaugaacaucacuguguuaacaaugccucaaauuagaguccaagaaagaaguuguuugcuuguuccuauuggacucauuuuauaugucuucauggauggacaaaguaggaaaucaagaugaaacuagauuugauuuuuuuuucagugauuuuauccauuuauaauguaacaucaaauuauuuuuaguaauuuuaugaaaauaauugucuuaaaacaaggucauuaaggacucuaaacauaggaagguguaugcauauaucuaauauguuuucuuuaaucacauuguggccucuggaggaaacaguucuuugugucuacuuguuuucucaccucucacgaaacuacuacaaggaugaggagaguuauggaugugguuugcuccaugaaagcauauuuaguuggccuuggugaguggagcugcuggguuugguuaagagauccagagcccagccauguuguccguucucugcuacccucaggaccuggcugagggguaacacagaccaagguucuccccuaaaacuggccaaauuaauuugccgccuucuucuucuucaucaucaucauuucucucccacaccuuuuuguauucucccccagagaaggcuaggucagccuagaccagaccaguuuuagccguuucuggagaguucucugucuuucucucuggcuacuuucccuguaacuguagaagaaugaaguuuucugguuucaauagagugguaaguuaaggagcuugaauuuagaggggcugcaguugggucauggaaguugaaaaggcaagugugauguccuaaugucauuaacuuaacuggguaaagaagcccucaacccaguuauucugucuuacaaagauuuggaugcucucaccucagcugauaauagaggucauauugccuagccucacuuugcuuguacauuuauuucccucaucacccuuguguggcagccucauaaucacggcugaagccuucagacuucccaggguucucuggccaaaugccauuugaauaccaucucaauucaccaguaaugugauuuaaauaaucauuucuccaauaacucuuucuuaucuagaggauacacaaaaggaaacaaaauugaaaugaacaccacucugaucccaacaguguuagcaauauuuucuaucuucuccaaguuuuucucuuugcagugcuccuguggguucuugcucuagugucccuuuuugcguaacccaucacccucccaguuaacaggcauaacagaagaacgggguauuucaggucuguaacagcugugcuuaaaaagcagcagcucccccauuucaccuguuugguuuguagggcaaggauagaaaggauggcaguggguaucuuucuaucuaagugguggcaacugagaacucugaggcauuuaucuuaacucauuuucugcggcuauaacaaaauagcacagacuguguaguuuauaaagaaaagagacuuauguggcuuacaguucuagaggcugggagguccaggagcaugaugcuagcaccugcucaaccaucugguuagggccuacuuguuacauuaucccauggcagaaagugaaaaggcaagagaguguaugagacagagagaaaaugggggcugaacuuaucuuuuuaucaggagcccacuccagcuaaccaacuuuugcaauaaagacauucauccauuugaggauggcuaugcccucaugaccuaaucacuuuuuaaagguucugccucuuaacacuguuacaauggcaauuaaauuuaaacaugaguuugggaggagacauucaaaccauugcaucauuguagagaaaagcauguaaauaagaaaaugcaguuacagacucagcagucugaaguauacgagagaaauaagcagaggaauaaagcagaggcugaaguauaagaagcucauuaugugcacauuuuuggcuaacuugggccugagaauaccacaugaaaugugaaaaguugauuuaaguuucucauuugaacugugucauucuuuuuuacauuuuuuuuaguuuauuaaaguuaguuacauucuauucccugaauuagaucagauuuauguauagaccauacaauuaaacucauuguaugagauguaaaguuugaauugagaaaguuaauuccuuggacaacauuuuuuuuuuuuuuuuuuugauauggaguuucacucuuguugcccaugcuggagugcaauggcgugaucuuggcacuuugcaaccuccaccuccuggguucaagugauuccccugccucagccuccugaguagcugggauuacaggcaugcaccaccacacccagcuaauuauguaucuuuaguagagaugggguuucaccauguuggucaggcuggucucgaacuccugaccucaggugauagggcugccucagccucccaaagugcugggauuauaggcgugagccaccgugcccgggccauaaucuuuuuuaaaaaauuauuauuauuaguuugagacggagucucauucugucacccaggcuggagugcagugguacagucucgucucacugcaaccuccgccuccuggguucaagugauuuucccaccucagccucccgaguaccugggacuacaggcacaugccaccacacccagcuaauuuuuguauuuuuuaguagagacgggguuucaccauguuggccaggcuggucucgaacuccugaccucgugauccaccugccucagccucccaaagugcuauaauuacaggcgugagccaccgcacccagccaaaaaaaauuauuuuaaaauaaaguauagcuaagaacuuccuagucaugugaggccuaggguaaagguugaguuucccuucaggguauccucuccuugaucuuuaagaacuuauguccaguuagguuccccacugauuucuccugaaucucucaugacagucacaguggccacaaaucuuucuuccaucccuuuguuuagcucccgcugcuuuugggauacagcucaaaaugcuuaccacagcuuauaacucuguaugagcuagcccaugcccaacucgccagccuaccucaugcccauuuuauacaucugcuuuaauuugguuacuaaucuuuucucccuuccuagaauguaugagggcaucuccaucuucaagacuucgacugagcuguucuuucugcuccagacuuucccuucucauguuuuucuuucuucagcuuacucuucaggucuuagcugaauguaauuaugcagagagccuuguacgcacuccuuacaccugauugaaggcaggggcauguuccucguuaggauuucucaaauuauacucuuucuuguuugauuauguagucauacagguaauuuuguauucagcucuguuuccguuauccauugcuuccuuaauaaaccaccccgaagcuuaguggcuuaaaaacagcaguuuaucacuaccucucaugcuucaguggguucacaugacuaaucugaguggccccugcuuggagucugcuaugcagcugcagucauugguggauggagcccgagccgugugaugacucaauugggcuggacacacaagauggcuuccucauaugccuggcaucucauugcuccuuggcccaucucuuuuucuuucucuucacauuccaucugaucucucuguguaguuuggccuuuucauagcaugguggucucagagugaucauauauagugaauggcucccaagaggcaggaaauggaaacuuccaggccaggacugacagugugccauuucugccaucuucuguuagagcaguuacagguccugcccagguucaaggagcuggauggauuagagaaacagaccccaucucuuaaugugagaauggcaaaguugcacugcagaagagugugaagcagaaaauauuacaggaccaucuuugaaagcugcccuacuuuuucugcuagacugugcccuucaugaagacaggguccaugucuauacuauauuggcaccuaauaggugcugauaauuuuuuggcaaauuccuaacuccagggaaaagucuuagacaaauugaagauucgcucagaaaacaaguuugagugaguucgauuuuuuugccuccucagaggccagacucccugcucuaccuccucaacccacacaucauacagaauuugacaccacccggccugcuuuuauuucacacuuuugccccucuuguagcacucauuugggcaucuguauuauggcucuuuucucuccuauucauuuucacaauagcauuucucgacagcaugcauuauauuauucagggugcuuaguuugguguuagaccauguaguuaaaaacaugaguaagccuugauuggaauucccgcucuguuuccucuuacaucugugacuuucccaagugaguuaacuccucuaagucucauuuuuuuuuuccugccugugaaauggguauauuaauagaaacaacucagcaggguugcuaugaguauuaaaugacaggauaaaacauauacgucuccuaccauauuacauauuuaauuauuauucauuuccauuaacucuugguuaugguguuauacugaucugguagucauuuauuagauauuuguugaaugaauaaauauuuuauaguuuucaaauaaucucuuuaaaggauauccuauccuauacuuguucaagguaaaauugcaguuuaaguuuccaaagacaucauucuuuuacuaaaacccuauuugaaaagucugucauugcaggccuuuacauuucaucuuuuuuccacgugaaggcaguggagcagcuuuuuucucgcuucaccugucaaaguuguucucucuagagauuaagcagguaugacgugugcuuugaccaaacccuuugagcuuaagaaaauugugagaaacugaauaacuuccuauuccucaauauuucaggugagaaaaauauacuagagcugcuguuuugauguaugagagauuguagcuaguauaguaaaagauuucggaggauaguuauuguguaucuagguguguuuauauuaucaaucucaagagguaagagaaaacacaaaguuguagagaacauuuagaaauucuccugaagacuuuauaggccagaggucauuaauuaguaaggaaggucuugguuucuguauucauaucauaguggaaguuccgauucucaauucuuaauucaaaacaaauuaaauauuccuacuugucagaauccugacuuguaucuaaauguucuauuggacuagauguaauauacuuuuccccuccagggaaagauagucaaggauuuaugugagaaagcaaacuuccuaauggcugccucccuuuguaagcaguaaagcauguuauaucuuuguaucuugguuguucagcugguaauauuucauaccuuacuguccauacguuuccugauaguaaucaauccauuuugucguuaucacacuugcuugcacuguggcugggcagccacugucuaccaaaacaguagcauuuccuccuggagaugagaguacuugaucgaaagggagaaaagggagaacaagacccagguuuugccauauaaaaaucgauagcgacaaacuucagugucaucucaucuugccggaugccaucuugauagcaugacugcuuuuccauguuaguaauagcacaacaucagauuaagcuucccucacaagacaggggauacacuaaguuuauuuuuacugccuaaaaagcuacaaagccaguuagauagauggaggcagucagccuugaucaaaccaguguucuacaaauuccuucaguuuaccuaguauguuaaugcccauuuuauuaaauccaucuuuuuaaauggauguaaaaauaugaccagcauaaauucuuuuuuuugagacaaagucucacucucaccuaggcuggagugcaauggcacuaucucagcucacugcaaccucuaccucccagguucaagcaauuaucuugccucagccuccugaguagcagggauuacaggcauaugccaccaugccuggcuaacuuuuguauuuucgauagagacggaguuucaccauguuggccaggcuggucucgaacuccugaccucaggugauccaccugccucagccucccaaagugcugagauuacaggagugagccaccaugccuggccaauuuuuuaaagcaggguauuuaagcagauacaacguaagggcugugugugucauuaaaagaguacugcuuggugagaaaugaaugggaauucuuacagcuggguccugauucuugcucugacuauaauuaaccauauaauaauaggucauuguuucucaaacuugagcaugucccagaacugccugaagggcauggaaaaugcugauugcugggugccacacuagauaauuuucugugguacuaagaagauaguaaaacaggaugauaauaaauaugcuagggucccagaugccaucaagacaagauuaaaugugcaaggauuuuaucagcagaaaucccuuugaaagaaaaugagaaagcagccaggagaggcuggccuggccaucagacuaugaugcaggucugacucugagugaaggagagagggaaggaagauuggaugccccuacucggcugggagcagcccaggggaagcauagccuugcccccagugcagccagucaugcugccugcaguucagagugugaggugcauucucaggaccuuagcagugagacagcaauugcuguagaugggguggccagagagggauucucugaggaggugacauuugaguggagacccgaaugauguaaaugagugaaccuuguugauuuggggcaaagugaaaagagcagcggaaaagcaaaggcaggagagagcucugaguguuucagagcagagugagcgagaaggacugaggaggcgcugagagugaagcugggcccagcucugaaaggacuugcaggccaaaucaggaaguuugaauucauucuggauaaaauuguaagccucugaaaggcuuuaagcaccagaacaaugaaaucuuagacaaagauaggaguacgcauuguggaaaaggaagagaaaacagagacuaguuggagacuaaugguauuagucuaggugucuccaaauugccuccauuugaauuaccuacuuuuucuccaugccucugggaucuugaagauacaguggcuaucuucuuauaucagggacauaaccacaggugcccugcuuucuuuugcccuguaauguauuucaggcaaucgauugucaagccccucuuccgauucguccuggcagcucucacucaucauauaacccaugucacuaugccaugcccucuuugaguuuuagcaccaugcuggcagcuuucauagacuuuuaccaucaccuucaaaccaguugaagacugauccaccaaucucauuucuacuucuauauauugucucagagauuacaagcaacugauuucuaaaagacaaaguaaaguagggcaucuguuaauauauggaggucacuuuuagagaaaaacaaauaaauggaauuugccuaaaugugauuaauaagaauauuuucucguugugacaguuccuaugcuuccuuuugcccacauuuuucucucagaagaguagcauguaagaaaguggaauuauaaguuuugacuuggaguugaaggaguguagacaucugcuucuuuucugaccacucuggucugccuugauugagggagaucuuugagacuggcuuuuugcugugcauuuugauugaguuuucagcagcacagugaguauguaaaaucauagccaugaugguugaaauuuggaauuggggaugucccauuugaaagaaaugccagaucaaaaagcgcuauucccaggaaggaugcauacacacgcuuguaaaauugcacacccaugagggcuucuuacuuucuuagagcugugaauuuuucuguuuuugggcaugugaggugcucuugcuguccagaagagguuggugcuuauacuuuaaguaaagugcugauugcccugucagucagagcauggaggaacugggaacuucugagauugaugcuugacagaauaauuagaaaaccgucacuuucaguaaccauuugaggacuccuaaaaggaaugggcuugggccaggucucugcuguccaaauccagagguuaaauguucgggaacacaaaacauaguaugucacaagagaaaauugcuucaaaugcacagaaagagauggcccuccaacuccuaaacaaugaugcucaauuaucugggcauucacagauguguuucccuagcccugcugcuguuuucauaccuccuugagauuauuucucccucugucaguugguugccuugaagugagguuugcaaacagcuguugagauggcuuccuccuugaccuuuucacaggaugacacuuucuuucucuuuauuucaagacggcccccggcccuggcauaaucucugguuaccaaagccagggccuuuuccauacaaccccagucaacuggauuagggcaauauuuuccaggcuaacaguaucuaaauuaaauauaagugggguaccaacaggaacucuugagagagaacaggaaaagcauggccccauaaacaaauuaauucaagaaaacauuuuauuuagauacucuucuccuuauuuauuaagaaaguauaaauuagguaagcauuuauaacaaaauauauaaagauaaauguuucuguuauucuacauccuuugucauaguuuccuuuuuaaaagauaaauuucugaaagaaaaugauucucugugucugcacaucuguauguauguacagauauuauuaacacuuccaaggcaccaggguuccuugggccauacugagaaaugcugacaucagccaucagugccccacccugcuuuaagacagccagcaacaagaaugguaauaauaaggaauuaacauuggugaggguacucugugugucaggcaaugugcagaauauuuucucugugucaguguauuucuguuuuaaaauccagaaaauuuucaaugacauucagccaccuuguuaagaagacagucucagagagggccuguaauuacuucauccccuauuuuucuuuaauuaaagcaaucaaauggcagcagcacacggucacacucaacucauaggacuugcuuuuugugcauuuuacugcaguuucugcccacaaacuugaucccugaauggaagaacacaaacuguauuuucucuauuuucacaccacaauagucaacacagaagacuucugugaucaaaugugugggggguuuuccccaccaguaagcaagcaaucaauucugcagcagacacuagcugggcauccucuaucuaaauucaguucugacacuccaccuggagauaaucucagaucccacagguugagggcucagucccacaaaaccacgccucacuuccgaugcugauugcaagcuccagguuguuuuaccuguguuucucaccaaccggcuauaaauuggguuucccaugaccucuuccuuggguucaauucauuugcugggguggcacacaaaacucagguaaauacuaacuuaugcuuacugguuuauuauaaaggauguuacagaagauacagauaaagaaaugaauagggugugguaugggaaggggcucagagccucuagcccguuccugggcaugccgcccuacagaaaccuccaugcauucagccguccagaagcuccugaacgccauccucuuggaccuuuuauggagaguccauuggaugggcaugauugacagccauuuugaaaugugacuagacaaaaaggguaugaucuaaugcuaguagacugagugggaacacccagaaaggccugucuauacagaugcuucuuggccucucugugcagcauuccuucuucugagguaugacacaggaccccuucggaaaugagggucuaaugacccauaaucagaaaaguggggggagauuagaguauauuuuuaguuucuaaagccugcugugggaagaaaaaggagcaggugaaaggaaggcaggagaauuucagagagagagagagagagauuguuuuuugagguuugcuucugagaccuaaagugccccaacauuauaacaaaaggcuguaacaggagcugugggaguuaugagcuaggaacuguggacaaaaacauacauauauauauguaaaauaauaccacaauccccauuuccugcaaacuaaauucugaauuucugagucagagauucagaagcuuguaucauccggccccgcaugaccuuaccuccccuugcuggcaugaucucuaccaucuguuccagagacccuucucccagaauguucuuccucucccuccucacuuugccugccuguuaucccuuucuccuuggaaaucuucccagguucugugaacuggggcgggauggaccagaucagcuguucucagcugggggccaugcuaccucccaggggacauuuggcaaugucuagagacauuuauuauugucauuuuggaguggguaugcuacuagcaucuggcaggaagaggucagggaugcuguucaacagcacacaaacagcucaccauaacaaggcauuuuccagccuaaaaugacacuaguuuccagguuggggaccccuagauacuagaugaaaauucuaguacuaguacuaguacuagauggaagguccuccuuuucugauugaucucuguuuucccaguaccugauacauaauauaugauuccgaaaauauuaaaugcacaaaccccuucccccucagaaugccaucuuugugcuucuuccaauaccguuauauggaauucgaauuacauuuuauguuuuuacuugccagaauacaagaaucacuuaaauauauaaucuauacuuucaagacuucaagcagauuuauggaguuggcaacagaaaaugagaaaugaguuggcuucaaugcacuguuaauguugagaacccugaguaucguuuggagcguuaaacucaugcaugcuguggguaaauuguuaauggucguauuucaguuuucuuuaucucagagcuuggaagagaaauuuuaaaaggcauuuucuuaaaaacucauaaaaagaaagagcagucccuugucauagaguuuuaaauccugcauguaauuggaaugucuuucagcaggaaagguacgacucaugaaugucuugggucagagaguacacugggcacuugggcagugaaccugagugcuggcucuguagugcagagacguuagacaaauuauggaaccucugucucuccacuuccccuccccuucuuuauaucuuaucagauaaaccccagagaaugcucacuagaauguuugcauugccuauauuuucuccaacugguaguguugggaaugauuuuuuacucucuucuuuacuguauaguuuuaauuuuuccuucccagugggccuguauuguuuuuacuaucagaucaaaaucaguauuaaaguauagagcgaggaugagaagcuagauuuccuaaguccuuuucuggcccuguuaggauuuuuauaauaaaaguccuaccauugauucaauauuacagugaauuaaagcacuccgauaauuuggaccucaguuuccucagcuguaaaaugugauauuaaugaccucaucaggggaaugauuaacaccagugugaucaagagggcuuugauggaauugcaguucuguuucccuccugaaguguaugaccuuagaaaagucacuucccaucucugaaguccaugucuucauaaaauggaguuaaugaaaaccucacaaaguugaugugaagauugaugagaauaagguauuauagcacucagcacagaauuugguguuuaauaaaugacagauacugcuguuaauuucugcuaucauuauuauugucacuuuuauuguacuaucaugugauuauugugugaaccagauuguaacuuuuacauagaaguuuuucagauuuaagguguuauuaccacuguuauuauucuuagcuacacuucuacuacuggaaauaauaagacuucaaucaguagugauuuacuaccaagaaauuaauugguauaaggcagggccuacugagauauccaauaucaauuuuuuuuucuuccuuaauaguagaaucucaacaaaaugucaauucuaugauauuguuccaccucccuuucagcuggguggaaucacgucacugcuuucuggccagugauauguaaacaaaaguguaaugugggaccucuggcaaggcuguguuuaagaagcugaagcagcugggaagggagcccuuuucccugcuccucacuguugcuuggaaugacuuuacaauggcaggggcuccagcagcccucuuagacugagaaauaaccuuagaacgguaccauugcaugguagaggagacaaaccaaaggcaucugaguuccugauggacuccugguagcauccuaccaucccaggccuaucuaccaccaguguuccuuuauguaagagaauaaauccuuguauguuuaaguccuuauauuuauuucuuuguuccuagcauccaaauacaauucucaacuaauuuauuuagucuuggugcgaagagcuuuggcauacuuucucucauuuaccauggaguacuuccaauaguucuguucuucccugguaaauuucuuuuucauuauaucacaaauaaacaaacugacccaaauuuaaacuugacccuugagcaaaucaccaagcaaaagccuucauaaaaagaguaaagaaagacacauggauguuuuucuugacaugcauuuuaggcuuguuuugaagauggaauaguuuuagggaaugggguaauuggccugggaaguagauuugcugccugccugguguuuuccuuccaacaguuggugauagcaugaaucuuguggguuuucuguguacauugacuccagaaaggucauagagaauguuguuauuucagaauacaaagagaacuaaguguguuucccucuacuuaaaugugcuucgucaagcaggccacguuagcuuaaauaguugagaaugaggaaaacguaaaacugugauaacgaauucauauuaaaacacacacacacaaaacagcugcccuuugaaugguucacuggucaccaagaucagaggcagguugaauuaagagcauuuggauaauugaccuuccaugugaaugaauuagaauagauuagauuugauugaccacauaacaauuuaaaucauaaaaaagccccuuuucucuuuccaggcuacuuuguuauauugggucucaaaggugauuaaccauguguuuuucuuguuggaagacuuuccugaacacaaauuagcagacugaaaaagagaugguaauauuuacauuugccauuucuuuuuuaauugaaaaacucaaaggaccauaugacagacugaguuguuuaacgauauuccagaagggcagcauacuuggaguguuuuaauaugcauucagccgucucuuccugacugguggggugguuccuguuacucagauggccugggcaguugggaugggauguucucaaggugcuuuuuuccccuccgaccuuugcuagugugugugaugugauguguugaaaaccacuguauaaacaauaagcaccggcuacucauuuagagucauggaauuucagagcugaaaagaaucuuagacguucagugaguuauugacucucuuuacuuuagagaugaugagacacagucaguaauaggaaaugccccacccucagaugagaaauggaacugcuguguguuugauaauauacagaauuguucucaugcaguaaagcccuacccccucgacuuauuauaggaggcguuauucaaauuggauaaaugcuucuguagaaggaugauauuauuagugccuauuucuuaggguuguugugagauuaaaaugagucaaaugucuauaaagcacuguuuugguuauuauuucugcauagcaaaccaccccaaaacuugauagaaccauuuucuuaugauuuagcaaucuggccugggguuagguaggccauucuuccacuguucuugucaguguucauucgugugacugcauucagcuggcagguucugggaaggcgggccucuucccucauccccaguuguugaaggccccucugucuccaugugauaucuccaaagggccccuucagcaaaguaaccagccucccuauguggcccuuaagcaucugagagggcaaaggcagagacucccaagccuucucaaggcauuggccugaaacugguucagcaucucugcugccacauuuucaggacuaaagcaagucacagacucagccaggauccaaagggaagggacuaugcaagggcauuuauaaacguugacaagguucauuauagaacaccauuguaauggacuaucccaagcauguaccacugugucucaugcaugguaaaggucccauaaauguuauugcucucuugcaguauaguaguaauaguagugguagcuguuuuaggaguaaaaacagcuaaaaaaaaaaaaaaaaaaaaaaaaaagcugcuuuuguucuuuuguuguuauaaguagauauagauggaaaacaauuuauauaguuuuaaaaaaugaaauaauuuuauuucuguaucucuuaguuuaaauaacaccacuauccacaguuuuccucgggcaucuucuguaaguaggaggguagaauaaauuccuuuaaucaguaauuccccaauaaguuccccaauuccccaauucaagcaggucugaguuagggacagagauucuguacuucuaauaauuguaacauugagaaucauaaaauugauauuauucaaguuauaaaguuaauuucugcacauguuucccaccaaaauuguuuuacauuuccauguaucacuuuagagcaugacauuuuuaggagaaggaaauugaaaaucuguucuuuucuuuugaacugauugcuuaccuguuuccggauacauuuaaugcugaagaucuggagaaccauacuagagucuacaaacucagaggcacaggucuuaaccauuagcagcacccaaaaauggagauuggagagaggaaggaccauucuuucauuaagagcaagucauuagauugucuuauggaggauauuugggguuugcuugugaugagccuuccaugucuaauguucauacaauguuauuauaugaugacuugaauguuuuucuuuuugcuaaagcucuuuaucugucuaauuacaaaaauuaugcauucauaauuuaaaauuuucaaaaacuacauaaagguauaaagaagaaaaggaaaauaaccuggaguuguuuauguccacauucauauuuugguguguaucaucccagacuucauuuuaauauuuucccccuaaacauguuuuucucucuggcaaauaugugcauuugcuuuuaaauauucagagcugaauauccucaagaaaguuucaaguuuagcuguuuugcuugagagagauaccgugauguauuuuugcuaauauguuuuaaaccuugcauuauuuauaguuucuccuuagaagcuugaaauuaaaauuucuuuucuaacugauuuugauucuuuccugucuggcuuacaauugauuucaccucgcuguguuucuaaugaagccugaaauuaccauacccuuguuugaguugaauguguuuuucccuaugcccucacauaccauggaucacagggcaacucuguuccuauuaucagcuacaucuuccuuuacuaucuauauucaauucaguguguuccaguaaaucuuccaaugagggcuuauaccgggauugaauagacaaacauguuuuucaguuacauuugaggagcauugauuuucuccauagagggaccuauuuuuuccuuucgcuuugcugauauucccuaagaccugccuauguuauagcccuugcauauaaugggccauauauuuuugacccaauuaauuuuuuauuugauugguaauaaaggaagagaguccuaugcaguauaauuuaagauauucauguaucaagggaggaggaaggccaggcugaaucccggaagucccaccucacuacccagacagcaaucacaugauuccagguugaaagggaugcugaaaaauauuauaaaauugacauucuguugagauacugccacuaaugaaagaagaauuaacacuugguaucccaauagucucugccuuauacugaucaauaucaugggagugaaucaccccugauugaggucuuacuacuuccagugguagaauuaaauauaauaacagugguaauaauacguuaaauuugaagagccuugggcacaacagugccccuuaccccacauauccuuagggcagggugauggagguaaagaccuggaauauugugguguucuugccgggauugaaacacuggguaguagaacaaaauggaaaggccuacccuuucagauacccauauuugaaaaucuuuauuccucaugcuuuuucacuuucucugccauauucccuaagaagaucuuugucccaucaguguuuuuuuuuuccuccacccaguaccuagagcacaguacagugaauuuugauuauaguguuugugcuaacauugagaauuacaaaauugaaauuguuuaaguuagaaaguuaauuucugcauucucuccccaucaaaacuauuuuacauugccaguauauaucacuuucaagcauuccauuuuuaggagcaggaagaaauuuaaaaucuccucuuuuccuccagucugauucuggaaaguaggcucccuuuuuagucaugggauuuaaacugaguugguuaggcaaacaugaaagaugcuuauggugauuuaugccccacaucacaaguguaugucaagagugaaauaacgccugaugugcaggaggauggaccagaagacccucacuuacucaaagugugaggaggaugggccagaggcaucuacaauguccuuuuugccuuaauccacaaagcucaguuucaaguuauggauuugaaaauacuugcuacaauucagggacaaauggacuaaaauauauauagaaauagaaaacuugaaauaaguaaaucuaaaacacugaauaugugaaauagacccuaagaacuacaugcaaugugugaacuuugaauggauacugcuuuggguaugugugucuauaaaacauucuugggauaacugggaauauuucacugcaggcugcauauuagaugacaauaggggaauuguucauuuucuuuuuuuuuuuuuuuuuuuugagacggagucucacucugucgcccaggcuggagugcaguggcgccaucucugcucacuacaagcuccaccucccagguucacgccauucuccugccucagucucucaaguagcugcgacuauaggugcccacuaccaugcccggcuaauuuuuuguauuuuuaguagagaugggguuucacuuuguuagccaggauggucucgaucuccugaccuugugauccacccgccuuggccucccaaaguguugggauuacaggcaugagccaccacgcccggcccauuuucuuacauguuguagugugauuaggacaauguuccuauuuuuaggagaugcauuugggagugaagugucaugauguaggccacucaguaugaaaugcuucaacaacuauccaucuaucuauauauguauagcuacauauaucucuauagagauagauauagagaggaagagagggagaaagcaaauauggcaaaucguuaaauacuacuaaagguagguagaggauacauggguaggcuguauaauuauuucaccuucuauuuuuuuuuuauauauuugauguuuuucuuaguuugaaagguaaaaaaguauugccuuguaaccaccagugcgaccacaacccuauccuuuacucuguuccuggaucucaaaccaauuuuucauauuauuuauucaacaauuacucuauauaccagcuacuguuccaaauccuggagauauauaaauggguaagaugucgucccucgucccuguacuuaaagagcucaugauuuagaauguuucuuuugcaauuuuugugcagcucugucaacuucuuauccaacauugggaaugaacauaaaaauuuacauccacuuaggccuaagaauauuuuaagcaauuuauauugauauaaggcugucaucagucagccuauuaacuucuaauuuucuugaaaaguuuuauguaagaacaauaggcaguaauggaauauuuaagccauuugcacacacauacacacacacaaaaugcacgacaacgacaaccuuggggguuugcccaaguacaucguggcauucugguuauaucuagauauauuucuggcauacacagcuagaauuauguuucaacuggauggucacauuuguaacugauacacaugugaccagugaacacaguaguuuucaagaggcauugccuucuugggagccaaaggcuugauguggccccucuauuaaggaauaucaagaguuucccacuacuugaaaauaacugcauuggaagauuguuuucuuacuuccugauuuguagccugguaaccaguaaggcaauacauauauauauucaugcuaaauaauuuuguuguguucugaauguuugugccccucuccccaccauucguaaguugaaauccuaacccucaaggugaugauauuaggaaguggggccuuuagcaguugauuagcucaugagggugggcucucaugaaugugauuaguguccuuaugaaauaggcccaagggagcuccuucauuccuucugccaugugaggacacagcaagaagguggcaccaccuguaauccaggaaacaggcccucaccagacaucaaaucuguuggugccuggauugugaucuuucagacuccagaacugugagaaauaaauuucuguuguuuauaaacuauccaguuaaugguguuuuguuuuagacuaucaauaagaauuaaaagaaaauacucauaaaaaaaaaagaagucugaauguacugagguaauuuucuucauauuauuccugugaaaaggaaaaugcucauauaacucaaaaaucauaauauuugauauucaguguuguaguccuugcuaaucagcugcaggguaaagaagagaaauaugcugaagauguugggcacgcaaaagagaugcauuucaggguuauaauuaaagaacuuaaaggaguucagaaagagaaugggaaggucuacuuuagaccuucaucuaugauuacauugaaaagaaaauaauaccagaggcuccuuuaaaacgugcgagauuaugcaguuucaaaaggcagugcaauggcuagaagauucuuauauguguuaccaagaucugcaaaauuaaaaugguauucaugacuuguaaacaaagcuacuaauugaacuauaauuuagaaaugcgguccugaauacaauuucagucacagaaugacaauuagaggaauuuauuagauguuaucucugaugcaggggagugucuuggguuggauuuaguaaucuacuugcuagaugcucaauaaauauuugagagggaagggcggaaaggaggaagagugggaagggaggaagagcuaaacuggauguggauuguuuaguaaauuugacaaggaauuugugguaacuugagcuacuaacugaaacuuaccuguuuucuacauauuagaaaggguuuaauaaagaaacuaauagaaguaaaaguauucuuagucuguuaaaaguauuaaucauuacuggcucauuaagcaccucaaaagcacucauucacauaaaaucaaugcacuaauuacaaaccagucucgucuuuguaaaagcaggcccaaauuuuuagaaaauauuucaauaggcauaauucauggccacacauggaaaauacuugaaacuuacaaccuuuaaaaauauuaugauaacuuaugcuuuuuauuaauguauguuuuauucauuccccaaguuaauauaaagggaugagauuuucuuacuaggcaacauaaaauuggggaaaagaauuaugggaguucuggaacuuagauauuuuagaagcacauagagaguuuuuguuuuuuauuuguauuuguauuucuggagaggaguuaaucaccagaaguuauuuuuuuauuacucuggugugaggcuuggcaaaguaucuuuccacaauuccuagaugauucuagggaguugacaaugaauagauuacauggagucaguuaaccuggcuucuaaugcagaugcucacacauuuuucuguuaccuucaacaacucuuucaguuauccugguccucagaauacucaugcuuucauugacgggguugggcuauggaaauuggcaaacacuacacaucagguucuuccccagccccccucuucccuuguaccacuacaucauagauuauauuaucuuuaaaguccauucaaacuuuaaggcuguauaaaucagugaucccuuauuucaaaaguaauuauauuacagacauucugagauauuuaccaucuuuuaaaauuaacuccaacuauaauugccgccccacccccaccagaaguaaaaaguauaagaaaggggaugaaaauuuguaucuaugaaaauagucauugugguagaauauccuuccauugaugauugagcugaagaacucaagacaccagaaaagagauaacugcuaggacaacaaaaugugaauuugccuguaccuagccuaaacauggugguguaccucccuugaggauuauuuaacaucugguugauuuuuguuuugucacucuuuucugacaacuguacgugagaaauagucucauuuugguugucuuaagacuuacuuacgaaaacgaagaccuaauauuucaguuaguuuaucaaauguacauuuugaccuugcaaauaucgauucauuuauuuaauucuuaaaauacuugagcaugucucauggaggagguggcauuugaguuaggucuaaacagaugaguaaaguuuggaugaaggaaguguaggaaauguauucaagcagccaaaacuacagauuuagaauugugaaagguguuagaagaaauguacaugggcugaguggaggccacugcaaaaauuggacaguguguugaguuguucaguuauaagacacugcuaucacuuggucaccuauaaauugggaauaauaggaaggaagaccuuccucauagaacuguuuuaaggguuuuaugagauaagcaagugaaauuccuaggacaaggccuagcacagaguaagcgcucaauaaacgcuaccugauggacauaccaugaggccaaagaagugaauuagggccagguugugaauggcauuuuauggcaagcagaguuaguuuaguuuugcacuuauguguuagggacuagagauaaggaagaaagauagccaugggccagauacaguagcaagccuucugggaugggccaaggccugggaaaugauguuguuaucuuuuacaauagucuuuccaaaauuguggauugggaccuggugauucuugagagaacucccucuagguaguuaaauaacaauauuaaauuaaauagccuugauuucuccauagaggaauggauagaaagaugaugucugaaaaaggaaauacagcaaaugccagaugauaguaucuagaugaugggcauauagguguucacuguucaauuuuuuucaacuucucuguauacuugaaaauuuucacaauacaguauuggggaaaauugagaaaguguauucccucuuuaguucuuuuucaauuccagaaaaucucaagaaagucucuuggugccaauauggcuuaaacacuuugcuuuggcucagagccacuggcagccuguaucuaguuacaauuuaauaaaacuauuguacauuuucccagguuugguagcuugagccuguaauuucagccacucaggaggcugaggugacaggaucgcuucagcccagguguucgagaucagccugggaaucauagcaaaaccucaucucaaaaaaauauuuaaaaguuagccaggugugguggcacgugucuguuguccuagcuacuggggaagauaaggcgagaggauugcuugagcccaggaguucaaggcugcaguaagcuaugauuaugccacugcacuucagccugggcaacagagcaagacccugucucuaaauuaauuaguuaauuuuaaaaaaaauacuguuuuuuuguauuuuauuaucuucaauuuauaggaauuaauauguuauuuuucguauugauagugauacuguucucuuuucaaauaauguauuuaagcuuuaaaauauucagcauggccgagugcagugucucaugccuguaaucccaucacuuuuggaggccaugcagguggaucacuugaggccaggaguucaagaucagccuggccaacauggcaaaaccacaucucuacuaaaaauacacaaauuagcugggcaugguggcacacaccuguagucccagcuacucagggggcugagcgugaggauugcuugaaccugggagguagaagcuccagugagcgaggucacgccacugcaccccagccugggcaacagagugagacuaugacucaaaaauaaaauaaaauaaaaauaaaauauucagcaaauagcaaacagauagugugcacuguugugguaaaaaaaaaaaaggcagagguauuauguacaugucugaugacugcuauaggaaaaggaggauuauugaagaauuugaaguaaaggacuggacuaauuguuuuggaaguuaaauuauucacccucugcucuuuguaugacugcagaaugaauauagaguuuugggcuuuuauaguuccucuagucacuguuaaacuucaauaugugacagugacugccugucugcauguucagauuuucuucacaagccuaugaaagcaaagaucccagauaaagcucauaggcuuucuagugcuuaagauguggcacucuuuacuugcuuuuggaaaacauucacauauuuccuaaaggggcaagagauauauauucuugaaauaaaauagagccacuuaaucagagugguuugccaaaggggacugccuguggauuggauuuuaaucugucugucacagucaccuuuucuuuuuagaauguucuuaauagaauuuagaaaacaccauaaaauaccucacuuauauaaaguaaauguaaaauaauguguuucugugaaagcaaaaaagcaagaaauauucaaauucaacaguguuuuuauauuacuuccaucugucuauuguuacaauucuguguucauuacuaucucaauggaauucaaaaguuuuuuuucacuaccagaaucaacaguaauaaugauaagcagucagaauaacuagacuuuacccacuaaaagaaaagaaaaaaaaaccuuuuuuacacuugauucagaaauaguguuuuuucaugcaguuuaaacauuguaaaaguguauuguuuccuaguaccagcuauauguccuuaugaacuuucauauuucugauaaauuguuagaaguaaaacugcuaaagcaacauauuaauauuuuaauuguuaucuacuuuuugaaacaaaaaguagcugguaucucagguacuccugaggucgggaauuugagaccagccuggccaacauggcaaaacccugucucuacuaaaaauacaaaaauuagcuggguaugguggcacaugucuguaaucccagcuacucaggaggcugaggcaugagaaucacuugaacccgggagcagagguugcagugagcugagauugcaccauugcacuccagccugggcuacagagucagaauuuaagugugacucuucucuguuccccuucugauauguuuacaugucuccuaauuuguucuuuaaauaaauggacccaucauauauguauucugugacuuacauuuuuaccuaauaggucuuagauuuuuauguuaauacaaaugaaacuauuucauucauuuuuaugacugcauuccauaaaaugaaugauaauguauuaccaagucccaucuugauggcuauuaaguuauucauaguuuuuuggggauuuuuuucauccagugaauaucaucuauauauccuuaugaacuuuuguauuucugauaaauuguuagaaguaaaacggcuaaagcaacauauuaauauuuuaauuguuaucuacuuuuugaaacagauuuucucagccgggugcggugggucaugcuuguaaucccagcacuuugggaggccuaggcaggcggaucaccugaggucaggaguuugagaccagccuggccaacauggcaaaacccugucucuacuaaaaauacaaaaauuagccggccaugguggcacaugucuauaaucccagcuacucaggaggcugagacaugagaaucacuugaacccgggagcagagguugcagugagcugagauugcaccacugcacuccauccugggcuacagagcaagacuccgucucaauaaauaaaugcauuaauaauugucucaauaaauaaauaaaaugggacaaauuuuuucaaguuuuuaugaacuuucuuuuccauuggcaaauauguugauuuggaauauaguucauuaauuacccaauacuucuguugugggagucaaagcuuccuccugaaguaucuuguuccuguuuucuguauccauucaguguauuguauucugcauuucuccugcccuccaugacacacauuuuuccauuucuguacccccagauugugggcauaaucaaaucagaguuguacugauuuuuguagcuaccugcaucuaucccaaugccugccauguaauaacugcucaaugaauauugaaaagaugguaggaaaaaaacucauuccuacacuuauaaaaucauauuuucuauauuuaaacagucacuuuuugguaaugacuuguuaagacauucccucucauuguugggguucaacuuuauagucaauuuuguauuuaauuauaguauuuuaugguacuucuaguauuauuacaguugagaaaugagguagaaauccuagauguuaguagguaaaaugauuuuuuaaaauuaacucaguuuuauugaccuugaauuuuagcauguuuuucaguaggugauuccuguuaacaucugcauuuugacaacacacuuaaauaaaacuagugaaccagagaacaaugaauuuucaucagcuaauuacuagugaugauuuuaaccuguuucaaaaaacuaauguuaaccuuuuuugauuuuuaaccauuuucuuccucaaacauaaaggauuauuuaaaaauuugcaucuuauuaaggauuacauuaauggaaguaugcaauuaauagauaaucuuuuuuuaauaugucacaauuuaaaauaaagugaauagugauuauagugaauaaaguguguaguuauauauuuuucuaaaagugaaauacccuuuuaaugaccaacauucuuugagugccuggcauuguuuugccuaaaaagaccugcacauggcugggugcaauagcuuacgccuguaauccaggcacuuugggaggccgaggcgggcacaucacaacgucaggaguucaagaccagccuggccaauauggugaaaucccaucucuacuaaaaaaaaaaaaagaaauuagccaggcgugguggcaggcgccuguagucccagcuacucgggagggugaggcaggagaaucccugaacccgggagguggagguugcaguuagcggagaucauacaacugcauuccagccugagugacagagcgagacucuaucucaaaaaaaaaaaaaaaaaaaaaaaaaaaaaaauguacauauguacauauuuagauaccggagagaucuaauuucuuuuuuuuuuuuuuuuuuuuuauauacaaauguuuauagcagcauuauucauaacagccaaaaaguagaaacaauccacuuuccaaggaugaaccuugaagugauugccuaaauuauccuuuuuacuuaggcauucacuuccaaauccagcugcgcauugacaucaccugggaagcuuaugcagcucccuggcaaucuuugaggaugggauaccuggauuaauguuugaauccagacuagacgaucucuaaggucccugauagccccaaaacuuguauaaaaucucuaauagugggucaccaaugcccacaucuuugaagaagagacauuauugguacuuggaacaggucucccgauagguccgucuagaagccuaaguugguucuucucuuaggcaucaucccaaccuccucaagguugaauaaacauauucuuaacaaggaugaacuauggcugaagggauaggucacaucugauuaugucuguguagucugcuauacuaagaaaucaccccauuuugaagaaaguuacucauuagcacagaacuugucgcugcaguugagaauaaccaguuccuccuucuaugacauuuuuuuuuuuuuuaaaugaaauuuuucaaaauaacuuuaauaaccacuuuuacacugagcagaauaugucucucauucucucaaaaauggucaggagauaauuuuuucauuuaugaguuucuauugcagcuuucauuuucuuuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcgguugggcucaccucccagacggggugguggccgggcagaggggcuccucacuucccaguagggggggccgggcagaggcgccccucaccucccggacggggcggcuggccgggcggggggcugaccccccaaccucccucccagacggggcggcuggccgggcagaggggcuccucacuucccaguaggggcggcugggcagaggugccccucaccucccagacggggcggcuggccgggcaggggggcugaccccccccaccucccucccggacggggcggcuggccgggcgggggacugacacccccaccucccucccggacggggcggcuggccgggcagaggggcuccucacuucccaguaggggcggcugggcagaggcgccccucaccucccagacggggcggcuggccgggcaggggggcugaccccccccaccucccucccagacggggcggcuggccgggcgggggacugacacccccaccucccucccggacagggcggcuggccgggcagaggggcuccucacuucccaguagggguggccgggcagaggcgccccucaccucccggacggggcggcuggccgggcggggggguugacccccccaccucccucccggacggggcggcuggccgggcagaggggcuccucacuucccaguaggggcggccgggcagaggcgccccucaccucccagacggggcggcuggccgggcggagggcugacccccccaccucccucccggacggggcggcuggccaggcggggggcuaacccccccaccucccucccagacggggcggcuggccgggugggagggcugacccccccaucucccuccuggacgggguggcuggccgggcugaggggcuccucacuucccaguaggggcggccgggcagaggcgccccucaccucccggacggggcggcuggccgggcggggggcugacucccccaccucccucccggacggcacggcuggccaggcggggggcugacccccccaccucccucccggacggcgcggcuggccaggcggggggcugaccccuccaccucccucccggacggggcggcuggccaggcggggggcugacccccccaccucccucccggauggggcggcuggccgggcggggggcugacccccccccaccucccucccggacgggguggcugccgggcggagacgcuccucacuucccagaugggguggcugccggguggagaggcuccucacuucucagacggggcagcugccgggcggaggggcuccucacuucucagacggagugguugccaggcagagggucuccucacuucucagacggggcggccgggcagagaugcuccucaccucccagacggggucucggccgggcagaggcgcuccucacaucccagauggggcggcggggcagaggcgcuccccacaucucagacgaugggcggccaggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcggccaggcacagacacuccucacuucccagacgggguggcggccgggcagaggcugcaaucucggcacuuugggaggccaaggcaggcggcugcuccuugcccucgggccccgcggggcccguccgcuccuccagccgcugccucccgaggggcgcucgccggcgcggcggcaaagacugagacagcuccgcugcccgcugaacuccauccucccggcgguccgagaucuaauuucauuaguuccucaauauccuuggggaauugguuccagacucccuugcagauaccaaaaucagcacaugcucaagucccugauauaacaugauacaauauaugcauauaaccuagacacauccuccuuuauaguuuaagucaucuccagauuacuuguaauaccucauacaauguacuugcuauguaaguaguuguuauacuguauuguuuauggaguaugaccaaagaaagucuguacauguuaagcacaggcaaaaccguccuuuuuuucguuucugaauauuuuuauaccgugauuaguugaauccauggauguagaacccauggauagggagagcugauuguauuauuuaugugugugacucuuacaauugugaaggggaugcacauuucaggagugcauuuuuauuuugucugaauucagucugggaaaugauuaauuacagggcaauauuucuugucaaguugugaauaaauauguuuagcauuaguauagauguuuacaaacaagaaaacucauacugcuugccaagcaguugauuaaaaaaugcauucaguucaccacaaagucucuguaggaaaaaucuuuacauuuguauggguuggcauuuaguaauuaaaucucuaaauauuuugauuaggcugaaggccacccaaagucuuuggucauaucugaaaaacacuuucagccaucaguaggaacaaagcucuaggacagccacugucauuuucacaggagucuuaaaucuagagcagugugcauaagaauccccuggaaagcccuuuagaacacagauucuucagccccaccuuuagagauuccaauuuaguagcccgggguggggacgcaaaaugugcaguugucacuagcuucaggccaauacugaugccgcuguuccagguaccauaguuugagaaccacuguucuggggauuucaguugugauuugaaaguagacagccuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggagguggagcuugcagugagcugagaucccgccacugcacuccagccugggcgacagagcgagacuucgucucaaaaaaaaaaaaaaaagaaagaaaguagacagccagauugaugaaaucaacccuuuuuaaaaaggcuuuugcuugacagguauuuuauauauuucagaacaagauacugaugggaaagaaagauggcaaaguguuuucuguaagauuugggaggaggagcagaugggaagccaguauguuugcccuuuuauuucucuuuucauuaacagcaguggggaaauauucugaguuauuuuucuugguuccuuucaugcccucuccuucuuuccuaacagcaaguauguuggaaguggcuugaacucugccacuucuagcaaugucaucuuggguagauuacuguauauguuaguuaucuguauuacuuuguaacaaaagauccuaaaguugagcaacuuagaacaacaucuauuaucacucccaguuuuugaggguuggaaauacaggagcagcuuagcuggguuguucuggccaggggucucccaugagguuacaaacuguugguuagggaugcagucucagaaguauuuggaguauguuuucaagcucacacgcagacauauuugcaggaggcuucaauuccuucccaugagucuccauagggcuacacaugacaagacaggagacucaacacaacacugaagccacagucuuuuuuuuuuuuuuaaguucugagauacaugugcagaaugugcacguuuguuacauaguuauacacaugccauggugguuugcugcacccaucaaccugucaucuacauuagguauuuguccuaaugcuaucccuccccuagccccccagccccugacaggccccagugugugauguuccccucccuguguccauguguucucauuguucaacuccuacuuaugagugagaacaugcaguguuuaguuuucuguuccuguguuaguuugcugagaaugaugguuuccagcuucauccauguccugcagaggacaugaacucauccuuuuuauggcugcauaguauuccaugguguaugugugccacauuuucuuuauccagucuaucauugaugggcauuuggauugguuccaagucuuugcuauuguaaacagugcugcaguaaacauaagugugcaugugucuuuauaguaaaaugauuuguaauccuuugucuauauacccaguaaugggauugcuuggucaaaugguauuucuaguucuagauccuugaggaauuaccacacugucuuccacaaugguugaacuaauuuacacuccuaccaacaguguaaaagcauuccuguuucuccacauccucuccaguaucuguuguuuccugacuuuuuaaugaucgccauucugaauggcauuagaugguauuucacugugguuuugauuugcauuucucuaaugacugguggugaugagcuuuuuuucauauguuuguugcugcauaaaugucuucuuuugagaagugucuguucauauccuucacccacuuuuugaugggguuguuuguuuuuuuccuguaaauuuaaguucuuuguagauucuggauauuagcccuuugucauauggguagauugcaaaaauuuucucccauucuguagguugccuguucacucuugugauaauuucuuuuucugugcagaaagcucuuuaguuugauuagaucccauuugucaauuuuggcuuuuguugccauugcuuuugguguuuuagucaggaagucuuugcccgugccuaugucaugaaugguauugccuagguuuucuucuaagguuuuuaugguuuuaggucuuacauuuaagacuuuaauucaucuugaguuaguuuuugcauaaaguguaaggaaggaguccagcuucaguuuucugcauauggcuagccaguuuuccaaacaccauuuauuaaauagggaaucuuuuccccauugcuuguuuuugucagguuugucaaagaucagauggcuguugauguguggcguuauuucugagggcuuuguucuauuccaucggucuauauaucuguuuugguacuaauaccaugcuguuuucguuacuguagccuuguagcauagcuugaauucagguaguaugaugccuccagcuuuguucuuuuugcuuaggauugucuuggcuguaugggcuguuccuggguuccacaugaaauuuaaaguagauuuuucuaauucugugaagaaagucagugguagcuugauggggauagcauugaaucuguaaauuccuuuuggcaguauggccauuuugacgauauugauucuuccuauucaugagcauggaauguuuuuccauuuguuuguguccccucuuauuuccuugaagagugguuuguaacucuccuugaagagguccuucacaucccuuuuaaguuguauuccuagguauuuuauucccuuaguagcaauugugaaugggaguucacucaugauuuggcucucuguuuguuauugguguauaggaaugcuuaugauuuuuacacacugauuuuguauccucagacuuugcugaaguugccuauuagcuuaagaaaauuuggggcugagacaaugggguuuucuaaauauacaaucaugucauaugcaaacagagacaauuugacuuccucuuuuccuauuugaauacccuuuauuucucuugccugauugcccuggccggaacuuccaauacuauguugaauaggaguggugagagagggcauccuugucuugugccaauuuucaaaggaaauacuuccagcuuuugcccauucagugugauauugucugugggauugucauaaauagcucuuauuauuuugcgauauguuccaucacuaccaaguuuauucagaguuuuuagcaugaagagguguugaauuuuaucaaaggucuuuucugcaucuauugagauaaucaugugguuuuugucauugguucuguuuaugugauggauuacguuaauugauuuguguauguugaaccagccuugcaucccaggguugaauccuacuugaucgugguagaaaagcuuuuugaugugcuacuggauuugguuugccagaauuuuauugaggauauuuggauugauguucaucauggauauuggucugaaauuuccuuuuuuuauugugucucuuccagguuuugguaucaggaugaugcaguccuuauaaaacgaguuagggaggagucccucuuuuucuauuguuugcaauaguuucagaaggaaugguaccagcuccucuuuguaccucugguagaauauggccgugaauccgucugauccuugauguuuuuugguugauaggcuauuaauuacugccucaauuucagagcuuguuauuggucuauucagggauucgacuucuuccugcuuuagucuugggaggguguauguguccaggaauuuauccauuucuucuagauuuucuaguuuaucuguguagagguguuuguaguauucucugaugguaguuuguauuucugugggaucagugaugaucucccuuuuaucauuuuucauugugucuauuugauucuucucucuucuuuauuagucuggccagcggucugucuauuuuguuaaucuuuaaaaaaaaacagcucuuggauucauugauuuuuuuugggugggaggaugaguuuuucaugucuuuaucuccuucaguucugcucugaucuuaguaauuucuuguuuucugcuaccuuuugaauuuguuugcucuugcuucucuaguucuuuuaauugugaugugagggugucgauuuuaggucuuucuugcuuucuccuguaggcauuuaguacuauaaauuucucucuaaacacuuccuuagcugugucccaaagauucugguacauugugucuuuguucucauugguuucaaagaacuuauuuauuucugccuuaauuucauuaguuacccaguagucauuuaugaacagguuguucaguuuccacguaguugcgugguuuugagugaguuucuuaauccugaguucugauuugauugcacugagccacagucuuuuuaucacuaaucgcagaagcgacagugcaucacguauauguauucuuuucacuagaagugagucacuaagccuacccauacuccaaggaacaaaugaguuccaucucuugaagggaguauuaaagauggacauauccuuaaaaccaucacacuacauuagccucaguuuucuguuccauaaagugggaaagugauauuucauaguggcucaguaaugguaguaauuaaauuauucugaugauuauaauuuuuuaucauaaucauuaucaucucuuaagaacuuuacguucaaccaaauuuucugaugcaugaaauucuccccaccuaaauccauauuuuauaaacugccacauaucauaaaagccucuucuuuuaaaaaaaaauagaagaaauuuacccuuauaauaaagccagccucucuacagccaaaaaaguuaaagacugauauuaauaugauuauggaugagaacaucuguaauaauuuauuuauugaauaggagucagcaacuauuaaaugaauaagccguauuaccaagugggauguauccugacacacaaagacuguuucuaucugguacguuaaaaagcuaucguaucauuuagccuuguaguccaugucugguauuuugucuuaagaaaauaauaccagcauuuuugaugccagaagauguuuaacacaggauuguauuuucaggcagccuuuaaaauggccccuagugauugauccuuaucucuuguuguucaggcucuuguguaaucaccuccccuugcaugugggcuuuaccugcugacucacaucuaaugaauagaaaugaaauaauucgguuauaaaaaagacugaagcuucagucuugggggcugcugcuugcucucucuguuuacacacaguauuuuuuuuaaccacaccuggcauaaaacuucuccccacucccagaaacauacuagaaggaaauauacaaaauuaauaauacucaauguguuuaaguguuaggacucugucauuugaucuacuuuuuuguguuuuucuauuuccuaucuugaucauauauuauuuuacaaaauggcaauauuuaaaaggaaaacaauaaauaaaagaaaagaaaaagcaaagaaaaaggacaaaguacauguagguguuuaaacacagguaacauuugaaaaacauuugauuguuuagugagaaaaaaguugaaaugugugcauuuguauuuaaauaccuacaaaaauguauaauuuguauucaagauuauauaauauugaaaauuugugugguggucauacaucacuuauaauuuuuuuaagcacuaaaugagauguuuauacaaaaauacugguaaauuuuuaccuaacacuugcugaugaaaaguaucauguaaauuucuaguaauaauauugaugaugauauagugacaacuuaguaaaaguccuauaguaauccaggcaacagacuugacuagcacaucgcugcuaguugguuccucccaauccgaauccuucaaccagugaagauuuuugaaucguuggucuuguuuggcuacaggauuuuuauaaaugccauucaaugaagauuugcccucuggccuucuugauguugguuuacccucccuccuccagucuauuauuuagcauggugaugccuuccauaaugacugagcccaucuccuugugggcucucuuugggguccacuaugggucacugugauaugggugucuggcaaagggcuggaaagcaggaacauuaaauuacuucaguuucagaccacuuacuuuuucuccugcaggaacugaagcagagcaagauuuuguuuuccugcucauucauuauuagcaguagccuugucuuuagaaaaaagcagguuauuuuucucacuuuugagccuuugguucuuaaaauuaccugaagcacuuugagacuugacuucauuucauaucuuucugugaugcucaaaacuaauguuugcccuuaauuuuuuuagaauugcucaaaccaaauaaaauaguuucccaaguaccaaauuuacugcuauaacguaugcaucucuucggauagcaaauacaauuucaggaccgcuuuugggagacacuauuccucacauacuuauauuacaaacaguauuaauagaacuucagucuaaaauauaugaagaaaagaacaucuaacuacauuuaaugguuaguggaaauuccauuuagcuauguucguguuuguuccuaagugaaguuauuuaaggggaaaacagucauaauugagugagcauauaauguugucuugucuguacuugauuaaagcaaaacagauuacauuuagggcccaucuuucuuaauagaaaaucacaucuaaaaaauauuuucuuuacuuucacuagcuuuccuauucuugcaaccuuagaggcacauauguguggacauaacauugggcuuagauaauguguauucuuuuuaauccauaagaugaugcauguacauucuccccacugagucuuaagggcugcugcaauuugaacuguguaguaauuuugcauuuucauuuucucugacuuaacgaugucuauaaauaaagguggcaucuuacuuuaauaauaaaaaacccauuaucgccaugugguggagauaacauauuaucauuaccacuauuaacaacugcuaguguuaauaauacauauuuucugcuucagccagagccaccuugcauuugaagcaaaaguuugagguauuauagccuuuuaaguuuauuauucuuccuauguuuuguucaaaaggaaaauaauuguuaaaggauccugaaagcauauuguuugggccuaaaucaauauuacaagguugcaaacugcagucauacaaguguacuugugauuugcugagaaugagaacugugguccucaaaccuuugucagcuguagcuacaccagcccauggaggagagguccuacuguaguuuacccacucaagcagauaaacaggagaaagcaagugagugcagaaaaagcuauuauacgauugaccuugagucuuuuguacuucauuuagaagcacaaguacauuauucacagauuuauauauuuaauuaucauuaguuacuggugaagaacuuaccuaacaacaguugagacguagaaagaaugcacauuuaagaacugguacaauguaucagauuggacuugacccagcccuuuugggugcaguucucuugcccauuuauuuggaaugaaaagagaaaagaaaugaacucauugcaucucauguugcuaugugguauacauagucacauauauaugaaaucugauaaagaaggaaauacauuuuuaaaauaaagccuuugcuuuguauucagauuugacugccaucuacccuucucccaaccaguauaaaauauuacugcuggccuuccccuucucucauccuaaguguugagaaauaauuuuaacaccuuuuuuuguuagguacccuauguacaauauuuaaaagcagauucacagucccacauuguuguuauuguuguuguuguuauuguuagagacaggaaccagacuggaauacaaguggcaugaucaccacacacugcagucucaaccucccaggcccaagaaauccucccaccucagccuccccaguagcugggacuacagauaugcacuacuaugccugacuaauguuuuucauuuuuuguagagauagguucuugcuguguuucccagccuggucucaagcuccugagcucaagagauccucucgccuuggccucacgaagugcugggauaacggacgugagccacuaugccuggccacaauuuuaaauugaacuuauuuuagcagcaucaauuucuugauuauguuaaacaacagaaaugaucauauauauuugugugcucacuuuucugcuuuucaaagagauuucugacagaucauuucauuugcuccuguagcaguuacucguacuuuagugauuugggguugcaagaucaguacuuacgagaccugcuucuucucaugcacuuugucaaccucuaguguaugugugguggccucuuggauuugcccucauggcucaauuagacagaguucucguagguauugaaagcuuuuuuuuaacuacaauuuuuugugaacagaaauuaagcuaauuauuaaaccagcaagaaaacaguuaaaaagcuguguuuuauagauguuuuuguagagcuaggcuaacuaagcaucucugugcaaauaaguuuuuuuuuuuuuuuacuaaaucccgcaccucauacuuccuagcuaauaugacccugguuuagucuuuacaccuuaaauuuaauucacccaaugucuggauuuauuauuaauucugcuaggaacucucuaucccucugggcauuugagcaguuugcuuauuaaucagcuaaugugguaggcucaucuaccucgcuacucaguuuauaccucauuucgcaguucucugcaggaagaaauagccuuuuuuccucacacagcagcuagcaaaaagaaaggucacucagucacuugaaucugggcccacucccccaucuucuagaaaggauucucccuccuuccacacccaccgugcgcaccuuccuaucuuuauccucagugggcaucacggcucacauccgaaaguuucccugaauaaaauugguuccuuucagccaauugcaagcacagaugaggucacaacugguaaauggaaugaaaaaauaaaccaguagcauauuuagcuugaaguaacauuccagcuaaauauuuuaaaacuuguuaaacaggguuuggggaagccauaugaagugguuucuccuggaggucaacuuuaggguuuuucaaaugguuauaaagugguguucuaugggguagcuuuuauagaagggcuauuuugaacuuuuacuagaggaaauggcuagcagcaaccucccccaacccccagaaguacagugaggaaaaacccaaaagacaaauaauagacacccuuuccccuaacauaggggagaacaguacagcauaacaagauaccaucucagcuuuauuucuuaccuauucagaggauuuuaagaucaggaagcucgagagaaauuaguuauuccuucaauuuaauucaauccaauaaaagaguauggaguuccucuucguuuuaaaauucugacugugguguuacggaaggaccuucuaggugaaaggguaaccgaaauaacaaagguuccauuucguccuucagcaaauucaaaagcuugagagcgagucauacaaugugauuauuugauaauucucucuauauucugauagaagaaccagagggauauaaaagacagaaagguaaaaugggauggcauaugguaacaacuggaggcuuagaaccuagcagaucggggucaccauguuggaugaaugugaaggguaauuaugccgggagaggucacaagaagaaucuuaaaugaagcuucuaaggauaggcaggauuuuaccagguguaaagaaaaaggaagcucuaggcauaaggauagaaauuagauaaaaaauaaacaacaaauuuggaauauaauauuguauagcuggaacguuuauaguugaccacagaaaguuuccuucgcagcuguuugcccaagguuucaccagugcaugugacuuuguauuucaaaucagaccuuguugaucauaaauuaauauuaucaccucuaguacuguccuagaccugcaggauacagcauuuacuaagaccaauugcugucuguaaaaagcuucuuagucuaguauaauaugcagccaguuacuugcugcuucuuuacugaaacaaguuuaauaaaccagcaaaacaaugccuagcaacccacuguugcuggguuuaaaaguaaagaugcugguugucaucugccaggcguguacuucaaaagguaguuagccucccaucuagccucccauuguuaaaucuagugccugcuaacaguaucucuugacagcugaaaaaugcaguugggacaaagggaaucugaacagaccauccaucauccccuuccugcauuucuuaagguuagacacccucaauguaccacccaaagagaacaaacauggucuccagugcccaauugagccaccagcugcugaccccuaaguaauuauuauuuguuuguauuuaacuuagguuuucuuuuauuauuuuauuauacuuuaaguucuaggguacaugugcacaacgugcagguuuguuacauguauacaugugccauguuggcuugcugcacccauuaacucaucauuuacauuagguauaucuccuaaugguaucccuccccccucccgccaccccacgacaugccccggugugugauguuccccaccguguguccaaguguucugauuguucaguucccaccuaugagugagaacaugcgguguuugguuuucuguccuugugauaguuugcugagaaugaugguuuccagcuucauccaugucccuacaaaggacaugaacucaaccuuuuuuauggcugcauaguauuccaugguguauaugugccacauuuucuuaauccagucuaucauugauggacauuuggguugguuccaagucuuugcuauugugaauagugucacaguaaacaucaauaccuaguucacugagaguuuuuagcaugaagggguguugaauuuuaucaaaggccuuuucugcaucuauugagauaaucaugugguuuuugucaucaguuuuguuuaugugauggauuacauuuauugauuugcauauguugaaccagccuugcaucccagggaugaagcugacuugaucuugguggauaaacuuuuugaugugcugcuggauucaguuugccaguauuuuauugaggauuuuugccucgauguucaucagggauauuggucuaaaauucucuuuuuuuuuguugugucucugccaggcuuugguaucaagaugaugcuggccuuuaaaaugaguuagggaggauucccuccuuuucuauugauuggaauaguuucagaaggaaugguaccagcuccuuuuuguaccucugguagaauucggcugugaauccgucugguccuggacuuuuuuugguugguaggcuauuaauuauuaccucaauuucagagccuguuauuggucuauucagagauucaacuucuuccugauuuagucuugggaggguguauguguccaggaauuuaucaauuucuucuagauuuucuaguuuauuuguguagagguguuuauaguauucucugaugguaguuuuuauuucugugggaucgguggucauauccccuuuaucauuuuuuauugcaucuauuugauuuuucucucuuuucuucuugauuaaucuugcuaguggucuaucaauuuuguugaucuuuucaaaaaaccaacuccuggauucauugauuuuuugaaggguuuuuugugucucuauguccuucaguucugcucugaucuuaguuauuucuugccuucugcuagcuuuugaauguguuugcucuugcuucucuaguucuuuuuaauugugauguuagggugucaauuuuggaucuuuccugcuuucucuugugggcauuuagugcuauaaauuuuccucuaugcacugcuuuaagugugucucagagauucugguauguugugucuuuguucucauugguuucaaagaacaucuuuauuucugccuucauuuuguuauguacccaguagccacucaggagcagguuguucaguuuccauguaguugagcgguuuugagugaguuucuuaauccugaguucuaguuugauugcacuguggucugagagacaguuuguuauaauuucuuuucuuuucauuugcugaugaguuuuuuacuuccaacucuguggucaauuuuggaauaagugcaauguggugcugagaaaaaauguauauucuguugauuuggggugcagaauucuguagaugucuauuagguccacuuggugcagagcugaguucaauuccuggguauccuuguuaacuuucccucucguugaucugucuaauguugauagugggguguuaaagucucccauuauuauugugugggagucuaagucucuuuguaggucucuaaggacuugcuuuaugaaucugggugcuccuguauugggugcaucuauuuuuaggauacuuagcucuucuuguugaauugaucccuuuaccauuauauaauggccuucuuugucucuuuugaucuuuguugguuuaaagucuguuuuaucagaaacuaggauugcaaccccuucuuuuuuuuguuuuccauuugcuugguagaucuuccuccaucccuuuauuuugagccuaugugugucccugcacgugagauggaucuccugaauauaggacacugaugggucuugacucuuuguccaauuugccaguuugugucuuuuauuuggagcauuuagcucauuuacauuuaagguuaauauuguuaugugugaauuuguuccugucauuuugauguuagcugauuauuuuucuuguuaguugaugcaguuucuuccuagcaucgauggucuuuacaacuuggcacguuuuugcaguggcugguaccgguuauuccuuuccauguuuagugcuuccuucaggagcucuuguaagacaggccugguggugacaaaaucucagcauuugcuugcccguaaaggauuuuauuucucuuucacuuaugaagcuuaguuuggcuggauaugaaauucuggguugaaaauucuuuucuuuaagaauguugaauauuggcccccacuaucuucuggcuuguagaguuucugcugagagaucagcuguuagucuaauggacuucccuuuguggauaacccgacuuuucucucugggugcccuuaauauuuuuuccuucauuucaacuuuggugaaucugauaauuaugugucuuggaguugcucuucucgaggaguaucuuuguggcauucucuguauuuccugaaucugaauguuggccugccuugcuagguuggggaaguucuucuggguaauguccugaagaguguuuuccaacuugguuccauucucccugucacuuucagguacaccaaucagacauagauuuggucuuuucacauagucccauauuucuuggagguuuuguucauuucuuuuuacucuuuuuucucuaaacuucucuucucgcuucauuucauucauuugaucuucaaucacuaauauccuuucuuccacuugaucaaaucggcuacugaagcuugugcaugcaucauguaguucucaugccaugguuuucagcuccaucaggucauuuaaggucuucucuaugcuguuuauucuaguuagccauuugucuaauauuuuuucaagguuuuuagcuucuuugcgauggguucgaacguccuccuuuagcuuggagaaguuuguuauuaccgaucgucugaagcuuucuucucuuaagucgucaaagucauucucuguucagcuuuguuccauugcuggcgaggagcugcauuccuuuugagggaaagagaugcucugauuuuuagaauuuucagcuuuucugcucugguuucucaccaucuuugugguuuuaucuaccuuuggucuuugaugauggugacgcacagaugggguuucgguguggauguccuuucuguuuguuaguuuuccuucuaacagucaggacccuuagcugcaggucuguuguaguuugcuggagguccacuccagacccuguuugccuggauaucaccagcagaggcugcaggacagcaaauauugcagaacggcaaauguugcugccugauucuuccucuggaaguuucgucucagaggggcacccugcuguaugaggugucagucggccccuacugggaggugccucccaguuaggcuacucaggggucagggacccacuugaggaggcagucuguccauucuccaguucucaaacucugugcugggagaaccacuagggauguuuaagucuccagaaguuccugcugccuuuuguucagcuaugcccggcccccagagguggagucuauagaggcaggcaggccuccuugagcugcagugggcuccacccaguucaagcuuucuggcugcuucguuuaccuacucaagccucagcaaugguggacgccccucccccagccuugcugccaccuugcaguucgaucucagacugcugugguagcagugagugaggcuccaugguugugggacccucugagccaggcaugggacauaaucuccuggugugccauuugcuaagacuguuggaaaagcgcauuauuuggguggaaguguccugauuuuccagauacuguuugucagggcuucucuuggcuaggaaagggaauucccugacccuuugugcuucucaggugaggugaugcccugcccugcuucggcucgugcuccaugggcugcacccaguauccgacaagccccagugauaugaaccucguaccucaguuggaaauggagaaaucacccuucucuugagcuguagacuggagcuguuccuauucggccaucuuggaaccucuuccuauuuaacuuagguuuuaagguugaacugacuuuuccuaccaacuagauagucaauugacaacauuaguucugggauauaaugugcccauagaaauacuuuugaccaguagcuuccuugauauuaaggcauuucugaaaccaagcauuugugucuaugaacaauaaaaucaggucuucaguugcugaccugguuucuauuguuuacuuucuugucaagggcuucuccuccucaaaguuauuuuaaagccugaucuuacaacaauaaauucaguuucaccugugaauugguaggcuacuuuuaaaggaaaauguuuuucuaaaaaaagaagagugauaacauaaaauacauaccuuuggcuauuuuaggugacuggaaccauuacuaauaaucaguuucauucagcaaaaaaaccguucuuucagguaauauauaaaaccuuuuguucauccuuaguauaaggccaaucgguaggaagaaauccuauuguaaauuacauucuuaguguuacuuauuauuuuauguguuuaaaguaggcaaaggaugcuuggucaaauggauggauuuugccacuuuuuuuuuugagauggagucuugcucugucgccagguuggagugcaguggcaagaucucagcucacugcaaccuccgcuuccaggguucaagugauuccccuccucagccucccagguaguugggacuacaggcgcgaaccaccacaccuggcuaauuuuuuguauuuuuguagagaugggguuucaccauguuggccaggauggucuugaucuccugaccucgugaucugccugccuugggcucccaaagugcugggauuacaggugugagccacugcgcccagcaugccaccuauuuuaauuagcagaaaagagugucaugcuauuaaggaaucaaguauuuauaaaugagacauuucaauacuggagaaaaguuuauuuucuugaauaugguaaguauguucuuuacagucuuacuguaauauauauuuuuuuacucagcaaauacuuuuccuuaaauauugcaaagguaaauuguggaagaguccuccauauucacauucugaacaaauggaguuugaaaugaagaguuuuaauuguuugugcagagccauuauuagcauuuuggguaaucagagcuuucuuuuucaccuaauauauucuuucuuauaugucuguuuuacuugcuuucaaguauguuuugguuauuguacaaaccaaccuuaaugaccucaggugcuaauaugacacugaguuuuauaaguagugaaauaaucaugauuaugggauuuuguuauuguuugcuuguuuuuuuuauucuuuuagcucaagaaaaagcaaacauuuuaaaauacuaaagcuuggcaaucuugucuugucuaaccuccuggaauagagacuuagcauucucuaauacucucagaguacagaaucuuucucauaggaauugugucauauauuaagugagacaguugguaauugaguuauauucuuuauuacagaaaagcaggaucuuccugagcuggaauuccucucuaacuguacauuaaaauccuuuugagcuuauaguaauauuuuacaagucucuauuugaggcuaaauuuuauuuuugggucauuggaaaccucgacagcucgaauguuuaugcaguaucaugguguccagugaaaauuuacuacaccuguuuuagaguucaccaaacaggacaaauaagagauauaaagagauuuauuauaagguauuggcucauacagucaugaaggccaaggaaucccacaaucugcugucuguaaggcagagacccaggaaggcuggugguauaguuugaaggccugagagccagagagccaauggcuuagcauccagucuaagucuaaaggccugggaaccagggauggcaauggcagaaggaagaugccccagcuaaauaaucacacagagagagcaaauccucccuucuuccaccuuuuuuuuuaugcuuaggcccccaacagauuggauggugcccacccacuuuggugaggguggguauucucuauucagucuaugaauucaaaugcuaaucucuuguggaaacacucucagacacccucagaaauaauguuuuaccagauauccggauaucccauuuuccagucaaguugacauauaaaauuaauuaucguacuuuccaagcaucccaauauuaauucuagggauaaauaauacacuuaggacagaggugugggucaguccacugauaauacccagaucuuauucuguaugccuaaaaugaugcuaaguacaagaaggcaauaccaaguaaaaauaggaaacucuuugcccuguaauuagaaaaacaaaguaaauucauaagucaguuaggaagccauaaaucauaguaaucuuauaugacauugaauuuaaaacuagaagagcgcuuaauucaaaugcaaaaugauucucuggcuaaaggugugggggaaggggaggcgauuguggguggaagauguugaguaggcucaaugagcagccuugauagcagaagaguuggaaggguguaagagaagguaagggcuuuuaggcuggaugauugagcaggagaauacaguaaagagauuguucagauuggcuaaaaguggaaugcuaagcaacauauucagccagauaaaauggggccaaaucuuggagggcaaggaaugcugcugccacuucuauaaucaucguuguccugcagcaguucauuugggguccuccaucaagcagcaguagugagaauggugguggcagaagugaugcuggugguuuuaguaacggccagcaauuacugagcucuuaugacuugccaggaucuuguacuucauguggauuauuguauuuuaagacaugauuaucuauuuuacagccaagaaaaggaggcauagaagagauucauaacuaaccagaggacacagagcuaguauggguauagcuaguauguugagcccgggcaauuuuacacuauauuccguauuucuaaacacaucccuguauuaccacuggacaguaaguagcuacagagagcaacaguuccaaugcaucauccuacauuuuaggagggauguuggugacuagaguccguccagagaaggauaacugggaaaauaaagaguccuugaaucucugugaauggaaauagagaugucaaaaagauaauccgguuugugagagaaagugguaaauugggcuuuagauuccccccuuuuucuccucuuccccaggcacagugggcugaguccccucaccauuguauaucagagauugaagaauuauguacaaauguuuaaauggauuacaagauuauuccagguagauggaacuauuuuuaucagugacaaaagaguuccuaagaguugucauucacugaccuuuuuugaaugagccaucauuugcuuuuauauucuacuaaagcaauccuugaagaucaaguacagagaaaacaaaaucagaguauuuaucaguuucugcaguuuugauuuuccaccaaacauaugagauccuuuagagacuucaugaaguggaacaagaggaagggaagugguguauaguuaguaucagugucaguccuguuauuggucaggaccuaaacaacagaaaugcaguauuucuucugcucuagaauccuagcuauaguaagauaccucacuguuuuaauaaugguguuuuaggagcaaaacucacuucaguaaagggagauauucauucuaagggggauucugaugucaaaaauguuaaaaugucuaaaagcuuuuuauuuuaaaauagcggaaauaagaaguaaguucugcucugaucuuuacagaaucuuguagagcaggggguaagagaaaacugggcaaauauuaacaaaggcagcaugaugugugaguauuugggcuccaagaggugagggaggcaugaggaagauagacucaaaugccaggcacagaaagagccuaaaugaaguugguggauguugggaggagggaauuguagugucuagacuuugaguacucauaucagguuagcccuguaauggaaacauuacaaacaugcauuuuauggaaaugcauaaaauuauuccuagguguauuaguccauucucauguugcuaggaaggaacaccugagacuggguaauuuauaaagauaagaguuuaaauugacucacaguuccgcauggccagggaguccuuaggaaacuuacaaucauggcagaaggcaccucuucacaggguggugggagagagaaugcaagcacgggaaaugccagacacuuacaaagccaucagaucucgugagacucacucagugucacacgaacagcaugggggaaccgcccccaugauccaauuacauccaccuggucccaaccuugauacgugggcauuauuacagugcaaggugagauuuggguggggacacagagccaaaccacaucacugcaccuauuaaccauccacaaacaagacuaaaucaacccuggcagccugguccaaaaaaaccuaccuucuucagccuaauaaauuugucuccaaagacccugaccacauaauucuaccuuccauucucagguccagaagcuuccaccuaaugugauggguguccucacaaccuucugaguauugaccaucucucuugguguagcugaagaugcuuauuaaguguaaaugauacagaugcccuauccgucaguugcccacccuuuaguaagaugcacagacaauaaaaaguccacaguuaccucccuauaggcauuaucuuaguaaauggugaaguagcuauuaaacugggacuuuaugguuuauaagauguucuuaguugagcuaugccuuugaaaucucuuucucauucucaacaucaaguucaccacuagauuauaaaauuagcaaaggcaaagacuaugacuuucuggucacagauuuccuuugucuccacaucucaacacaguuguacacauauuguaagaucuuaguaaaauuguguugaauguucuuuuuuuuuuuuuuuuuuuuuuuuuuuuuugagauggagucucgcucugucaccaggccggagugcaguggcgcgaucuuggcucacugcaaccuccacuucccggguucaagcgauucuccugccucagccuccagaguagcuggggcuacaggcgcacaccaccaugcccagcuaauuuuuuuuguauuuuuaguagagacaggguuucaccauguuggccaggauggucucaaucucuugaccuugugauccgccugccucagccuccuuaagugcugggauuacaggcaugagccacugugcccagccugaauguucuuuuuuuaaacuucccugucauacuuuauugcucaucagagcuauuuagggugaaagaaaaaccucaaguuuugaagcuuagucucugagacucagguagggcugacagccauucaguucuguucugcauuuacuugccucauuugaguaaacuucuuccugccuugaaggacuguacuauauacauguggacugaugacugugcaaaucuucuuugcuuuuauucaaagaauugaaaacauuucucaucaaaauauccugcuccucaacauaaccgaaauagacuuuaaaaagccaauuuuaauuauuuuucuaguccaguuuaugucaaggaugcaauucaguucucuugacagucuuuauauucuaauuaaacucuuccaauuugcaauuuuugucuucauucuucauuuauuaauaaaagccaaauuugaccuagauauguaauaguagaugacaaaauguggaguugcuaagccccuuucucccaaugaauacuauuuaucuuucauuuuuauagcaguaaaacauuuauauaaacauaccauaguggaauaaaagcaacagucuggugcuagugaucuucacugugauugacuucuauuacuugccuauacauuuaguauguuugugcagaaauguuucucaaggauuuucuaacaggugauguuauugagguccugagagaugaagagauguguccaagguccuguaccuaaagcagggcagagcgaagacuagaacccaggucucccaacugacugcuagugaaauguuaugcaucccugcuucuuugauuguuuuuuugcugagagaggauuguuuugggaaauauaaaaaggacucuguuagcgugugucuagggucauguuauacuguaauagcauaugugggguacucuggcagugguaggacagugggucuuuaaaugggucuuuaaaaugggucuuuaaugacagugggucuuuaaaugugguagaugggguaucagguuggauaagaguuuggguaagcugcauggucagaugggcccagauugaaauuccugcucagacauuaagcagcuguaggacuaugggcaaguuacuaaccucugugaucuccagugucaacaccugaacuucuugugaggaugaaaugaccugauacuuaugaugugcuuagcauuacaccucacacagacuaacacccuuaauaaaaaguuaacuauucuuagauauuacauguuuaucugaguuaugguuauugaaaaacccauaugugccugacaguaaaacuaggauuacugcaaggggaaaggaaaagaugacagucauguuucuuacuaacucucauuggaacacacaacaagcaccuucuuuagaauuaagauaaauacccacacacacucacacacauacacaguaugcauaugguguaugucuuuguguguguguaucuauuccuuuguuuuuuacuuuaucaugcugccuaauggaggauuguuuuuugaaauaugaaaaggacuccuacaugugucuguaagucauguuguaggauaguuguggauuggauaguccccuugagauucuccuugcucuucaauaucaaauuaacagagaaagaacauaguuuuacuuugugguguauggacuuuugcaaaucaguaacaagaaaauagucuauuauuucccacaccaucccacacucauacuuaauaauacucauccuacuacuuuguuuuucauucuuucccuuacuucucuugaagucagagaugaaaauauaauuugccaauauacagccaaauuuguuuuuggaacacauucuagauuauuaucuuucucacuuaccaccagugugguauacugcauuguuauaaaacaaaaucacaaacaauuuucaggucaguacauuuuaguaaagucaguuuauuacguugccuauuuuguagaugagauaccugacuugugacaaaugguuggacuuauauuugauaguaagucacuucagacucaauucaauuucauuuuccuuuuuucacccaaguccauuuuccccauuuuucuccugaauuuaggauggcaaguauguacuuuaugcuuugcagauaaguugguuucuguguaaccauaauaauaaaucaagccaacugggugcugcugcccauaucaaagccuacagcuuccuaguacauuccaauuaauuaucuucaugaagcaaucaaaccaucccugccuuccuugcagugucuuuucuguuucccucaccuuuucuuaaacaucuuaaagagaaacaugccucugugaaaugauugaaugguucagcagcuuuugauuuucagcuucucauuuaaucaugcaaccugucauucuaaauauuuuucaccucacaauuauccuauuuucuuuuccugcuuguuuauuguccacucugugaaucaugucaauaacaguuuuuaaaucauuguaaaucauaauaguuugacacuuauuuggagaagccuuauuuuugacaaggaggaggaaauuucauaucauacugucauaaauugggggucaaaucaacauagauuucucuucucauuaacauuucagacagaaugcuccuaauauaagacuuuaagaaaacagucacuaagauuugaguuuaaauuguuuccucuggccuuacuagcuaaugaaagcacauucauaaaagaccuucccagauaaaggaccauaauuuuuuguuaauauuaugguucaugauuuuaguuacauuucucagagccagagucagacaauuagacauucugauucacuguaguuuguaagccaauuucuuauguaccuuccuaaugaauaggcagaacuguaucuuguaaguucaaaggaguagaaaaucuauaucaggagagaccgagauaacaucugaccugguguucuaaguggggugugauaagcguaucucuucagaaaauuacagacaugauuuagaguuauuuuaauuuguuccucucaacaggccaucaacagaaagucaguuucuuuguaaauuuagcugauguaaauagaaugccagcauccuuucaucacaggacugagugcuuggugauagaggacagagaugacugagcgugcuuuuguaauaucaggaagcaagcaaccuggaaguacucuuaagugucauaccauuguauucugauccuaacauugugcagaccuuuuuuuuuuuuaaauccaugacuuggcauagagagcacacagcuauuucaaagguuucacugaaugcauuucuuauaacauucaccugugugucuuuauucccgacuagauaauucucucucaauacuuuuuuguuaucccugaguuccaggagagguccaggccguuugugauuaucccaugaagaacaguuaaagguaguggaagccccaccucuacagaggcagagauuaaccaggaugguaugggcuccaggaacagagguuggaacagcaggcaggauggcucacuggaagcagggcucagggacuucaaagauucuuccaucuccagggcuccuguucucccauggcuaggaagggaggaaucuugugguuagcuuuuggcacuaacuauauuuauaucagagaaaggaaaaauuuuggauuugucauagauuuugucagugaauacuggcccugucacuuuaggauuaggaaguugccuuacuguucaccagaacagcuuaguguaaugguuaaagcucuugucauuagauaaaccuguguucaaauccuugucuagccauuaauuagcugcugaucuuggcaaacuacuucagcuuucugagccucaguuuuccugucucuaaaaauaaugguaauaaaaucauagcucauaggaguuuggaaaggguugaauuacuuauaugccagguaaauagugaguagcaauaauugcugacugcuaauaaguacuuaccacuugccacguacugggcuuagugccuuauuuuaauuaucucauuuaauccuggcaccaacccugcaaagguagguacuaauauuauuauccccauuuuaaagaugaagaaacugaggcccaaagaaguuagcuaauucacacagcuaauaagugauagagccagugcuuuuguugcagagaucagaaucagaaccuacugcauggguagaauuuuacagcuccucgaagucaggaucauguauuauuuaucuuuguaucuuauguccucuuuuuggccucaggaaccagaacaguauuuuguugugucagaugaggucccccaguauaaagauuaaagaauaacuuucaaacagcuauagccucaacaaugcaauggagggaugcaaugggccaccuugcaaaggaggaaacuuuugucuuugaaaagguucaagcugcgguggcugaacccucagguccugccuagcucuaagauuuucugguucauucaucuccccggcaugcccacauuacauaaggugccuuucucugcuggaggaaaaggggaaagaguacacaucuguggguuauguguuaaaucauucagccuucacucuuacaaaguaaaaucuccuacucaggauccuaccaacuauuauugucuacguuuuacuaaagaaucagauuuucauuuccacuccgauuuuuaguuuugagaaacuaguucaguuccuuguuaaaaaguauuguaggcaucgugucgcaccauuauuaagaaauguauuuuacaauaugaauguagugcuaggugaauuuauaugaauuauuccauguuugagaaggaaccauuugguacuuguucugaauacaguuguuuaagggaagaaaauugcagacaugcaguuuuguuccaucccauuucaaaacccuuggccuugucuaggcagcuagcaaugaugacugccuugaaaaugaaauuacugugguacuuucuagguacuccagaucuuuaauuauuuccaauauauugccaaaugaaacauuuaugaaaaagcuuacaguuacaccaaguaucuugaaaauuuacacuuacguuggugaaacaucaaacaguacaguguaugguaguacuauuuuuuuuucucuagacaagaauucucuuugcucuuuuuuuucaugacucauccuuccuuaacucaucuuucuuauccucugaagcuuucuuuucagagaaucaaaauagcuuucuucaucuuuuuuuucuucacuucacaagaccuccacuuuugaaugguaggaauaagguugguuuuuccacaggaauugguuauaaauuccuucuccaugccgaaguacacuggccucuaguggauaccugucucaguuguaguucauacugaucuugccuuaauucacuuauuguagcacuaaaccagauauuuuaauaauuuucaauagucuauauuaaggaacacaaucagaacuuuggaggguuuaaaguagauuuuauuaugaaauugauuaagcuuuauguggauagucauauacuuagcaauauauuuaacaaauuuagauuaucuccugcaauuucuuaagauguaauugugauguuaacuccacaguacuuuucauuuaacucacauugcacuugaagacuuaaggcauauguaacagaucauuauagaaaucagcccaacuuacucaugucagagaaauaagauucuaauaggauaccaaauugucucauauucccuguacauaguccugauuaagaaaaaaaagcuagcauuuuccaaagcaguauuauuauagugggauuuuuuaaguauaaaauuuaggaaaaucaucuguuaaaaaguauaaaucuaugucacuucuuagaacuugcaguuuaguauauuucaguauggcaaaggauuaguuucaauuuucauauguggucauuaaaugguaaaagcauauacauuuuauucagcaaucugccauuaauuuaaaugugaaaaauauuuuauugaaagagcuaccuaaauucuuauucaaaacucugccuaucagugagccaacaauucaaccuugaguuuauugauaagugacaucugguuuugguuguagguugguucugccucagggucucucaugaggcugcagucaagaaguaugccagguucacugucaucucaagacuugauugacuggggcuagaggaucaaucugcuuccaaaaugacucacauggcaguugguaggaggccugaggccuugguuccuugcuggauagaagucucuugaguguccguccuuauggcuuggcaguuggcuugcccagagugagugauccaagagagagaacaaauaggaaggagccccaauacccuucauaaccuggucucaaaagucgcacacugucauguguaccauauucugcucauuagaaugaaucacuaaguacagcccaugcuccagaggaggaagauuaagcucuacaucuugaagagaggaacauuaagggauuugugggcauauuuuaaaacuaccauggaaggagaucuucaagggaggauuugucucauguuuaaggaauguguugcaucugguguauauaaaggacauuuuaggcuaugccaaggauuucagccaaguuggccaguaaggugacugaagguguuagaguagaagaguauaaggcaaaccauaugacacaguagaucuggagucacaugaggguuuaggauuaucaaauguguggcuuagaggaguuaccuaaugccucuauacuguaugccaucuguaaaauauggaaagcaguuaccuuccuuauagggucguggugagauaucaguaaguuaagauagauaaaauacuuaggcagugccuagcaucuaguaagugauuaagaaguguuagcuacuucagccuuagcaugauugcugucauguguaaauucauguuguauaacucuucaauccucguuuuguagccggagaaauccuuguguccuucuccaaacuugcuugguuucuuuucucucucuguguagcuuuauucugcauuccaacauucacacauguaacaguuuuccauucgaauauuucauuauaugcagaaauauuuucaaauucuggccaagcaugguggcucacgcuuguaaucccaguacuuugggagaccuaaacaggaggaucacuugagcccaggauuucgggaccagccuaggcaacauagcgaggcuccaucucuaccaaaaacuuuuuuaaaaauuagcugggcauguggcagaugccuguagucacagcuucucaggcggcugaggugggaucacuugagccugagaggucaagucugcaaugagcugugauugcgacauugcacuccagccugggcaacagagccaagauugcaucucauaaagaaaaaagaaauagaaauuuucagauuauuugagggagugggaaaauccaaaaguuagagaggguagugauaguaucaggaaagaugcacugguuuggaaagcaucuucugggauguugauacaucuaccuaguugugggagauacacagauuaagcaguaaggacagaugcugcucucagauacauuuugucuaguaagccuaguguuuuuaaaaauccagaauuuuggcuuuugaaaacaggaaagaucugggcauaaaaggccuacauucgcauggcaacaauuggauagauuguguagcaacugccccauuugaaaaggcauguccuugcugguaugucagaguauuuucuguugucuuaaucuaauaccucucuacucauuuacuuaccugucuggcacugaguuugaaaccaccccuuccaauuaaaauuaacacucugcaagucaguuagucaauauaaucucccauaagaaguacccccaacaucaauguacucgauacaucuauaaaaacagucauuuggaacuguaacaugaaacugggauggaauuccuguucucaaaucugccaaggcagagauuacagucuucucaacuagguggcaagaacuucggagucgaguuagauggcauaguaugaaagggaacucguguagcagaaaugggcauuacaggaagcaucaccuacucaagacaaacaaaaaaaugggagaugcccucagcuagccuugagcaacacagaagaccauccagguuuccggaguaagaacuuugacaugauauucaaagcaaucaugaaaauaaaaagguggcaggucaagacauuuacaaaaauauuuuuuucaacccaagaagcuuuuuuuugauaggacacaaaauagacauuaaauaaguuaaaaacuauuuuuuggauuuaacauauuggaaaauacauguucaugagauaaacccacacugagaaacaugugugauaagauggaugagguaggcgucugcaaacagggacauuuguccagacauuucagagaauaaaggagaguuacagagcagggaagacaaaaggaagcucuagcauaucuggaaagcaaaugcuugucuacguuguggacuuagguacuguguguguaucugucuuuacuggaugcugcucaguuccuagaaaagccauguggaauuugagagcuuuaguuuccuuccgcaugguuuuucuugguuguuaagccauccuauacguauucccuuuggguauauuuuuugguugacuguuaacagcucaaugacacaguuuauuugcuuaguagaacagaauaauguggcuuuugagauaaauguauggugacuacuugcagcugggucauuggcauuuuauggaaguuaacacuuuuuguucaagguugcagaccuacauuuuuaaauacuaaccaucuucucgaguuugucuccauguuacccauguuccuucuuuagacagacuggaagaccacauggggauucagucuuauugagcccaucuuucaucaugcugaaaauaaggauuucaagucacuuucuuagugggccuuccuuaguuuuguuuguggcuaauaaacugaaugaagccguuuuagugcugagaagcucguuuucaccugacaagccaucaucugucauuuguaauggacaggacccaagauaauaaagccuuuagcuuguuuuccuuuuucugccuuuaacugggguguagauccagacagcuaaugagcaacaauuucagauucuuagguauuagccaugucccaaaaagagccaaggaaagaaauguuugugauaauacucauuuaauggcuugugcugagaaugugcagcuuuauuugacuuuuauuuuauuguguaacccaugaccgugguuaucuuguggagaggggguaacugaacaaaauguuaaccuuccaguucuagaagguugaauggauuuucccaagagcaagcuggguuggucaaaauggcacauuaucaguuagucuuaaaaggaaacaauggcacacucaucucacaguauauggaggaaaguuuauuuuuaaaaauauugauaaugacaauauaugugggguuaaaggaaccuggggcuggcagcgugggaucgcuucugucccaaugcugagagagagagaaggaggugacuacuugaccagaagagaauauccuguaaugaagacuuuuuugagaugcucugauaccuucuguggaggaaacagccacccaagacaaucgugcugggagggacgggggaauaaaugcccccaauucccucuccuccugccagggcuccccagacaucagauccaaaaggaacccauuaauccguucucucuagucagccucccagggccaagaggagguugcaaaagaguggagaggaucuggagaggccccugacaauucugcagcacagcuaggucccaaaucacgauguuuucauagucuguuuaacaugugccucagagaauaugauauucuggaauccuuuugcaaaaggagucuaauagcuggagaacucuacuagguccaugaaagguuaaccauggaugagagaagguguggccaaucaaugauuuagacacuuugagguagaaagcauuuuguucaauuccuuacuuagcaggcuguagggagugcucugccaauguaguuucuaauuuucuccagucaugguauacugacauuugcugaacagcuaaauaaauagaucucuguuccacacaacagauaacagcaaggucagacagugauauuaguaauuuuagaauauugucuacagcugagaauguuuuuuuggugacagugacacuuaauacugcuggucaguguagaaugaauucuacaagauuccauuccuccugauauuaaauauuaccaggcaccagcccugcccagggauuucagaggagcccuaauucaaaugggguguugauuuuuauaacacauguuugaauguguaacuuucuugcauuauuguuuauuugguuuuccucuuaauuuaccugaauuuaaguuugagaugcuaaugaauuuuuucagcagugacugaaaauucugaaauuucagaauuuaagauucugagugucagguuuggcauuagagucauuuuacuggaaugaacaaaagguggggauuuggggaaaugaaauggaaacuuguuuuuguaaagaaauuuggcaguaaauugccuuucacaaauauacuagugagauuuguaaugaauaaaacauguauguguuuuaaaaaugcuuuuacuuaaaauaauuuuaauauaaauuuuagucuauaagaaauagcuuauagaucacugaaaucauagcuggaaucuuauguuuuuacucuuuccagccagauauuuauccacuaggguuuugauaugaaucuuugucaaccccuuauuuuuccagaaaacuaaaugaucaaauagguuuauuugaacagaugccuaaaaccucacaggaucauuauauuccaccaucguuuuacauuagauuuguuauuuacagaaacaguggguuuugccauuaacuaaauuugucuucauuucucuguggugugaagugugaaucuguguggucuuaaguuuuggcucucucugcuuagcuauuuuuuuuucuaauugauguuaaucacaaauaaaggagaagaaaccacucauagaaauauauuuuuuccucuugcuuguagggacaguaacccuguggagacugauauguugcaacaauagauggguagacauccuguuuauagauuaauaaauggauccuucaccaaguugccaauuuuauggguguucucuauauuaacucuccaacaaaugaugauggaguauacguauuuacaugcaucaagaugacauaagucugagaugauugaacaaaauauggcucagaaagaaugugccaauaaauauucucaaucugcaccaauguagcucccauuacaaauaaaauauagauacugcauuauaagcaaugaguauccugcuuugaaagcaauuaucuguuaagcuggaaagacaguuuuguaaccaaauauuucugaagagucaauucuaauagcugauuuguuaagagagaauuauaugacucuuuuuuuaagccuuuugaugccccuuuaugaaauaguaugaccaaaaucucuuugcucuauuuuuuuuuagcuuugaauaucucuguggccaaauuauacauuaugguaguuuuugcaugauuuauuuuaaacacacagcacucaaaaaagaacguugcauuugccauucuaaauguccaaaugguuuuuguaaucauggcagugguucugauucucaguucaaaaggauacgggaacuauggcuguaaaaaaauagaaacugugcuugugcuauucccccaaaucucugugcccuucaguccuuuuaacuccuugucuccuuuuccuauuuauaaugccauucaauauuuccaucuucagauuuuucuucuccugaaaauccuguuaauaccugacuuaaccacuacuacccugucugcugacaacuacagaagcauuuauaugccacccuuggccuggccagggccuuuguaguugcuguucuugcuugugaaagccuucuacuuuuguagauacuauaacuuugaccuaaauaaugaaaugauuagcaucuuuguaaagaaggaccauagaucucugugccaccuaaccacaaacauaccagcuccugaacaccuuuucugacagcucucugcagaucaaauuuccaacccauugacucuuuugcagaaaauaacuaaauuaagguguuauaauuuagaacacagauggucugcuaaaguucacauuaagguagaauccaaauuauuugaccagaagauuuuuucaaggagcauuacuuaggucuaauacuucguacaauauacuuuggagaacuuugauuuaaggaaacagauccuuguuuugggaggaaguauggcuuuauaauuuauauggugcaguauucacauuaguuuuuaaccuguuaagcuauaccaguauuccuaauggaagaugucuucauucuauuuagagcuggaagucuauauuuaaauuuuuugcuuuacauauaccuaaucauacauaauuaauauauucuuggugguuaugcaggaugugaacuggauuucuuuacugccugauauuuucuuuguaaaaguuauuaaaggaggggcaauguugacagacuaaaccuuuaguuguaauuauguguaauuauguguaaauaugugucauguaacuccaaaguuagggaaacaaauguauuauacacuugcauugacucuuuccuccacuuccauggcagacauuguuaacaguucaaagaucucugccauggaacuaacuagaaugugcccccaucaucauucuucaagcagccacuuacagaguuaccaugccuaccaguggccauuccacugccugauaucuaaaaucuguauugaugaugaugucucaccauuagaauuuuuauggccauaauuucaaagaauaauaguggcaaugguauacauuucaguguuucagacauggagaggaggagcuaucagucugcagagagaguucuuguuaggaacaucuguuucagcucaggacagaguuuaguguuugaaggccaggccccacucuuguaccuucaugaccccuccccagccccaucuaacuaggaaaugccaaaaccaugagcucuggacaacucuuuuaucaguaaacaggaaauaucuguauuguaaagaacuaaaacccauugguccacaaaccuauacaagauaucuuaccucugauugauuuuaauucagcagcaaaauuugaaagcaagaaauacuugggcaccagaauacaggacucagaagcacguucuugaagcuuggaaauaggaccaauauggagcuggaacuccugacucaucuugggagucucugauuauagagagacugccagagggaguggaacgaacauggacuuuacaguaagaccgccuuaauuuaaaucuugacaccauugccuacugcugugugauguuuaagcucauugaguuuauuuaccagggaaaguuauaauacauaauuuuagcaccuaggaaaauuaacacucaauaaaccuuaauccuccauacaguuuugcuuauucuaccaaggaguaaauuauagaauauaaguaaagugaagaauuuaggaagaagagaauagacagaauaaggacagauuggagucuaauuagacccauuucccuagguuccccugacugcuuucagaggucaaccugaauggaaacuugacucuccaucaaguuacuguccccagaggaucucuccauaagaugucguuuccaugcuaucaguucagagaaguuggaauaaaaugguugguucaucucaauugaugaauuuaaaaugcccaaaucuuguuuuguauuaaggguguuguauaagacauuuccuuuugauucugagauuuucaggcaggaucguggacucacuaaaauuauuucuuuuuuccuuggaagaaauuaaaagggcagagugggaggguaucuuucgaggaaugcuguuuuucacaugucaguuuuagcuauuuuggagguacaugaguugcuuuauuccaaggauccuggcauuugaagucacacaaaagaaaauaauuucaaacuccaagaauauaccaaagguagaaaagugagccugagcagcuugccauaauuucagcagaaggcaaaucuggucccaaucgaaccaaucuguugguuuauuuguauuauuacaacaaagcccaagauugaauuccucaccugaaucacuuccuuauugacugaaucuauuuagacuccccucuaauuuagcagaguauuuuuuauuaaauccaggcauacaaacaucaauuauccaagcugcaucucauuuccuucaccauuuauuuuccuucguuggcugccaguggauuagaagacaugauuagaauucaucaggaaaauaaaaacaacaaaaaagaaaaacaguuucacaaaaacagaugcuuaaacaagagcaacaacauucagaauuaaaauaaccugugauuuuuuuaaaaaaguccuuaucuuggcuaauauaaacaugcuugcuugauuuuuaucaaccucaugccugcuacagugggacuaaauuagcauucgugauuggaauaggcacagacaaaaccuaauaguugcacuuacugugcuucacguauaugcuacaguguuuuuaaauacaaugcaguacuuaacuauuugcaauaaccuuugcaaaguagcuggcuuacucugaaaguuuucuauuuuuucacuuccaaccaaugucagggaggaaaaaagaacaaaacagagacuuuccuucuaugaacuuguuaaagguaacagguuuuguuuuaaaggaauguuauuaaaguuggacuccuuuauguaauuggccaccacuacugccuggguaccuuuguguuaucagugauggcaagaaaauaacacaacaaagaaagacaacguaaugucugaaaaguguuaucaaagauauaucaagugacaugaagaaggaggggugaugguauacuugccaugaauuugaggggaaaugaaccaaaucacaucugugucagguuagcaaacuaugaccugugggccaaaucuggcucaccgcuuguuguuguaaauaaaguuuuauuggaauacaccaugcuuauuuacuuauauauuguuugucuaugauugcuuucaugcugcaacaaggguaaguaguugugacagagacgggcucaaaaaaccuaaaauauauacugauagagcucuuaaaagcaagauguugucgaucccuggugaaugucaguggcuccuuuaucauuauccagcuauuccuaacugcccugcaugugcuguggugaaacaguguugguuugaacuguaacugcuuaauagcuaggaaacccuaaauuuucugagacucaguuuaucuauaaaaugaagguuaaaaauacauuuauaagcuuauuguaaauucauuguagaugcucaauaaauguuaauuuccuuccugaccuuacuguagucuguguaggugucucaaaaccaaaggcuucucaaacucuuugucauggcguuugcucugugagacucugcaugauuugcgagggggcccaucuuguuuccaucacucuacuucucaggccccagggaccugauacuccagauucuguucaguuucucaaaugcaccacacucuuuucuguuccuccaccuguauacaugguauucuguugucuuaagauacuuuucucccucucuuaaucuugaucuaccugcccucuucccaacugcccuucagacucuagcuuaaaugucucugccuaugagaggcccucccucaccaccugguguaauauagguccuguccugcuacucacauaggaccuagcauuuuccuccccuucauaacuauuaucgugguuugcaguuuuagauauauagaaccuuuuugucuaauuuuaaaaucuuucuugcuggcuuagcuacugccuacaagcacagggcacauaguaggccgugaagaauauauauuaaauuaauaacuuuuuauugagcagucuugcaauauuuuuauuucauuaaggggacucaggaucauguugaauaaaaagagcugaauuuuuuagacugacagcaaacaggcugccuaauuuggcacaauuuguuucuaccucugagucuugguuuucucaucugcgaaagggggguagguaauaucugucucacaaguauauggcagaguugguugugguaaugaacacaaagagacuaagccaucacucauuguagggcuucucuagguuugcuggcuuggaaggauauuugacaguagauaaagcuguaaccccugauucucccagaucuucaccucaauuuggggaugauuauacccaccuccugugauacucauguguuaaaugcguuaguacauauacaauaauuagaauacugaguacaaccugcuaaaugcuuuaguaacguuaauuaugguuguauuugugauagcuauucauauaucaacucuagaggauuauguacacuuugcccagaaaaauacacauucagacaaaaauucuguggacagcugcgaagaauucacuauuccucugaaacucauagcccucuccugaauacauauggugugcacuaacacuugccauuaucugaaacucauagcccuauccugaaugcauaugcuguagguuaccacuugccauuggaggucuuggaggccauauccuguaggagcaggguagccaugggacuuaacuacuauuaucccccaaaaauguuguguuugugaauucaccugacugaggaaucccuaauauucaucagauauucaaaaggauccauguuccaaagaagagguuuaguauugauuuuuguugguuuguuuauuugagcaguggggaugaugucaaaagaagcuugauaaauagcaagggcuguagcuguucuuuuuucaaaguuuaguuuuuacuuuuaauuguguacuaaaaucugcagcuagaguguguuuugcaaagcaaaacacccagacauuugaaaaacuuguguauggacugccugaccaccugcacagcugccagagcaaacuugccuugggaucagcugucuggggucuggggacccgggcccuguaucuggcacuucaacugccucauuagaugaucuuuacuuuuguaaaacaguaaauagcaacccucauaauucucacccgagaauuagaaaaagccucuguucccaaaagcacuugggaucuuccgggagagucucugguuacuuaaauagaccuaacacugaauucuuaaaaaaaaaaaaaaaaaaaaauucucuuugccagggggcugggggaagauaauuaaaaguugcuguugguaucaucauggaacagcaguuagugguuguaaaaugaaugaacacgugaggcacauauugaaaauuugacaugcuuuauaaaugcuaaauaauaauaaugaugucacgaggcuuucauuuuuaaacugucuuaauugcauucccaguuugagauugcagauuacaguaguuaauuauagaaguuggcccagaguuaaaccuuaaaucagauuuccauuaaagugcaugacugcagcaaauuacuuuacagugggagagaaggcgagaauggcauaaucucugguugagugggaucuucucaccacccaggguggugacuuuccucuuagggugcugugguguaucguguguccuaaacaaucccauuucccugagcuaagcagccugcguacuucuauguccuguugcucuucuuguagaaaucucaauugcuuuguuaguauuugucauacucuuucuguuccugucuuccucaugacuucucacucuccuuuuugcacuuucucucucucuuauucuuuuguguucucucaugccuucucuuuacugcuucuuguucacucauucucucucucucucucucucccaugcucucucaugguuguucuguauuucucauugucucucaugcacucacucuccucucuguccuucuguuccccuccuauaacuucucuucggcguuucagggagccugcuuucaagacuugcgucuacccaguucugaagaaggaagaggccaggcacgguggcucacaccuguaaucccaacacuuugggaggccaaggcaggaggaucaguagaggucaggaguucgagacagcuggccaacauggcaaaaucgccucucuacuaauacugcaaaaacuagucaggugugguggcagcugccuguagucccagcuacucaggaggcugagguaugagaaccacuugaacccaggaggcggagguugcagugagucaagauugugccacugcacuccagccugggugaaacagucaaaacgugucucaaaaaauaaauaaauaaacuaaaaaggaagaaauaagaggauccaaauucccaucccuggcaucuggcaccugacaaucuuggccucaccuguaucaucuuaacuuacuucaccauucaaccauuaguuccucagcgaacuaaguugggugacauaucugccuuuauccuggcugcucccuuuaucucagauccugcucuuuuuuucuuccugucuacuagaaccucaccuauuccaaaaauccucugucaugucagcagccugcaucaccgccucuccccuggucuuggcugugugagacaucuguagacccuguauuuguaauugucaguuuauuggucuggcucucaaacuagucuuugaauucuucccugaggacagugaugauacuucauccuucuccauaucccaaaacuuaauucuguaccugguacaagggagauguugaucaagugucuguugaaauuaauucauucauuguuaaaccauuauuuuuacgugauuaugccauaucauggauugugcuggcuacugauuauuaaaaaaaugggaaaauacauaaucuuuguuuuagagaagcacaaagaugauccaaacacgggaguugcaucuugggauggggagaggaagguaagaggagaauaaaguacauuggagaacaacagcuauucauuucucaguaagucuaacaaaaccaguuaucccucugcaguuagaaaagaaggcuuuuccugggguucagcaccaacuaaaguaguuaaauuuuaaccgcaagugguuauaugaagaguaucuauuuuuaacaucggacucuaauuaaacacgagauacuaacacaugagagacucaugggaacugaugccaccugaggcaacacugauuccuguuugacacuuacuccaggcacucacccacuaaguagaauugaaucacagggucucaagccccuucucuccuuuuugcuccuaucccucacuccugccuguuuaggugaauucacauaagauuaugauguaaacuauacucuguaaaaugaucguaaagcuuuagauggguuaaacagagucagugauucuaauuuaaugagaauucccugagaaguugacauccgaacuuguccuuaaggaauaugcagacuggaacauggcagaggcaugcaggugccaauguguguuuuacuagaaugccaaguuccucugcacaaaccuuacugagccucagcagguccugaguuucuaucauggaccccauggagucauucuugcucuugaauguuuuucuucuauuguucuggcaaguuccucuccauccuacaguuauuuggaaacuacugcuguaccaagccucaaugcuaacagcauuuaauagcugucauuagaaagcaagcuucugcuuaccaguuguccuacugugaauaguaaugggagauuucuuuucugggaguagccccaaucucuaauugguuugaaaaauauuguucauuucuuugauucuuaaggcauuaccuuuuuguugaauuucaauaaguuuguauuuccauuauauuugaauucaacaugagcugcagucuacugaaaaagguuuucuuacuugcccacuuucaucaaugcuugcugaauaaaugcaaguguaaauacccauuaaguacauuuaaagccaugugguaaacauuucacauguauuaccucauuuaggccuuucaacauccugugggcuagguccucuuuuuauucccauaauacagaugaggaaauguucaagagagguucuguaacucgaccaaggucccagcccuagcaacaacaucaaugaacaaaucaguagacaaucuagggagcuggcuuugggccuggccacagccacaugacagcugugugaccuugggacaacaugccccaaugcgcccgauggcuuucucagcuagagagccaaccuucacccuaccuaauaaauaggguucugggaaggcucacaauaaaaaauaaggauuugugugauggcacuuucuaaacauuuaaaugcuauacaaauguaagauauucucuucucauauguuugguguagguaauuuaacagacagaaauaauaggauucuaugcagcacauauauauaugcuuuacaauuaguguggcauaauuuaauugugacucuacuguuggaauuuugaugccuccagcuucaugaacagccauuuuucuguggguguuaucaauuaaucuagguaaugaauucucuucauuaucucguucuucauguuaauuauacaggauuuucuuaugccuaguuaucaagucaggacaaguagaguuuguuuuuuuuuuuuuuuuggcccacaugccuuugaauauggaauauguacaaacaaguuaacaugaugggugauggguuuaaauuuacauuucuaagaagcuccagucaguagcuugacuuuccuuacauucuuacuuaugcuauaagcuuggaucucuuuauuucgagagucuuuuuuuaaucaaaagguugcugucuaagauaauuaaacuaucucugauuuuugagaacauaccucuagcauaucaaagagguauuaaggaagcaugaaaacauuugaaucuuuuuuaccuuuuaauacaaaacaauaaaugguuucugauuuugaaauauugugugaggcaccaugacauauaaaaaggcaauuguaaaucguggaggaaaaaaaccuaaaugcaagaaauuuuaaaugauacuacucauaaaaagaauagacaauaauauuuucagaaaaagaagacauuauauaauagacgaaugaaugaugauuaaauucauuuugaguugaaaagagugauugaugggaaaauuugguaauguuauauugugauauuuauuaauuuauuacuaauaugagcuuucuuaacauguucugggccauuuuuguauuuuaugcucuguauaaaacaaaaacaaaaaaacgagcagucuuauuuuaauugucucuauuauuuaaccaguuauuuuugagacuguuggcgaucagcauuuugauugguaacuuuuuauuuuugauuucagguugaagccauccuugucaauauauuuggugguaucgucaacugugccaucauugccaaugggaucaccaaagccugccgggagcuagaacucaaggugccccuggugguccggcuugaaggugagucaugguagauuuccgcugugccagcaccccuucuccaaggucaggugaccagcauguucuggauucacaaacuuccugagauaacagaacgaaacacuagauuguguaagaugaaacaaacacaguacggcaggacuucccugggccucuagcaaacuaauguggcuuuuagcucuccaaguauggcagguguuaugauucuccagauuuugaaaaauuaccccagagcaaaagcccuuuuauuuaugaaucauuuuaugagauuaguguuuggggaaaaacacucugagaaauguuucucugagaaucaugcaucauaacugaggaucccaaaaagcuuugguuuuuuggcuuauauuugucaauguuuauuaauugauuuaauugauaaauuaauuugauaacugaaauuacuuggaauuuaaaaaauaacucuuaaaaaauaauuuguauauuuuaugguauauuuuauauaucauauguauuauauauuuuauagcaauaaauauuuuaaaaaauuuuuaguaagaauaaugacauuguuuuacagguuuguaaauaacuuuucacauuuagcaugucuguuucugcauaaaauguuauaacauguuuuaguugaaguauaugaagaaaaucuggccucacagacauauguguuuuucaaaaugggaguaguuuuguccguuuguuuguuuguuaguuuguuuguuuugagacaggguuuguuuguugcccaggcuggucuugaacuccuggcuucaagugauccuccugccucagccucccaaaauguugggauuauaggcuuaagcuaccacaccuagccagggggaguuuuuaaugcucuuuucauauaguucugaauauucuuugguacuacacuaaaagucuauugguaauaguuuauugaaaauuaguuuccauguggaaucuggaacuaucucgaugaacuuuucauauuccauuaaaacccauuggucuguguuacacauuaagggaguuuuauccaugcaugguucaaaaucauucacugaugauccagaaaauuugugauuaugcagaucuuccaaagguugucucauuucaauguacaauauaaaaaaaaucacauuuguuaauauuaccaccaucauauuagaaaagcuuuuuaguaggaagcugucaaguucacagggcaggugcacauugucuagaauuugaauuugacuuuauagugcaaauuuuaucagccacaaaaugguuaaguuguuuuccuugaugggacagacucacuucacucauauuuaagaaaaugucugccagcuaaccaagucugagcaacuauagugugucagucuuuauuccaagaaagaaacagcauuucauggaaaagugagcaguuuagcuugauacccagacaguugcacgaacacuuuuccucagaacaguucaagaugcugcagaagugcuuuauguguguuuauaauuuggucacaaagaguaucaaacagauguguaaucaaggguugagguuuaaugaaauaauuuuuuuucuuuuuuuuuauuuuauuauuauuauacuuuaaguuuuaggguacaugugcacaaugugcagguuaguuaccuauguauacaugugccaugcuggugugcugcaccgauuaacucgucauuuagcauuagguauaucuccuaaugcuauccuuccccccuccccccaccccacaacaguccccagagugugauguuccccuuccuguguccauguguucugauuguucaauucccaccuaugagugacaacaugugguguuugguuuuuuguccuugcgauaguuuacugagaaugacgauuuccaguuucauccaugucccuacaaaggacaugaacucaucauuuuuuaugacugcauaguauuccaugguguauaugagccacauuuucuuaauccagucuaucaucguuggacauuuggguugguuccaaggcuuugcuaucaugaauagugcugcaauaaacauaugugugcauguguccuuauagcagcaugauuuauaguccuuuggguauauacccaguaaugggauugcugggucaaaugguauuucuaguucuagaucccugaggaaucgccauacugacuuccacaaugguugaacuaguuuacagucccaccaacaguguaaaaguguuccuauuucuccacauccucuccagcaccuguuguuuccugacuuuuuaaugauugccauucucacuggugugagaugguaucucauugugguuuugauuugcauuucucugauggccagugaugaugagcauuuuuucaugugucuuuuggcuucauaaaugucuucuuuugagaagugucuguucauguccuuuacccacuuuuugaugggguuguuuguuuuuuucuuguaaauuuguuugaguucauuguagauucuggauauuagcccuuugucagaugaguagguugcgaaaauuuucucccauuuuguagauugccuguucacucugaugguaguuucuuuugcugcgcagaagcucuuuaguuuaauuagaucccauuugucaauuuuggcuuuuguugccauugcuuuugguguuuuacacaugaaguccuuguccaugccuauguccugaaugguaaugccgagguuuucuucuaggguuuuuaugguuuuaguucuaacauuuaagucuuuaauccaucuugaauuaauuuuuguauaagguguaaggaagggauccaguuuuagcuuucuacauauggcuagccaguuuucccagcaccauuuauuaaauagggaauccuuuccccauugcuucuuuuugucagguuagucaaagaucagauaguuguagauaugcgguguuauuucugagggcucuguucuguugcauugaucuauaucucuguuuugguaccaguaccaugcuguuuugguuacuguagccuuguaguauaguuucaacugagguagcgugaugccuccagcuuuguucuuuuuacuuaggguuaacuuggcaaugcuggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuauccaugagcauggaauguucuuccauuuguuuauaucaucuuuuauuucauugagcagugguuuguaguucuccuugaagagguccuucacgcccuuuguaaguuggauuccuagguauuuuauucucuuugaagcaauugugaaugggaguucacucaugauuuggcucucugucuguuauugguguauaagaaugcuugugauuuuuguacauugauuuuguauccugagacuuugcugaaguugcuuaucagcuuaaggagauuuugggcugagacgaugggguuuucuagauauacagucaugucaucugcaaacaaggacaguugggcuuccucuuuuccuaauugaauacccuucauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauuuauuuucguauauugaaccagccuugcaucccagugaugaagaccacuugaucaugguggauaagcuuuuugauaugcugcuagauucgguuugccaguauuuuauugaggauuuuugcaucgauguucaucaagaacguuggucuaaaauucucuuuuuugguugugucucugccaggcuuugguaucaggaugaugcuggccucauaaaaugaguuagggaggauucccucuuuuucuauugauuagaguaguuucagaaggaaugguaccaguuccuccuuguaccucugguagaauucggcugugaauccaucugguccuggacucuuuaugguugguaagcuauugauuauugccacaauuucagagccuguuauuggucuauucagagauucaacuucuuccugguuuagucuugggaggguguaugugucaaggaauuuauccauuucuucuagauuuucuaguuuauuugcguagagguguuuguaguauucucugaugguaguuuguauuucugugggaucgguggugauaucccccuuaucauuuuuuauugcgucuauuugauuccucucucuuuucuucuuuauuagucuugcuagcagucuaucaauuuuguugauccuuucaaaaaaccagcuccugguuucauucauuuuuugaaggguuuuuugugucucuauuuccuucaguucugcucugauuuuaguuauuuccugccuucugcuagcuuuugaauguguuugcucuuguuuuucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaaaaacaucuuuauuucugccuucauuuacuuauguacccaguagucauucaggggcagguuguucaguuuccauguaguugagcgguuuugagugaguuucuuaauccugaguucuaguuugauugcacuguggucugagagacaguuuguuauaauuucuguucuuuuacuuuagcugaggagagcuuuacuuccaacuauguguucaauuuuggaauaggugugguguggugcugaaaaaaauguauauucuguugauuugggguggagaguucuguagaugucuauuagguccacuuggugcagagcugaguucaauuccuggguaucguuguuaacuuucugucucauugaucugucuaauguugacagugagguguuaaagucucccauuauuauugugugggaguaagucucuuuguaggucccucaggacuugcuuuaugaaucugggugcuccuguauugggugcauauauauuuaggauaguuaguucuucuuguugaauugaucccuuuaccauuauguaauggccuucuuugucuguuuuggucuuuguugguuuaaagucuguuuuaucagagacuaggauugcaaccccugccuuuuucuguuuuccauuugcuugguagaucuuccuccauccuuuuauuuugagccuaugugugucucugcacaugagauggguuuccugaauacagcacacugaugggucuugacucuuuauccaauuugccagucugugucuuuuaauuggagcauuuaguccauuuacauuucaaguuaauauuguuaugugugaauuugauccugucauuaugauguuagcugguuauuuugcucguuaguugaugcaguuucuuccuagucucgauggucuuuacauuuuggcaugauuuugccgcggcugguaccgguuguuccuuuccauguuuagugcuuccuucaggagaucuuuuagggcaggccugguggugacaaaaucucucagcauuugcuugucuguaaaguauuucauuucuccuucacuuaugcaguuuaguuuggguggauaugaaauucuggguugaaaauucuuuucuuuaagaauguugaauauuggcccccacucucuucuggcuuguagaguuucugccgagagauccgcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuuugaggcauucucuguauuuccugaaucugaauguuguccugccuugcuagauuggggaaguucucuuggauaauauccugcagaguguuuuccaacuuaguuccauucuccccgucacuuucagguacaccaaugagacguagauuugaucuuuucacauagucccauauuucuuggaggcuuuguucauuucuuuuuauucuuuuuucucuaaacuucccuucucgcuucauuucauucauuucaucuuccaucacugauacccuuucuuccaguugaucgcaucggcuccugaggcuucugcauucuucaaguaguucucgagccuuggcuuucagcuccaucagcuccuuuaagcacuucucuguauugguuauucuaguuauacauucaucuaaauuuuuuucaaaguuuuuaacuucuuugccuuugguuugaauuuccuccuguagcucggaguaguuugaucaucugaauccuucuucucucaacucgucaaagucauucuccguccagcuuuguucuguugcuggugaggaacugcauuccuuuggaggaggagaggugcucugcuuuuuagaguuuccaguuuuucugcucuguuuuuuccccaucuuugugguuuuaucuacuuuuugucuuugaugauggugauguacagauggguuuuugguguggauguccuuucuguuuguuaguuuuccuucuaacagacaggacccucagcugcaggucuguuggaguuugcuagagguccacuccagacccuguuugccuggguaucaguggcgguggcugcagaacaguggguuuucaugaaccgcgaaugcugcugucugaucguuccucuggaaguuuugucucagaggaguacccggccaugugaggugucagucugccccugcuggggugccucgcaguuaggcugcucaggggucaggggucagggacccacuugaggaggcagucugcccguucucagaucuccagcugcgugccaggagaaccacugcucucuucaaagcugucagacagggacauuaaagucugcagagguuacugcugucuuuuuguuugucugugcccugcccccaaagguggagccuacagaggcaggcaggccuccuugagcugugguggguuccacccaguucgagcuuccuggcugcuuuguuuacguaagcaagccugggccauggcaggcaccccucccccagccucgcugccgccuugcaguuugaucucagacugcugugcuagcaaucagugagacuccgugggcguaggacccucugagccaugugcgggauauaaucuccuggugcgccguuuuuuaagcccgucggaaaagcgcaguauucgggugggagugacccgauuuuccaggugccaucugucaccccuuucuuugacuaggaaagggaacucccugaccccuugcacuucccgagugaggcaaugccucgcccugcuuuggcucgugcauggugcgcugcacgcacuguccugcgcccacugucuggcacucccuagugagaugaacccgguaccucagauggaaaugcagaaaucacccgucuucugcgucgcucacgcugggagcuguagaccggagcuguuccauuucggccaucuuggcugccuuccccaauuuuuuuuuucuuacugugaguaugugguaguaaaaaguacagugaucucucagguguagugaugcaugccucuagucccagcugagcaggagacugaggcaggaggauuguuugagcccaggaguucaaggcugcagcaagcuaugaucaugacaauauucuccagucugggcaacuuagcaagaccccaucucaaaaaaaaaaguacagugacuacuagcacaguauggugccacugccuugauuccaugauaacaugccagcgguuuugccuaccauuacuuucaaccuaugaguacaaaugccaacauagucuucucuuauuguuauuauuacugccacuauuaacuaugaaagugguuuuuaccuuaaggagcaccccucugccccugccuaaaguguauuaggacguuuucucuaagguaaggcaguggaugucuaacaugggauaaauuucaauuacucacauuauccuagggguaaaaugaaaacccaaagggccaaauauaguagauuauuuaccuggaaauugauauauucgaucuaagaaagcuagccuaacuaauacuuugaucagguccugugagccuuugucuaauguuuacgugugguaaaguuuaagcauuaagaaguguuuuuuagacaauggagcagauuugaggcuugacggcagcaugggauucccucaaugucuuacuggguuuaagcugaugaugaagaauugaacaccaggaggaaggagcaaggggguucugcagggaaaagguggagaggaugcgagugauaaggcaggagaggugaaagaugucacugugaagugaaacugguccuaguaaggacauguccacaggggucagugaaggaggaaggagaugaagaggugagugggcacuggugaggcagagagcaaagugaugaacaggacauguagaaaauggagaccuggagaguaagaagagaaaggacaaugagacucaaacauacagaaggacaggggcaugcacugacaaaaacaucagacccuccuccaagagccacgucuccaaugacagcagcaacagaacgaccucagacaggcuguggguggaggugggaaacagguccaucuuaccuugcaaggggacagggcuugaguaaagaauagaagauggaaaauuaacuccguacagaacacacguuggaaacgagcagcggagagaaugccuaaauccagaaaagugcaaagaggccaggggacaucaucagacacagaacuggaccuuggcucugcuggggaucugcauucacucugcccagaacaauuccaccacucagcuaagggcccguucucaauguauucuggguguuagcagcaaaucuugggcucuaauauucugaaugaaaauguuuucaaagcuacucggcccacagucaaucuaccgaggcugccuuuuugauaggagguaaaggcauuauuacugcucucaucucuuggucuuagaaccuagcauaacugaagacuugaagaaugaauagccacgaagcauaugggacacagcugaaaacucuauggcugccucuaaacucuuuaauacccaaagguuucuuucucuccuccagcagaccaaaggaucacauaccaucauguagcgaauaggagugcaaauuguguccuucuuagcauaccgaguccaugcuaagaaggacacgauuuguacucuucuauuuguggcuccaguuuaucaguauuucagaaucaaggauaagaaaguguccacccagaggagguacagugccuagucaagaaagcgaaagacacagaauauguuuauguucacaacaacuuuagagaaaguuuagggaauguuagagagauuuguaagaaugaagggggugggauaauuguuuuuaaagacauuuggcaaaagaaaaacaaaauguuuauguugcugaaacaaaccuuuugguauuggguggaaaauaaaauugagaagauuuggcuaagagaaacgguauccagucuacaaauuaucucgagguuuauuauuaauauauuaagagcucaacuuggagucauaaugaacaccugagaaacaagcauauuccucuucagacauaucugagacauagaaguuugcugcagauuuaaauaggacaguaauaaaaggaauucuuaaaaaauuauuauaagauguugguggauucugauaaagaacuguaaaaccacucaaaacauuuuguuuacugcguuuggccaaaacgcuuuguacacugacuguauagagcugucaauaaauguacauuucucaacaguuucauggguugggccaaguuaaccgucuaggcaauuuuugugccaagguuuuuauacguuucaaaaaggaaaaaaaaaaaacccucauuucagauaauuuguucuuuauucacaccagaaacaauugguuacaaaggcugaauuucccccaaauauguagcuguucauuucacgcaagagucuuuugaacaaaaauaauccucugucucaguuggugaguucuguucugauaaggcaaguaaauacauguaauuauaaaguuaccauuuucaaagaggagaauaauccuuuccuuauccacuggugaaacagcuuguaauuauuauacagcugagaacaaagauuuguccacaaaaucccacuacaucaagccugauuugauugauuaaaacuuuucucaucaggauauuuuuaauacauugugggugggcaacagaaucuuuaaaaugugggcugcauauuagagagacugauggcaaggacccuggaucuucugaauggucaccaaacaaacaagaaggccacuuacuuuauucacaggaaauagguaguaguuacaaaaugugccacuggguuuugaaaugucuguuaucuggaucacugaaaaucucacaguucuucagacugugauaaacauguggcagcgugccugaaacuuagaaaguacuuaauaaauauuagcaauaaaaauuauguaccauuguaauccagucucugguaacauuuuuccaucacaucucauuuuuagugucacuuggcuuuguaauagcuacugggaugauggagacccguuuucaccucacucucccuagcuagacaaugguguguguugugggagucugagccaauuuuaauauugauaugaauaaagaaccuugagaaauucauccaucaaaacagaguauaguguaaugucaggucaaauagaaacuaccacuaaaagcguccaaaauguuuccaucucuuuguaccacuuuaucuuucuuuguucuuguagacaaaugaagacuugcucuguuuagaaaaaaaaaacagaaggaaccaaaucauacucuaagguuggauaaacuacaacuaaauguagagaaaauugugagagaauaagaauuuauguuuugacauagaggaaagcaaaugaaaaauuuagauggaagauaaaagacauuucgcaaaggucccuguaguuggcaacuuuuucuccacuggaaguacugagaaccacuauuugugacaagauauuuuugguuuugguugguuuuucauuuucacugagcuaucuuugaaaaccacaguucugcaugugguuuaugaagggccuuuaaaaugaccauaacuucuccauuugucugucacaucucuccuuggauggcccccuguauucauacaucuuucuccacaugcacucucuccaguguugcagcuucaucucugauccucucccacgcucucuauugaguucccuuucugacuuucccaaguccaucaacuaugccaucauucuucugguucacagauuuaaauuccuuagauuccccuuguugucucaucuccuuuucucucugcucuugccuccauaccacuuuauaucuguggcaauucugcuuggguuuuugguucugccuaaugucauugacucgguaccuacucaguuuucccacucuguucuuuuagccguaacauauugcugcaaagccauuacucucuccaggacauccuucugaucuacccagguccugggcuucaguuuuuaccucuguuacgaccccaauaccaacucucagguauggaugaugacuuacuugaugacugacuucugauccucuacccacuccuuccuucuuccuuugcaaugauucaauucuuaccuauccuccagacucaacuuggaaauucuccuuuuauacuacuucuuugcuaacucacaucucuaaaucuacuauaacuauaauaguccauguugaauaagcauaaaaguggguuaugccaaugaaagugagcagagcuacacuaggcacugacuuuugucccuuaaagggacacauuauuaggagucugcauuuccuuagucuaaaaagcauuggcuugauuugcauuuaguucccuuuauggauaauaccuucuucaaauuucugcauuguuucaccuaugaucagugccaagaauacaguuauaacagaaugcuucaucuucccuuuauuaggcauggucaauacaauguugggauaggucuugucuugcuaugggucugcuccauucacagaaaucacacauaugaauauuagugaguaucccugguaguuucauguugagugugagacccuguaucuauccgaggacguuuaucacacaagaugccaauucccacaagaggaagaaaaggacaccagcuaggacuccagaaauguccaaagcucucuugcuuuuucucucuugauaaagaucccagauucuuacgguaagagaggagcuauaauaguggaaagaggguaguggcuaagaagggucacuauguauauuuuucuuugcauaaauuuggaaggcagugcccucuuugaucucauccugagcuaucacauucaauuccuucaugauacaguggacauugugaaguuaucaauauuucugaagauucagcaaaccagucugguggcugucugggauccccugauggcuacuuuuacuaagauagaagcagguccuauuagcagauaacacuuguuaccauuuuauagauauugucuuauguuguuaguuuuuuccauuuuauuuucccagccaucuaguagcugacauuuuuuuuuacaucucucuugauccuccuuaaugccuaaaguucauugaccugcaugcacaugguauuuacuaauauacuaauuaacuaauuaaaaaaccacaggcauaaaccuuggaaguacauuuaguuaaaagauucaaaucugaucaucuaacaaauuuagaaaugucaaaucuucuucuuaguaucucagauagaccucugaugcaaucagcagagaauauuaaggaaaauaaucuugaaugugguauuuugcauauuucagcaugaauaucaucugcguauuauaaaaaucacuuaauucuucuggaauacuaagcagaguaugaaaauaaaagaugcacuccuuuaaaucuuuugggaaaaauuuaaggcaggguaacuagcuuuucucgaaauguaugaauaacuaauaaauugugggccucugugacaacucaggcacagaaaggauccccagaaagaaugggucaaucguagugugcauucauuucuaguuauuuccagugacaaacaauaauauaauuggcugauagagaccuuucccccuuuaagaacaggagaagaguugacucuuaaaaucugagggucucugaucacuuugacccugaaaacagucugacaucaacauuuuaaucagaaauacaccaauacugaugcacucauugacuccuugaucaauuuuuuuucauuguagcuuugucacuuauuuuccuuuuauuacuuuuauugggaucaauuaugcugcauuuacacuucuaagaagauuuaauucaucaguauguuuuaauguucauauuaggcuuugcugacuggcgugucugccauuuucauuuuuccuuugugauuauuauuucuauuaaguccauauugugcagaucuaaacaugugaggcagacagucucagggaaggaaagagaaaggagaguggcagagaguggaagaagaaagagauacaaagagagaggcaagcacagagaacaacacaggcuacaacuguuugggagucuucaugucaaaggauggggguacaccagcagagucaaaauauccuuggacuuuuucuugagaaggucuccagggaauuauggcugcaacacagagcuugggaaaacugagcuguuccaagaaugauacuguaaaugauauggcuugccucuguguccccacccaaaucucaucuugaauuguaauaauccccacguguugugggcagcacccuguggaagauaauugaaucauggugguggguuuuucccaugcuguucuccugauagugaauaagccucacaagaucugguaguuuuacaaaggggaauuccccuacacaugcccuuucuugccugccaccauguaagacgucccuugcucuuccaccacgauugugaggccuccucagccauguggaacuuugagucaauuaaaccccuuuccuuuaucaauuacccaguguuggauaugucuuuauuagcggcgugagaacagacuaauacaguagauguugacucaguggggcugcuugaguauaguaaucugaguuuguugaugaaguguacaagacuuuuggauaguuaucauauuaaagugucuguuauucagguggauaaugaggucggagaucgagaccauccuggcuaacacggugaaaccccgucucuacuaaaaauacaaaaaaaaaaaaaaauuagccgggcgugguggcgggcgccuguagucccaacuacuugggaggcugaggcaggagaauggcgugaaccugggaggcggagcuugcagugagccgagaucgcgccacugcacuccagucugggugacagagcgagacuccgucucaaauaaauaaauaaauaaagugucuguuacugcuguuacuauggugauucucagaguaugguccacagaacugacuuucucacuccuuuguguuuuuucuuggucccucugagaccuucuagccucucaggaaggccauccugaucccacgguguuccuuaaaaguccagaucccauagguagccaaccuaauuagcuuaccuaauagccacugcucccauuguucacagcccauccagccaagccuugggguuagggucuuugaagaggcccaacagauccuuuuccaccuggguucugaucccaguaagaaauaaaauagacugaggaaacaaaaguauuaccuucaucaccaaagaaaaaagaaguaguuggaggaugcaccuuauugugugaccaccagugagcuuccuuacucuaagccccagaauuaggcagcuuuguaaacccagucacaggcuccacuagacuucaguguaccuuccaucccaggguggaacccaaggagcagaggaugaccuggacucacucugaguggcauaucccuaaaaggaaggccagaggaaggggcgggacuacccaugccaacuuucuccauucaaauauucagucagcucccuacaccaucaccacucccggauggagccagugauaggcaaagagaacaggagggguuacacuaaugacugucccucugcauggaaggaaacaucccccagugcacaucacaggucuuaucugccccaggagugggcugccuuuggucggguagcugccccacucuaggcaguggucaucccuucaggaacaagagccugaaguugcuucccugagcagcagcuguggguguggccauuuuuauaaggagagguuuuaaaacugggcagguaccaggacucgcauauccuaagugcugccuuauagugucagaacaccacugcgugcucucggguaucuucugagugacuagucaguucauuucuuccugacucaauuuccacuugaaagucauauuugaugagccaucaaaaagagcgagcgagcacauugcuaucaggacgagacuuacaggugauucagucuguagugucuuauagacgcuaagugugucccgcugagacucuuccagagagcgccaccuugaggcuguccugaggcagaacuaccuauggggaaagacuucaugagaaauguuucagaugagggaagacagcuuucaucucaugccaccuucucuuuauuggcaguggcugccugagcagugcugugccaagaaagauucugaggcuauaucccagcucaguggaaaaagaguucuaugaucuuuccagccacacaugugggaagggguggagggaguggaaauucgagccaauauuugccauugucaauucaaagagaccauagguggguuuuuuucuccuagauauauagcugcuuaccacuauaucaagucagaaguagggacugcaagcugggaaacaccagaugaagaugauucuugucuucaccugacccuuuagccacaaggccagaaauuuggauuguauagagcaaaggucuacaaacuuuuucuguaaagggcaggauuuuaggcuuugugucuguauauucccuguugugauuacucagcucugccauuguaguguugaagcagcaguagacaauagguagaggaauggacauggcugugucacaguaaucuuuuuuuaacaaaaacagauaguggaacagauuugguccgugagcuauagcuugcagaucccuaguguagaaaagaggccagcagcaagaccuagaauucuggaaaauccucacguuaucucuaucuaaaucucccuuccccuaagcucugaaaugucucgugagagucaaguaagaauuuggcaggcaauauuaagcucugagaaucugacuucuucccaaggaaaauauuagcaaugagguccacucagucauuuccccacguaaggacagaaucacacugagugacacagugaugaaugugauucuguccuaggcaguaaugguggaccaaagucagcauuuucgacaaaagucucacacuguuaaaauuaccuuugaaaauuucuuaaaucauccguaaauuagaguaugcauggcuugaaagcuaggaggaagauucaaggaaagcaugaaagguaaauucacaugcagauguuuggguguauaaaacaucccuucuuuaaaagaauugucuuaucccuagcagaugauggcaggugagcacagaaguguaagguguucuugcuugccagaggguucauuccauucuuguuuaauauuaaggcuccuuuaacuuugguuuaguaucuauguugcuuuuuuucaaggguuaacguaauugaaagcauaagcacguagcaucagcucucagugaauauguuagacuugauccuaaaccuugcuugcaugaucauagcacauacacaccauucuuugaaaccguguagagaagaacuuagccauuggcuuccugccacuggagcugggggcuccugcugugaugguccgaauaacuaucacauucacaccucgaguguugauuucuucuuacugugcgagaagaaaucaucgaggagauuagguguggauacaauacagccacacagaauaucuuaugucaucuuuaaucuucauaaaauguuagggguacaaagcauuuagauaugauucacauucaaggagaaaucuaaagccucaaagcugcaguaacuuccccagguuguucagcuacuugggaacagaaccggguuuaaaaucucagcuucuuccucugcaaaauggaauaaaaauagggcaacucuauaagguugcuguaaggagcagaugaguuuuuaaauaauuugcaauaguccuuggcucaguaaauguuagcuauccuuauuauuaucuaaacccuugucaguaucucgacugaggccacauggauggccaaugcuguuggcugccaagcacggugcuagguauuaggcacauaucaucucaaagaaauaagagcugcugacauagcagaaguuuugccucugauucucaaugaauuauucuguuucugacauaaaguaacaaggcaaaagagacaugaaaaguuaucuaaauuuacaggucaccaagaaaauggaccuccucuaucuaauugccacuugaaaggagacuaaggaaggaggugcaaggguacaggagcaguggacauuugaggaggaauuugcugcuuuagagaauuuggcuuguuuccacugaauuccccucucccaguggggagaaaaaaacucaguuacuuccagcagaggggcugaaauacuuuaggcuuucgaggccaugcugucugugccacagcgacugacuccucccauugcaaagcgcaaacagccacugaugaagcaaaucaguuuggcuauguuccacgaaaaaguuauuuauggaugcuggaauuugaauuucauguaacuuucauguaucauaaaauguuccugugauuuuuuccucccagcuauuugaaaauguaaacccuauucuuaacuugcaggugauacaaaaagaggcagcuggcucaauuuugcccaaaaacuagaacuugccagcccugacucagagcacuagaccaagaaucagaccugucaggguuaacugguuguuugauccaagcaaauugucugacaucucugggccucauuuuccucuagugaauuccuucuagcacuuaaaggccagcugcgugguuauguggcuuuacccucaggugaaccuggguucaaguccuggcucagccucugacuugcuggggaugucgggccaguuccgaagccucccaguguuuuuguugccucuccuguaaaauggggauuaaaaugauguugacugcaggguugcucugaggauuaaguuucaugauacuuguaaaucccuuaacucauguauccaacaaacauuuguugcaccuaauauguacucaauaagugcuaacuacuguauucuuuuuuaaaaaacugaauuccuauuaaaauaauaacuuuuaaauuacaguuucuacauauuuccagacuggaaaaugauuuucuucacagccuuaugauaaaaggcaggaggcgucugcaccuugcgaacaaaauccuguaccaugugcccacuaccuuuauuuucucuuguguguaauaaaagcgaagaagaaauuuugauaaauuaaccuugcaucuuuguuuacagcucucuuacuccacccaguggcagaaagucacugguaacaugccaaggaggucacgaauuuuuaacauuuuaauaauuguuauuauuuauaauauccccuaguaguagagcaagauuucauuuuaaacucauuccccuuugauuuuccauuuuuaaggccugcaguggguagauaaccauuuagcugaguggcucucaacaagcagauauuaagaagugccugagguuccaccagcaugaguugaucaguuaucuguacaggugguuauuaaaaguguuguccugaaggcucauuaaaaagcaauguagcauuuaauaaauauuagaacaugucaguagcaccauuuaaaugugggaaggagaucaauuuccuuuguaauucugugcacaggcauaaacacucuuuagaacacuuaauuccaugucagaguuuaaagcagcuaugauaauuucuauuuagaaguaaaggcagggagaggguuggggaauagaugucagacacuuggugaauuaagaagaaaauaaccuuaaauacucaaauaauaucauuuugcaaaaaaggaaugcagaaacucacagucauuuccaaggcuuccucuaauucuuuucuuccuuuucuuuuucaauaaccuguuuccacucucugcuguuuuacuuuuauuuuauuuuauuuuauuuuauuuauuuauuuauuuauuuugaaaauagaagugggucucacucuguugcccaggcuggagugcaguggugcaaucacagcucacugcagccuugaccuucugugcucaagcgguccucugaccucagccuccugaguagcugggacuacaggccaccaugcccagcugguuuccuuuuaaucccucuucucugcguguccccaccuccccuuccaguuguucccucaacaggaaggaggaagcaagugguaguuaacgacaagggcagggucagugggcaguagagcuaugccuucaaggagaaaccagguugaaugcugcaaagagauggugccagcaucaggguaggggcugguguggaaggcacuuggcaaacucauuuuuuuccuuuacuuucucuuauucucuaccugucuuuuuucuuaugucuguuccuuuuugagcuauuccccaugacucugucucuugucucucucuucauuugucucucucucuaucucccucucucucucucuaccccccuuuccccuucuguaacaaguuucuaccuggucaugauggcucugcauaugacccauuucucauaacagaugagcuucauauuugaauaugagaaucccuucaaaaacugcuuaguucugagcaugccuaguauaugcuuaauaauuaaggugguaauuaaaguguaacugcaaguauaauuaaaauucacuuuuguggauccuagaauuaugaagcaauuaggcauuuucacauggcacugaaggagcagcugggaggagagaaggguugugguuuucugggaaacugcuccguccccuuucuucccuggcccuguccaccaguguuagccuggagcaaggccucacuugacuggggcacuugaagcugcuacagguugggagaagugguaacagcuuggaguccucacucagggcagugagcacagccagcucuuccugggcccuucccagcaaaaggagccacucccaaaaccccuagguaacugugagaggacuccaaaaaaaaaaaaaaaaucccuccugauugcaccuugagcaguuugcgguaucuauuucaacccuauaggaaaggguuguuaggacagcaaggagaucuaucaaaaaguacccgcccacuccucuucucgucaagcacacuuuguaugugggaauccaucuggaguuaccccgucggucagcacguacugcuagcuaacggauauugggagguauccaguaagcaagucugacaaaggaaaguggauguuuagaggggacgagggaagcaucaguaagucaucccaauaagacuucauccaugguaagauuuuagaaauacaaggugcuccagaaguucauuguaccagccccugcuuuaguuggggcauggggagguggugauuagaaagauauccccaaagaaauaccauuuaacagaugccuugugaaugaaugggugucagcccaguggagagaggugucagcccaacagagcucuggguggaaagcccagcaagggcaguggcccagcacaucuuugugcucaugaauuucuaaaucauuucuuuucccuugggaauacuggugcuaaguugggugcaaaagaggauauuaauuaaggaacuaaauuauuuagauuacuugguugcaaggaagcacaacucauuaaaguuaucucaaaaaauuaagaagaucaagagcucauuucauccauacacaugcaaaggaacucagguaaaacugaauaagaaguuaucugaauaagugggaaccgugauaaaaaacuagucuccagaaagagcaggaucugaaauggaggaagacaucaggagcgccacuccugcaccuaucuggaggucuuagagcugcauugagauuggaaggugcucaaaagaagaaaggaagaggaagaagggccuagucuacgucucugcaggaggagauagaaauuuacacaugggguacgguggcucaugcuucuaaucccagacuuugggaggccgaggcaaguggaucacuugaggucaggagguuaagaucagccuggccaacauggugagacccuaucucuacuaaaaauacaaaaauugguugggagagguggccacugccucucaucccagcuacucaggaggcugaggcaggagaauugcuugaaccagggaggugaagguugcagugagcugagaucacgccacugcacuccagccugggugacagagcaagacucugucuaaaacaaaauuuacacguguaacugucauuuaccuucugguccaaagacugguuugcuccuguguccaucagggcuuuuguuucacacucugucauuacuccaugaaagccaugcuuugauuaguuucuaaauuccuuagccugcuaucuaacaccugccacagucaaaugaaucaaagugcacgcagguuguguuaaugaaauaauacauuuuuacaucuguguuacuuaccuaucagcacuuaacaaauuaccccaaaauguagcagcuuaacaaaaagaacaguuauuaucucacaguuucuguggucaggaaucuggguguggcuuagguggauccucucacucagggucucucacaaggcugcaaucacagugucagccgagcuguagugaucucaaggcuugacuagggaagaauuugcuuccaagaucccuuauaugguucuuggccagaugcacuuccuccuuggcuauuagacccagagccucaguuccucaucagccguuggccagaguuugcccucaguuccuugcccaggugagucucuccagagggcagcucauagcaggguaguuugcuucaucagagugaaaaaagaguuaaagggagcaagacugaagccacaggcuuuuguaaccuagucucagaagugacacuccaucacuuuugccauguucuuaucuauuagaaguaaggcuguggguccagaucauacucaagggggacggauucuacaaagaugugacuaccaggaggcaagagugauugaucuuugaaaaccauuuuagaagcugccuuccacagcauuuacaaagucauauguuagucaaaauaaugcuagcuccuguaacaacagaaaaaugcagaaauuucagagucuuaacauuauagaagggucuuucucauucccauaaggucuaagagggugaguggguaagaugcuuggcuccagagaguuauuaaaguauccaggcugaaggagucauugccaucuucaagaagugauuuggcugggugcaagggcucaugccuguaaucccagcauuuugggaggccacggcagauggaguccuugaguuuaggaguucaggaccagccugggcaauguggaaaaaccccaucucuacaaaaaauacaaaaaauagcugggcguggugaugugugccuuuagucucagcuacuugggaggcugagguagaaggaucacuugggcaccggaggcugaggcugcagugagcugagaucacaccacugcacuccaucuugggugacacagcgagagccuaucucaaaaacaaaaagcaagacaaaacacaaccagaaccaaaaaggugacuuccagggcugccccagcuaggaacacuccagaaagcagacaaggaaaaccgagugugaagagucccuuuggagauugucauggccaugugacauuccuuuggccugaacucagucacauguccccuucgagaugcaggggggccugggaaauguaguuucuggcugggcagcugcuuuccagcaauagcacucuacugcagaagaggagcaggagucuguggugcaaagccagccaggccugccacagauacugcaccauuuacaaaaaugcuuuuacacucauuucauuugcuucucaucacaaucuauaccaucagcuauacuguccucauuuuucaaguagguaagcagacuagcauaucuuuagaacaugcagcguuuauaauuacagagaacaguucaagucccaucucugacacuuaccgccucugugaccauggaaaaguuauuuaacuucucugugccucaguugccuuaucuguaaaauaggaacaauaggacuacucauaguuuuuguaaagauuucauaugcuguguauaaguuacuuagcacugugccuggcauacauaagcacuuaaugauauuaguucuugggaagauuacgaggaugauagugcucuguauggaaacaaaaguuaaggcucaaagaaguuaaacgauuuacccaaaacuacauaacaaguacauggcagagccagcauggagauuuuagguagcagcuucccacauuuuaugcuuucaccuuccagagaggacuuucaccagcuuccucuguaaaaacaggaguaggugagccuuaaggugaagacacagugccaagcggccaucuucacugcugcuuggguagacccagggucccaggggaaucagugcugcaucaucuuuucaauccacccauuucuauuuaauccagcauuugccucuuuauaugaaaugugcugacccagugccucuuuuuaucugcacucuuugugguaaggcaaguucuccaaggccuauauuucaaggucuuuguuuauaaauaggcucugucuugccaacuagauaaaagcacaggaaaugauguaggaugagauauuucauuagacacuuaaauucuauuacauuucuccuacaggaguuguucacucuaaaauggcagaaaagcaguucucauguuaaauaguccccaagcacaccuuugaaugaagugacuuggccagaagauacuccagauccaccaggaacagucaagagauugccaucagaggcugcuuugcccguuuugaagggcucagcccauuucauuuuauagagugaggagaaggcagaaauggacaugcuggaugcgccagagucuccaaagcaguggauuuguggacauagcugggcagauucucggaacuuccuuucucaaaucaggucacagcccaaaccccugaugacgucugagagggcuuuaagacaagugacuucuggugugggccaaaaccgcauuaaauccacauggcugugauuaucagcagacaacucagcuuccaucaguaaaauauguucauuucccucuugcaagcccuugcuuucaucuucuuuucuagcuggaccacagcuugagauaaauuucaucacauaaucuuuucugucagugaccuugaugagaaccuauauuuaauucauuuccuagugaaaagcuguagacaggugagucuuguguguccuugugcaaacuucauaaggcgccaccucuaguuucauucagugauuguucccugucccccuucuaggaaccaacguccaagaggcccagaagauacucaacaacagcggacuccccauuacuucagccauugaccuggaggaugcagccaagaaggcuguggccaguguggccaagaagugaugucuuuguccugauccaauggagaaagaaagccauuuuuccguaaaaagggaugguucaucauugugaaagaaaugguuaucucauuggggaagaaaaggggagggggaaggcaagaaucacugaaaaaucuuaaaucuguguuuucuggaauaagauaucuagacagccuaaaucugauuuuggucuuuauaaaaauaauaucuuguguucucauacuuuucugucacuguaagccugcccaguaggcaguguuuugcagacuuuggggaguggucuauguggccaaauauuguguguauagacagaauuugaaaucaaguccugcuucauuuacaagaauuuuggugggcaucuaauccuacauaaugaaaaagaaaaacagaccauuuaaaaacucagacaagauuauauuuaauauauuaauuacuaaaaaggcauaagauuacacugaacauauuagcuacuaaaaaggcacugcuaagacauucaagcaaauagcuauuacacacuacugcagauuuuacagguuucuaauucuaacauauguuugaaaaauccgugaguauuccaaaauauauuuaauaauggaauaucugcauuaauauaccauccauguguuuuuaccauuugccuuaauauugaauauacuguuuaccucacacuaaaaagaaaaccagaagccuuauuugugauuuugggaguggaagcuuccauuuuugugucaaaaaugaauccugauucuuauggaaaucucuguuauuaagauauuucaagaugagacaacacugaagaucaaauuguguuuaguaucacuaucuucucuccucguuucucucuuacuccucauccucccagaaucuaccaguuuaugguagaaagaugggaaccuuauuugaauguguuuuuuuuuuccaugauguccaauuuuguugugggaaaggauuuggauaaaauuuuuguuuaaauuuugguagauuuuuaucuauacaaauuuaaauaaaauuauguuuuguaagcuguaagaucuguguguaucucucauuuuacucaauuuuauuccucaaacauuuuuuuuuuuuacaaagacacuagucuuagugucuuagguaugccucuaaaauuugauaauuugggucauuccaggauuauuccaguuccacucaacuuuaucagauacccauuucuguguuaggagauuauugaauccauaaaaguuauacacaaaccagaaccccaggaauguaucucagaugucugacagguugaacugugaugucagucugcguaacgcaaagggagauacuccaguauaacucauuccauuaagugaggcucaauugccaccauuaauuuuccuuucaguguauaaauauguaguagaccaaacuauuuuguuuguuuuuuuuaccagcuuacuuuguucucauaaauuuuauguguggacaaaaguaugaaagucauuauuguuuagagccauguuugccauggagaaauaaacuauuggauagaucagucuuacauccuuucuuaaugcccaugcaaugaaugaagaauauuaacaaugucuucuuaguuguguuuugguuuuugauagcuuaaucacuaguuggugcaguaaaaaaaauaaccuauauuaugucaacuagacaacauuuuuaaauuuuugaucucugaagaggacuauguuugaaucacuuguaaauauugauguuuccagucaacccaauuuggaggaggggauaaagcaauuaaaucauuuuugugauuauuucauaaaaggguuaauaacaaggaaauagccuuuuauuuucaaauaagcu

SEQ ID NO: 14813 - RNA, 10197 nt, Homo sapiens
ccuugaauagcacagagauuuauuacuuuauccucauauaaauauggcuagagaagaagaaugguguucauauauguauuguagauauacaacuaguuguaucuauaauuuguaaguguuuauauauauauuaagaacauuugaagaguaauguuaacauacugaaacuuugaaaucuuucacauuuaaaauuucaacauaucuuaauuacugcucaugaaaauguacauuaaguguuaaaguaaaaaauuauuaaaucuguggcuauuaaauuuuaaacuaauuuuuuuccuuuaaaaguaagagucacacugacacugucugaaauuuaaagagugaaugauuuaaacuuaaaaaaaauuuugaucugaaaauuuauuucacccagcuuucacaauuaagucuguauaaaaugugguaccuuuugguaccuauccagagaaaccuguacauauucaauguuaucuagaugugauuggauaauggagaaaauuuauuuauaaugauuuugcaauggcaucaauaacauuuaaaugauuuugaagaaguauuauuuuacuacccuauaaaaugaaucgaaaauaauaaaguucuuaacauaauuuacucuuuaaaaauuaccuguucauauuuuguaaacccauauuuuuagcacauuaaaaaugaauguuugauauuacagaauauucauaacaaaauggaagaauuauaggaauuaacuugaauuuggcauuuuuaauuuugugauuuaucauuuuauuuuuucuugaaauuucaaacacaaggaaagcauagaauagcuuuuaaaaguagcuaugccuucuuccaaauguuauuuuauucaaaaagguaaccagguuguguuuuaaaccugugaaauauugugaugcauuuuauuacugaaaguuauuuaacugccuuuacuugcacauaaaaacucucauuuacggccaggugcuguggcucaugccuguaaucccagcacuuugggaggccaaggcgggcauaucaccugaugucaggaguucaagaccagcauggccagcaguuuggugaaaccccaucucuacuaaaaauacaaaaauuagccuggcgugguggugugcgccuguaauccuagcuacucgggaggcugaggcaggagcauugcuugaaccugggagguggagguuacaaugagccaagauugugccacugcacuccagcaugggugacagagaaagacuccgucucaaaaaaaaaaaaacaaacucuuauuuaauuuuuaguuaaaauuaaaacacuaguacuucagaauauagauacaaguacaccaucuugaagaauuuggaguuuuucagggcaauucaaaugaccucauuuuuuguucuuuuuguauuccagacaguguuucugucauuggaucucugauugguaguguuaauaaauauucuuucagugugagccagauucauaaaauuaauuuucuucauuuuaguaguaaaaaguagucuaauagcuuuuugucagcuugauuuuuuuguguguguaauauucaagggcagaaugacaggacagauaagcaauaagaaauguauagaauuagaaaauauaguaguucccucuuacccaugggacauacguuccaagacccccagugaacgucugaaaccauggauaguauagacaccucuauacacuguuuuuuccuauacauauauaccuaugauaaaguucuauuuauaaaucagggacagcaagagauaaacaauaacugcaaauagaacaauuauaacagugcacuguaauaaaagugauguaaaugugauaugucugucucuuucucucaaaauaucuuauuguacuguacucaccuguaaucagacugugguugaccgugaguaaccgaaaccacagaaagcaaaaucguggauaaggggagacuacucuauaugaaacuuaaguuacaaaauucucugaagcauuugaaacuagacguuuuggaauuauaaaauagucccuuuaaaauauccacuaguagaaaaaaacuucauuugcagagaaaagauugcaauaaaacucauuccuaaacuuuucaauuuuauaaaauuaaacauucuuuuuuuauccguauuaacaauuucuaguuacauaguuucuaguuacauauuaccauauauuacucuuuaucuacaaauaaauagcugauacucaaacugaucauauuuugauuguuaaacacuuggaucucucaauacuucuguaaguuaaagugaacuuaaacaguuucuugaaaaacuccaguagguggcagaauaccuauugaauauucguugcuauacuuugcuguuugucauuaaaacaucucuacccauauucuugcaaaauaauauuuauauuuuaauggauaggaaaaugauuugcaauuagauguuuccauucuugaaagaaaaaagcugcaaauaacauuuucaagaauauaaaaaaaugaguaaacaaagggaagguuguuuggucauuuauagacaauuaagcacagacuguagauguccuuccaauucuugggaggcuaaacugagucuaccauuucuuacauuucuuuuaccuauuuuuugagaauugccaguuguacaguguuuagcauguggaauguaccaaauauaucuauguugugacuuaagauauucuaaauguggauaacuucugaccuaggaaacaugaaguuuguagugaaguaagugaaaagaauguucaggaaauuuuuuuucuccaucucuucaguuggcauuuauugagaguuuuauuugaaugcuuauuaaaaguauaugauuuauaauauuuagaaaauagaagaaaaaagaaaacuguagauguuuuaucuuguuuuaauacuguauguuuaguacguauacauuuauguucuaguguaucaaaauuuuucauuuucauuaaagugaauccaauuuuccauauucuagguccauuuuaaaccaugaaaacuuuaaucacauauuuuguaaagggcugaaaguaugauuuaaacuacagauugauauauuuuaauucuaaaugaaagguaauguaaauaagcauggaucugauugaauaaagauuuuaaaauaguaauaguguauuucauuuuuaacaaaauuuauaguggucaauaguaaugagugaagaaugaauauuguuuuaugaaaauauaacuuguuuacauuugagauuaauauuuuaagaaaaugaagcccuaauuuucuauaaguuacauuauuaguauuaaguguaguuuuuuuuuuuuuuuuugacagagucucacucuguugccugggcuggagugcaguggugugaucucagcuuacugcagccucugccucccagguucaagugauccuccugccuuagccucccaaguagcugggauuacaggugcgcaccagcacauccggcuaauuuuuguauuuuuaguagagauggguuucaccauguuggccaggcugguuucgaacucaagugaccugcccaccuuggccucccaaagugcugggauuauaggcauaagccacugcgcccggcccuaaguucauuaucuucuaaugaagauauguuuucggaaaacacagugcuaagaauuuacuuauaacuagcugguaacuacuguaaggauaguuugugucaguuuuuaaucuuaagcaauaucaagacauucuucuaaaagucuuauguuucuguauucaaguaauaacaacaguuaaaauaaguuauccucuauuucugaguucauauugcuuggauuaagcucuguaaccuuuaaaguacuuuuaaucuguugccuuuauacauacgcauuuuaccuuuuagcaaauuaagaucuuuuuguaagacagacuggaaaugaaauguauuucuccuuaguacuuaaauaccuuuucucaaaacaaaacaaaaaaacucaaaaugcuucaauaauucacaaauacgguaaagagaauuuacucuuagaacugucuggaauuccccacacugcccuacucccaaguagccuaaauuuaauauuuagaaucgcaaauaacauuaaacaagaacguaauggcagguuuuucuguuuguuuaauauuaaacauucuucuugcuuuuacagguauaggcacagcaugguagauagagguauuccuuccauuuuuauaaaaugccaugcugauuugucuguuuuaaaauuacaaucuuaauuuuuaaaaauauacguuguucaaaaaucuguggucagguugguaauaggaaauauagucuuuucuucuuuuuucuuuuuuugggaaacauagucuuauuuuguuccaaacacuguguaaggaauucacuuauguaggauuauaaucccauaaucauuguucugaaauccacaaagcucuaaaaaccauacauauuuuaauacauuugcuguuaaaucuacuucggugguaaagccugcacugcacugacauagggcuauguauagucuuuaacucauuuggugugaauacucauacauuuugcugcagaaauacugugugagauuaugggguacucacccaggacucaguggggggggggggguauuaaguuaaacgaugggcauaucuauucuauuuuuuaaaguucagacacacacagggacccaaggauuuuggaaaaggaaguguguacccacacuuuaucaucaagucaaccuuuuaaaauggaugccauuaucacccccauuuuuaaaaauaaagauuaaguaaauugcucaaggucauauggcaaguaaguggcaaagcugggauucuaauuugugcaguuuggcuccagagucuaugauuucaauaauuaauuauauggugcuacuuuuccuacugcuuuucuguaaaaucauaagcauauagaucaguuacagccaaaauuuauucauuaaaaaugucaacaccuuuuaauuauggucuaacaguuggaugagagaaccaguauacuacauucugcugauauuguuagcaauuuacucauuguaauuuguuggauuugucucaaauuuuuuaagccaugcauucuuccaucucugucucucuuuuucuuaauucuugcaauuucgaugaaguuucuuauuuguagaaaaaacuaggucauuuguccuauaguuucccuccaucuggauguugauuucuuaccuuuuguuaguguguuccgccuccuguguuuaaaucuaaaggcaauuauuuuucaacaaaaauacuucauuagguggaaguguauucuuccagcaggagacagauaauuccugaugguuucucaguugugauaaagaaauaauugaugaucacuucuuaaaucuauuaguucacagagcuuguggagugauauugucauuucuuuuucauuuaguaguuggaauguuuccauaaaaaauuuacuucaguuauuuuguuauuugcaucauaauucauacaggaaagacaguauaaauauuccugauucuuucccuuuguuuaccaguuuucagaauaagaguugguuuccuucugucauuaaaaaugaacagcgauaccuuuuuggcuugcauguuugguugauuggucgugucugauaugauuacuuaaauguaucuguccuucauccaauuacaguuaccuuuauuuauguuuuaaaucauccuaucuuuggccaguaggaagguuuucaagguggauccugaguccuuuugauaugacccuaauagccuuuugauugcuuugcugcuuccugauguaagauguugcaggcuuaucuuguacauuuccugcuccagacccaagaucauccauuguucuauggagucaguguuucuuuuaaugggaaaugguugguagagaucacagugugagcgcaagggggugcuucuuccuccuggguagcuugucucuaggccuuuucaauggagcacguaggagagauguguuuuuaaagauuaaccauacuguuaaucauacugaggccuccaacugaaauucagaacuacaggauguuuauauagccugauuaagcuuucauauuucuaucucaugucaaaaauuucagcuucaaagguaccaucauaauuacuucaacuugguguaucccauaauaccaauauugccaccaacaauuugguuacggaaugcagucuacaaaagaguuuuuuuguacuuuaguccugagaauacaucccacuaaguauauacaaauuaaguuuuaaagucacuugggauagcuccucugggugauaugccacaauuggaaaacauuuagguucauuuaguuucauuuuacuuucaaggauugcuuuuuaaaaacagaauuuugcuuuauaauguaacauauuuacaugacuucaaagucaugucuucacgccaggcgugguggcucacgccuguaauccaagcaguuugggaggcugaggugggcggaucacuugaggucaggaguucgagaccagccuggccaauacagugaaaccccgucucuacuaaaaauauaaauauuugucaggcaugguggcgcaugccuguaaucgcaguuacucaggagucugagggagaagaauugcuugaacccaggagauggagguugcagugagccaagauugcaccauuguacuccagccugggcaaaagaguaagacucugucacacacacacacacacacauacacacacacacacacacacacaccaaaaaacaaagucaugucuucuuuguuccuuauaccccuccucuucccuccuugcccauauagucauuuuaaauguuaaucuacuuguaaaauaauaauuaguaaauauauauguguauacacauguauacacacauauuccucuuagaaaaaugauauuuacauauuacauauccuuuucccacucaauauucuguaguguacagagauauuucucaauuccuuuuuaugcaugcauaguuuuacauuguauggauaaaccauaguuuauucaaccagccuucuauugguagacacuugaguuuuaugucagcucaaagaaaauuuaaauucuaacauugguauuuuggagagaaauucuauuugagaauggcuguuacaguaagagagacucaaucucauguucagguuuaucauaucugguuuccuguaagucugaaugaccauucaauauguagguguuuaaaauagcaccacauagccaggcgugguggcucacaacuguaaacccagcacuuuaggaggccgaggcuggaagaucacuugaggcccggaguuggaaacaagugcugggaacauagcaagaaccuguuucuacaaaaaaaauaaaauaaaauaguaccaugcacaugucauacugauuuuaaccuuuuuguaugugacaaaaauaggaugguagcaaguaggcugaggaagcuuuuuuuuuuuuuuuuuaugagacagggucucacuguggcccaggcuagagugcagugucucaaucauggcucacugcagccucaaccucacugggcucaagcgaucauccugaguagcugggacuacuggcaugagccacagugccuggcuugaggaagcauuuuaaaaaauuacugucauuagugugggauggugaaguaugcaaaguauaaaauaauagagcaguaauucuguuauaggaaaggggucccaauccagaccccaagagaggguucuuggaucucgagcaagaaagaauucagggcaaaguguaagcaaguuuguuaagaaaguaaaggaaaaaaaaaaagaaaguaaaggaagaaaagaauggcuacuccauagacaaagcagcccugagugcugcugguugcccauuuuuaugguuauuucuugaugauaugcuaaacagguggauuauucaugccuccccuuuuaagaccauauaggguaacuuccugacauugccauggcauucguaaacugucauggcgcugauaggaguauaguaguaaggacuaccagaggucucuuucauggccaucuugguuuuggugggauuuagccggcuuauuuacugcaaccuguuuuaucaacaaggucuuuaugaccuguaucuugugccgacuuccuaucucauucugcgacuuagaaugcuuuaacggccugggaaugcagcccaguagguuucagccucauuuuacucagcuccuauuuaagauggaguugcuccgguucacaugccucuugacaguucccuuagaggcaaaaucuuuucaauaaaaagaauaaauuaauacuguaaagugcuuuaaaacaauguuuggcacauguuaaacaccacauguucuugcuguuauuauuugaaaaaaauuccagguaagauuccuaauuuagcaggucacuaauggaacuuguaacaauucuuaaacaacauuacuuuuaaaaauuacguaaaaagcauguaagccuuuggaaacaaacuuguuuccuuaugaucauauuauuuaacuucuggugacuauauucauuugagcauguuuauuuugaagucaucaccuucauauaaucaguucaacuuuagucacuauuuaaugaucaacucuacugugcuguagauggaauacuaggccugggggagcuuagaggaaaagacagugggggaugggaguucaaauaauuauaagcaguaauaaaguaaauuaacaaaaccauaaaaauuaaacuccacagaguagcauuugaacuugaugaguuuacggauagguaaaacuauacugcuuuuaaaauguguguggacuccaaaguauccucaccaucacaaaguguauucggugaacgauguucaguccccaaauuuggaaguuagggcggcaacuucugcuugaaauaagacaaaaguaaaaauccaccucagugcaacgcagaagacacgaagagucagguuuucuacccaccccguccuaacauccucugagcgcuuuaacgcucucgcucaaggaggcgcgggcugcugcgauggagaugggcguccggcgccggcacgugccgucggucuuuccggcccuggugagggagcuggcggacucgcgcgaacguucgcgggagaacgccaggaagggcagaugguuccucgacucugagccccucccugcugcgcucgccgggucgaggccgcucgccgggcugaagccgcuccgagcgucgggccccgcgcccuggcccuccuggguguagucccgguccugccucugcggggcccgagcccgcccacggcgccggcuggccaaggugucccagcugcuccuuggcgcccccuggcccagcucccgcgcccgagguuuccggugagcggcaguagccgguuaugacgacucccuccucuggaacagccgccgucuccuccgccuccuccucgguaguucacggcugccccggcuccaggugggacucccccgcaaucugcggagccuucccccgcucuccuucccgccgccgcagcgcucugcgcuguucuugcccgggugguagccgcucccggcgcggcuucccggagggcuauagccuacgcacgcacuccgcccgcgccuucccauucccugcgggccgggaggcgggcgucggaagccgauccuggcccuccccggccccgggcgcccggccccuucccagcgcccggagcgcaggcgggccccgggcccuagccgcguugaccagguuuccagccggggcggagccgcuccccggggccccucccaggcgcgcuggggacccggggcgccgcggugcacgguggcgggcggccccgggagaucaccgaccccgaagcaaucccuggcggcgcccgggguccggaaccccagcgcggcgucucagccgcggcggggugcucgccacugaccccucagcccuuggccgggacugacguucaagcggacagcugggcucugccgggacugacguucaaggggcagccgagcacuuccugagcccugccuggcacccgccgagagacuuuuuggcacaaguaggggccagccguugaggugucauucggggucucacguguugaacuuuccauuugcccacugccgucuuuaaacuuuuccaagcucucucucucugcgacauugccccauuucgcccgcugugucaaccccagguuuugccuccuauccaucaucuuucagauguuucccuuuuuuccuuccucauuaggccuguggaaaucgaaucaaggguuucuggaguggagugauuccagcugcuuugagcugaaggaa

SEQ ID NO: 14814 - RNA, 29186 nt, Homo sapiens
uuucuaauucuauaaaagaauuuauuggaaguccacauuaaauguuuagauauuaaaugcuuacauucaguuugaugggaauucaauuuucacaaguuaacugagacuuugucuuaaaaguucaucuauuugaguuuuguacauauuuuuuacaucuucgagaucuaaucgaaguucuucugccucuucugcuuuuucuccauacaucugcagaauaguguuguaccuuugauccaaauccugaaaaauguauuuguuuacaauuuuuaaaauaacuacacagaacaucuuuaauauuuauauugccauaggagucaacaaugaaaacacuacaauuuaaauaaaaguauauacucaucucuuuuaaaaauuaaacucacacuucagucuauguugaacuaaauagcaaaaaaaggaauuaaagaaaaaaaccaagcuagauggcuaucaauuuuacccuaucucuccacuaaaucuacaauucuccccauauaugacuucucucccauuaauguaagcacacuugauauaaaauuuagucucuuuguuccauggugguauaaguauuacccggcauuuagcccacaccacaggaaagaucaaaagaaaacauauucucacuuauggcuuaacagugucuucuaacauccagaugagacaauugugaugauacauauaacaacaaucaacaaaauauuacuaagaucauacaaaguucaauguuauaaaugaaguguagccaaaugaaaucuaguucuuuuccuauacugggacuaaacaugauugugaaaauuacuuugaauauguaaagauacaagcaagauaaaagauucauuuuuaaacuucuuugcucaaauauuaguacucuuuaauuuucaaauaaaucacuaacacauacuauaaauuaaaaacaugagauuuaaaguaaaugaacuaaaauaucuuagacucauccuuaggugaagaauacuuacucuuagcugaguucuaaguuuggguaucuccuucaccuucucuucaaguucaucauuuugauuuguuaauuuaacuaguucuucagccauuauugaucgaguuuuuucuagauugccaauuucuagcugagaagcauuaccacaaaauaguuuaaaucaaaacauaucuuuuuuaauacucccaguaauauaaaaauauuuaaugugugugugguuuuuuuuuuuuuuuugaaauagacaugucaacauauaaccuugagcuagcucuuucuuaaguaaaggaaacaguggcagaaaaacggucccaacuuuccugagagguauaccguuuauaagguuuacugugcaacagagauaaauccaauuauuuguuugaaaacauucaaccauauauuuuucuaaucuaaggaaaugacauauauuucaguuauucuaaauuacuacaagaacccagagaaauaaaaauauacuuuaacguagccccaccuguguagguuguaucgacagaggcuuucaucacuaccaaagaaauuaauuaggucccuguauagcauaccagcuauacaaacaucugggauucagauuagucugaucuacuuuuugccaauucaaguucuuuaauauuuucauauaacuaaaaguauauaaugggaguugaauuuuuaccuacuucugaguguauuguguuuaacacugaaaagagguauccugauucaaaaugcuugagaccaggaauguuucaaauuucuuuuuuuuuuuuuuuuuuuuucagauuauggaauaauugcauuauguacuuacugguugagcaucccaaaucuggaaauccaaaaugcucaauugagcuuuuccuuugagcagcaugucagcacucaaaguuuuggauuugggggcauuucagauuucagagcugggaugcucaaaccuguaaaacauuucaauauuucugacugcauaaaguuuuuuaaaagccaaaaagguaagauggaaggaugcuccaucaacaacucauguuguuuccucccauguacaggguguuacaguucaaacaucucauccccuuuaccccuccuucccgggguagcuggaacaacuuaucuaagagguaaaucugaauagaacaggcauucacagcucagugacuucccuuuauucuguugggaaagagcugcuugaaaggaggagggauucucugcuccuagaugcuuaugucuuauguaggcagguuguaaaacaugggaggccugcuccagcccagcauuuccugugacagaucagccgaauaugccuaauucuggcaauuagcagguucaguuggcuguuauccuuagcuaauuucucuuuuuagccuuuaucauugauauaugugauacauuuugggcuucacaugccacuaugucaucuuguuucucaauuugcucagaauucagauggaaaugaagggugcuauuuauuaggccucaaaacuucauuuacuucuauagcaaauuuaauuuuuccaauaccuguaaaugagugauuuccccuucccuuagcuuuagcugagacuguagguuuucaauuaugcuugauccugcucccauccuuacagcaucauaaagauugcuuccauuugcugauauaggcauugguccaaaugagugaucaugagacucauccuauguuaauuaagaaaguucacacaguuacucaguuaucauagcuugucuuccauuaccagguucgaacaaaaaugguucugucaauuuuugcuuuaaaugucuucucaaaggcagaaaaucauucacguguuuccucucacuaaaauuagcacuccuccacaaguauucagaugaauuacccauagaauggcaaggucaugaugacagacaauauugccauuugcauauuuccuuuauuauuauucuaagaacuaagcacauauaaaaaauaaaacaucaccugagacagaaaagaugucuguaguccugccauaucaacaccacuuauugaacuugagcgugacauggugggagugcuagaaacagaaaauggcuugcguuccuuagggaguaaaaaaaauucuguucauauuaaagagcaaagagauaagcagagaaagcaagaacauuuccuaggguuaaugagaacaaagauucagucuuuuaaaaaagccacacuacaaaggaauucaauacaaucaaaagaagaaaaaaaacuuuuuuaagauucauucuaauuuccccauaaaauggcuucuuaagucaaaaauacaauauuuggccaggcaugguggcuuaugccuguaaucccagcacuuugggaggccaaggaggguggaucaccugagguugggagaucaagaccaacuugacuaacauggaaaaaccucgucucuacuaaaaauacaaaauuagcugggcgugguggcgcaugccuguaaucccagcuacucgggaggcugaggcagaaucgcuugaaccugggaggugagguugcggugagccgagauagcgguggagguggcggugagcugagauagcaccacuacacuccagccugggcaauaagaguaaaacucagucuccaaaacaaacaaacaaaaaaaaaguacaauauuuacuaauuaaaacuguagcuagacuugguuagaucaucacagaacccauuuauuacaacaauguaauuuguuggguuuuuauaauagaauaagaauguuucuguuaagcuucauauuauacaauauacuaucaauuaaaccuauuucuguaacauaaaauuacuaaugaguguuacaaaucauaaaauuucuggcuuauccauuuuauuuuuaauguauucuuaaaauuccaaauaaauucaauagguaauuuaaauuuaccuaucgguaguuuaaauauauuaugcuaacuccaaguacacgguaauucuuucaauacagaaaacucauuuuuauuuauuuauuuauuuuuauuuuuuugagaaagagucucgaucuguugcccaggcuggaaugcagugaugcgaucucggcucacugcagccuccgccucccggguucaagcaauucucccaccucugccucccgaguagcugggauuacaggcacaugccaccaugcccggcuaauuuuuguauuuuuaguagagaugggguuuugccauguuggccaggcuggucuugaacucuuagccucaagugauccaccuaccucagccucucaaagugcugggauuacagaugugaguccccaugcucagccucagaaaacucauuucagaaaaauuacccucauuaaccagaaagaaaacaagccagacuuacuccuuaagugccuauagaccaaaugaugugcacugguuucagugacagacaauuaaauucauuuuuaaaaagggcaagagguuuuauauuucaaguccuagaaaucauagaucucuuuggauaaacucaaaauuacuuuggguccacucugagcaggacacugauuauaauacuagaauucaucacuauguugauuuuagacauuaaaaaaaugauacuuauaaagcagggauguccaaucuuuugguucccugggccucauuugaagaacaagaauugucuugggccacacauaaaauauacuaacaauagcugaugaacuaaaaaaaaaaaaaaaaaucaugaaaaaaaucucaugaugauuuaagaaaguuugcaaauuuguguugggcuucauucaaaaucauccugggccacaugccaaccagggccacagguuggacaagcuuguuauaaagcauagcuaaaauuaaaaagcaaugauuaaucacagcaucuacuaaaugguuacaccacaaacaaacaaaaacaaaauucaauaccuuuucuuuuauuguuucuugaguaaaaauggcuuucuuccuuucuuguucaacuuucauucuuuccauuucuaacugacuauucaacaaugucuaauagagagaaauaaaguuagacaauuucugugauaguaauucaugccaugauaagucaaucucaaaguuagaagcauaaaguauaaacucauauuuguuuuccuacuaaagaccaaguuccaaaagcaguggcaucacccauuucaucuuguuaucucauuaauuugcugccauccccaaccauucucuaauguaugcccuaagagcugaguggucacgaagagaaauaccuuuucuuuccucgucucuucaaguguucuuacauauucaucuuuuagguuuuccaauucaaccugguaccuauuaaacaaggcagaauuuaaaaaaacagaaaaugaaaaagaugcuaguauagacuauuaaaaacucaguacuuuauuaacuccagcuacauauugagaaaucauuuuuauuaccagcuugacaucagugauuuuccaacaguguguuccagaucccaucugaguuucacucagaaaccaaaccaaaagugaaaaagcuccacuucugugcauuuuauuuauuggugcucuggguuaagauuucauuuaaaaagagacuuuauaaaaauaauuuugaguaccaucauccuauaauaugcucagauuccacaaagcuuauuagggaguucuaugaaaauguuucuaaaaguucagauauuuuacuuuagaaaucauuuuuacuugacauuuuuuuaaaaaguaaaauuuccaaggaagaacagaggguuaaaaaauacuaaccauugccuuaauauaaucucagauagauggauuuuacaccccaugguuuccaagaacccagaaauuuauuuagaaaagacuuaaauuauacuacuaaaauccuuguaauauaaaaguaacuccaaagaguagucucaaaacuauuuugugguguuauaggccccuuuaaaaaaucugauuaaagguacaaauccuuucccuggaaaaaaaaauaaauacaaaacaugccacacaaucucaacaaucuacaugacaaugaaucccaguacuaucuucuuguuauaauauccuauuacuuuauuuauuuuuuuuuuuuuggagacggagucucgcucugcugcccgggcuggggugcaauggugcaaucucacugcaaccucugccucccagguucaagcaauucuccugccucagccucccgaguagcuggaauuacaggcgucugccaccaugccuggcuaauuuuuguauuuuuaguagacacaggguuucaccauguuggccaggcuggucuugaacuccuaaccucaggugauccaccugccucagccucccaaagugcuggauaacaggcaugagccacagcacccggccauaauauccuauuacuaauaacccuaacuuuaaaugcuaaaagugauuacauuuaguucuugguacccugaagcuaaaagccaacgacauacuuuguuuauuuacuuauuuaauuuauuuuuuuuuuuuugagaccgagucucacucugucacccaggcuggagugcaguggugggaucuuggcucacugcaacuuccgccucccggguguaagcgauucucaugccucagccuccgagcugcugggauuacaggcgcacaccaucacaccuggcuaauuuuauuuuuaggagagaguagguuucgccauguuggccaggcuggucuccaccuccugaccucaagugauccgcccgccuuggccucccaaugugcugggauuacaggcgugagccacggcgcccggcccaacaacauacuuuuaaaaagugcuuuaggaugucacggaacuaccaaaaauaucacucagaaaccaugcucaccuauuguucucauccuccaguuuacacagccuauuuuucucugauucuagcugggcuugaaaucuacuguuuuccugucuuaaaagagaauucugugacuccauggaagacaucugaauuuuguuagcaaggaguucuucuguagcugcacguucucucucaacugcugcugccagcaaggucugggauucaccugauuacaggacagaaaaaaaaaucacauacacauacagcccagagaccaaaauaccaagucaauucugauuucaaacauuuaaugaugcaaguagccacacuuaaaacugauaacuauuuauugccuaaggcaggacugucuacugagacaaaugaaccaaucuuaacuuauaccugcuuuaucacucuuuuccaaaaguauuuuaauuucaaaauggagucaugcauuaaaagaguaguggaucaccaacaccaaaugguccuggagcaacuggacagcuauaugcaaaaaaaccaaaaagccuacacaucacaucauucacgaaaauuaacucaaaauggaucauagacuuauauguaaaacaugaaacuauaaaacuuuuaggaaaaaacagaggagaaagucuucaggaucuagaacaaggcagauuugacacaaaaagcaagagccauagaaagaaaaacugacaaacugcuucaaaauuuucaacuuuuaaaucuaugugaagaggaugaaaaggcaaacuacagagugagagcaaauaaaugcaaaccauauaucuaggauuaguaucaggaauauauaacaaucuaguuagaaaauggguaaacgacauagacagaaauuucaccauagagaauguacaaauggaaaauaaggacauaaaaugauguucaauaacauuagccauuagggaaaaaauacaaauuaaaaucauaaugagauaucacuacaugcugucugaguaacuaaaagaaaaaacagggacgacauaaaauguuggcaagggugugaagaaaccacauuacucuuacacagccacuuuguaaacaguuuggcauuuucuuaaaaacacuaaacaugaccuggcaauugcacacuugggcauuuaucuagagaaaugaaaacuuagguucacacuaaaaccuguacaugaauauucacaguagcuuuaucuguaauagccagagcuuggaaucagccuggacgucccuugugcagugaaugguuaaauauacgugguacauacuauggaauaacacucagcaauaaaaagacuaaacuaccgauacaaaaacaacugugugaaccucuuccugggaauuacacugagugaaaaaagccaaacccaaaaugucauacacuguauaauuuuauuuauguaacauuuuugaaaugacagaauuuuagaaacagaggacagauuagugauugccagagauuugggacaagggaggaaggguugagagagugguagguguguuuccaaaaggguaacauuaagagugauuauuuucagcuaagaaaaaaagaaaaaaagcuaacaggaaggacucaauaguguuggaacuguucaauaucuugacuaugguaauggauaugugguauaguuguuuagaacuuaauacacacacacacacacacauacacaaaugaguaccaauaaaacuuuggaaaucugaauaaaaucaguagauuguaucaaugucaauaccaugguugugauauuauacauuaauuuuguaagauuuuaauacuuggagauauuaggcaauguguacaaaggaccuuucuauauuauuucuuauaacugcacaugaaucuacauuauaucaacaaaaauuuucaauugaaaaaaagagcaauggguaagauucugagauuuaaccuagguaagaauucuuguauuuuuucuccaccaaaguagagcuaguaauaccucuauuucacauuuuacacucugcuccacagcauagcuauggucuuuuuaauagcauuccuugguauguuuguccuguggcuuugccuauaugcuagcacaauaccacauauugcugaggguauguagacuucagucuaaaaaccacaaaaguaccaguuucuagcauucauuuauugcuaaauauuuauuucaaaagauaucauuuucagaugucucauauuucacagcacauugcucucaaaagcugucagagauaaacgacagaccuaacauuuauaccuauaaauuuaaauauauaugaagguuuaucuaauucaguucauuuuuuuaaguaaaugaaucuuuuucuagaccaaaucuuucauggaacuccaauuaaaaaaagauagacaaaggaggcccuauuuucauuaaagcagcuagagaagcccagccucuuauuuaucaagcuucccucucaccaugacagcagccccaaagguaucuaagaguccacugaauacuauuugaaagucacuaaucuaguucacccccccgauucacaaggaauagcacagagauaguuggaacaauauaagugacuuguuccacacuguuuugcuggaugauucaaaacagaauacccugaguccaugucuccugacucauauuuaggucugauuuuaucacuacacugugauuucucaaauuacauuuagugucaggcguagaaggcauacaugaauuuuucaugaauuugcuagcuucugggauaccuauaauauacauacacuagcugucugugcuugaagggaaacauuuuagaauaauacuuuucuuuuuauuaacaucacagaagggcaaccuggggcaugacuguaaagaagcagaauauggaaucuuuuuuuuuuuuuuugagaugcagucucgcucugucacccaggcuggagugcuguagcgcaaucucagcucacugcagccucugcuucccagguucaagggauucuuugccucagccucccaaauagcugggauuacaggcaugcgccaugacacccagcugauuuuuguauuuuugguagagacgggggucucaucauguuggccaggcuggucuugaacuccuggcgucaagugauccacccgccuaggccucccaaagugcuaggauuacaggugugagccaccgcgcccugccagaauauggaaucuuaagacucccuaguaugucucuucuaaggucgaucuugacucuccuuagaccuauuuucgcucuuggaauucuaccagugaugagaaucauauaugaucucuaccuccuacacuacugcagacaagcuacaaaggggucagauuuagcaauggacaagaaaaaaaaaucgagugcagcagucuacuaaaaauacaaaaaauuagccaggcaugguggcagacgccuguaaucccagcuacucaggaggcugaggcaggagaauugugugaaccugggaggcggagcuugcagugagccgagaucgcgccacugcacuccagccucagugaaagagugagacuccaucucaaaaaaaaaaaaaaaaaaagaacugaaugaaagaaugacauggaaguacuuuagccaguaucugauaccauuguguaaugggaaaaaaugguuugaaagagacauaauaaagguauuaaaaauacauguagaaaaagagaaaauguaaaaaucuacauauuagacacaaaauguaacuaucagaucaaaugaauuucaauuucauaccauuauucuaauucuauaaacaagauggaagagcuucugcaucgagcauaaaaacuaaagcaguuaccaagccuaucagaaagauucuucucuaauuucucccacgacgaugucugggaucccaggguugcuugcaaauuuucuauuugucgaagcaauggucuuguuguugaugaaacacuuugacucaguuccugguuucgauucucugcuuccuggagucucugaaucaugaaauucugaagucauuaccaaugacagcaauaaaaacauuaaaaacacuagcaaaccugaacuuugagagguuccuggaaaauuauuuuuccaagagaaaauaauuugcuuuuuaauuauuauuauuaauuuuagaaacggggucccgcucugucacccaggcuggagugcaguggcacaaucguggcucacuguagccucaaccuccuaggcucaagcgauccucccagcugggacuacagguacacgccaccacaccuggcuaauuuuuguauuuuuuuguagagacgagguuucaucauguugcucaggcuggccucgaacuccugagcaggcaaucugacugccucagccucccaaagcauugggauuauaggcaugaaccaccaugcccagcccuuaauuauuuuucuaacuguucaauccuuccaagagaguuagauuguguaauacaguaucuaaauaaguacuucuuuggccaggcacgguggcucauguguguaaucccagcacuuugggaggcugagguggguggaucaccugaagucaggaguucaagaccagccuggccaacauggugaaaccucaucucuacuaaaaauacaaaaauuagcugggcaugguggugcacgccuguaaucccagcuacuugggaggcugaggcaggagaaucgcuugaacccaggaggcagagggugcagugagccaagauugugccacugcacuccugccugggcaacagagcaagacucugucucaaaauaaagaaauuaaauaaauaaauaaauaagugcuucuuuaaaaagcguuucuaagauagucuucaauuaccugaagguuaaaaaagaguucauccaaaccucuuaguaguuaccuccucauccaaauauuucuaaguauuuauaaaaacugaaaaaucaaccuaaauuguauuuucucucccuuuuccucugcauguuauaaaugacugaaaauuaacagaggcauagaaaccgggaacuauuaccugucccacaguaaucaaagacugacaaucauuaauaagcgauuacaaauggaaaagcaauacugaauacauauaacaaaucuaucauaacauuauuuucuauaaaacaaaauaaggaauuuccuuguauaauuuuuaaggugcccacucugauuuauucacacaagccacaaaaauucagcaaaugcuaggugugacaguaauccucucaauuccaugaacacuaucccacugaggaauucuuuuauuucuagaaaaacacauacuucuuggauuuguguuuuggaaaccugugacaguaccugcugaaguucaccgaucucauggcguaaauaauccuccuuucuggcagccgcuuguucuguacgcugcaaugcaagccuaaggucccccaccuguaggaggagaaacaauacauucacaaacaaugguacaguauuaucuauaacuucccacuaacuacauauuuuguguugugucaacauuguucauguauacuauuucauacucuccaaugaacuuuuacauaugauuaucacaucucucauucaucaagcaauucuaaaacuguauguauauucaauguuuacuuagaaaagcauucuguuaaggcaaagaaacgcaaacaaauauguauaaggcauagccauuaccauacaauauuggagaaaagacagugcgucuauaaauauuugccacaucacacagaaagugauaggugcuauacggauuauaaaagcugggggcuccacucauaugcaggagcauacauuauaaacuaccauagccuuuuuggaaaacguuauaauauguuuaaagaaucaucaaacuucucacauccuuucaccgggccauccuagucuugggaauucacucuaagaaagcagauacguaaauacacagggauauucccuacaguauuaaauaggcuagcaaaaacaaaacuggaaauauucuaaaucuccaucacuaguaaucuauaguugcaaaugucgauacaacaugaauauaaccauuaaaaauuacaauaaauguauaaaacauguaaaaaaaauuucuaauauacuauuaaauggaaaaacuauaaaauaacacguaagacaucaauuaugaaaaacacauauaugggaauagaaugaaacacuaacacacaaaacugacaguacuuggaaaaagugauggauuuaugcaugguaacucauauaugcucuaucucccauucccccaauuuuucuguauuauuauuauucuaacguauuuuaaauuuaaauuacugauauuuuaucuaucccagcagaaacacaaaggauauauggaccauggcaugacuuauaauagcaaaauacugaaaauaacccaaauauccaucaauaagaaauagcugaaaauacuucaccuaauaaaguauuauaaaacuguaaagagauauuuuuuaaaaaccucuauguuuuacuagagugaucaucaggauauuuuacuaaguaaauaaaacaaguuauaaaacaguauaaacaauaaacuaucauuuacguaaaaaggauguaggagauagaaauagguguauaaucuaucaauaagaaagagcugaaaauccuucaccuaaugaaguauuauaaaacuguaaaaagauauuuuuuaaaaaccucuauguuuuacuagagugaucaucaggauauuuuacuaagaaaauaaaacaaguuauaaaacagugugaauaauaaacugucauuuauguaaaaaggauguaggagacagaaauagguguauaagcgaauguguauguacgcagaacauguaaguauauagauacauauauuuucuugcauuuugccaauagaaacacugaaaagauaagccaaacucuaauaaaaugguuaccuacaggcaaagagaggaaauggggagcagcuaaauuggaaguaaaugucugaauagauuuugcucucacuuuggaaucauguaaauguuuuacacauacaaaacuuaaaauuaaaucaaaagggcauaggagucaauaaaaauaguuuucucaacaacugguccugcaacaacuggauauccacaugcaaaagaccuaaaugugagagcuaagacuacaaaacucuuagaagaaaacugaugaagaucugcauaaacuuggauuaagcaaugguuucuuaaauaugaugccaaaagcacaaauaacaaaagaaaacauagauaagcuagacuuuguuaaaauuaaaaccuuuuggcaucaaaggacacuaucaagaaaaagaaagacaacccacagagaggcacaaaauauugacaaauccuauaucugauaaaggucuaguaugcagauuauacaaagaacucauaauaacaauaaaaagacaaaccgcccaauuuaaaaaugugcaaaggauuugaauauuuuaauuaauuucucccaagaagauacauaaauggccaauaagcaaaugaaaagacauccaacaucauuagucauuaagagaaugcaaaucagccgggcguaguggcucacgccuguaauccccgcacuuugggaggccaaggcaggcggaucacgaggucaggagauugagaccauccuggcuaacacgcugaaaccccaugucuacuaaaaauacaaaaaaaaauuagcaggguggccgggcaugguggcucaugccuguaauccaagcacuuugggaggcggaggcggguggaucaccagaggucaggaguucaacaccagccuggccaacauggugaagccucgucucuacuaaaaaaaaacaaaaauuagccgggcaugguggugggcaccuguaaucccagcuacucgggaggcugaagcaggagaaucacuugcaccugggagguggagguugcaaugagccgagauugcgcuauugcacuccagccugggcaacaagagcgaaacucugucucacaaaaaaagaaaauuagccaggcaugguagcaccugccuguagucccagcuacucaggaggcugaggcagaagaauugcuugaauccgggaggcagagguugcagugagcugagaucgugccacugugcuccagucuggcaagagugagacucugucucaaaaaauauauauaaauugaaaaaaaaaaaugcaaaucaacaccauacucaguuaccacuucacacacacuaaaaaggcuauacuuuuaaaaacagacaauaauaaaucuuggcaaggauguggagaaacugaaacccucaccuauugcuggugggaauguaaaguaaugcagccacuguggaaaaguuugccaguuccucaaaaaguuaaauauauagaguuaccauaugaccuaaggauauauaucuaggagaauuuaaaauauauguucacacaaaaauuugugcauggauauuuaaagcagcauuauugauaauaaccacaaaguauaaauaacccauaugcccaucaacugaugauuugauaagacaaagccucacaaauuuuguuuuuccuacuucaucugagguccuuggacucccacagauguuaugaaugagcucaggaguuaaauggauucucucaaaauuauaugcaauauguaugugcauuuuugcucuucucuucuaagaggguuccuagcuuuuauaauacucucaaaugggucuaaaacucaaaaaaauuaaacaauacugguaucacguaagcauuacuuuaacaguuuuaaaaaacacaacugguuaaauuuagcagaauccaguacucugaaaucuaacacauguaucacuacauuguuugauucaaaccagcuaauuguuuaauuuguagaagcauaaacaaauauuuuuaaaacuacucuaauucaucauccauugcuuacuugaauggcuaauguuucuugcugcugacgggcuucuucuugggccuucucuaaugcugcagaaaguucuucuuuagcuuucauuucacggcucagagcagcuuccugugccucacuauccuuugcagcauuggcuuugugaagaucaguaaguucucuuaaaaaauuagauugaguuuauaaauguugccagugaucagauaauagaaaaaguauuucuucaacauccuacucugauaauucauucuaaauggguugcauauuuguucauuuucuuacuuguaugcacuauccagggcagccugaauacuucgguucuuuucuucaaguucauccaugucuaccugaagacggccaagaucuuucucuuggcguucuaccauggaauuuaguuuuuuaauauuuucucuauguuguuucucaaccucuucuuugccaucaaggaccuauauguuauaaaaacagacaaaaguauuuuucaagaaauaauaccaugguaaauaacuguauuccaggaaucuauaauaauggagaaaaauauauauuuuuuugagacaaagucucgcucuauugcccaggguggaauguucuggcucacugcaaccucugccucccagcuucaggcaauuuucgugccuuagccucccaaguagcugggacuacagaugugcaccaccacgcccggcuaauuuuuguauuagguuggugcaguauuuuuagcagagacaggguuucgccuuguugaccgggcugaucucaaacuccuggccucaagugaucugccugucgcagccuccgaaaguguugggauuacaggcgugagccaccccacucggcuaaaaaaucuuaucauuuaucuauuguuugaaaaauccuucuuacaugauauaccccauuaaaucuuuucaaaugcuccauaaccauggccaacuguucauacaggaaguaauaacaauauauauguagagaauuaugauugcuauucaccuguuucaaaugcugcaacuccucuucuagcucuuuaacuuuuuuguucagcuuugcaaccauauuuucauucuccuugucuuuagcucuuaauuucuugaugauguuagaauugugcagcugcuguuuugaaaguuuuucuccuggugaugguaaagaaguauaaacucaaaugauaacuauucccuaaaaaucucaauagaauguuuuaucuaauaguaacauaaaagaacagaauuuuuuuaaauuacaauuuuguaacccacaauguuacaacuaauuuggacagcaaucaucaaugaauguuaaaauuauuggguaaaagguuguugggaacuggauauugacacggucuuaaagaaucacucucauauaucaccuacuaauuuuaaagagaaaaaucuggcagucaacuccuuaacuaagcauucaguuuuggcaucaccaauuguaguacagccugacaauaugugucugcugaugugauauaguuguucaauaucacccagauauuuccuacuagaaauaugaacuaaaucuaauuuaaaucucaucaugaagaaaguaacaaauucccgaacaugggugggacauccugugggacaacugcccuagacucuacagaguccucaaagacauaaagaagagagaacuguccuagacugauggaagacuaaaaggacauaacaaucaaaugcaaugggcaaacuuuggauccuggggcagaacaaaugaucaauuauaacagacacuuuuagagacaacuaggauuaauauuaaaauauaugcuggauuacacuucugaauuaaugcugauuucuuagguuugacuaugauguaccugucaaggaaaacguacuugcccuugggagauguagacugaagaauuuaggagcagaauguuacgguauuuguaaccuccuuucaaaugaguugacaaaaggguaguguauguaugugcagaaagauauggaagaguuguggcaagauguuaacaccugaugaaucuaggugaugaaguaaucagguauucauuguagugugcuuucagcuuugaguuuuacagcucuuuagcuuuaaguuuuaaaaauacuggccgggugcaguggcucacgccuguaaucccagcacuuuugggaagcaggcggaucaccagaggucaggaguucaagaccagccuggccaacauggugaaaccccaucucuacuaaaaauacaaaaacuagcuaggcgugguggcagguagcuauagucucagcuauucgggaggcugaggcaggagaauugcuugaaccugggaggcggagguugcagugagccgggaucaugccacuguacuccagccuggacaacacagugagacucuguuucaaaaaaaaaaaaaaaauuuuucuggggcacgcggaaacaauauauaauacccuuuugugaaauguaaauacucugugaauauaaaauacucccaugugaaauugcucuauuuucucuguaaaaagguucauuaagcaaaagaagacaucaguucauucucugacaaaauuauuaaauuacaaaauaauaacauucgauauuaauauuucaaauaacucuuuuaaaauaagaaaaccaugcaguuagccuuccccucagucucugauauuguaaggcaaggcaguuaaugacuucaagacaucuugagaaaauaauuauaacaacaguuccuucauuuuucuauuuuagugcuuagaauuguguuuuaucauuaucuguguuccuauauuucccucucacugaacuaagccccuaaaggacagagugucauacuuauuauuguaucaaacauaguaucugacauacuaaccguucaauaaauauuaguugaauaaaugaaaaaguuggauaaagcuaacuuucaaaugaaaugacugcuuccaacuguucucaaacgcuacccuuucucuggaaauuuacuuaaguucagugauuuaagcacaaaaacauucauccuaccacuaacuauauuauuaacauuauaaaaauaaauguacaacacuagaaauaguaaaacauauuaugguauacccauauaauggacuuuaauacagccacuaauaaugauaaaaagcauuuaauggcauagagagauguaagagaaggaagauuggaaauuaaauauaugaucuuaaauauguuuaaaaaugcauuaaaaaauacauuaaaacuagaaaaaauuaauaguuccuuauaauauuggauuauaaucuacuuuuccucuuuauucauauacuuuccuauaacuucaaaacuuucuacaaguagcaaguauuacucuuauaacuacaaaaacuuuaauuaacaagagaaauaaaaagagagauucacuugaccacguuuuccaaaggcuccucucucccaggauauuacaugaagaaauuaauucaguauccauuuguaaugauuuauuucaugaauagaucuuuaauuucuguaaugcuauuaauuuuauuuuauuuauuuauuuuuuugagacaaagucucacucugucgcccaggcugcaguacaguggcgugaucuuggcucacugcaaccuccaccucccaggcucaagcaauccuccugccucagccuccugaguagcugggauuagaggcacgcaccaccaccacccggcuaauuuuuguauuuuuaguagagacgggguuucaccauguuggccaggcuugucucgaacuccugaccuuaaaugauccacccaccucugccuccccaagugcugagauuacagucauaagccaccacacucagccaacccuguuuauuuuaaaucuuuucagagacaaaagugcuuaauaauuuaaaaauuaauacaaugaaaaauucacuaucaaaugucagaaaaagacaauaucauacaguacuuaagcuagguauucagauauuacauaaaucccagaguuacacacuuugaaugucuugguuuaaaugacaggcucuuaagaccuguuuaaaguuuucuuagggcagcacaaauuucugucuauuuuacagggacuuacuuuucuuuuuacuuccaaaaaacaaaagcuagaaacacguaucucugucucaauauaucuuauuccucauucuuccauaaacugucaccuauuucuaugguuuacguccaaacccuccuugcuuucaguauuuuuaauuaggaagcaucagcuaguuauguggcaaguacuuuuccuguucuuacaguauuuuucauagucaaccaaauacuauacgcaccuucuuccauuaacccucggaucugcucaucuuucucuuucaaaaggucugcaguuucacuacuauuuaaucuaguggcaaguucuucuuuuauguuuuugauuuccuaauaaaaaagaaaucugugaauaccguaaagaaugacuuucacucuaaguacaguucucauuucucccccauccaaagaagcuguccauaaucacauuugcaauaagaaucuguaaguuuuguucaguuaaucuacuaccuugguuaacuaagacuaagaaaacaacuuugaaaaugauauucaaaaccuaaauucagauauacaagcaaguguuaauaugaaaauauaaaugagaauaaauuaacuuuccuuuucauuuuuauuuuuauuuuuugagacagggucuuacucugucacccaggcuggaguagugguacaaugacgacucaccacagccucaaccucccaggcucaggugauccucccaccucagcuucccgaguaguugggaccacacgcauguaccaccauggccagcuaaucuuuguauuuuuuguagagaugaggucucgccauguugcccaggcuggucuugaacuccugggcucaagcgauccacccucuucggccuccugaguagcugugaccacaggcgcacaccagcaugaccagcuaacuuuauguauuuuuuaguagaggcagggucucaccauguuacccaggcugcucucuaacuccugggcucaagugauccgcccacuucagccucccagugugcugggauuauagacaugagccaccacacguggccaaaaaucuacaauuuaaauguuaauagaugauauccuuuucaccuuacuucucuuuuuuccaauaucaaaauacgaugaaugcacuccucaaaaaucuauaucucuauagaguuuaauuaauauuacuuuaaauuucaauuaccuuuuuagcagcaucucucucuuugcaggcuaguugaacuuucuuuucugcuucugcaauucuuugaguaaacucaucuuucaaggaagaaaugcuacugcuuucuucuuucacucugaacauuucacuaaauuuaaaauaauauuugagaaugaggauggugucuauauaucccaaagguauacaugaguucaauucucaaaaggaagauaacuuuucucugacauauaccuuauuaaaauagaacaguuuuaggccuauuaacuuuuaagaaaaaaaaaggaaauuucccuuguuaaauuuauuuuaaaacaccucaaagaaaaucuguuagaaagagaaaaugucaccaauaucugacauguaaaaauaagagaagaguaaauacaauguuucaauucugaaucuucuuguaucacauuuucccaaucagcuccuuauagcacaacuguguuauugauuaacacaguuuucuucaaauacguuuuaaaucucuaauacuaaaagacuaaaaacgaaaggaaagaguuuuccaguuuugcaaaaugacucucuucaauggcaaaggguaaagacaaucaaaagagaaaaguaaucuuuaggguuauaauugaaagcuauacaacuuucaauaaugauaaaauuacaaaacauuuuaauuucaaaaacauucuuaaauauguacaaaguauacagguuuccagaaaauguguaacauuauucacauuugcagaauacuuacucuuucagguuaucaaaagcuucuucuagaagugcuuuuuccuuacuaagagauaauaacugagccucccuuuuuuccagcuuuucauucagaaauucaacugucuggauaaggcgaauacauaaaagucagaacgcuuagcuuuaaaaaagaccauuuuuacaugcagguguaucacuguaacaaagaaaacagcuuuaucucauaaaaacaaucaagaacaguauuaggaacacagaagauccagaacaagaagaacucuuaggcagcugagaggagaguaaaaguaaauacaaccaaauagcuagugggaguguaaguugagaaaccccuugagaaaacaauuaggcaauaucuaguuggggaucuacauacucuuugauauagaaaauuucacuuuuagguauaccuuagaggagaaaauucuugcauaaaugcacuaggcgacauguauaagaauacuuuauguagcuuccugguaauagcaaaaaucuggaauaaucugcauacacaccaaaagaagaagggagauggaugcaaucaaaagaggucaaagaggaaauuuaaagccucuauauuuuagcuaggugguggauacacaagugucuauuuucuguauuauucuuuacccgaaacacauacccuuuuuaaaauaugacauauugcauuuaaaaaauaaaaguaggccaggcgcaguggcucaugccuguaaucccagcacuuugggaggcugagguggggggaucaccugaggucaggaauuugagagcagccuggccaacacggugaaaaccagucucuacugaaaauacaaaaauuagcugggcaugguggcaggcaccuguaaucccagcuacucaggaggcugaggcuggagaaucgcuugaacccaggagguggagguugcagugagccaagauucugcaaugaucuugcacuccagccugggugacaagagugaaacuccaucucaaaaaguaaaaauaaauaaauaaauaaaaguagaggccgggcaugguggcucaugccuguaaucccagcacuuugguaggcugaggagggcagaucacuugaggucaggaguucaagaccagccugaccaacacggugaaaccccaucucuacaaaaaauacaaaaauuagccaggcaugguagcauacgucuguagucccagcuacuugggaggcugaggcagaagaaucacuugaaccugggaggcagacuagccugggcaacagggcaagacuccgccucaaaaaauaaauaaauaaaauaaaauaaaaguagggcuggacacggguucaugcuuauaaucccagcacugugggaggccaagaugggaagaccgcuugagcccaggaguucaagaccagccuggcagcauagugagaccucaucucuacuaaaaaucaaaaaaauagccaggcguggugcgagccuauggucccagcuacuagagcggauuaggugggaggacugcuugagcccaggaggucaaggcugccgugagccaugaucgcaccacugcacaccagccugagcaacaaagagagacccugugagccgcgaucgcaccacugcacgcuagccuggacaauagagagagacccugucucauucauacauacauccauccacacuaaaaguaauuuuagaaaacccauaagaauuuuuaaaucuccauaauguaucaguauaaagcuaaacaaaaaguaaugcuuggaaugucuaauuccuuagguccuacucaaauggugauaaacuugaguauaaaaggaguaggaaggguuccuuuuuggacucaaaaaaauagucuuaccugaguuugguuuagaugaacuuagaaaucacuuaccuucuuaaauacacugaaauucaaaaauaucugauaguaauuagugcugguuucuaagaauucaaacuccuauuauauaucuuacaguauauagcuauuacuaauugaaauauuauugcacagcauuuuguuugugaauauuuaaccugauuaacagaaucuggcacuuuuuuaaaaaauuaaguaauucaauacauggcacuuacaggacauuucuucaagacauccuacaucucagaagucuauuaaagauaccagauccaacuaaauuuguauaucuaaaagucacaguaaaaaccaaaacuaggacuuaaugucaaagaauuuauaucacuuuccuuucacauguauuagguagaagcaaucugucccuccuaagcaaugcuuuuguuccuuagacauuucucuuucucguucaugugaaauauagcuaucaauaggagaucucaaaaauaacauaagcagaaaacaaacugaagcaauauaaggauauauacuccuuauauaugaaugaaaauacuaauaacagaaaagcaccaauaauuaaaaucuuaaauuaucauuuaauauuugcuacaaauaauguaaacauguaaaaacaaauucugauacaagaaaaaccauaacauuuaguuuuuuuggcacaucuaucugcaaaggaggugaagauacauguuaauguaagaaaauauuccuuucaaauugacauacuaauaagcauaacagaauuuugaagugauaaggacucaaaaauaaagauguaagaugaaaacuuucaugcuuaacuguauugaaguaucaacuuauucuaccauaauugccuuggagaaauuccaaauuauauuaauaauuguucaacuucaagguacuuaaugcuacacagaaauggcaaaaugcguauguuuuuaaaucuguauaaauuauuaugcaucaaugaaaguauuuuuuaaaacaaaugauuuaaucuccaaaaagcacaucuaaaaaucccuuccacuuacuagaguuaccuugcaaacaucuuccuucucagaaagugcuucuggcugacuuucagcagguucacacugcucagccaccuugucuaacacagucuguccuucauuuauugguguggaagaaaccaagauaucaggcuguucacaguuaacaggaguugcacuucguccacuuucuuccauuucugcuuccucaguggguauaacuaauguuucauuuacuucuucagauuuuccuucagcagauucaacuguuuuagacuuuggaguugaagaauuaacuauaauaggcacuaaagcauaucccuugccugacaauucaucaucugaauugauuucacuuacacuccggcuaucuaaugacuguacacuaaaugagucuauucuuucaaaagcaucagaugaacagcaacucucagugaguuuuuggaaaucaucuaaacgauuauauucaggacaagcagaugcagagagaagcugaaaagaugucugcaucaagugaagacuugauuuugaaucuguagucucuugucucgagcucgcugagcucucacuuauuacacuuucaugaucuaaaacuucaauaucacuggugguagaaguaccugaugaaaagguacuaacaggaggagaagguguauugcucugccugucuucauguuuuuguuccuuagguuccaaagcuauguccuuuguuucugcugugagagacugcguagacguauuagauauacuuuccauaguuguuuucacaucaauuacacuuucagauacuuucaaacuuacaguuggcaccuucauauccgauucuuuauuaacaguuucuucgugcuugccuucaguuuuaggugaugaaguaccugcugccagaguuuccccugaaacacacaaagaagagucuuuuacuugugauucaguuguuucaggaguucuugacuggccaaugugcaaggauucauguaagcugcuuuucacuucuucuucuggucguugugauuuugcuggagguuuugauaccacuggacucuucugaauggucuggacaucaguuggcgagagaaaggcacugaagaaauuuucagauucaucgaccacaguccuccgaacuggcuuugugauugcuuuaggagaggcuauugguggacucugagguucaguguuugauuucaacccccagguugaaguaucccauccuccacugacaggggaacuuauuccuuuaacaaaaaaguaaauauuaaaaaagaacacauauauguuacauuaauauuucaaucaucauuauaaaucaguauaaauauaaauuuagaaaaaauacccuaugaaauaccuguaauuugcaccugcuaaacuccuugcuuacuacaucauuaaguaguuuccaaguuaauacagggacuuacggaagaaaacugguguggguccaccugagaggaaggaggagcacagacaaaagacugggccuggccuggacuaccagaugcgaguauguuauuccuccccacaacaaauuaaggaaguaacaguauauguuuuauaacccacaguaaguccaagauaccuaugauucaucucauaauaacacgcuuuacuuaucaauaugaaauaaacuaauauggaacuaacugaauagguugggccaugugcagucacagaaaaaugacccuaccuauucagucaguuucauauuaauuuuuacuuguaauaucaguaauauaguuaugagcuagacaaagggcaacacucaaaaacugaacucaguggguauggagguucacaccuauaaucccaacacuagaagagucauuugaguccaggaguucaagacaagccugggcaacauagugagaccccugucccuacaaaaaaauuuuuuuaauuagcugggccugguggcccacauauguggucccagcuacucaggaggcugaggugggaagaucaucugagcccaggagguggaagcugcagugagccaugaucaaaccacugcacuucagccugggugacagaucgagaaccugucucgaaaacaaacaaaacaacaaaagccucaaaccaagauaauggugacaaauguucuuucccgaagaucauauuaaacugaugggaaugguaaguucuagagaacaaauucauuuucauccacuuaaucacaggcugauucucuaaaucccacucuccaagcccacucuaagaggaaguuuuguucucaaauucuaaauuaugucagaaauuacaaggucauuauaaauuucagaaauguguguuuuuuuaagaacuauugcucuuugacauagaggugguugacacuaggguuuuuaaaaaagcgcuacaaagaaaaugacuguuuucuuggggaaaaaguuaauuaucauaucagucauacaaauagcuacuacuaaaauccugauuuuuaaaaauggcauaaucaggaucuuaaaaaugguauauucguuaaaguauuuaaagcauuucuuuaaaaauguuuucuuuuucaaauuaaaauguggcugaacaaaauauucacaaaauauucacaauuagaaguugguggagagagcacaaguaacuaaaagcuucuaaaaacuaucaagccuuauaguagaaucuauccuuuaauaugacuucaggccaggcgcaguggcucacgcuuguaaucucagcacuuugggaggccgaggcgggcggaccaccugaggucaggaguucaagaccagccuggccaacaugguaaaacccugucucuacuaaaauuacaaaaauuaggcagguguggugacgcaaaccugcaaucccagcuacucgggagguugaggcacgagaaucacuugagcucaggagacagaaucugcagugaacagagauggcaccacugcacuccagccuggaugacagagugagacugugucucaaaaaaaaaaaaaacaaaaaaacaaauauauauauauguaaauauauguaugacuucaaaggcaguuaggaugaaaaguauguagaaaacuucaguuuggaggcauaguucuacacauucauuugcacaauauccaaaccagagaaaaucaaaauuaaauaugcaaaugaacaaccaagauuaugucugauuaauuuaaauacauucaaaagaugacaggaauuaauuuugccucuuggagaauacuuuauauaaucccaggguuauuugguauccaucuaaauuauaccauucugaagacuaugggcauuuuccgaaaacaaauauccuuauauguaaaaccuauauucuaucuuaucuaaaguuuaguaauucuaauuaacuggggcacauaugaaaaaacagaguuacuccagcaagguuauaugacaucuuguaaaaaguaaagaggaucaucacauacacacauggaccaaaauaucuuaaacugagguaccucaaauuuagguccugacuuuucaaugauguaaaauuaagaacagaaaccagaaaggaguagucaaguacaucucuuauccuuuuucacacaaagguucacaucccccaacaccagcaaaucuuuaccccacacaucaaaugcugaacuguuccuuagacuuaagagucaaaagcaacugaaugaagaucccugaaagauuaagcucaaugaaacugcaaagagagacuuggcuauucagaaauaaaaugugauaccauccagaaaucuugggucacacauuuuccggcuaauaccuccggcacauucuaauccuccuccgccgugugaccuagagcaaguuacuuggccauucugggccucauuuuccucuuauguaaaacacggauauaaaccaagcucucucugggaguuguucugaagaugagaaggccauaaaaaagcacauuacaggcucgugccuguaaucccagcacuuuaggaggccgagguggguggaucgccuuaagucaggaguuccaccagccuggccaacauagugaaaccccgucccuacuaaaaauacaaaaaguugccgggcgugguggugggcgccuguaaucccagcuacuagggaggcuggggaaggagaaucgcuagaaccugggaggcggagguugcagugagccgagaucgcgccacugcacuccagccugggcgacggagugagacuccgucucaacaacaacauaaaaccacauuacgcgcuaccaagcgcgaaauguucacugacuguuagcgauuguucuucccuucccugaugauuuacguacuucagaccuuggaucccaacagugcccgagacgcgaagcaauucgagguucagguucgggaagguugugcuuggaagcugcgucgagggagagcuugagggcaagaccaaccaaccaaguccccugucauccaaguccacaagccucgcacccaggaccaaagaaagacaagggggaaccuggaucuggguuuucccucaggaaaacagcaaagaccgacuuggaggcugaagcagcauuagggaacgggccggggagaaauuacuuccugaaaacucucucagcaaggaaggaccccucucuacaccacuuaaccugccugcaucaagagaacagcagccuccgggagccaggaaccccgcuccucucucucuuacccggcucuccauacggaauggucucggcccagaugcucggcuccucuuccuggauguccagaacccugucaauagacuucugggccugggacagggccugcuuagcgaagcuggagagcugggaggcguugaaccaacucaucgccccuccucagccggcaguggcggcggcagcaccaagcgggaaggccucaggccuggggaagggugcagaggaacggcuucgcuccccuuuuccacucggcugguucugucagcguguggccauuaccccgacagccucccgcgagcccgggauguuacccucggccguucccgcaca

SEQ ID NO: 14815 - RNA, 20904 nt, Homo sapiens
uaguaagacuuaguuuucaaaagcagcucauucuccauuaacacuguagucgccuuccauuucauuucacuuagauuggcaucugcacagcugccaaaauuuuucucuaagucagagaacacacuccuagguaaaccuucaaaaaagguauuucgaaggaggcagcuucucugcugcuagagaaggcauugccaccucccuucagacaggggauuuccgcuaguugcuuucugucauuucgucucuauucugcacucagucccuuguucugucuggagguuccuguuuuccuguacccaaccaagagccaaugaagaaguaaagaggagcaaacacgcccgcccacucccaauuuccuuugcucugcugucugccaaccgcaaagccgaccgagacggagccgcugucaacucuccaacucagcucagcugaucgguugccgccgccgccgccgccagauucuggaggcgaagaacgcaaagcugagaacauggacguuaauaucgccccacuccgcgccugggacgauuucuucccggguuccgaucgcuuugcccggccggacuucagggacauuuccaaauggaacaaccgcguagugagcaaccugcucuauuaccagaccaacuaccuggugguggcugccaugaugauuuccauugugggguaaguggggucccccuacccgggacaccgauccggggcgagcacggaggggccucggggugcaagaucccgggauguagagacgcucucugaccacgcucagcgccugcccuggcaauucugcaagcggccaagccaguggaaacuuguuugcagggcgaggccgcaguaaccuggggccccauuuucugcaccaagggcugagacuugaggggggcccuaggggaaagaggacggggaaaauuugccagccgcagggaagaaaaaugagaguucccccaccccccugcccccgcccgcgugccaggaucgggcucuugcuggaaagauauuuguagcgcccucgucuuuuaaaaauaagaagaaaaaggaaagugguguaacccuacccuggagcuggcuggggcggcaggguguggacccgggcuaguguaaaaagggcaaccaaguggcgacgcacuuugcugcuuucucugccuaaugccugccacacuguacaguaaagcugagcuugggaucaaaagggggggugucuccugguggcgcaucucccauugugggguaaaggcugccaugacugugggaagauggccuucuggcauuuucuuccagcaguggccaggcguggucacuuucucugucuucgcuuccuagccugagguuucaauguaucagaaggccuuuucaauaccugauacuuaacaaaguauccuguguugagacugcauguacaccugcuuuccuagaaaccaccuuuccuucuaguucacccuuuaagaaaugcuucucucgcuuaugcaggauggguggugauauucucaaucuugcugauuaucuccuacacaucuuuaaagaaaaagccacccucagacuuuauaaaggacucacuugcacuuaaaugucugacauuucuauuucagggcagacguagagggaagaagcagcaagcuggcuugggagaaaagggagaaauuugcacuugaagggugugggaaagggugaacaggguggcuucuucaguuggcucgcaguuaauuggcuuauacauugagccaccucucugugccuggccccaugccaagcuccaagcacaccaagaugaaucagacuugaauucuggcccaggggcuccuggcaguuguugagaagcuaaaggagcaaacacacagcacagaggagagggggagacuucacaguuuccgaguaugguucacagcaaucacccccaugcagagguggaagcccacaugugggacucuauacacaaucgcacagauccuucuucugcauugcuuaaggaauucuuaaggaauugcauucugggaauggcuugguguauagagggcacaggcucugaguggacucggaacuaguguggcagccaagguacaaguuagucagggcaggguggggcaggcccaaggccugaggcagcugccuucugaaccuucccucagcucugugcuucaggcugcuuuccuggaacacuaaaaaauuucuuuuuuuuuuuuuuuuuugagacugagccucguucugucgcccaggcuggagugcaguggcgugaucucgucucacuacaaccuuugccucccggauucaaguaauucucgugccucagccuccagaguagcugggauuacaggcacguaccaccaugccuagcuaauuuuuguauuuuuaguagagacaagguuucaccauguuggccaggugaucugcccgccucagccucccaaagugcugggauuacaggcgugagccucugugccuggccaaaaauuucuuuuuaaaaauuuuuauuauuuauuuacuuuugagacaaggucuuguucuguugcccaggcuggagugcaguauugugaucacagcucacuacagccucaaccuccugggcucaagcaauccaccuaccucagucucccaagugacugggaccccaggugcgugccacaaagccuggcuaauuuuuuuuagagauggggucucacuauguugcccaggcuggucuugacuucugggcucaagccauccuuccaccuuggcucccaaagcacugagauugcaggcgggggcuacugugccuggccaaaaaagucuuuaaaacaaaauaaguaguaaauagguuugcaucaauuuuuguuuuuuucuuucucuuugcaaagaagcaggagggcaucuuaucuggugaucuaguuauggagguauuuucuugagguaacuuagauguggggcaaaguuugacacagaccaauaauuaaaaaaaaaaaaaagucuauuuucuucagacaugugugcugcccagaccaggcacaagcucagacagccuugcugcuuuugauagaauccauuuuucacugugaaggccaggggccagcccuuugacuaaauauagcuccgucaguauugugccuuaggccacuaacucagguaguuuagggguguuggcccuccucauuuuccuuucaaauaagaguuguugguugucaaugaaaauuuugaagugaaaaagugaaaaguagccaugaaguuuuuaaaacuuauccuuauuuuuaaaaacuuacaaaagauacaggcuaguaguaaagguugauuugaaaauuauguggauaaaaugugaaauuuccuucauacuucaguaaaaguuugguauauaaccccuaacuguuuucuaugcaacuauaagcacagucaguaguuuuuuccaccaguuguucucuuuucuuucuuuaucauuuaauaauauaaauauuuauugagugcucugugugucagguaccuugcaaaguauuuuaccugcauuaugucauagaacccaauuuuaaaaaacuguuacuuuuuuuuuaucauuaaaccugaggcucagagagguuaaaugauuuacucaaagucacaaacuuaggcuugugcucuuaacuacuguucugucuuacuaugagucacaaggaagaaaccaaacaucuucagaguuagggagcguccuugauuccagaacacuucucauucuaaagagaacuauccucuuucggugaugcuaguagauggguaggucagagcagugcuggcagcuguucaucuggauccuccacagacuucucucuaguuucucagaauaucuugguagaguauaugugaaaaugugaccuggauaaaagaguguucaacaaugguuccauccccugcuggugaggagagccucaagggcauuguaggagugcucuagccucagcucuccaauguuggaaacuggcuuagaugaggauagagagggccuccucuucaagauuucaggaagggugagggaagaacauagcaaauacuaucuagauccagaaacacuggaaaaaacugcccauaccaagacggagauuaagagggauuaggauagagauaaaucuguguuuaaacuucugaucagaagagauugaauuauuuaaaaggaauagcaugaauaacaggcuaggaaacuugcguuuugcuggaaaugccuuuggauccuuuacaucaagaaggaaaagugucuaagaucgaaguugccauagcuuaccuucugcauccuugaugugagacguuuugggauuaagauauucuuuucacaucacacacaacaauagaagucucuaccuugaucuucaaagugaaaaacaaaggcaacaccuaaugacacuugcaauuuaaguacuaagcgugugauacauucuaguuguggaugaaaacuucuuugugcuuaauggaaugccaaaugauuugagcuggagaacucuguucagugugugagccauggaacagcagcaucuuucgccugagagcuugucagaagugaagcaucucaggccccauuucagaccuacuggguuagaaucuacauuuuaacaaaagucucagaugauucauagguacauuaaaaucugagaggcacuggauuggucuggcucaaaagaaaauuuaaauaaauauaccuauaugcccaggugucaccuuccgugauucaaaauguauaguucuuggcaggguccaggcaucuguuguuuuuuucuuuuucucuaacuuccuaagugauugugauuauacaccccuaggagaaauacugauccucuugaaccccguaacuucugaaauguaaaagcucgaggucacaggcuaauuggaacuaaagcugcuaauaauaggaagugaaauauuuuuuccauuaagccauauugcaaauuuucuaaagcucuugauuaaccaaauucaacugcaucccugacucuuacaauauuugcaaugcuauugcugucuuauucugaaaaguucuuuccuggauggguauaguggcucacaccuguaaucccaacacuucgggaggcagagaugggaggauugcucaaggccaggaguuuaagacuagccugggcaacauagugaaacccugucuaaaaaaaaaaaaaaaaaaaauuauuuucugccauuagaacucauauuuucugguauggccucagaaucaccaaccacacacagaauuugcaacauauaaaaaugccucugcugcuucuccagcaagagagcugcauguauucuuauguauauacauuugugccucccccuuuagauagaaccauguagcugcugaaggaaugagcccaugauuucucagcugaaguaacuccucaccauguggccugaucauuuggccuauggagauguugcaggaggguggaauugacagcugccacuuuaugcuuucaguuacucaagaugguaaggaguuucuagaaggcugguaauuauaaguuugaaaacagcauuaauguaaucuuuucaaaaugaacguggcuugguggcucuguaauauguucuaggccuguggcucccagcaucugguauuaugaaauguucguauuguuuguaccuuuaaaugcuguaaagaugaagaaccaaguuuccaguugguagaggaaaaaaagcguaaggcaacccugggaggcucuggaucagaaucuauugaaaugauugcagauagaaugaguugcagucuguuuauacuaaagcaaguggaaauguuuuugagauuagucagcuucaacaccaguucuacaacauuacucuuauuuguguugcuucauucauucaauuaacaaagaguaugaagcacuuaccaacuucucagacacugcuaggagauagugaagaauaggacagcugugauuccugccuucacggaaaggcagcaagaccacacugaacacaugauaacuaauuuguauacaaguauagcaaguguacagaaauacacaccuacauaaacacauccuucucaaccugacuuaccugaucuccccuguacauuauuacuccaaauuccaaaucucucagguguugggaauaggggaggcauugaguauguagacaggaaaaagguuuuuuuaaauuuuacuauccuaacccacagcucagauccuucuauuccauugaacaaauacugagcaccuaccaugugguagacacugucuaggcccugaggauacagucaggaguacaacuccaccagccuucccaaauccucccagaauucuccugcccuucgaugcccauuuauuugcauuugaggcuggcaccugucuuccucugauggcuuauguguuucuucugaauacagaacuuuaagaggucugucaacacacaguaacauuuuaaucucaaaaucuuuaucuaggcuggacaugauggcucacgccugugaucccagcccuuugggaggccgaggcggguagaucaccuaagcucaggaguuuaagaccagcccgggcaacauggcgaaaccccaucucuaccaaaaauagaaaaaauuagccuggcgugguggcaugcaucuguggucccagcuacuugggaggcugaggugggaggaucuuuugagcgugggaggcggagguugcaaugagccaagaacgcacgccacugcacuacagccuggguaacagagugagacgccguguaaaaaauaaauaaguaaauauaaaucuuuaauaaggauugcuuuucauuaaauaaccucugacaguguauguguguauauguguguguauauacauacauauauauauauuuugagacaggguuucacucuauugcccaggcuggaguaugguggcgcagucauggcucacuacagccucuaccucccugggcucaggugauccuccugccucagcaucuuaaguagcugggacuauaggcaugugccaccagccuggcuaauuguuguauuuuuuuuuguagagaaggguuuuugccauguugcccaggcugguuucgaacuccugggcucaagcaauccuccugccuuggucuccgaaagugcugggaugacaggcgagagguauggcuggcacaccuuugauacuauuuauguaacuuuguuuaucugaacuucucuccccucuccguccagcuuuuuuuuuuuuuuuuuuuucaauguugccugcuacuuuuggccuuugguugguaguuucuguuuccuuucccuagguaaggauuuacaaugauucuagguaagugugcaaauaaaugaguguauuuuggauuccuggcccccugucuuagaaaggagaagcucuccaucagcuuagggacagagagcucuguacaggaaauccaguucaaaaaggucaagacccauucuugaccuacccacuuaauaucuaauuaagcaucaauauuggaaauuuuguauuuuuuauuuuuuggacaaaugaauucuauccuuaucacucagcuucagaaaacuuaacccuuaauaccauccucugucucuugaaaugagcguggcuuccuguuucugagaaugccuucacccuuaauaccauccucugucucuugaaaugagcguggcuuccuguuucugagaaugccuucaagcccuguaauuuuaggcaaaaccuucaggcuaacaacuucagguuugcaagcauucaucauugauauaugauaggauuuccuggccuuccuucucguuaugcaauuugcuaaaggagacaccuggaaggcagaaagcccugcuucuucuaaucugcuucauaucucauuggugcagcuucuccuugucucagaggaaaaagaaugcagaaauuggggguuagugagggguaaauagacaggaaacuugugagaaggaagucuguguuaccaagcucguuagcauuuguccagccccugucuucucuccacagcucuguaagaauuugccaugugacaguucucaguagcuuuuguuuguuuuguuuuguuaagacagagucucucugcaucgcccaagcuggaugccauggcaggaucuuggcucacuacaaccucugccucccagguucaagcgauucuccugccuuagccuccaaguagcugggauuacaggcacgcacaacuaugccuggcuaauuuuuguauuuuuaagugauuacaggcacacacaauuaugccuggcuaauuuuuguauuuuuaaguagagacgggguuucaccauguuggccaggcuggugucgaacuccuagccucaaguuauccccccaccucagccucccaaagugcugggauuacaggugugagccacuguacccagccuuuuuuuuuuuuuuuuaauuuucuaaaaucauucaagaagaacaguuuguaaacaaauaucuuuccacuucuguuccccaaaaaguauugguuguuaagaguaaccauggguugcuaauugugaaagcagugaugagcauacaugaagauucauuauacauuauucucucuaccuauguauauguuaguuuuccauaaugaaaaguuaaaaaggguuuuaugaagucuaaucagagcuuuguacacaacuauuauuugaagcuccgucacugugggaagcgucagauuuaugguuucuaauccgaguccaaccuguuguuuauuaaaaacaaaagaaaaucuggagguuccuaaggcaugucuuaguaugaacacuuuuaacaugccaacuguuaaaaagacaaugguugguuuggaugcgaguguuuaauuugugccaaauuacacaggauacaguaaauauuuagggaauggcaagaauacaauaaauccucuaggccuuccuaauucaguugguuaggaaaaucucacuaugaccuuucuguaacaaaagagacaggcuccuguucaguuuuaccuacuguacagucuccuuuauuccaugauccuuaggccaaggagacacuguucucauuuacucaagacgaauuuguguccaaagcccacauuuaugccuauagucaaaaauagcucuccacuuugggaggcugaggcaggcagaucacuugaggucaggaguucgagaccagccuggccaacauggugaaacaucgucucuacuaaaaauguaaaaauuagcugggugugguggcgcaugcuuuaaucccagcuacuggagaggcugaggcaggagaauuguuugaaccagggagucagagguugcagcgagccaagauugugucacugcacuucagccugccgacagagggagauucugucucaaaaaaaaaaaaaaaagaaaagaaaagaaaaaaauuaaaaauuagccaggcaagcuggcacucaccuguagucuguaguuucagcuacucagaaggcugaggaaggucacuugagugugggagaaagaggcugcagugagcuaugaccaugccaucauacuccagcuugagugacagaggaagaaccuuucuugaggaaagaaaagaaaaggcauauggagcugugcucuggucagagagacugaggaaaggcuggcugagcugagacuugaaggaggguggagugaggccugugugcaaaguauccucucugccugauucaccucacccugagauggcaaaaggcaaggugaguucugggguagauagaaacccugaguggaugggggugcaaucaggagauggugugacaaaccuggcagguaggccagcugcuagcccugagaguucccucaugcuaauuacuaaggcacuucuuccucuccuagcaguuacagccaaagccaaauuuuggccuuggcuuguggagugugugaccuggauuccaggccccacuuacccccucagccaggcaccaacuccacaccuauauacaguggcccuggcugcagaggcaggcaggggccagacccugcgaagccuuguagaauguuuaaagaauucuguuuuuaguuuaagaacaaugaaaagaaaaugguuggguggguucauauuugcagugaucccucuggcugauuaaggaccacagagaaacaucgccaauuuagagaaguccaccgugaguauauuguuccccacuuuuucggugagucagccuuccucagaaaccacacuucaaaaauagcuuuuucggcuagaaaauuggaacucagugcaaagcugccuguacuccucaggaaauauuuugcugccucuuuggugguucuuuuuggccuugcagccugacaggagucaccaaauguggccuugaguugauccgaggauuucuguuauggcaaacuuuuauugccaacuuugcaauugguggccuuggacaaauuuauuaacuuguauauucuuuagcuugcuuacguguaaaaugagguggguuagcaagauccuuccuagcucuaaaauuuugugagauuuuuuuuuccccuuucaguaacuugugguaaaacuauagacauagcuacugaaucacguugggaaguuuaggaccuguauccacacccacuaauagccaccuuguuucagagagaaaugagagugcagagggauuuuccaggaugauccuugguuauaguagguuacuuagagugugggggaaauccuuaaagccgguuaacaugacagaauggguucuacugugaguugcugccacaacuggcacccuuguuuucuuguuucucuccuggaucccuuuggauauguuucuucucugggccucaguuuaguuaucuguauaauuggacuagacugauucaucuuugaagacugcuacaaaauuucugugaugggauucuaaaccuuuuuauaaccauaaaugacugcucuagaauguguaacuauuauagggaaagauuuauuaauuauuuauuggaauuggguaauacauguucauauuuuaaauauauauaauuaaaauauauacaaacauauguauuaauauauuuuuaauuucacaauagaaaaacauaacgguuuuugaguugcaaaacuagguccugcuguuucucccuucuuucucaccaucccucguucuuuuuuuuuuuuuugagacggagucuggcucugucacccacgcuggaguggcacaaucucagcucacuucaaccuccaccucccagguucaagugauucucgugucucagccuccugaacagcugggauuacaggcaugcgccaccacgcccagcuaauuuuuauguuuuuaguagagaugggguuucgccauguuggccaggcuggucucaaacuccuagcuucagcugauccacccaccucagccucccaaaguucugggauuacaguuaugauccaccgcacccagcccucuuucuuacucuaggacuaucaguaagugaaacuccacccagcagaccacagaggcagcugucuacaugaaagauggguggcauguuuauggaaaguuuuguccuaaaagucuuugggguuugucgugauugcugugauaaacagcccaacuguugacuaaaaagcaucucaggcaagaacugguucccagauuucugagaauuucuguuaaucuguagagggugugugugugugugucugucugucugucugucugucuuuuguuccaaauacagguaagugccagggcauuggagugguauacauuuuaucagauacagaagaaaauaauuucugcucagaguaacuucguuaguuuuuuuccagcuuggaaacuugcuugcuuucuaauuauagacuguuguugggcagguuaugaacuaaaaccaguucuauagaacuucaggcucuguucuuuucucuuggacaugagcaaccagaacaggugaaacaaauuuggaauugcuugaguuaggccuggauuuuucauuguuccuuguccuggacuuuaggcacucaaccuaaauauguauuuuacuugucuagaggaaaauaaaaacagcuugacaugaauuuuguuauaugcuucacuucaugaauuauuauuuuaauaaguauuccagaaugaacugaguaggagcccuuugaugcuuugcugccagccaacccacuccuacuugcaggguaugcaaaggaauuuccuugaauuucaauccuccauuugaguucuuuguguugauuugaucuuuguuuugcuuugcuuuuuuuuuuuuuuuuuuuuuuuugagacggaaucucgcucugucacccaggcuggagugcaguggcacaaucucggcucacugcagccuccgccucccggguucaagcaauucuccugccucagccucccaaguaguugggauuacaggcacaugccaccaagccaggcuuaguuuuguacuuuuaguagagacgggguuucaccauguugaccaggauggucuugaucuccugaccuugugauccaccugccucagccucccaaagugcugggauuacaggugugagccacuguaccuggcgaucuuuguuuuucuuuacggcucagaagaaacauuuggguagguuauaggucaaagucaaggcuuuguaaaggguuuuuuacauucaggagccuuuccccaauuucauuuguucauuuuuaaauaccaauuuuuuuuauucaucaaggaauacauggccauugaaaaaaauaugaaaauaaaaauaagcaaauggaaauaaacuccccuuauccuacuauacuguagucuuugguauaauuuuucaguuucucuaaguaucuuuuuauuuuuuaauugagacaggaucucacucuguuacccaggcuagaguauaguggcaccaucacagcucccugcagccuugaccucugagcucagaugauccuccuaccucagcuuuccaaguaguggggacuauaggugugugcugccacaccuggcuaauuuuugugggguguuuuuuuuuuuuuuuggagagaugggguuucgccauguugccuaggauggccucaaacuccugggcucaagcgaugcauccgccaccucggcuucccagagugcugggauuacagacaugagcuaccacacuggcuuagaaucuuuugugaugcugggaauuagauaauauuaaucuauaagaguuucaaggccucuucauucacucuccacucucuacaaccugcugaaggggauugugguuuugauucaucagauucuuuccuuccucaggcguauaagggaauuuuuucuuucccagaccaauuccgggguugucucagaagacagggcauaauccagauaaaauaaaacagaaagaaagugcagagaggccaaguagacccagguaacacagaaccaagagggaggggaagagggcagagagaauagcacaugugcuggguauuggggaagguuggggcacuggggugcuauagacuggcacaagaggaucuggaggaugagcagaaaaccaggauuuggauuggagaaggaacagcuucgcugugguucaugaacugaaauuccauuaauguuguuggcgagaugggacaaguagagauggacuuuugugguuggucugugccaagcggcgguuguggguuggagagcagcugcuuuuauguuuuuguauuuccuuuuuuauauauucauuuuauuucugauuaugaaauaauauacuaauuauagaaauuucuauuucuuuuuuuuuuggaaacagagucucacucugucacccaggcuggagugcaguggcgcaaucucggcucacugcacccucugccucccggguucaagugauucuccugccucagccuaccaaguaacugggacuacaggugccugccaccauaccuggcuuuuuuuuuuuuuuuuuuuuugagacauaguuuugcucuuguugcccaggcuggagugcaauggcaccaucucggcucacuacaaccuccgccucccagguucaagcaauucuccugccucagccuccgaguagcugagauuacaggcucccgccaccgagcccaacuaauuuuuuguauuuuuaguagagacaggguuuuaccauguaggccaggcuggucuugaacuccugaccucaggugaucugcccgccucagccucccaaagugcugggauuacagacaugagccaccaugcccagcccaggcccagcuaauuuuuguauuuuuaguagaggugggguuucaccacguuggccaggcuggucucaaacuccugacuucaaaagauccacccaccuuggcccccacaaagugcugggauuacaggcuugagccacuguacucagccuagaaacuucuacuucugagcuaucuaacuuauaugauaaaucuaccuaacagacaaugcauuauguauuacaauugcuuuuacccacucaauauauaaugucuucccauauuauuaaaugcacuucaauguuuuaaaaauagcuguguauacaauaccacagcuauugguauuguuggccauauaggucguuucugaaaguuuuuaaucauaaauaccacuaauaucaauacuguuacaacucaaucuuugcguuuuuguuuaauuccuuagacuauauucugaggaggggauuuauuggcuugaaggauacaaguauuugcaaggauuuugaaugaaauuagcaacuuauuauuguagaguuuaguuuuaaauuauguacaacuggcugggugcgguggcucaugccuguaauagcacuuugggaggcugaggggcggggggggugggggguggaucacaugaggucaggaguucgagaccagccuggccaacauggugaaaccccgucuuuacuaaaaauacaaaaauuagcugggcauguuggcgggugccuguaaucccagcuaguagggaggcugaggcaggagaauugcuugaaccugggaggcagagguugcagugagccgagaucgcgccauuguacuccagccugggcaaugagugaaacuccaucucaaaaaaacaaacaaaaaaaaauuauaugcaacuacucuuaccacuguuuagcuuugugcaucuuaauagaaauuuuuagcuuuuucaaagcaguuugacauugauuuuaucccuuaauuucacccauucaggugugaaaagcuuuuacucuuaauuuuaaaauguucaaaauuccuuuuauguuucaguaggcagaaacagagcuaaaauuuaaagggauuuuugaaaaagaauuguauuuauccugaauacgaaucccaauaugagcaugaguucuucaucucuuccauuucagagaaaguaagcucuuggcaucacccucccuuauccugucuucccccuucccucauuucaaaucagcaauguuacuauucagggcaugaggagaacacacuaucgucuguguccuucccaaguaaaguccucauuagccucuaggguaaaaaguuaaguaacucauuguaccagcccaccacagacgucuuguuaaggguuuuguauacacaguggauuggggugggcgacuauaaugcccaaaacuuugucuaaauuucuucuucuuauuaucauuauugagacagaguuuugcucuuguugcccaggcuggagugcaauggcgugaucucagcucacugcaaccuccaccuucugaguucaagugauucuccugccucagccucccaaguagcugggauuacaggcauguaccaccacgcccagcuaauuuuuguauuuuuaguagagaugaggugccaccauguuggccaggcuggccuugaacucuugaccucaggugauccacccaccuaggccucccaaagugcuaggauuacaggugugugccaccaugccuggcauaaauuucuucuacauaauguguuuccuccauuaucaauaguaguguaauugcuauuacauacuaaacauuuggcuuauauaagaaugaaucuggaacugugugcuugaaaaucugcauugguaacucaucuccuaaugauacuuugggcauuuuaaaacacuuauaaugaacucucuaugugaggagucauaaacucaaaugccuccauggggcaggcagguuauguaagagagcgauucaggccagcuauuagaaaaacaaugauuagacugggcaugguguggcucaugccuguaauccuagcacuuugggaggccgagcugggcagaucacuugacgccaggaguucaagaccagccuggccaacauggcaaaaucccaccuguacugaaaauacaaaaaauuagcugggcgugguggcauguaccuguaaucccaguuacucgggaggcugaggcacaagaauugcuugaacccaggaggcagagguugcagugagccaagauugcgccacugcacuccagccugggugacagagcaagacucugucucaaauaaaaaaaaaaaaaaaagaaaaacagugauuaauagcaccucacuuugggccuauguguccaugaugcaguagagagcaguguggacuggagcucaauggagacuguuuauucugucugaaugagaaggcacucaagccagcuguugacaugugggaaagugggccuagcacuguuauuuucuuguuccaggagaacaagaaaucccaaguuuucuggauuuuuuuuuaacacauggguuucaaguaaaaguuuuuuaaaacacuguacaggccaaacaaaaaugugacuguauacuggaucuagcccauggaggccauuauguggccuguauucuacauucguccaucaugagcuucucugaggauuuaaauaaaccuuuagagcuaagaaaacacaaccuacuguguacuagagcccaggauguaaggaagcuaaacauaguaccuucaaaagaaguuuuagucuucaaaauuguggaccucuaacgagauacuuugaugggaacugccugggugugaucucagcuccaccuuuuuuuuuuuuuuuuuuuuuaaugagauaaggucucacucugucacccagccaggagugcagugggggaaucuuggcucacuggagacucaaccucccagguucaagugauccucccaccucagccuccugaguagcugggaacacaggugugugccaccacaccuggcuaauuuucauauuuuuguagagauggguuuugccauguugccuggguuggucuugaaccccugggcucaagugauccucccaccuuggccucugaaagugcugggauuauaggugugaacuaccauuccuggccuuccccaccauuuucuaaccucugugccuuagcuucuucauuugagaaaugaacuaauaguaucuccuuuauaagguuaugagaaaucaaaugagacaauuuagauaaaguauuaaaguauuaguaaguucucaauaauuguuuuuacuccucuuucuccuuuugcuacuucuauugcugaacuagucaccccucauuuuuucuuccucauauuucagguuucugagucccuucaacaugauccugggaggaaucgugguggugcugguguucacaggguuugugugggcagcccacaauaaagacguccuucgccggaugaagaagcgcuaccccacgacguucguuaugguggucauguuggcgagcuauuuccuuaucuccauguuuggaggagucauggucuuuguguuuggcauuacuuuuccuuugcuguguaagugaacuugaguuuuuucuuccaucaucaaaaaaauguagaagcaauuauccaacgggaauuccauaacccauuucuuauauguguuggcaugucagcaaaagugucagaauuuucuaaaacagcuuucuacuuguuauccaacuagacccagauaacacagaacugaggucaagaacuaugaggucaaggccuuauaguucauuaauuccacaaauauuuguuggggcaucugcuaugugucauacauucuuuuguuguuguugagauggggucuacucugucacccacgcugugguguuaucucggcuuacugcaaccucugccuccugaauagcugggaccacaggugcacacccagcuaauuuuuuguguuuuggguagagaccgggguuuuacuauguugcccaggcugaucucggacucccaagcuugagugaucuagcuuccuuggacuccccaagugcugggauuacaggcgugagccacuucgcccagcugugugccauacauucuuauggggacacaacaguaaacagaacaaagacaaaucccaggucauacagcaggaauguggcauaaccugcacuagacuccagauuugucuaauaagagagucuauucucaauuuuuaagugccauuccuauuguccugacacaggaaugaauguauuuauuauuuggaaguagacuauuuauucuccacuugcucaggagaucauaacuaguguuaaaaguuugguaagucuauaggaauaauuggcucagaauauagguacuaaauacucagauucuggugaagagaucuagauauucucuaaguuuuacaugaauuauuuacuaagacuccaaacacuugaagccugaaauagacaagaaauaaaaucccagccuaaucagcagaaaucugauuaaaauucuaguauauuaagugacaggcacaucccuuuaacuuucaauaacauuugacaugugcacuuauuccacuaaaugaaauuauuugcuuguuuagggcuuuguuagauuaaguccagaauauuuauggauacaucccauacccuauuggauaaaauaucugagccaacaaauucacacauuuuuggaauuuucuucagguuuucuguaggugcuuaacgcuuaguauuucaaugauacuguuuaaucaaacagcuugcuaauuuuaauaccuuuccacaucagaaccugagacaggccaguguaacgaaauguaucagagguagacaguuaagaguccugauuucuauucuuagaccugcuggaaaccagcaugugauuuggaccagucauccuauaugggcuguaguucacucaucucuaaaguaaggagauuagauaagugauucccaaacggauaauugugacaagcauucaggauacuuuuuaaaaauauacauuucccagccacaucuuuauuuugugggucaacagugguacccaaggauguuagguuuuuagaaagcucgucaacuauuucuaacggguggucuagguugagauccuccagaugaauccacaucaggguuuuucaaaauaaggguccaagauccaccuacaucagaaucaucuggagugauuauuaaaauaaugaauucuggagccuucccucaguuguaacagucugaauuuggggugauggagaccaggaauuugccuauuuaacaggcucuccaggugauuugaauguacauggaaguuguaaaaccacugguauagaucauauggagagaggguuaccuguuuaaaauacagauucccaggccugucucuuuaaggcucagguggaggagguccaggaaaggggauagggaaucugugguaaaauaaucaagcaaguuuggggaacgguaggcuauagaaacucuguaaagcccuuagauuuuuacaucuagaauucuauacccaacacuuuggguaaagccuccgggaggcacuuuaaaaguggacuuuacucacgugcuccugcagggaacaagauacagauaaucccgaaucgagcaagaguucuuuucuggaaagccucggguaaguugauuuuuaaguaggauggaaucccguugauucacucugaauuucaggacauuuaaguagcaucugcaaggugaugauaucagugugugaaggaaaggguguggcuuccagauaaugguccuuccuguugaauacagcauuuuccuuuaaugcagaaaaaaaacuauguaugacuugauggagagcuuuacauaaaguccaaggagccauuugaaagcuugcaucaauucgagaagcagacuggacuguggcuaacuaaggcaguuuacuaauagugugaagagagggaguguaauauugauauggcaaaagagaauuguugcuuugguguuaaccaggugucccuucucugcagugauguuuauccaugcaucguugagacuucggaaccucaagaacaaacuggagaauaaaauggaaggaauagguuugaagaggacaccgaugggcauuguccuggaugcccuagaacagcaggaagaaggcaucaacagacucacugacuauaucagcaaagugaaggaauaaacauaacuuaccugagcuaggguugcagcagaaauugaguugcagcuugcccuuguccagaccuauguucugcuugcguuuuugaaacaggaggugcacguaccacccaauuaucuauggcagcaugcauguauaggccgaacuauuaucagcucugauguuucagagagaagaccucagaaaccgaaagaaaaccaccacccuccuauugugucugaaguuucacguguguuuaugaaaucuaaugggaaauggaucacacgauuucuuuaagggaauuaaaaaaaauaaaagaauuacggcuuuuacagcaacaauacgauuaucuuauaggaaaaaaaaaaucauuguaaaguaucaagacaauacgaguaaaugaaaaggcuguuaaaguagaugacaucauguguuagccuguuccuaauccccuagaauuguaaugugugggauauaaauuaguuuuuauuauucucuuaaaaaucaaagaugaucucuaucacuuugccaccuguuugaugugcaguggaaacugguuaagccaguuguucauacuuccuuuacaaauauaaagauagcuguuuaggauauuuuguuacauuuuuguaaauuuuugaaaugcuaguaauguguuuucaccagcaaguauuuguugcaaacuuaaugucauuuuccuuaagaugguuacagcuauguaaccuguauuauucuggacggacuuauuaaaauacaaacagacaaaaaauaaaacaaaacuugaguucuauuuaccuugcacauuuuuuguuguuacagugaaaaaaaugguccaagaaaauguuugccauu

SEQ ID NO: 14816 - RNA, 520 nt, Homo sapiens
ggaaaguuucaugaugguaucuauagucaagacgaacauguagcauggugccuauguagacaauauaagagcuuccaauuuuccuucagauauuuuuaauauuaaauauauuuuagugacagagugccaacuucuuucaucaggaaaccuuauucaggaggguuuuuaaaaaguguuuaaaugucaaaugugaauuggugaugggugauggaggguucagagaggagugaucgucagaugugugaauggacgguuuaggugaaaauaaucaacugcauaguucccaugcacgcugggcaaugagaauccuuggaaacauuggugaugcuaucaguuuuauagcuuuauuucuuaaggggguagggaaaauuaguucccauucuuucaacccccuuaacuguauagcucuuuuccuagaauagugacgcaaaucugcaugaacagcuaauuguaccauaguguucauugauacaaucauagcauugucuauuuuucucuucauauuuauaugggggggagg

SEQ ID NO: 14817 - RNA, 2996 nt, Homo sapiens
aaaauucagauccagccauguuacccucuauguuaguuggaguuuuaccgagaaauagaaccaaaaggauguauauguauacauauguaugaaaaaagauuuauuuugaggaauuggcccaugagauuacggagacugagaaauuccccaaucugccauuuucaagcuggugacccgggaaaggcaagguuguaauucggccugagccugaaggccugagaaccggagaagcagaugguguaaaucccauucugagggcacgagaugacaagaugagaugcuccagcuacaacccugaggcaggaaagaagggaugauuuccuccuuccuuggcuuuugguucuguuuagacccucagcugaugggaugaagcccaucuacauugaagagggcaaccuacuuuaccgaguccacugauuugaaugcuaaccccauccagaaauaauguuuaaucugggcaccuuguggcacucaagaugacauguaaaacuaaccaucacacucccccaaacuaaaucccccaaacuaaagccaaaagaaggaacuuuuggcuuccuucugccaauaagggaaguaccaauacuuggcuaucauuucaaggccugccaguaucucucuucugccacuuugggguaaucgccaaccaugaacacccuugccuguguucucaccuccccauacuggucugugagucuugcauugaaucaugcucucucucaauuuggguacuucuuuccugagcuuuccugucuucuugcuuuacccagcuaaguacccuauucaucuaucugaucucaacuuaaaagccacuuucccagggacuucucugagcaccugccccauagaccagcuuagauccacuuuucauauguccucauagcucucucuacuaauuauccuccucuuucuuuuucaaauguuccucaaacauagaauuaauuauucuuugcccuucuccuggcauuaucucugugaaaguagaggcugcugauuucuacaucugcagcaccucaaaugaugccuagcacauaguagggcucacuaaauauucaaaaaaugaaugguugucccgacuacggugucaacaauucaggaacuuucucuagugagauacauugaaacaucuuggauagaggaauaaaaugaaguuguauuucacuggacuuaauuuauagacuuuggauaagacaauguucauguuacuauauuaggaaugaaaacaaacugacaagacuuucuuuuagcacauuacuauaauccccacuaaucaagguacaccaacaaguugaacauuucaaagacccuucucuacaagcuaaaagcugcaaauggaaaaaauccccauacauuccuaaaugaaaaacacaaaucaugauuuuucucaguauuuuuguuauucacucgucauuucaggaaaaaaggaccuccucaauucacgacguuuagugguuaccccacccugccucuauucuguaacuguuuugugaaagauuacacgcaaaagagucgcuauacauuugcaaauagcuuuuuaaaccggagcucucuccugggaauaugauccuaauaggauagagacaaggcuaaguugcugaaugcugcuggucauuauucuuuuguuucaacucaaagaaaacaugcacaaaucucuaacuagacucccgggcauguguuuuugcuuacugccuaaugugguucuaauaaugcaaacauuccagcuaaguaaugaugacacaucuacagcuauagauauuagaagccuacgcaagggaaacauuuugggaaagacaaaggaaaaauacuuucauuuaaauuuucuugaugccaucauauuagaacucauuccaggcccuguguuagcaugaaaaaaaaaaaauagacucugaagaaauaugaacuaaagagaaauucuuucaguguguguuucagaauuagccucaaaauguacuugauugagaguacaucucaccuuugugggugcacauucaagaacugguaaauaaauuuuggaaaauucuuuuuuauuguaucauucauggcugagucaaugaauauauuucuuguguaaaaaccuauuuuuguuuaauuuaaucauuuuacaagaaguuggaugccagccuuuccagggaucaacuuugacucgcagggagacucagacuccaucggauaaggugacaguauuagauuuggauugguugcauuucucccauuagccaauagcugccauauuacuucucucuuucaaagccauguggugugaguagaagugcuccugcucuuggggaaugcuuaugccaaugucuuaguccauuuguguugcuauaaaggaauaccagaggauagaaaauuuauaaagaaaacagguuuauuuugcuuaugguucuguaggcuguacaaaagcaaggcaccagcaucugcuucuggugaggguuucaggcuguuuccacucauggugaaagugaaaaaggagccagcaugugcagagauuacauggugagacagaaagcaugagcaagaaagcaggaggugccagggcucuucuuaacaaccaguuuuugcaggagcuaauagaaugagaacucacucaccucccuucuucacccccuacccagauccuagggagagcauuacucuauucaugagggauucaucuccauaacccaaacaccucccauuaaacccuaucuucaacauuugugaucaaaucucaacaugagacuaggagaggucaaacaaaccaaaguguaauagccaaucagcaugucuuuccccuaggccucaguguuugguuaaagcauaagaauaugaccuuauugaguccaugagacaugucuucacuguuugcagacauuguugcugcuaagagugaaaucucccccgaaaauaacaucaucacauggaagagaguagagcccagagaauagcagaacagggcaggaugauaucuggauaagcuucaccugacgccaguguuaacuuugaaauucugguuauuu

SEQ ID NO: 14818 - RNA, 708 nt, Homo sapiens
cgccgagcgaugggcaucucucgggacaacuggcaccagcgccgcaaaaccgggggcaagagaaagcccuaccacaagaagcggaaguaugaguuggagcgcccagcugccaacaccaagauuggcccccgccgcauccacacaguccgugugcagggaaguaacaagaaauaccgugcccugagguuggacgugggggaauuucuccuggggcucagaguguuguacucguaaaacaaggaucaucgauguugucuacaaugcaucuaauaaugagcugguucguaccaagacccuggugaagaauugcaucgugcucaucgacagcacaccgugccgacagugguaagaugucccacuacgugcugccccugggccgcaagaagggagccaagcugacuccugaggaagaagagauuuuaaacaaaaaacgauuuaaacaaauucagaagaaauaugaugaaaggaaaaagaaugccaaaaucagcagucuccuggaagagcaguuccagcagggcaagcuucuugcaugcaucgcuucaaggccgggacaguguggccgagcagauggcuaugugcuagagggcaaaggguuggaguucuaucuuaggaaaaucaaggcccggaaaggcaaauaaauccuuguuuugucuucacccauguaauaaagguguuuauuguuuuguucccccccccccaaaaaaaaga

SEQ ID NO: 14819 - RNA, 862 nt, Homo sapiens
uuuuuuuuuuaguuuaaaugcauuuuauuuuucgacaacauacauaacauguuuuucuuaaaaacaaugccuccacuccaaauaaaucacggucaaaauaaaugaagagcucaagaugacaucagccccaauuugucuuaaguccugguguuguguggaugacaagcagaagccaguuacaaugacaggugauagaucaaaguaauugccaaauuuguuaacauuuuuccauuucuaaaucauccuuaaagaaaaucauauauggggucacaccaucuucacgguaguccaauagagcaaccaugccaucuggauucauguuuucacaauuaaagaacugguaguuuuugaaauuagcaaggauguccuugauuuguuuugcagccccugucauaaaagguuuuacuguuucuggucucuguucuucaaguuuggcuuugauugauuucauguaaucuuugauauacuucuuguaggcuucuuuugugaaacuuguuuccugcaggugaugguucaugacaauaucaacaccagugauuacugugcuuucuguaccuucgcccuagggucauucagcggagguauuaccaccaaugagcgagucaucaauguuaccuucuauccuacugaccaucuuccccuccaccuccagguacagcccguccaugaucucccagaucuuguagaugucggaaaacaucucaucguggcugaugaggucgcgguagauaaucaugauggcggcugaagggagacgaugcagcacuagcuuagcaggagccugaagcuugcagcaagcgcagugcagccugagcggugcuaagguggagaggggagcgagcggggaaaaaaaaaagcuaga

SEQ ID NO: 14820 - RNA, 890 nt, Homo sapiens
gguggaugcccggagcauaccaguguuagcaaaauggcaaaauucauauagcauuaaaguuguacuucaagagcuaagacgucuaaugauguccaaagaaaauaugaagcuuccacagccaccagaaggacaaacauacaacaauuaauuuuaguggaucucaaacuugucuuaaaucaacaaccuucuacucauguuaaugucuugauuaaauaucacaaugcaaaauacacauuaaguaaaagaauuccagcugguaaacaugaccuggacauuuguaagaauauauuuaauauauguacacccauuauguuuucagguaacaggaggaaaaaugcagcacaauuuuuuuucucuugaaaggcacugucauuuaaacauaaaccuggaguacucgaaauagaauucagguuuacaagaugaaagcguguggagaagugucagauggcaguggaagcauguguguuucuaaaaaguaaaaaucucaagaaaacagaaauggcaugcuuuacccaucuuacuuagugaaagagagcugcaguugaaauuguuuaaaaaguagcagguacaaugaauauugucacagauguguuaauuuuugaagcaaugugggugcugacuacuaguaguaucaaaaauauguucaggauuguuuugauaccuguauuuauaauaaaaaauguuggggggaguugaugaauuccuguuaaaagcuguucuuguguguuacauguaacagacaugguaaauauuuguuuacagucuuuguuuaacaaaccaugcauuuaaguuuaagugaagucaacaaaaaggaaauagguguauggauaugugauuuugagauuaaaguuagucuuaaaauguaaauaaaaugugaaacguguccucag

SEQ ID NO: 14821 - RNA, 890 nt, Homo sapiens
cugaggacacguuucacauuuuauuuacauuuuaagacuaacuuuaaucucaaaaucacauauccauacaccuauuuccuuuuuguugacuucacuuaaacuuaaaugcaugguuuguuaaacaaagacuguaaacaaauauuuaccaugucuguuacauguaacacacaagaacagcuuuuaacaggaauucaucaacuccccccaacauuuuuuauuauaaauacagguaucaaaacaauccugaacauauuuuugauacuacuaguagucagcacccacauugcuucaaaaauuaacacaucugugacaauauucauuguaccugcuacuuuuuaaacaauuucaacugcagcucucuuucacuaaguaagauggguaaagcaugccauuucuguuuucuugagauuuuuacuuuuuagaaacacacaugcuuccacugccaucugacacuucuccacacgcuuucaucuuguaaaccugaauucuauuucgaguacuccagguuuauguuuaaaugacagugccuuucaagagaaaaaaaauugugcugcauuuuuccuccuguuaccugaaaacauaauggguguacauauauuaaauauauucuuacaaauguccaggucauguuuaccagcuggaauucuuuuacuuaauguguauuuugcauugugauauuuaaucaagacauuaacaugaguagaagguuguugauuuaagacaaguuugagauccacuaaaauuaauuguuguauguuuguccuucugguggcuguggaagcuucauauuuucuuuggacaucauuagacgucuuagcucuugaaguacaacuuuaaugcuauaugaauuuugccauuuugcuaacacugguaugcuccgggcauccacc

SEQ ID NO: 14822 - RNA, 4509 nt, Homo sapiens
agccuaguggauuugguaggguccugaaucaucucuauaaggcaaacaaggaaauuguaacacaaagaaauaaacauauugaauauaauugcuauucuguaagacauacagucuguguaagauguaucuuauuuacagagacauuuuugaaaauuaaaauauuaaauacuuuuuguuauauagagacaaugaucuggaaguauaaaaagaaaaauauuaucuuguugauguaaauaugauauccuuauauauauuagaauccaauaagauaucaugggcgcaauauuagcaaaaaaaagucagucuuacccugaaaaaaaaauagauaugaaaaucucagcacuacacagaaauguuuagaugucaaucaguuuugguaugcagcauuauuauaguaguaacaaauuuaaaucuaaaauuuuagaguaauacuuuccuucugaucaguugcccugugguuauuuuuguuaaggaaacuaccauuaugacgggaaacucuuauuuuugcuguuauauuuuguuuccuuauuucaccacuagaggugacaucauuauuuuguaacuuuaguacuaggcuuuccauuugugguauggacacguaugauauggagcaauuuuugaauugucuuucacauaggggaaauugcaucuuauauacccauaaauuggguuuuagugaaagagccaggauggaacauaauuuccuaacuuccauccuaguuuccuuucuacuuguucagaauggccagugaaacacacaaauggcacucagauuuguugauggcucaccaacucaaagagguuccuucucuccuuugauaagucccacaaaaacaucuacuguaaagacuugaaauacaaugccuuucuuuuuuaugagagccaaguuuacccacaacucucaacuaccaguacuggucugacugugcagaaaaggguugcccgcaaaggucaaugauaucacccuagaacauucuagaaugaugaauuuugagaaugugaaaccuuagaaccucgugcgguugucugccuuggaauuccugugcuguauccugaaauuuuagcugaauuuggcagagaauucagagaaaauuugcuuuucuaauccuugcugccugaaagugcuaauuauuuuccauagcuaggauauuaccauggagcaauauuuucucugccuuugauaacucccagcaaauuacuacauuaaccgccuuugaaauccaggagccacaaauuuuaauucaguggccugcuaaaacaugcacucucugguuuaaaguuugccagagguggugcugccccauaugccacauugaauacugggaagggccgggcacgguggcucacgccuguaaucccagcacuuugggaggccgaggcgggcggaucacgaggucagcagaucaagaccauccuuucgaacacggugaaacccaguaucuacuaaaaauacaaaaaauuagccgggcgugguggcgccuguggucccagcuacucgcgaggcugaggcaggagaauggcgugaacccgggaggcggagcuugcagggagccgagauugcgccccugcacuccagccugggcgacagagcgagacuccgucucaaaaaaaaaaaaagaauacugggaagaaggugggccaguucucuccucuccuccugcccugccuuuucucucuucccucucuuuucuucuuuacucauuucuuuuuaauuucuguuuaaugcauauaacuauggacuuccauuaaagaagaaaagagcacuuucugauagcaaaaggugacaguauuuuuauaugcaucgagauugagguuuuucaacagcagugucacuggaaaugcugccaauauuuuucuugcugaguguuucuccaauauaaaucucaguaaucauggcuuacauugaaaauucuaauauuuaaacaauuaacuggcuagaaaagcaauuuaaguuuuucuucaacuuccaaaauggcaauuuagcacuuuggauacaaagcuccaagcuuuacuauuuaugggauaugucuaguucauauucagugcuuccauugcaaauuauugugacuuuuaccaaauuugguauugaaauggguauuuauauggacucagacguuugagaguauuucuuuuauuugcaguuaugguguucaugagcaaaaacaaauaaaccaaaucauacaaaacauuauuauucacagugauugaaaacaaaauaaugauccaguaacaaaauaaucacucgcagcccagccugaaagcaggacauucauacaaauuuagauucauguauaaauauuaucugauauuuauacauuauuaucugauauuuauacguauaaaagauaaauuacauguguuugauaaaccaacaugaacaugauuucaucacugaaaucagaaauauguugaguucuaugacagcacaaaucauauuuccuuucuuucuuucuuuuuuuuuuuuuuuuuuuuuuuuuuuuuugagauggagucucgcucugucacccagccuggagugcagugguacgaucucggcucacugcaagcuccaccucccggguucacgccauucuccugcuucagccucccgaguagcugggaccacaggcgccaccacgcccagcuaauuuuuuguauuuuuaguagagaagggguuucaccguguuagccaggauggucuugaucucccgaccucgugauccgcccgccucggccucccaaagugcugggauuacaggcgugagccacugcgcccggccucuuuucuuucuuucuuuuucuuucuuucuuacucuugcucucuugcucucucuuucucucacucucuuucucucucucucuuucucucuuucccucccucccucucucucucucucuuuauuuccuaagcaagcuaacacaggacauauucucucuuuuuuuuuuuuuuuugagauggagucuccgucugucaccuaggcuggagugcaguggcacaaucucagcucacugcagccuccgccucccagguucaaacgauucucaugccucaggcuuccgaguagcugggacuacaggugugcaccaccaugcccagcuaauuuuugaauguuuaguagagaugggauuucaccauguuggccaggcuggucucaaacuccugagcucaagugauccaccugccuuggccucccaaaguacugggacuacaggcaugagccacugugcccagcugacauauucucacuuaauagaauuauagagaaauuuuucauguuuuucuuuuucucucccacuuuuucauauuccucuuuuucauuuuugccuuuccguuucugucuaugauguaggcuucugaggagaaccaagaagcuuggcuuuagugguagaaugacagaacuuagggaucccuugcaggcuagaacaaaguucugacccuuagaccaaaucuuuauguuaagaguuuuccagaauucaaaaaaaaaaaaaaaaucaaucaacacaacacacacacacauacauacacacacacugccuuuaaaaggaggagccaauauuuguuguaccugugaacugaggaauuauagauaaaccuuaggucaaaucauuucacaauugcauuggugguauugaaaaaugaugagauuucucugacagagagcuuuguccuaguuuuuguucuucauaggucaaaacuggcaauauucucuugucugcaagauaaaguguuugugcuucuaucaccauaugcaugaacauguaagaaucagauacaauuucugcuucaucaguuucacauguucauguugucacugaaaaaaugcaucuacuguuuauagcucccaaggagaccccaaauccuuuuuuuuucuuuugagauggagucuugcucuuguugcccaggcuggagagcaguagcgcgaucucagcucacugcaacccccaccuccuggguucaagugauucuccugccucagccuccccaguagcugggauuuacaggugcccgcuaccaugccuggcuaauuuuuguauuuuuaguagagacaggcuuucaccauguuggccaggcugaucucaaacuccugaccucaggugauccacccaccucggccuccgaaagugcugggauuacaggagugagccaccgcgccuggccccguauucauuuuuuauacuggaaaacauuuuuuuuguaauuuuucuuugcaaagaaaugagcauaaaaaugaauacuccaaagaaaaggaauuauuauggcaaauuaaaagggacacgguacuaugauuuaauuacugucuugucuuuuuaaaaugucaucucuuguuuuacccuuuuuuuaaauaaaagcuuuaaaaacaugucuuuggguauuauucuggagguauguuucuuuuauauaagauuucaaguuuaaacauuuacaauaaguaauaauauuuaaauucuuauaacaaguaaugaaauauuugguuuaguaauuagcuuagucuauuuuaaaaaaucauuaaaauuugcuuuguuuuuaag

SEQ ID NO: 14823 - RNA, 6600 nt, Homo sapiens
cacauugauggaagacguggggacaauacgcaaaauaaaugaaaauauauagauauuuaaauaauggcuaugagaaaauauaaugcagaaaaggggaauggcaaguaccccuaaggaaguguguaauuugugauuuuaagcaagguggucagggaagaccuuacugauuagguaauauuuugacuugcuaucccuauggugcuauggaaguaguaaugaacuuggaauuggaaaaucuggauucaacucuuguuauggacugaauuaugaccuccaacccccuagaauucauauuuuguagccuuaacccccaguaccuugauaugugacuguauuuggaggcaggggcuuuaaagagauaauuaagguaaauuaucuuguuagggcccucagggucggucccuaauccaauaugauugguaacauaugggaagaaugacaaaaauaauaagaggcuucaggaaugcgggugcacagagaaaaggccaugugaggacacagcaagaagguggccaucugcaaggcaagaagcggccucaggagaaaccaggacugcugacaucugcaucuugaacuuccagccuccacaacugggcgaaaauaaauguuguuuaagcaaccuagucuguaguauuuuucauggcagcccaagccgacuaagacaacucugaugucucggcaggcuugugaucuugcaaggaacugaccucaguauccucauguaccagagggaagcaagacagucaaggucaagagugaaguaucucucagguucuguuccuuacaugaccuccuaacaggagggaagaguuccuguucuuucagacuucaacagacuuaaaucucucagaaaccuucacuucuauaauccauggccuuaaaucuaaacaugucucaaaucuaaauauauccaaaacugaguucuuccucuucaucccaccaauccuguuucacccacagccuuucccaucuccaccgauuuuaccuccaaccuuccaguuucuuacaccaaaaaccucacagacaucuuuggcuucaguccuucugucaaaacccaaauccaauaugucaggaaauccuguuggcccuaccuuaugggcguauucagaccccagugacaucucaucaucucugcuaguaucaugcuagucauauccccaacaucucugagcuggguuucuucaggagccucccagugaauugcccugcuagcauccaccccucugucuggucuacuuuaacaauagcagagugaucuuuucagccugccuacauguccccacgccaagagucuccagucagggcucacccgaagccuucuuuuuuuuuccacuauaaagucuucucucuccucuacccuccuuugagucucuaucaaacacaagugaagguaguggcuaagucucucacuauagcaaacugacuaaauggccuuugcuugcucucauuuggguggccuucacuuauuuccacagacgucauguuuaaaauauuugauaaugacccagucuggguuuauggaccaccgugaauauuuuuuaacuucaucuuugcuccaugaagugcugauuuggaagauuggauuuuucuggaucgaaauagaacauuaagucuagauaacuaagcaauuauuggacuagauggaaucuuuugagugucucuuggguaguuuucuaccauaccaucacacuuaaaccaucucugacauacuguaaaaaucugagcugugcuuaagcacauuaaccuuuucagcauuucacucugcugauauccucuuuuuuucuauaacaauuucuauuuuguuuguccucaaacuuauuuauguuguucucuccucagcagaaaucaaaucaguguauucuauguuauaagcccugcagaugcuuccacuuuauaagcccuucagauacauuauaacucuguuaaauuggucaugauuuucuuaauuucagaaaacauguuucuuuuuuuauuuaaguauuauuuccuaauacaaaguucccaugaaauguguuuuguuauuuuugcugcaugugauuuuaucuacucacuuauacagagcaucccacaguuaaacaaguauaaguguaauugcaggacaucucagagucuaauaugcuaauauacauagugaauucuugagaauggagauguuuacgugauaccaaaggauuccuuugcuuguggagcaucuuuauauuaauauuucgcaugguuuagcccuuacauguugucauggcucuuguaaacuuucccaaguucuucucauuacacaagccuuaucacagaacgguauuugguuuguuuguuagcauugaauagcugaaggcaaaaaucugaccauucucuuguaaaguagcaacacauuacaaguaaucauguauuaaucugagcauuuuuggucuuauauacaaaucaauaaauuuuaucuuucaagccuuuaaaaacauaccacaucuugguuggguguuaagaggaaaggucucagugcucaaaauaacugcugacauaacuucuauauuucauuuuccuacuaaauaagaccugcuaugucuaacacauuuuaauuaaugccgagccccagauguuacuaugcacagagaagcuuaauauuaugaaacucuaauaaaaccuugauccaaucaauuucagguacuucaauuguaugggugguuuuugcuuauuugaaaugcacauuguuaauuucuuaaguuuccuuucugccuauucucuagguucucuuuuuuuuuaauuuuucuuccuggguaauggaauuugaggcaauaugcucaugcuaaacaaauagauauauuuuuguguacuuuuucaauuuaggaaaaccagaaugaagugggucuucuacuguuugguaaaaauccaaucuaguuuauguaaaauaauaaucucuuaucuuuguaugguauuguauaauuuucaaagcacacucacauguauuaaucuguuuggguguaauaauugagguuagaaccucagccucaggguucaggcagacuuggagauuaaaucuaggaacaucauuuacuauagucuggcucuggggaaguuacuuaaguuuucuccacuucagcuucuuuacuuguaaaaucgagcuaauaauuuaguaccuaaaaugguuguugugaagauuaaauaacauaauacagaaaguuuuuagcucaguauuuaguucauacuaaguauucagauauuuuagguaguaguggggauggggguaggggcuuaaccaccuugaaguaaaaugcaaaaauuaccuccauuucaaaaguaggagcauuaaugaccagauggucucagugaguuacucaagccuacugaguagacccagucuacugaggguccaaauaaaacaaaaaaucagagaaggggcaaaucucucuuuuuguugagcuggaacauccaucuucuucugcccuugaacauuagagcuccugguuuuugaaccuucagacucaggggcuuacaucaacaccccaccucucccacuuuccucaccuccaguucucaggccuuugaccugggagucggaguuaaaccauuggcucccuggguucucaggguuuuggaauuggacagaauuauaccacuggccuuccugauucuccagcuuacagacagcauagugaggacuucuugguuuccauaaucacgugagacaauucccaugaaaacugucuucugaaaaauauauguauguauguauauauacaacacauauccuauugguguuguuucccuagagaauccugcuaguggaagauuuccuugcaaaauauugugaggucacuguaguuguuaucugugugugcucaaggucugcuuucucuucagaaaguuccagcuccuuuuuucuuuggggaucuaggucuccccuggagauuaccauuaaaguauacacccauucaguagccaaggaauaaaagggugacaugugacugaauugaaccaaucucuaucucccugaaucuugcaaauaacccaaauaaugaaaucuauuggccuuuauuuguccugaccuuggugcuuuguagaggcuuaccauuaguugcugcugccuagaucuuuggggaugcuuugucuuuauucuuucugaagcuagguucuuucacuuugccuuuuauucugggggcuauucuuuaucuuucucuuauaauuuuuuuaaaaauuagcuuauucagagucaguuuuuuuguacaaaaacuccaacgcacaguagucagcuauugccacaaaacugccgcaaaacaaaccacuccaaaacucaguggcauauggaacguauuuaauucccauucacaaauuugcaauucugcuaagggucaccugauguaggggcacucagccucaagcuauaacuugguuccagggcaguuccaugugucucucauccucccuggaccaguuguauguucuugucauugcaaaagaaacucagcaggucaagcuuaaucaugcaagcacauuuuaaaccacugcuuccaucuugucugcuaauauuucauugacuaaaguaugccaaauggccaaguccaaagucaaagugugaaagcucucucuacucaugaagaugguaaaaaaugagacaggaauaauagaggguggucacaggagaacagaggguggucacaggagaauagaaaauuccaggcaucaguuuuacgugguuagcaaauggaaacuguugaaguagcugcauaagcuagggacccauaagacccugaaaaccaggaugugggccaaacuggcgaagacugacuggaccaaacauggcacuggcuuugaccuaaguuucaccuaggaucucauuauacacucaucaacacgcucaaucacacacgccccagcaccuugagaguuccaggaacaccucuauuugguggaaaaaugggugacacugcaguucugagaaaucuuuaucuuuuucuaagaaucuucauaaauauuccaucccuuggcuaaagaaacccauaguaccccaaacucccaaacccaauggcgugacucacucucuugaguacaccugcacuucuguuucaugagugugcacuuuucacuuugcaauaaaucucuguacuuucccaguuuuuucugacucacuauugacuuccuucccgugaaggugucaagaaccuggaugcuggccagaggcagggucccacgggaauuuggggaccuccccuagcccacugguaucagaaguagcacugaauaguugcugaguaucaaaugcagacagacuaauuugcauuaaaaaguaauuucuuuacucuguaggggaagaggauuuuuuuauuuaacccccauagguuccuaguuggaauaaaccccugcaacaaaagauagauugacaagagaaaaacaaacagaaauguauucacauguauauuucauauauaugaaagacauccagggaaugaguaguucucaaagagauggcuuugaauucuagcuuauguggcaucuucaacaaagaaaacaguacauuuuuauagcagugacaagacaaaggaaaagaacuuuaagucucuagggcagcaacuugcgagaaggcaaauacauggcagauaaagauggguuaguaaagcucauuaauguagauuccucugguaccaucuccaggguaacaggggucuaaaguugucuuaguggcuaaccacuguucucccugguagggggugggagguggaauaccuuuugucuuuguaaaucuguguccuucuuuuaggcaaauacagagagggcagagagcuuuccugcacaggcuucuucuuaacugccuucaacucaaugauucuuuauauuugggggcagcauauucugcucuuccacaccucuaagauuuccucuuaaaacacaaauaggauuggagaagaaaaacaugaagccuuuccauuaacaaccuaccuuaacuuggguuuuucaguuggcuaguaugcaguguccacagauagcuaagaagaaucucugaaauaagacacagacagaucuauauuacuaaaggacaucaggauucaggagaaaaggagacccaggcucauaucaggguguuuagaagcauguggaaauucaggugaacaagauuuguagcagcuaacaggaaagguaaauuuuacuggauauaugcaucccuuuccuaucauaagugagauggaaaugaaauaaaaguguacugauuucuuagguuugcaagauuuggaucuucaauuuggggcuuacacagaauggcucacauauuauuauuucccuguacuuugucauugcuacacuguaaauuuggagcccauuguuauacaaaaacuagcauacagucuugucuguggaagagcugaguaaauuguuuuuugauucugacucuaggagaacauauuccuuucagccucuuugcuuuuccucuacuguguuuuaguugaggucaucagaccugccagacuaggucauuucaugaaauacauauaacuuacauggcucugaggccuaaggaagcuucuguggaguguuaauuauugcaauacuugggcuuuaaaggaauggaagaaguugagaggccaugcccauaucugaagucuaaacuuaucuacaaau

SEQ ID NO: 14824 - RNA, 408 nt, Homo sapiens
cauggcuccauuuguccguaaccuuguggagaagaccccagcacuggugaaugcugcugugacuuacuugaagccucgauuggccgcauuuugguacuacaccacgguugagcugguuccucccaccccugcugagaucccuagagcuauucagagccugaaaaaaauagucaguagugcucagacugguagcuucaaacagcucacaguuaaggaagcuuugcugaacgguuugguggccacugaggugucgacgugguuuuaugucagagagaucacaggcaagcguggcaucauuggcuagaauguuugaagaccagucuuaacaucugauuauauuugauuuauuauuugaguguuguuggaccaggugugaucagacugcuaucugaauaaaauaagauuugu

SEQ ID NO: 14825 - RNA, 32963 nt, Homo sapiens
guuuggguuaugggguaaguuuugucgugaguagggaagagcucaaagacagcuuguggugcuuguagaguagucucuagucagaccuagguuugaaggaagcucagccccuuaucuagucuuugcaacuuggguuaguuucuaacccaaaaaagcgguuuaaaaguaauguagccucuaucuaauaggaaagcuaaaaggauucagugaguuaauacauguaaagcucuuuuagaagagugacuuguacacagaaauuguucaguaaacguuguaauucauuuucacagagaauagugggauuauaugguuuaucacacuucgguaagcuugggcauauuucaaauuucaguaacauuacugaaugggggguggaucuuguaucaguguaaagucaggaauuugugauuagaaagaguaugccuugugagucugacaccacugucaccacuaccccuggaacucuugauguagcuuuaauggaaacaagaacauuuuagagguuuugaaggugacaggggagagaauaacaauauauuagugguucgccuuuaaguuggaacaucagacugaaccuauauaauguauccuagugacaaagcauuucuggauacuaaaaugguggcaagguuuaggauaugagugguuuuuuauccccacuaaaaacaggugaaaaaugcuuuugucccuacagguuuaccugcuaaugcaaguuuagaagaauuugacaaagucaguaaaaauguugaugguuuuucaccaaagccagugacucuuuuggccucauuauucaaaguacaagaugaugucacaaaauuggauuugagguugaagaucgcaaaagaggagaaaaaccuuggcuuauuuauaguuaaaaauaggaaagauuuaauuaaagcaacagauaguucagacccauugaaacccuaucaagacuucauuauagauguaaguauauacuaggcuuggucagaaauaugaaguaucgucacgaauuuagaauuaauuuauuaaaacuaagaucuacaaaucugugaauuuuacuuauuuuaaaugaaaaaauuuauguugaguauuuaaauuuuaggauaagauuguaaguguauguuuucaugugugacgaaacuaaauguuugauuuugacacguagucuagggaaccugaugcaacuacucguguaugugaacuacugaaguaccaaggagagcacugucuccuaaaggaaaugcagcagugguccauuccuccauuuccuguaaguggccaugacaucagaaaagugggcauuucuucaggaaaagaaauuggggcucuauuacaacaguugcgagaacaguggaaaaaaagugguuaccaaauggaaaaagaugaacuucugaguuacauaaagaagaccuaaaacugauggcuacuaaaaagcagagcauuucugguaagacuaaauuuucuccccucccucuuaaugagguuuuagagacuacaccagaauaaaagacaguuuaggggaccucuguagaacaacaagggucuuauuuugugaauuauauauuucaagaacuaaacagagauccaccuuucuggaucugauuuauaucacugaaauguacaguucuuuuggaauaguuucaccugagaaaacauaguuggcuauuaucuaucuuaaccuguucaggcuuuuaaaaaaaacuguuuuugcauaggguaguacuaagaucuuaaaaagugguaacugucuugaagaaaaaacguuuauuguuuguuugcaauugaaauaacaggguuaccuuaacaaugacugucuaugaugugucaguucuuaucugaauuccaaaauaaaccugugcuuaaaaaagaaauaauugaccaaguaaguuugcauaaaaugugaauacuaaauguguccccaguugcuggcauucauauguacaggauuuguucuagcaagcuaugcuucaguaugugguugauauuuuucugucacaaugauuucuuuaugcaugcagagccuggggaagucaugggauuaacuugagggucacuauugagccuauuaauuaauuauuguuuuaauaaaacaaacauugguauuggaagauaaauauguuuaugugguaucugacaauguguauuaggugucauauacaaugguaauaugccugucuuuaaaguguuauuuuauuaauuaaaaggauauggcuauuauuauauauucucuaaagauuugaguccuaaaugcuuucaucagguaaauaaaauguauaauacaaacuguuuauuucagcugcuauaauuucagcugcuauacugacauuucauaauuuauuuccuuucuguguagccagucauaacaucuuuguacucuaugagcaaauaguaauuuuggaccuugauaaaacaauuuuguagaguguaauauuucuaagaggaaaugucacaggggcuaugaugcaagaaagccucagaaaugacugcauacaggucaguaauuagaugcauuauaaaauaauacuuugaaauacuuacuuaaaauauuuaaguacugccaaaauacagauuuagacccaacgucauauaauacauacuauuucuguauagaaaguaugcagauuuagcuaucaggucugguuuugucauguguaaaaccauuuucaguaguaguauaguauauguguguuuuuacagaucagaaaauuuuauuugcuaguaaacgguaugggacauacugaaauuuuaacuuuucagagggacaagguaacucauugcaacugguuuagaguucagccuacagagagguacuaugcuacugacaggaacuuccuggaguaaguaaguuuuagugcaguguaagaacuauaggaacaaaccagaccagugaagucacacaaacccaaaauuauuaaaguaguaaaaguagaccuuagaaaaaauaaggcaggggcauauccugauuggaaguauucuugaauuuucauuuacucuauuuacauaaauaugcagugugacacucaacugauuucacuccaccuucaaggcauguauuuuggccucauacuauuacuacauuugaguaaacauuuaaccugauuaguuuuaaaguagcaaaggacuaccaauaaaacgaaaguuaucauacaaauguggaaggaaggacccacuaaacccuugaauauaagcaaagagguagguggcaaagcagccuuuuuagaacuuuaaaauuaugaguagauauuuuacauuauuugaacaaagaacauguuuaguuucacacuuaagguuuacuuacuuacagauuuucuucaauuuacauugaacaaaauaauacaguaucaaguuuagucugggugaggggacauguuuuggcaucuuuucccuauaguaguaguuuugguucaaauuaauuuuugaaaaauagcuuuuguauggaacaguauaaaugggcuuauaguucagauacugagcaaauacacaauacuacuuuuuacuaacaggcacauaaaggaaaugacaacuauucgugggcucaaaaaacugcauauuuuaacuaauuuucaaaauuuacaaaucaguaucucagagaaguuaaagaaaauggaaaggaacaaagcccuuuuagaauaauuaauauacauugccuugcuucuuuccaaaaggaacauguacuugucacccuagcuuuuguuauuuagagcacugguacagauacgcugucccauacaucaggaucaaauuauuaguuucaguuucacauuguaggaauuuaagauuuuuuuuuuuuuuaacacaggaaauaaucucaucauuuccaaagaugucuucaugucccaucaaugacaugcuaccagacauaucagauuccacaggauaauggcaccaagcuacccaaguagauguuucugguauucuagacugccguucaugcuuguuuccuaaaguauacuuaaaaguuucaaauacaguuucacuuagaaacugcaacccuccaaguaauguuauguuuacuuagguauuaauguuauguuuacuuagguauguaucagaggcaauaauuuccaaagcagaucuuagaauauaaccaauuuguuagauaacuuuaucucuaucacaucuguuuacaagcaaaguauuacuuugucuggacuuauuucaucuucagugucugggaucgugggcaacagagcagaucgcguuaagccccaaaauuuuugaggugacaugucuuuuuugguggccguaaacuuccauccaauauggcuugcacagaucuuacacugggcaacaguccaggcauaccuaagaaauuaaggaaagauaucagcuaaggaaacauuucuguacuccaagccuaucauauaaaccuaucaugaagacagacuuuagaggcaaauucuaaggauuagagauucuaaguugagauuugauccauacaguucccugaaaccuaaaaacauuucuaaaaacauuuucuaauuuuguaauauguaugacuuuuaugcucuuaagccauguuuacauuuuucuucuacugcauagaaauaaagaguaaucuuaagaauuucuuuauagaaauugcugguugccaagaccacauucuaacuuguacuggcaccacauucuaacuuguacuggcuuuuccuuuguuguauugcagucaaguuagaaaacagcaauuaccugcagaaauaaugcacuucugucugaguuaaacuggaugggccaggaaggacacgucucaaaaaguaaauauuuauauucuaaaauaagaacgauugucagauaaugcaaccagaaauacaaaccaugguauuuuguucuuaagauaaaccauguaauugcaacuguuuccuuauuuuuuucccuagguauaccaugccacauuuauuuauaguaacaaauguauucuaguuuuaguccucacauagggugccaaguaagauagggcaauccaagauacauaguccuaaccccagaguagcauguaaucccuucuuagcaucccucuuugaaaacugaagauaguacagcugagggaacugaacagguucccaggaucauagagaaucauuaagcugaagcaaacaaacaaaaggcaaacuagaagaaaagcaggauucaauggguucugcaccuucuuagucuaucauugcuuuguaaacauucuccgguuuuacauuacuacagaauaugguccagauauaaaguucuacugggucauaagacagcugauuuucagaauuacaugacugacagaaaaaaacaauuuuggauuuaacuggauacaguaaucugaggacaacugcaguugucaaccuuuucuuccuuucauucaaugauaaaagauacaaaaagugcaacagauguuucuagcuauuuguggaaugaaggacauuuaaauaaauuuuuuuuuuuuuuuaaauagacagauucucacucugucacccaggcuggacugcaguggcacaaucuuggcucacugcaacacucuugccuuccagguucaagagauucuugugccucagcaucccgagcagcugggaguacagaccccugcccccauacccggcuaauuuuuguagcaaauuacucauuugucugucuacuuuuuauuauaaagauuguggcaacucugcuuaggacucuggauuuuucugcccaauuaagguaaaaaaagaaaaaaaaaagcaaccaccaccauaauauuacccaggaaaccagcuguguucuguagaaggccggccuaucagauucaaguugcaagccuuauacacaguaagugucucaugcacauauccaugaggauucacauaagcugccaucggcccacauaaggauaaacuaaaacaaagaaucaacauggagaacacgucaaaacgagaagucuaauuuuauuaaaugcuuagaauuuuauugaaguucaccaagaaaugagguaugagcuauacaguuuuuaauccuucaguuuuauauaauaccaggaucuuaguaugaaaaugggguggggguacagcuggcagacaggccuguuuugucuaaaugucuaaauguuuucugugaugacccaaaggaaauaguacuuguuuuuaaaacccuccucaagacagacauuguaaagaauauaaaacucaaaugcuucuaaaggagucugagaguguaagugcaaugacaagguccuguguggucauuuuggggcaguugauuauuuugcagaaagcaguuuccuuaccuucuugauuuacaacugauggauuugucauaaaaugauuuucaaacacuguuauaucagagcaucaguauguguucagaagcauguccuacuuuggcccuauauggcaaaacugaugacugaaauguaauuucugaagcaucuauguuagggccuaauugaagacagucuaauauauagauugucaacaagaauuagggggaaaagaauuucucaguuguuuuacuuuaccaugcucauuaccugugaauaaucccugacaugcauuguugcucugaguacccaaucuggaagauggucuuagcaaaagugagcuaauucccuauauuucauuugcuaaauguuuguaacuuuaagguacuggaggaaaguuuauggaaaacagaaauacagucuucauuauaauucugauaaggcaaguauauuaaaaacguaauaaagaccuuaccugaauauuucauuuuugguuguuauuucuguuucuugacauuguuuacagcaaagggaaguacacuaaaagauuugagagaaaaauuauugguaggaaaaacuggcauucacuuuaucauguaaucacauagaucaucaagaaacuuacuuauaaagauauugcucucucugaauaucacauuuuccuuccaagcauucaaaaacacuuuuaaagauggagcacgaaagucacugaaacugagaucugccacauauuuacauaaaacuaaaugaccuucucuagaguaaaggaauagugauauauaaccuuggauauuuccaugcagaaaucaaguuauuuuucacuaaguugauaaauguauucauauuugacaaacacaaaacaaugaguuuguuuguaagaucccaauugaaaucugaauugcaugacuacauuacuggacucuauacagagcuccauuggccccaacagagcauccuaguucuccagccugaauaaaacaugggcaucaaaaacauauucacuuuacucacuuuauucauaaugucuaauucacagcgaagucgcuggauagcacugccaauuuuaaggagcugaauucucaauacaucaucaauaggaagacaagcagcuacucuguaagaaaaaucuucaagacaugguuuuucaaguuuuaaacuuaggagucagauaagcaucagagaacuuacaaaucggauaauauccuuuugaaauaaacccuucucuuuaagguuacacauuuuauacaaguauaaacaauacaaaaauauaccagcugucaaagauacacuuuucagaagcucuaaauuuaauugcuuuucuuauacuuuuuuugguaaaauccuuuuauguuaaacaugaacucaaauccauguuagaaguuauuugccaagagacuagaaaaauaacuaaacuauaccuuauaaacagauaaagagaguaucuauaauuaaggcaaguccuggaacuagacucacuucuuuuaaaggcaccuugaagaacagggaaaggaguccuuacacaggaaguguuuuuggaugacagccacuuccugcaauuugaacuuuuuauggaaaacuugucuaaaauuggagugcucacagaauaugaggauuuuauugcaauuaauuuuaaaauacucauuuuuuuucaacugcucaaaggaaauuaugcuuuucagaauuaaaauguuuuaaucagucuuaaaaccuagaagauaugauuggaucgcauccaugaaaaagcuauuuuuuauagcaagacaucccaggcuccaggcaggaaacuaacuuuucauaccuauuggauuugaaggaagagaaucaucuuuuagauuuucaucccauucacguagcuguuucuugauucuguccauuaaggucuccuuguuuaaaauaaagguagccauaaucaaguucaugggcuuauuaaaauuuacuauuaagcuuuucaacucuuaaaacuaacacugguagcaauuuaaucacucagucccaucucagucccaguuuaaaugccuccauuuucguaugcagcaaugaucaagcuccagcuccuuugcccagcacugucugccuuccagccuuuucucacucacugucuuaacccagcgguauaugcucccaacucccuugcagauuguucuguucuaugccccugcuuggaacuggccucucuucugccuucuauuaggccauuucugacccaguccauagggauuauggcaccuauaaauugcacuagcacuugcuaucuacauaccuuacuuggcaccuauuuacuacauaauuuucacaagcauaugcaaaacaugcaaaaacucauauauugugucuuuguaauugcugaaaagcugcuaaagagcggagaucaacugcaguuuccuuuagugucgugcauguuguugaguuuucccaggacuccagauuugugggcagugauucauuaagggaaauggcuagcauuuauugaaugcccgcuaugcacaccagguacaauagcuaccauuauauccauuucauagguccuuggagaaguaauuugcuccaggcccacagaguaagugacagaaaucagacucugaagucagucucugaucugaaauccagauucuuuaaaccauuucagcacugucccuuaguuuugcaaaauguggcaaugccuaguguuaaacuuuaaggagcaaaaacccuccuggaugcauuaauuaauagacuaaugaucaagagacguaaguuaauauacuuguuuagagaaaaaccaaaacaguaaaauauggaugcuuuaauguucuaaauguaacuaucacccaacccaacaaaauuucacaugcuuaauaaaacucuaaagagucuugugauaccuuuuuuuuucccuuuugagacagucuugcucuguuguccaggcuggaguacagugacacaaucucagcucacggcagccuugaccucccaggcucaaucaauccuuccaccucagccucucaagcagcugggacuacagccacaugccaccaaaccuggcuaauuuuuguauuuguagagaugggguuucaccauguugcccaggcuggucuugaaugccuggcuucaagcaaucccccugccuuggccucccaaagugcugggauuacaggugugagccaccacucuuaacgauaucuuaaguuauaaggcacuagaaacuggaaaaacuaaaccuuuguuuuuuaaugacccuuaauuaugacauggccuaccauauauaaaguaaauuuaagguaaguuacuuacagcaucauauaaggaauacagccagcgaggccaugaaguuagauuugcacaaugaaacuuucucugaaaacaaaacaaaaaggcacuuaaaaaaccccacagaauaaagauucuaaugcuggaaugagcaacaucugaaaaaugauuuuggccuaggaaaacaucuaauuuuaaaaagauaaaaaauuuuguagauaaucccaugacgugacuaucuaugaagugugaaaucaugcuuccuauauccuucaaauauauauuguaacuagaaucuucauuccuauuuaaaaaggucaaacauuaaaauuucaaugcugaagacaacuuugggaagauaaauguugagaguaaacaccauacuucuauuaugaccauguuaguugccuuuauacuaauuacuuguccaguaucugaagugaaaaccucaagauauaauccaaacuguuuuuguguaaaaacuuuaaaugagaaucagcugaaucacuauaagggcaaacauuaagaagugauagaaucccaagaaagauaaaauguucguuuacuugagacuucaugaugaaguuccucauuucauaaaacucaaggagaggggaaaccgauuauuuaucaccucuaauuguaacugaaauccaaacaggagcaugccuaaguccauauaaaaaugugaauuguagaaauuucaguugaauugugaauuguagaaauuguagaauuucaguauuugagggggagaaaugugaauuguagaaauuguagaauuucaguauuugagggggagacucaauacuguuaagaugucaguccucaaauuacauauucagugcaauaccagugagaauggaauuuauaaguauaauuuaaaguucguuuggaaacauaacugcaaaaguaaccacaaaauuuuugaaagagaagcaaauggucuauaggacacaaaaauauuacugaagggaugcacugcagcagugcuaauagcaacaaauugcaaacaaccuaaacaucaaucaaaaauagagugaaauacauuagaauauguuuauaucaaggaaugcucugcaagugaucaaagaacaagguauagcagaauauaaagaauuaucacauuuuucucaaaacaaaaccuacauacguacaaaucuuuguaauuucacuguaaauaaaauguuaauugacaugugacaugacacaugaaagugagagagaaaaggaauaagguagaucaaaaggcacuuuuaacagaccagaacaagaaaaacaagguaacauuuaacaaaacaagaggaagacccuacuccugcaccugcaauaucaaaugacuagguauguuucauacgcugaaugauacuuacccuagguauguuucauaccuagucauaugaucuugcaagugccggaguaagaucugcaggaaacgugggaacacagcacacauaaaagggacucgggacugagcugacagcuggaauuguacuacgcaacuguacaaugugcuacaccacucacacccucgacuuccccgccacuccaauccuauucuagcuauguuaguuuggugcaaaaguaacugcgguuuuaacagaagacuagaaucuaugagacaauguuauucuauuccaugcuguucaaauaugggaacuuuuauuaucaaagggaaugucuuguuaccagagauguucaguuuagagcugucucucaaguggacacacugguuuucaaauauuuuaggaguugcaauauggaagaggacagacuuguucuaaaacacgaccuacagcucaaaacaaaggauuccuuaaugagaaacauuucuggcuuaauauaauccuuauauuugagacuaugcaaagaucagccguccccaaccuuuucgacaccagggaccagucucguggaaaacaguuuuuccaaagaugggguggaggaugguuuuggaaugauucaagugcauuacauuuaucauuagauucucauaaggagcacgcagucuagaucccucccaugcgcaguucacaauaggguuugcgcuccuauaagaaucuaugcugccacugaucugauaagagguggcgcucagcuucacuugcucguucaccacucaccaccggcugugcgucccgguuccuaacaggccacagaccagugcugguucgugggccaggauuuggggaccccugccaaaggugaucugagauggccuccuacugugugcucugguagugguuaaagccugaggagucagaccaugagacccuucagguacucuccaauaaguugucccucacuuuuaagacuaaauaccuaaugguaagauuauugucacaguccaguuacagaauuuaagaaaauacuaccaagagcacaucaaguagcucugaaucuucaggaacagcaauggcaaccauuaguauugugccaagaauuucacauuucuuguaagaauacucuaagguuaguaguuuauuaucuccauucuaaaguaaggaaacagaggcacacaaggaugguauaacuugcucaaggucacagagucaguaaauaggaaggagcuaggaucuguauacagggagucugacucuaaccaucauucauucaacaaauauugugagugccugauaggguuuggccguguccccacccaaaucucaucuugaauuguaguucccauaauccccaugugucgugggagggaucuggugggagguaacugaaucauggggacaguuacugccaugguuuucucaugauagugaguucucacgagaucugaugguuuuauuaagacgguuuugacccuuuugcuuggcacuucuuccugccaucaugugaagaagaacauguuugcuuccccuucugccaugaugguaaguuuccuaaggcuucccuagccaugcugaacugugagucaaauaaaacucuuuucuuuauaaauuacccagucuuggguacgucuuagcagcgugagaccagacuaauacagugccuaacaugugucaggcuauuuuuauacauuuaggcuaugccagugaaugaaagaaaaaccaacaaaauucaauacccugucgagcuuauauuuuagagagaagaagcuauauauucuuagaauuacaaaaugacaaagacccaacugaaaguuuuaguuucgcugacacacuccucauucaguuauuaaaauauacuucacauaucagaauggucacuuuuguaauacaaaagaaauguaaaaaaguguaguacaaaaguguaauuucauuuggcacccaugucaagaaaaagaaucugaaauaauauguaaauuucaaguauaaagagaauaaaauguggcacacuagcauauuaagagcaaugcacuggaucaggcauucacucugccaccaugcccaugagcaagcuacaguuucagguagcuucuuuucagagucagaagaccucuaaaauucuuuaucuggagcauccugacagauucaaauaugcauaauacauccuuaauauuugugauguguguuagucaauuagacacacugaagagacauauaccagaacagauuagcuagcuagcuuuuacagagcaacugccaaaguuuaagacauuucaacauccucaaauuuaagagucccauuuagcuuucuggcacaauaggaaaggcuccugucuuauaucuggguaaaauggaugauaaguucuagcaauuuauaggcauucuuuaaauauaucaacaccaugauugaugucauaaaaugguuauaccucaagaaaauuuuaauacuagccaaaaaguuuaggcacuuaaaagugaccaaugacggauucuccagcagaguaguauucacucugggaacaggauuuacuacugaaagcaggcauaaaagcccuuaaaacgaaucuguuaccuggagguaaucuaucacaguccuccauucuuaagccucauaacuauggcuucggcuuugccucccaacaacguagaauguucaaaacaugugaaacuccauuuaagugagucuuugaagugcaaugaaaauggaaagaguaaugugaaaagcuaaacauaaauaguaaaucacuaccacugacuuccuuuauauagugacuaaaaguggucacuuauuguguuaaauccuauuacaaucagcaauguaaaugacagaaauaauuuauauaaauaauuaaaaaguuaccaguuuuuguuuccuucuuucaugaaccaaauuccuacaugguaauaagaacugggauggaaugauaagcucuuuccuacuccugaggcuuauacgcuaauggcagauacacaaguguacauacaagauguaugccugggaaaugaccagucuuucugaggaagcaccugacuauacauagccuaagauuucaagacuuuucuucuuuauauaaaaauagucaauaaauguuacuguucuuacgauuauuauccuggaacaaggugaaacagauucucaaguucacaaggaaauguuaaucaaugguagucacugaaaagcuugacaaaaaagcagugaggggcuuaccagcccuauuuuuauuuacacaaaguauaaagugccaacauuaacaacaauaugaugauggcacacaagcagaccaaaagagaagaaaaguaaaauaaacauaugaauuuggucugugacaaugguggcaucucaaaucaaugggagaaaauauggacuauucaaaaagugguaguaggacaauagggagccaucuggaaaaaaguaaaguggaauuuauaucaggaucaacugcacaaggaucagagcuuuccacggaaaaguaaugaaaccacagcaaguauccaaagaaaacaugagacauuccuuugcaugggaacgucauuuuuggcuaugauuuagaauacagaagcauuaaaaauuaaacuauguaagaacaacaacaaaaaaacaguucuguuugacacaccacaccaaaaacaaaagacaaaagacaaacuaggaaaaauguuuggaacucauuaauuacagagacuauaaagcuuacaaggaacucccaagaaaucaacaagccguagaaaaaugggcaaacacuuuacagaaaggaaacacaaacugcucuuacaacaaaaugcuuacccuugcucucagagaaauucaaauugaaccuucaauguaauauauuucacuuaucagaucagcaaacaucagguuugauacuacauugccugucaggccaugaugaaacaauaaaaauaaguacaaacaccuuaaguauuuugaaaauaacucgccucccggguuccagugauucuccugccucagcgucccaaguagcugggauuacaggcacccgccaccaugcccggcuaauuuuuguauauuuaguagagacgggguuucaccauuuuggccaggcuggucuugaacuccucaccuugugauccacccgccucagccucccaaagugcugggauuacaggcgugagccacugugccuggccucaaaauuauuuuuaaaacugacagaauuauaaaugcauuuacccugugagccaauaaccucacucuuuaaaaguuaucauaaauauuuaccuauauaaaaggucauuuguacauguuauuuaguacagaucuaucaucaguaugggacugguuauacaguguauccauacaaaagaauuccaagcagcuuuaagaaugagcaaugcucuauaaacuaauacaaaagaaucuccuauaagauacaccguuaagaaaaagguacguauccuucuguauaagaaagaaauaagaacauuuguaucuagauaaaauuaggaggagauuuaaacacuaaucugggagauuacguaugagaccccugcccuuccaaauucaugcucaguuccucccugcucuacgcaauaaacaggaacaaccauggcuaaguucaacagaggccagaaagaugagacucauuacuuucuuaguaucuguuucccauuugacuuaucuuuacauuucauacucaacucuuuucugauuaacauaguaagccuugauauaugaauaagcagauggucugggcaagcagggaauauacuuagaaacauuuaagucauacuccaaacagguuuaaacaaaauuuccucuuuuuuuuugaggaggauuuuuacuguagggggauucucaaaucccccuacaguaaaccagugaauagagaaaggcacugugaugggagaagaaguaaacaguuucagagcucaaauuccagaacaagaaaugucucuagauggaguggguuuugaaaguguuuccuaauuacacuggccuaacuccuuaaucaugagagacacgugcugaaucuucucuaaugcuuccuugucagaaugguagauaacacagaacacuuccagaagcuuaaauaauuuuauuucaugucauuugaguuguuuagguuuccacggcaaaugcugugugcaguuucaaaguuaauugaauauaucucaggaagacuacaauccucgauacuuuaaguuccuuuucugcaggaaaagugcgcggcaaccuuauuagcuugaguuagcuuaguuauguaagcaucucccaacucugaccauuuuaacuacuacucagacacagagacagaagacacauaugcaguacuucagauuauggugggauggacaaaucagauacaagcaagcucuaugaagacaggaaugaacugaaccuuguaucugucuaaagacaaacacuguuacauaauccagcccucaugguaagcuagcgucccacuaaaggugcagcaugccaaaccacucagauggucccacugcauacggaguuccuaccaaagauaucugccauccccuuucccuguuggauuccuuuuugaugcacacagaauggcucuaaguggucucucuaaagcagaacagaguuuguaggucacuuggaguccaaaauagaucagcuagcgguuucucuuggccuagugaucuagauuccaaauuucagaaccuaagaaacucuaucaauguuuaagcaagggaacccuguagauaaccugacguauaugggauggaguuauuuguaucaccuaaaaccuuuuaggccuucucauuccuuagcaucgucucuuuagcccuuggcaacucugaauaugaaaauaaccaagggcuaauuaagacaagaggaaaaauucagaggaucugaacccaggcaaauaugugcuucuuuggucuucccagcucuaucuuuucuugucuuauuaagccaguggcaacccaguugcaugggccaaauucggaauguaauguaaacaagaugcuuuaaccauagaacaggaagaauuuaaguaguaacucacauaaaaaauaaauuuaaaaagcagucuuacuugcuuagcccaaguucagguuuaagacugcaggauccuacaggcaggucacagaacuagcuguacagagcacuugagucaggaauuaacuaccacugcucucacucuauacuuagaacuuugcaaagaagcguuaauuuaggauuuuuaaugguuaagaauuuuuaagccaucuuggugcggaagaacuauucuauauacccaaauacuuaauacaggcauacugugauucacagauacugccuuuaaaaacaaacaaacaaaaaaaaaauuaaagauuucuggcaacccuguuucaagcaagucuaucaagccauuuuuccaacagcaugugcuaacuaccugccugugccauauuuugguaauucucacaauauuucacacuuuuucauuguuauaucuguuaugaugauuugugauuagugaacuuugauguuauuacuguaacuguuuuggggcaccacaaacugcacccauuuaagacaguaaacuuaacaaauguguuuugauugcuccacugacgagccccuccaucucucucccucuccucaggcuucccuauuucuuugagacacaacaauauugaaacuaggcuaauuaauaacuuuacaauggcuucuaagugcucaagugaaaagaagaguagucaagcaucucucacuuuaaaucaaaagcuaaaaaugauaaagcuuaguuagaaacacaugucaaagcugaaagaggccaaacgcuaggccuccuggggcaaacagcaaagcugugaauaugaaaugcuacucuggugaaagccaaaaagucuuauuacugauauggagaaaguuuuaauggucuggacagaagaucaaaccagccacaaauuuccguugagccaaagccuaauccagagaaagucccuaagucuccuuucaggggcuaauagcuggugacuuuaaguuaaagccaaugcucacuggccauuccaaaaauccuagggcccuuuaagaaugcuaaaucuacucugccugugcucuguaguaaauggaacaaaguccggaugacagaacaucuguuuagauaaugguuuacugaauauuuuaagccugcuguugagaccuacugcucagaaaagacucuuuauaauuauuacugcucauugacaauguacauggucacccagaaguuuugaugggagacauacaaggagauuaaugcuguuuucaugcuugguaacaaaauuuccauucugugacccauggaucaaggaguaauuuaaacuuucaaaucuuauuauuuaagaaauacauuuuucauaggcuauagcugccacagauagugauuccucugauggaucuggaaaaaguaaauugaaaaccuucugaaaaagagucaccauucuaggugccauuaagaauaaucaugauucaugggagguggugaaaauaucaaccuuaacaggaauuuagaagaaguuuacuccaacccucauggaugacgauuuugaggguuucaagccuucaguuaaguaacugcagaugugacagaaacaaaaagagaacuaaaguuagaaguggaacccacagauaggacugaauugcugugaucucaugaucaaacauggauuaggaguugcuucuuauggaugagcaaauaaagugguuucuugagaagaaaucuacugcugaagauguugugaauguugaaaugacacaaagaauucagaauauuacauaaacuuaguugauaaagcagcagcaaguucugacaggacugacuccaauuuugaaaguucuguuguggcuuaaaugcuaucaaacagcgccgcaugcuaaagagggaucuuuugugaaaggaagagucaaucuguggggcaaacuucguugcugucuuaagaaauugcuguagucaccccaaccuucagcaaccacuacccugauuagucagcagccaucaacagcaaaacaagacuauccaccagcaaaaaagauuaugauucacugaaggcucagaugcuuguauuuuuuagcaauaaaguauuuuuuuauuuaagguauguacacuguuuuuuagauagaaucuuauuguacacaugauagacuacaguauugugugaauaaaacuuuuauaugcagugggaaaccaaaaaacucaugagacuaacuuuauugugauacuuguuuuauugcagcaguuugaaacugaaccugcaauaucuccgugguaugccuguacccccugaaaaaaaaucucuaguaugaaauacaucacuacgugaauauucagaugacacauagggaacaacuugaugcaguuaccuugccacguauuucaguagcaaaccagugccaaacauacuuuuaggcacuaaaugacuuaauauauuccaaaucuacuccuugggggccacauacugacagugaucacugacauacuuauuucaacaguaacauuuaaaaugacuaugggagcaaaauuucucacaguucaguuaaaagaaacaaggguaaacauguauuuaaagugucuguaucugguauggggaagaaaguauugcacggugauaugaucuggcuguguccccacucaaaucucaucuugaauuguaacucccacaauucccacaugucaugggaggaacucagugggaggugacugaauuaugggggcaggucuuuccugugcuguucuugugauagugaaugagucucaugagaucugaugguuuuaaaaaugggaguuuuccuguacaaguucuuuuucccugcugccaucuauguaagacgugacuugcucuuccuugacuuucaaccuucugccaugauugugaggccuccccagccauguggaacuuuaaguccaauaaaccucuuuuuuuguaaauugcucagucuugguuaugucuuuaucggcagcgugaaaauggacuaauacagcuacacaaaagcugccuguuaacuaaaggcaguaucaauauuacuaaacguuaaaaaauacuaguuucaagguuguuugggagucuuaaagcagucuaauuauaucuuccuuauuagaaucuuccuuagaaacacuagucaaaacacacuguaccaugaaacagaucaguuaacugagauaaagaccaggaagucuuauagauaccugguuauaacccugaugcccaucaagugcccauucugcacaaguuuucacugaaaacuggaggaauucuacugcaagaacaauaaaaauucgguacagugacuaguauauaaguccacuucauuaauuauccauaauaauuuacauuaaauuaggauucuguauuuacauuaaaauauuaaauccucaccacucaacaaaggaaugauuaauagagaauuuuuaagguuacaguggaaacugucuuuccauauuaaaaaaaaaaacucaaaaagcccaauuauucuaaauuuagaaacuaguaaucuuuuucuuuagguagcaauuauaaauauuaacuauacuuaaaauugcacaucucacaaacgaguagaaacaggcucccucaauuuuuuuuuccuaugacaauuaugauuuagucaaaggauauaacauaggaauuagugcccaaacaagcaacauuuuuaaagagcaccuagucucaagucaauuucugcgaugucaacuguauuucauuaaaacacauagcaaaagaaaccuuucucucugguuuggaagaaggaaaacagacucuacuucucuacuacuacucuaccccaaaagaauccucccuucuuuaagauaauggauguuuauaacucaagagccgaacaucuaauuugaucauaguuuaauaagcauuucccauggaauuaaaaaucaaaagcgauuaauauagcugauaagcauaauaacaaggauaccuuacagcugugugacauuuuauugcuuuuguaaacugcuuuuacauaaaguagcugccugugcaauuuuuagaggaucaaauguagcuggaauauugccauacaagguggcuggguaaugaaucaugaaaguuguguuucuuucuuaaaacaggaaaaaaaacaaccugucuucauuuuuugaagaugcauaaaaaauuaguuucucaccuucugguauuucugccaccauuuauaugaacauuggucuucucuugagacagguuuugaaggaaauaucuggcacuuauugagggauucuaauugaacugcagacaugguugaaggcaacacacauucgggaagaauuugcacuuuagcuugcuggauucuaaaauaaagagaaccaagcaugguauucauuucuaagauugacuaacucaaaacuauaaguuucuaaacagugauaauuuuaaauaccaagauuuuccaaguuuuaucuuuuaaacauauucaucaaauacugauguuaagauacagaaacuuucagaaaauaauuuuauuucauaaaucauaccaaaguuaaaaccaaagauaaccuaagguacggaucuucaaugucacuguggaauggaaagggagaucuacacauuucagauaaauacagagucuauaaaugaaacaaaguuuuaaaaaaaccaacauacaaccaacuacugcuugauacuucuacuuucuuaaacauucuuaagacacccaaauucuucuauccccccacuucuuaugcugcuuaacucuuacaucuauccuuucucauaagucaucuaaucuaaguagagaaaggaagagaaaaaucaagaaugcauuuacauggaugaauuaaaauaacacuagagaguuacaugcaaccuuucugugugcauuccuuuucacguucuuaagaguuuaacuguacaaaggaucaaacuauaaauuagauuuuuucuuaaaaguuauuuaaaaugucauaauaaagucauuuccaaaaugcuacuugagaauaucauaauugcaaacaucuuaucaugaacuagugcaaacaggaagguuguaucuaugagcuaucuuccugugaggcauucuaucucuuagaguguagcuucugaaauguagaauauguaacuauauucaaaugcuaguauauaacacugucagacugacaaagucaaauauauuaaaagucucugcuuuauuaguuauacuuaagacuucuaaaguagucuuucauaauaaccacuguuugaccacaagauauuauggaugaaauucugacauuuuacuuauuuauuagaaggaaaaauaacugaguguguuagaaaguaucuaaguuuaauuuaaugauaauaguagacucacucuacuaacuuuauuuccuuccugcaaacucauuagaaauacucagaaaauuugucuacaugacuucggaaaauguuaaaaaauuuuacuauagucaaauuauggucaaguguucuuauauuauuauuagagcucauuagaaacaaaaucucaauuuucuucaccugauucaugaacacaaauaacuuguuaauuacauuaugaagguaaaaguauauaccauccuauagaaauuuuuagaaaucugauucuucaagguuauagguaacugaauuaagaacuaugcuuuacccaacuauuguauaagauuugauuaugauaaaaacaguaacauuauugauccccuggcuuacagaucauguuaauuagucugcaguacaaacugucugaauugccuugaaggauuaaggaaugcucuccuuuaccugguuaaacauggccaggguccacugcauaugcaguggcugguucuucucccagcagcugaguuuuguuuuuaacauaagcuaguuuuuuuucuuuccaacuuguuuaucacaguuguuuugugauuacagcaacauaauuuauauaaauguuauaaaaaccagugaaauaugacuucaacaauaaaacugcuucaaggaacauuaaguugagacauaaacugcuuucaaauuagguacagacuacucuaauaggaaaaaaaccgcacaaaucuggaaaaauucugcacucaaauugccuugugacuaucuuuagaaucccucuuuaaagaaaaacuagcaguauaaacuguggauaauguacaaugaaagugccagaaagucuacagucaucuccaaucugcagaacugcuucaauggaaagaccuuggucucuccagaugaaaaaugaaugaauuuauaaaguuaaaauaaaauguuuaagcuauauauguguaacauuuugugauuuccagcuucagcuaacuuuuugacuaacaauuauuggucucagucuagacagguaagagaucuucucuugugaugccaauaggauaucaauccccuccuccucucuacaugcuaagaaguaggaacuucugaagaguccuaugucagugagaccuguuuuuauuaaaaaaaaauuucuauguguucagaagaugcccacccccccuccgcccuccccaacccacacacacucaugacuuuggggguuguauacuuuuuuucuuuuuugagauggagucucacuguuggcgaagcuggagugcagcgguauaaucucugcucagugcaaccucugccucccagguucaagugguucucaugccucagccucccgaacagcuggaauuacaggcacaggccaccaugcccagcuaauuucuuguauuuuuaguagugaugcagcuucaccauguuggccaagcuggucuugaacugcuggccuuaaaugauucacauaccuuggccuuccagagggcugaaauuacagguaugagucaccacaccuggccucuguaguguacuuuuaauaaaugaagugucauuuagguaaaagauggauauuuauauuuuuuaauuuuuauuuuucuauaugcuuauuucucuaagaaaaacaaaugaauauuaaauauuuuacuggagaaagggaagcuggcuugaguuucaaauguguuauagagaaauucugguauaauggaaggaguaccaguuuggaagucaugggaccuagaaccaaucaggucugucgcuuauuugcuguuuaagcaaauuacuuaaccucucuaguaccuggcauucugauacagaaaaagacgagacugaacuaaaucaacuccagaauuucuuucauuucaccauuuccagugaaggugguuacagggccagagaaguaguggagccaagagaaaucucauuccacagaggccuuuuaaaugaagacagacauacccuuaugagaggccuuaauaaugggucuacagaauacuagagagaaugugcccuuuccaagucuuguccaccuguaucaguuugauguuaaucuuuuuuuuccuuugagauggaguuuuccucuuguugcccaggcuggagugcaguggugccaucuuggcucaccacaaccucugccucccggguucaagcgauucuccugccucagccucccuaguagcugggauuacagucaugcgccaccaugcccggcuaacuuuguauuuuuaguagagaugggguuucuccauguuggucaggcugaucucaaacucgugagcucaggugaucguccugccuuggccucccaaaauacugggauuacaggcaugagccacugugcgcggccugauguuaaucuuuacuagagucaaaaauccauuccuugucuuguuuucagaguuaacgguauacugccaucuuguguucaauaguuuuuccacaaucaaaagucacuaaugucaagacagucugagaaauauacuuuuccccaagucaauuuuccuuaaugauuucuauaaaaguauucacaaauaaucaaaauuguaugaagauaagaaguacuuuaaaaauggaacuguuagcaaaauccacaguaacaaaacaguuugcuaauuaucauaaugcagaccacccccacccgccccaggagaucauucuuucauucauuuauauaaaauuuaugguccuaaauguaaaacauaaauaagucuuggucauuguucucaagcagcuuaucuauugagggagacguacauaaaauccugucaggacagugcaaugugguaaggcuaucaaaguuugcacagugaauguucuggaaaaguaccuggggagaacuaaacacccuaagagcucuggcaaucccaucucacaugccucuaugcucucuuuagcuccaaggagcuaccugacaugucaauauuuucauaauucaaaaauauauaggaacgcccaccaugugaacaaaacagacaaaacguuccugcccucaugcugcucacauuguuuuuucagucuuaaucccccaccccgcccaaaaaaaccccaaaauacucagaacuugcauguguucagaagauaccaccugggcaacacagaggucugaugagauuuucaacuguggguauaaauuggaaaccaauucacuaguacuuguauugcguaccaggacuguguaucugugagaccucacgggugaugccacaguuuagaagcacuccguuaagagguaauauccagugaucaaggcaaaugcuuuguuuccuuuuuaaaagaggauaaaauaaacuggacuuuuuugugucuguuuuaauguguaucccuugaauuugugcaaaacccagccaugacagcuuugucaaaaugaauuacugcugaaacaguauacucagggaauuucuaaaugucacaaggcacauagacuacaaguauuuauugaucauuuauuauguaaauagcauuucugggugauauaaaauucacacuggagagggacacgaaauauaaauggcuuuuauagcucagcuggagcaguaggcagauguaaccaguguggcuuucaaacaucauagcaaugcuacaaaaaccacagcuguccuggugagcacacgaacagcucacaagccucuggucucccuauccucuuaugcuccgagaggccuucaauccuaaagaagccaaaucccaaacaacacuucccuuuggauuuacaugauuguucucaaaccuggagagacauuagaaucaccugaaaaucauuuuuaaaagaugcugcagccucaucacucucuggagaugggagaugagguuggaacucaagcuucuauaguuuuaaaagcuucccaggugauucugaugcauagcaagguuggaaaccacugggcuauaccuuagaagggaaagagaacaacuaguuaaaaguuacaaaauaugaaggcucaguagaacagaaaaaguacaagaaaacuauuucauuaggaaacauucaaagagcauuaagguauauguuauuucuuacccaucugacuguguucuuagcucaaggacuuugaaccuuugucuuccaauugcuuucacuuucacuaucucaauuccaaaauccuguucuucucgauaggcauauaucucugcuguuguuccaaacugugcuucccuuuccuguacauugcuuccaagaaaauuuuaaaaggaaagaauuuugaacauuugaguuuuaaauauaugcaaaguaggcaaagcaauaaauacagguaaacaauuuauagaaucaacccuuacuacaaagcuaggauaauuuuauuuauuuauuuauuuguuugagauggagucucgcugcguugcccagacuagagagcaguggcaugagcucggcuugcugcagccucugccucccagguucaagugauucuccugccccagcugccugaguagcugggauuacaggcacauaccaccacgccuggcuaauuuuuguauuuuuaguagagacgggguuucaccauguuggucaggcuggucucaaacucccgaccucaggugauccacccgccucggccucccaaagugcugggaguauaggcgugagcuaccaugcccggccaauuuuauuuauuuuuaaaucacaugggggauauacaagaaggacucaggaaguacaauuagagaacuuuaggaaaauaauagauuucuagucacugaaaauaauuuagaacuuacagggguuuaaacucauuucccaaaccaaacauucuuucacucugucaaaugacuuaucauuucugcugcuuacuggcagcacuguacuggggugggagcuuccuguauguauuuccugccucuaccgcagauuuccuuuauuugccaugggauacuuaaaauucagcuucaauuuaaagugguacaaccuaugaauuuugagagagagggaaagaaaagaccacucuuuuggaaaaguaauccuuuacguuaaaauaaaaaagcacuacuucucuauaaugaagacaguuauugaaacuaagauuccagaaauguuuuucaucaaauauaaaugauuaaaaauuuuucaaauaccagaaaguuaaauuguguaugaaggugaagagcugaguuagaugguaaugaaaugaacaaaaauacuccaacuugcacuaucaaacuucuacuuaaccaaauuccuaaccucacauucuuacccaaccucuccuguacaugcgaaauaacagccugcuuuggcuucaacacugaccacugcaauuacccaugagagggaauguauuaagcaaauggacucuaauauuuuaccuguaugcaagaacagcaaagguucuaucuuucugaauuaaauuccgcaccauacugacuucuugagggugaaaaagcugaagagguaaugucuguccgggaaucaggaucaucaucacuuguggaagaacuggaaucaccugacagcugucgucaucgugcaaaguccugccaugaaauucuuccauaucagcaccuagguacuauauaaaaacauauauagguauagugucaugaucgauauguaauaaaaauguaagcucaacagacuaaagagcaaaucacauuaaaagaaauacaggccgggcacaguggcucacaccuguaauuccagcacuuugggaggccgagguaggcggaucaccugaggucaggaguucaagaccaaccuggccaacaugguggaacccuguugcuacuaaaaauacaaaaauuagccagguguggugguggacaccuguaaucccagcuaaucgggaggcugaggcaggggaaucacuugaaccuggaagguggaggcugcagugagcugagauugugccacugcacucacucgagcuugggcgacagagcaacacucugucucaaaaaaaaagaaaaaaauacaaaugggguuacaaacacuuaauaaacgugguauauaagcaucccauguuaaaauauaauuuuuaaucuaacuuuaacucuuagaagaauuucuaaucuuuuaugaauauaucacaaacacagaaauucaagaauuuuuuuaguacaaaguauuauuuuuaccaagaaauaucucuaugcccacauaucacaaacaguaaguauaaaauguuaguauguucaauaacacucuaguaccuagaaguacagagaaguauuuaauagcucaauuaccagaaagaguauaaagagcaacaauuccucaaacaauucuaccacaacauaguauuaagcuucuuaaaaauuacaguuaaauguuuaucuacuggcaaauagcccauguccucauccacaauuucugauaucuaguaauacaaauaucagucacuuguuuuuaugaacuuuuaucuacauuuaaauguauaucuauuauauuagaucugucacuaaauuacauacuguaugugaugucggcagacuggugucaaaauuuaugauguuugguuuuuuggcuucuuuacuauccuggucuucaacuuccauuucaucuucuuccucacucucugcuauaaaaguagaauauuguaagaaaaaaaaaaagaugaaugaaaaccuuucaaacauguaauuccuucuucaaaagagggguacuucuaaaaccacaugcauuugguaaacucuacagcaccgugaagagggagccagaggacugggguccgugcugggcucugucaguagcuauuuuuuuuuuuuaagucaacugugaauuuuagaauaguuuaacauuuacagagaaguguaaagauaguacagaaugcucccgugugucacacauccuuuuccccuauaguuaauuuauauuaguaugguacauuugccacaacgaaggaaucagucuugguacauuacucuaacuaagcuucauauuuuaaauggauucccuuaguuuuuaucuagucuuuuugcguuccaggaucccacuuuacauuuaguuaucaggucccccuacccuccucugggcuagggggguuuucagacuuugcuuguuucugaguuuugaggaguacuggucaggccuuuuguagaguaucccucaacuggguuuuguuugauguaauucccaugauuagacugaggauacguguuuuagggaggaagaccacagaagugaaguguuguuauucuuuuccuuuuuagaaauggggucuguugccaaugugcuguuuuuauuacauauccagccuauauauuaugaacuauuccugcuguuaaccuugaucaccuggcuacagcagugugugucagguuuuuccgcuguaaaguuccuuuccccccuccuuuucacauuguacccuucggaagcaaaucacuagguguagccuccacuucaggggugaugaguuaugcuccacucccuugaagaggaaauguaaguuauuuaaaauucuucuauaugggagauuuuucucuucucccucaccaguaacuaauuuuaacaccuuagacaacucauucugcccaauuaaauuuuaguuuccucaucugcaaaaugauaggcuucaacaagucaaccucuaacguucucucaaacucucaacuucaaucaguuccuacauaaguaagaaaagaaacaaagcaggcaagaucuguuaauuaaaacugagagaaagauaaccuagcaggaagaauuucacagcauuuuucuagugacaacauuucccuggcagucgcuacauuaucuuaaaaugaaggccaggugugguggcucacaccuguaaucccagcacuuugggaggacgaggcaggcagaucacuugaggucaggaguucaagaccagccuggccaacauguugcaaccccaucucuacuaaaaacacaaaaguuagccgggugugguuguaggugccuguaaucccagcuacuggggaggcugaggcaggagaaucgcuugaacccaggagguggagguugcagugagcugagauugugcuauugcacuccagccugggcgacagagcaagacuccaucucaaaagaaagaaacaaagaaaauuuugcaaucauuugcauacuauuuugcuuaauuuuaaauuuaaaaauaaaguuugcaugaagcauaaaacauuuuaaaagaaugucuuagaaaaccagauguuaccaaugacagcaaagaaaauuagaaaacgcuacacaauacauaugcuauuguacuaacugugagucuguccuuuucauacaaacuaugaguaaauuuccuauccuagaccagugacucucaaccacaggugauuuugccccucaggggauauugguugcaauaacuaagggaguccuacuggcaucuaguggguagaggccagggaugcagcuaaauauccuacaaugcacgagacaaucccacccaaagaauucuccagcccaaaaguccagugcugagguugggagacccuggccuagacuaacaauaaagaauuacugaaucucauuucucaccucccaguucauguauuuuuaaaugccccaaauaaacuucuaaaucgauaaaaugucauuacgaaauaaucauuuguuuuccuuugcauaucauuauuuaagucaaaccaccucuagccaggccccugacagaaaauaaaaaugauuuucaauaugguaacugccuuggacuuucuauuuauuauuacaacuuccuagauauaaaacuuugucaaaaacagaauuacuucaacuuauauguaaauagccaauggucuaacacuucauacaaauuuuccuuggaacauguaaguuucacugagauaaaaaaagagcuaucuaaauggaugacaaaaauauucugcaucaaauuguuuguauuuccaacucugacaguauggcuaucacuuggcaugcagcacaacccacuuuauugcucuacuacagaaaguuuaaaagauaaacuauuagcucaaaggcuggaauuaauauuguuaaaaauuuacauuuuaacuguucugacuccuagucucuaaauaauuucuuuaguaaccuuuuuuucauaaauauggcuaaaaaccacuuuccccuacucaguuauguuuauuaauguuucauuugccuaggauaaacucuucacaucucaaauauaaagcuuuuuguuggaacuuagaggauuuacucuucagaacaacucguacuacauggaauuauggaaagcccaguguuucccuacaaauaaaauuuacguaauuuggagaggcauuauugcuauaucuacaccaucucugggcccucucccgacgcuuuucugaaaaacaaaaaacaaaacaaaacaaacaaaaaaaaaacaaacaaaaaaccacgcugacuguucagagcuaucagugaagucugaugacucaucucaugcagaggcacgaugugaaugucgacagaagaucaguauccucccucuucuauucaccauucucccugaaacaccggauuuggcacagagaguagggcuaaugucucugaaaaaauagcucagcuuuccaucaaaggcuggcacacuuacccuugugucaacucagcuagaauggcuucgagaacaaccagugacuaugguuuauuuuuacagaaaaguucucuccuauauggugggcacgcacucagucucuuccucuuuuaauccaugcugcuaccaguggacaaauuaaucuuccaagcauagauuucuuuaggcaauuaccugaaaccuaaaacuguuucuuggcaauccacaggaaaaacccaaacccacuggcaagagaugccaguuucccagcaacuuagacccaauauaccuccuaggccuuaugucccacaaccauauccuaaauaugugcuuuuagaugucuccugaucuaccugaaaggcuuuuucccaaauccucugacccuuaaacaaccucugccucugaagagccacaacagcauucauuuaucuggcccuaaaucaaccgccucugcaguugauuuacguuuaguuauauucucagcagccccgccuagacaguaaaccucaauuaucagauuguguauuaccucucguuucaucuccacaacaccuaacauacuugucauauaacgaagggacucaaguaauacuuucaaguuuggaugauacaccuuuuggaaagcaucucuugaaaggcauuccaugaaaaguuuaugcaauauuccaugcauuuuuuuuuuuguucaguauuucaacacaaggccaaagucuaaacauuucacacaacauacaggaaaaagaaaaacuaaguaucucugauuaagcauaaucguacaugccugagaaagaccgauaguaagaaaaacaaaacagagaagugguuuagagauauaaugacagacacacccggguuggaauccugacucugcugugugaccuugggcaagucauugaacuaaucugcaaauccaauacucgcuuaucaaaucggaaacugaaaacugaugugggaaggauuaaaaggcgacaugcaugcaaagcguuaacugcacggcucguaacaugguaagugcuuaguacauguuagcugucacucuuauuaaaaggaaggagaccagcaaaaguaaccgcugugaaucugacccgguccucuaguuucagagcauuuccuaggagcuaaacucagaacacaaggaggauggagaggauggguuuccuguucuuaauagcaaaugcuccccccgacacccuggcucacggcucggggcaacagagcagcgaagaaagcgccgcgacuccaucgcuggccgagggccgacgugaagcagcuuuccggugcggcccugcugggcuggcucgccaggcuuggcgcccccacgcccgccucccaggcccagcugcaccgcuagcggcuccgagccucgccccacucccgacuacagggaacuacuccgggcgguuaccaggcaggagcggcaggugguugcccauguugugcgcagcguccugcugaucuccuucgccggccaugucuguuuacccgcaaaggaggcugggacag

SEQ ID NO: 14826 - RNA, 32963 nt, Homo sapiens
cugucccagccuccuuugcggguaaacagacauggccggcgaaggagaucagcaggacgcugcgcacaacaugggcaaccaccugccgcuccugccugguaaccgcccggaguaguucccuguagucgggaguggggcgaggcucggagccgcuagcggugcagcugggccugggaggcgggcgugggggcgccaagccuggcgagccagcccagcagggccgcaccggaaagcugcuucacgucggcccucggccagcgauggagucgcggcgcuuucuucgcugcucuguugccccgagccgugagccagggugucggggggagcauuugcuauuaagaacaggaaacccauccucuccauccuccuuguguucugaguuuagcuccuaggaaaugcucugaaacuagaggaccgggucagauucacagcgguuacuuuugcuggucuccuuccuuuuaauaagagugacagcuaacauguacuaagcacuuaccauguuacgagccgugcaguuaacgcuuugcaugcaugucgccuuuuaauccuucccacaucaguuuucaguuuccgauuugauaagcgaguauuggauuugcagauuaguucaaugacuugcccaaggucacacagcagagucaggauuccaacccgggugugucugucauuauaucucuaaaccacuucucuguuuuguuuuucuuacuaucggucuuucucaggcauguacgauuaugcuuaaucagagauacuuaguuuuucuuuuuccuguauguugugugaaauguuuagacuuuggccuuguguugaaauacugaacaaaaaaaaaaaugcauggaauauugcauaaacuuuucauggaaugccuuucaagagaugcuuuccaaaagguguaucauccaaacuugaaaguauuacuugagucccuucguuauaugacaaguauguuagguguuguggagaugaaacgagagguaauacacaaucugauaauugagguuuacugucuaggcggggcugcugagaauauaacuaaacguaaaucaacugcagaggcgguugauuuagggccagauaaaugaaugcuguuguggcucuucagaggcagagguuguuuaagggucagaggauuugggaaaaagccuuucagguagaucaggagacaucuaaaagcacauauuuaggauaugguugugggacauaaggccuaggagguauauugggucuaaguugcugggaaacuggcaucucuugccaguggguuuggguuuuuccuguggauugccaagaaacaguuuuagguuucagguaauugccuaaagaaaucuaugcuuggaagauuaauuuguccacugguagcagcauggauuaaaagaggaagagacugagugcgugcccaccauauaggagagaacuuuucuguaaaaauaaaccauagucacugguuguucucgaagccauucuagcugaguugacacaaggguaagugugccagccuuugauggaaagcugagcuauuuuuucagagacauuagcccuacucucugugccaaauccgguguuucagggagaauggugaauagaagagggaggauacugaucuucugucgacauucacaucgugccucugcaugagaugagucaucagacuucacugauagcucugaacagucagcgugguuuuuuguuuguuuuuuuuuuguuuguuuuguuuuguuuuuuguuuuucagaaaagcgucgggagagggcccagagaugguguagauauagcaauaaugccucuccaaauuacguaaauuuuauuuguagggaaacacugggcuuuccauaauuccauguaguacgaguuguucugaagaguaaauccucuaaguuccaacaaaaagcuuuauauuugagaugugaagaguuuauccuaggcaaaugaaacauuaauaaacauaacugaguaggggaaagugguuuuuagccauauuuaugaaaaaaagguuacuaaagaaauuauuuagagacuaggagucagaacaguuaaaauguaaauuuuuaacaauauuaauuccagccuuugagcuaauaguuuaucuuuuaaacuuucuguaguagagcaauaaaguggguugugcugcaugccaagugauagccauacugucagaguuggaaauacaaacaauuugaugcagaauauuuuugucauccauuuagauagcucuuuuuuuaucucagugaaacuuacauguuccaaggaaaauuuguaugaaguguuagaccauuggcuauuuacauauaaguugaaguaauucuguuuuugacaaaguuuuauaucuaggaaguuguaauaauaaauagaaaguccaaggcaguuaccauauugaaaaucauuuuuauuuucugucaggggccuggcuagaggugguuugacuuaaauaaugauaugcaaaggaaaacaaaugauuauuucguaaugacauuuuaucgauuuagaaguuuauuuggggcauuuaaaaauacaugaacugggaggugagaaaugagauucaguaauucuuuauuguuagucuaggccagggucucccaaccucagcacuggacuuuugggcuggagaauucuuugggugggauugucucgugcauuguaggauauuuagcugcaucccuggccucuacccacuagaugccaguaggacucccuuaguuauugcaaccaauauccccugaggggcaaaaucaccugugguugagagucacuggucuaggauaggaaauuuacucauaguuuguaugaaaaggacagacucacaguuaguacaauagcauauguauuguguagcguuuucuaauuuucuuugcugucauugguaacaucugguuuucuaagacauucuuuuaaaauguuuuaugcuucaugcaaacuuuauuuuuaaauuuaaaauuaagcaaaauaguaugcaaaugauugcaaaauuuucuuuguuucuuucuuuugagauggagucuugcucugucgcccaggcuggagugcaauagcacaaucucagcucacugcaaccuccaccuccuggguucaagcgauucuccugccucagccuccccaguagcugggauuacaggcaccuacaaccacacccggcuaacuuuuguguuuuuaguagagaugggguugcaacauguuggccaggcuggucuugaacuccugaccucaagugaucugccugccucguccucccaaagugcugggauuacaggugugagccaccacaccuggccuucauuuuaagauaauguagcgacugccagggaaauguugucacuagaaaaaugcugugaaauucuuccugcuagguuaucuuucucucaguuuuaauuaacagaucuugccugcuuuguuucuuuucuuacuuauguaggaacugauugaaguugagaguuugagagaacguuagagguugacuuguugaagccuaucauuuugcagaugaggaaacuaaaauuuaauugggcagaaugaguugucuaagguguuaaaauuaguuacuggugagggagaagagaaaaaucucccauauagaagaauuuuaaauaacuuacauuuccucuucaagggaguggagcauaacucaucaccccugaaguggaggcuacaccuagugauuugcuuccgaaggguacaaugugaaaaggaggggggaaaggaacuuuacagcggaaaaaccugacacacacugcuguagccaggugaucaagguuaacagcaggaauaguucauaauauauaggcuggauauguaauaaaaacagcacauuggcaacagaccccauuucuaaaaaggaaaagaauaacaacacuucacuucuguggucuuccucccuaaaacacguauccucagucuaaucaugggaauuacaucaaacaaaacccaguugagggauacucuacaaaaggccugaccaguacuccucaaaacucagaaacaagcaaagucugaaaaccccccuagcccagaggaggguagggggaccugauaacuaaauguaaagugggauccuggaacgcaaaaagacuagauaaaaacuaagggaauccauuuaaaauaugaagcuuaguuagaguaauguaccaagacugauuccuucguuguggcaaauguaccauacuaauauaaauuaacuauaggggaaaaggaugugugacacacgggagcauucuguacuaucuuuacacuucucuguaaauguuaaacuauucuaaaauucacaguugacuuaaaaaaaaaaaauagcuacugacagagcccagcacggaccccaguccucuggcucccucuucacggugcuguagaguuuaccaaaugcaugugguuuuagaaguaccccucuuuugaagaaggaauuacauguuugaaagguuuucauucaucuuuuuuuuuuucuuacaauauucuacuuuuauagcagagagugaggaagaagaugaaauggaaguugaagaccaggauaguaaagaagccaaaaaaccaaacaucauaaauuuugacaccagucugccgacaucacauacaguauguaauuuagugacagaucuaauauaauagauauacauuuaaauguagauaaaaguucauaaaaacaagugacugauauuuguauuacuagauaucagaaauuguggaugaggacaugggcuauuugccaguagauaaacauuuaacuguaauuuuuaagaagcuuaauacuauguugugguagaauuguuugaggaauuguugcucuuuauacucuuucugguaauugagcuauuaaauacuucucuguacuucuagguacuagaguguuauugaacauacuaacauuuuauacuuacuguuugugauaugugggcauagagauauuucuugguaaaaauaauacuuuguacuaaaaaaauucuugaauuucuguguuugugauauauucauaaaagauuagaaauucuucuaagaguuaaaguuagauuaaaaauuauauuuuaacaugggaugcuuauauaccacguuuauuaaguguuuguaaccccauuuguauuuuuuucuuuuuuuuugagacagaguguugcucugucgcccaagcucgagugagugcaguggcacaaucucagcucacugcagccuccaccuuccagguucaagugauuccccugccucagccucccgauuagcugggauuacagguguccaccaccacaccuggcuaauuuuuguauuuuuaguagcaacaggguuccaccauguuggccagguuggucuugaacuccugaccucaggugauccgccuaccucggccucccaaagugcuggaauuacaggugugagccacugugcccggccuguauuucuuuuaaugugauuugcucuuuagucuguugagcuuacauuuuuauuacauaucgaucaugacacuauaccuauauauguuuuuauauaguaccuaggugcugauauggaagaauuucauggcaggacuuugcacgaugacgacagcugucaggugauuccaguucuuccacaagugaugaugauccugauucccggacagacauuaccucuucagcuuuuucacccucaagaagucaguauggugcggaauuuaauucagaaagauagaaccuuugcuguucuugcauacagguaaaauauuagaguccauuugcuuaauacauucccucucauggguaauugcaguggucaguguugaagccaaagcaggcuguuauuucgcauguacaggagagguuggguaagaaugugagguuaggaauuugguuaaguagaaguuugauagugcaaguuggaguauuuuuguucauuucauuaccaucuaacucagcucuucaccuucauacacaauuuaacuuucugguauuugaaaaauuuuuaaucauuuauauuugaugaaaaacauuucuggaaucuuaguuucaauaacugucuucauuauagagaaguagugcuuuuuuauuuuaacguaaaggauuacuuuuccaaaagaguggucuuuucuuucccucucucucaaaauucauagguuguaccacuuuaaauugaagcugaauuuuaaguaucccauggcaaauaaaggaaaucugcgguagaggcaggaaauacauacaggaagcucccaccccaguacagugcugccaguaagcagcagaaaugauaagucauuugacagagugaaagaauguuugguuugggaaaugaguuuaaaccccuguaaguucuaaauuauuuucagugacuagaaaucuauuauuuuccuaaaguucucuaauuguacuuccugaguccuucuuguauaucccccaugugauuuaaaaauaaauaaaauuggccgggcaugguagcucacgccuauacucccagcacuuugggaggccgaggcggguggaucaccugaggucgggaguuugagaccagccugaccaacauggugaaaccccgucucuacuaaaaauacaaaaauuagccaggcguggugguaugugccuguaaucccagcuacucaggcagcuggggcaggagaaucacuugaaccugggaggcagaggcugcagcaagccgagcucaugccacugcucucuagucugggcaacgcagcgagacuccaucucaaacaaauaaauaaauaaauaaaauuauccuagcuuuguaguaaggguugauucuauaaauuguuuaccuguauuuauugcuuugccuacuuugcauauauuuaaaacucaaauguucaaaauucuuuccuuuuaaaauuuucuuggaagcaauguacaggaaagggaagcacaguuuggaacaacagcagagauauaugccuaucgagaagaacaggauuuuggaauugagauagugaaagugaaagcaauuggaagacaaagguucaaaguccuugagcuaagaacacagucagauggguaagaaauaacauauaccuuaaugcucuuugaauguuuccuaaugaaauaguuuucuuguacuuuuucuguucuacugagccuucauauuuuguaacuuuuaacuaguuguucucuuucccuucuaagguauagcccagugguuuccaaccuugcuaugcaucagaaucaccugggaagcuuuuaaaacuauagaagcuugaguuccaaccucaucucccaucuccagagagugaugaggcugcagcaucuuuuaaaaaugauuuucaggugauucuaaugucucuccagguuugagaacaaucauguaaauccaaagggaaguguuguuugggauuuggcuucuuuaggauugaaggccucucggagcauaagaggauagggagaccagaggcuugugagcuguucgugugcucaccaggacagcugugguuuuuguagcauugcuaugauguuugaaagccacacugguuacaucugccuacugcuccagcugagcuauaaaagccauuuauauuucgugucccucuccagugugaauuuuauaucacccagaaaugcuauuuacauaauaaaugaucaauaaauacuuguagucuaugugccuugugacauuuagaaauucccugaguauacuguuucagcaguaauucauuuugacaaagcugucauggcuggguuuugcacaaauucaagggauacacauuaaaacagacacaaaaaaguccaguuuauuuuauccucuuuuaaaaaggaaacaaagcauuugccuugaucacuggauauuaccucuuaacggagugcuucuaaacuguggcaucacccgugaggucucacagauacacaguccugguacgcaauacaaguacuagugaauugguuuccaauuuauacccacaguugaaaaucucaucagaccucuguguugcccaggugguaucuucugaacacaugcaaguucugaguauuuugggguuuuuuugggcggggugggggauuaagacugaaaaaacaaugugagcagcaugagggcaggaacguuuugucuguuuuguucacauggugggcguuccuauauauuuuugaauuaugaaaauauugacaugucagguagcuccuuggagcuaaagagagcauagaggcaugugagaugggauugccagagcucuuaggguguuuaguucuccccagguacuuuuccagaacauucacugugcaaacuuugauagccuuaccacauugcacuguccugacaggauuuuauguacgucucccucaauagauaagcugcuugagaacaaugaccaagacuuauuuauguuuuacauuuaggaccauaaauuuuauauaaaugaaugaaagaaugaucuccuggggcggguggggguggucugcauuaugauaauuagcaaacuguuuuguuacuguggauuuugcuaacaguuccauuuuuaaaguacuucuuaucuucauacaauuuugauuauuugugaauacuuuuauagaaaucauuaaggaaaauugacuuggggaaaaguauauuucucagacugucuugacauuagugacuuuugauuguggaaaaacuauugaacacaagauggcaguauaccguuaacucugaaaacaagacaaggaauggauuuuugacucuaguaaagauuaacaucaggccgcgcacaguggcucaugccuguaaucccaguauuuugggaggccaaggcaggacgaucaccugagcucacgaguuugagaucagccugaccaacauggagaaaccccaucucuacuaaaaauacaaaguuagccgggcaugguggcgcaugacuguaaucccagcuacuagggaggcugaggcaggagaaucgcuugaacccgggaggcagagguuguggugagccaagauggcaccacugcacuccagccugggcaacaagaggaaaacuccaucucaaaggaaaaaaaagauuaacaucaaacugauacagguggacaagacuuggaaagggcacauucucucuaguauucuguagacccauuauuaaggccucucauaaggguaugucugucuucauuuaaaaggccucuguggaaugagauuucucuuggcuccacuacuucucuggcccuguaaccaccuucacuggaaauggugaaaugaaagaaauucuggaguugauuuaguucagucucgucuuuuucuguaucagaaugccagguacuagagagguuaaguaauuugcuuaaacagcaaauaagcgacagaccugauugguucuaggucccaugacuuccaaacugguacuccuuccauuauaccagaauuucucuauaacacauuugaaacucaagccagcuucccuuucuccaguaaaauauuuaauauucauuuguuuuucuuagagaaauaagcauauagaaaaauaaaaauuaaaaaauauaaauauccaucuuuuaccuaaaugacacuucauuuauuaaaaguacacuacagaggccagguguggugacucauaccuguaauuucagcccucuggaaggccaagguaugugaaucauuuaaggccagcaguucaagaccagcuuggccaacauggugaagcugcaucacuacuaaaaauacaagaaauuagcugggcaugguggccugugccuguaauuccagcuguucgggaggcugaggcaugagaaccacuugaaccugggaggcagagguugcacugagcagagauuauaccgcugcacuccagcuucgccaacagugagacuccaucucaaaaaagaaaaaaaguauacaacccccaaagucaugaguguguguggguuggggagggcggagggggggugggcaucuucugaacacauagaaauuuuuuuuuaauaaaaacaggucucacugacauaggacucuucagaaguuccuacuucuuagcauguagagaggaggaggggauugauauccuauuggcaucacaagagaagaucucuuaccugucuagacugagaccaauaauuguuagucaaaaaguuagcugaagcuggaaaucacaaaauguuacacauauauagcuuaaacauuuuauuuuaacuuuauaaauucauucauuuuucaucuggagagaccaaggucuuuccauugaagcaguucugcagauuggagaugacuguagacuuucuggcacuuucauuguacauuauccacaguuuauacugcuaguuuuucuuuaaagagggauucuaaagauagucacaaggcaauuugagugcagaauuuuuccagauuugugcgguuuuuuuccuauuagaguagucuguaccuaauuugaaagcaguuuaugucucaacuuaauguuccuugaagcaguuuuauuguugaagucauauuucacugguuuuuauaacauuuauauaaauuauguugcuguaaucacaaaacaacugugauaaacaaguuggaaagaaaaaaaacuagcuuauguuaaaaacaaaacucagcugcugggagaagaaccagccacugcauaugcaguggacccuggccauguuuaaccagguaaaggagagcauuccuuaauccuucaaggcaauucagacaguuuguacugcagacuaauuaacaugaucuguaagccaggggaucaauaauguuacuguuuuuaucauaaucaaaucuuauacaauaguuggguaaagcauaguucuuaauucaguuaccuauaaccuugaagaaucagauuucuaaaaauuucuauaggaugguauauacuuuuaccuucauaauguaauuaacaaguuauuuguguucaugaaucaggugaagaaaauugagauuuuguuucuaaugagcucuaauaauaauauaagaacacuugaccauaauuugacuauaguaaaauuuuuuaacauuuuccgaagucauguagacaaauuuucugaguauuucuaaugaguuugcaggaaggaaauaaaguuaguagagugagucuacuauuaucauuaaauuaaacuuagauacuuucuaacacacucaguuauuuuuccuucuaauaaauaaguaaaaugucagaauuucauccauaauaucuuguggucaaacagugguuauuaugaaagacuacuuuagaagucuuaaguauaacuaauaaagcagagacuuuuaauauauuugacuuugucagucugacaguguuauauacuagcauuugaauauaguuacauauucuacauuucagaagcuacacucuaagagauagaaugccucacaggaagauagcucauagauacaaccuuccuguuugcacuaguucaugauaagauguuugcaauuaugauauucucaaguagcauuuuggaaaugacuuuauuaugacauuuuaaauaacuuuuaagaaaaaaucuaauuuauaguuugauccuuuguacaguuaaacucuuaagaacgugaaaaggaaugcacacagaaagguugcauguaacucucuaguguuauuuuaauucauccauguaaaugcauucuugauuuuucucuuccuuucucuacuuagauuagaugacuuaugagaaaggauagauguaagaguuaagcagcauaagaaguggggggauagaagaauuugggugucuuaagaauguuuaagaaaguagaaguaucaagcaguaguugguuguauguugguuuuuuuaaaacuuuguuucauuuauagacucuguauuuaucugaaauguguagaucucccuuuccauuccacagugacauugaagauccguaccuuagguuaucuuugguuuuaacuuugguaugauuuaugaaauaaaauuauuuucugaaaguuucuguaucuuaacaucaguauuugaugaauauguuuaaaagauaaaacuuggaaaaucuugguauuuaaaauuaucacuguuuagaaacuuauaguuuugaguuagucaaucuuagaaaugaauaccaugcuugguucucuuuauuuuagaauccagcaagcuaaagugcaaauucuucccgaauguguguugccuucaaccaugucugcaguucaauuagaaucccucaauaagugccagauauuuccuucaaaaccugucucaagagaagaccaauguucauauaaaugguggcagaaauaccagaaggugagaaacuaauuuuuuaugcaucuucaaaaaaugaagacagguuguuuuuuuuccuguuuuaagaaagaaacacaacuuucaugauucauuacccagccaccuuguauggcaauauuccagcuacauuugauccucuaaaaauugcacaggcagcuacuuuauguaaaagcaguuuacaaaagcaauaaaaugucacacagcuguaagguauccuuguuauuaugcuuaucagcuauauuaaucgcuuuugauuuuuaauuccaugggaaaugcuuauuaaacuaugaucaaauuagauguucggcucuugaguuauaaacauccauuaucuuaaagaagggaggauucuuuugggguagaguaguaguagagaaguagagucuguuuuccuucuuccaaaccagagagaaagguuucuuuugcuauguguuuuaaugaaauacaguugacaucgcagaaauugacuugagacuaggugcucuuuaaaaauguugcuuguuugggcacuaauuccuauguuauauccuuugacuaaaucauaauugucauaggaaaaaaaaauugagggagccuguuucuacucguuugugagaugugcaauuuuaaguauaguuaauauuuauaauugcuaccuaaagaaaaagauuacuaguuucuaaauuuagaauaauugggcuuuuugaguuuuuuuuuuuaauauggaaagacaguuuccacuguaaccuuaaaaauucucuauuaaucauuccuuuguugaguggugaggauuuaauauuuuaauguaaauacagaauccuaauuuaauguaaauuauuauggauaauuaaugaaguggacuuauauacuagucacuguaccgaauuuuuauuguucuugcaguagaauuccuccaguuuucagugaaaacuugugcagaaugggcacuugaugggcaucaggguuauaaccagguaucuauaagacuuccuggucuuuaucucaguuaacugaucuguuucaugguacaguguguuuugacuaguguuucuaaggaagauucuaauaaggaagauauaauuagacugcuuuaagacucccaaacaaccuugaaacuaguauuuuuuaacguuuaguaauauugauacugccuuuaguuaacaggcagcuuuuguguagcuguauuaguccauuuucacgcugccgauaaagacauaaccaagacugagcaauuuacaaaaaaagagguuuauuggacuuaaaguuccacauggcuggggaggccucacaaucauggcagaagguugaaagucaaggaagagcaagucacgucuuacauagauggcagcagggaaaaagaacuuguacaggaaaacucccauuuuuaaaaccaucagaucucaugagacucauucacuaucacaagaacagcacaggaaagaccugcccccauaauucagucaccucccacugaguuccucccaugacaugugggaauugugggaguuacaauucaagaugagauuugaguggggacacagccagaucauaucaccgugcaauacuuucuuccccauaccagauacagacacuuuaaauacauguuuacccuuguuucuuuuaacugaacugugagaaauuuugcucccauagucauuuuaaauguuacuguugaaauaaguaugucagugaucacugucaguauguggcccccaaggaguagauuuggaauauauuaagucauuuagugccuaaaaguauguuuggcacugguuugcuacugaaauacguggcaagguaacugcaucaaguuguucccuaugugucaucugaauauucacguagugauguauuucauacuagagauuuuuuuucaggggguacaggcauaccacggagauauugcagguucaguuucaaacugcugcaauaaaacaaguaucacaauaaaguuagucucaugaguuuuuugguuucccacugcauauaaaaguuuuauucacacaauacuguagucuaucauguguacaauaagauucuaucuaaaaaacaguguacauaccuuaaauaaaaaaauacuuuauugcuaaaaaauacaagcaucugagccuucagugaaucauaaucuuuuuugcugguggauagucuuguuuugcuguugauggcugcugacuaaucaggguagugguugcugaagguuggggugacuacagcaauuucuuaagacagcaacgaaguuugccccacagauugacucuuccuuucacaaaagaucccucuuuagcaugcggcgcuguuugauagcauuuaagccacaacagaacuuucaaaauuggagucaguccugucagaacuugcugcugcuuuaucaacuaaguuuauguaauauucugaauucuuugugucauuucaacauucacaacaucuucagcaguagauuucuucucaagaaaccacuuuauuugcucauccauaagaagcaacuccuaauccauguuugaucaugagaucacagcaauucaguccuaucuguggguuccacuucuaacuuuaguucucuuuuuguuucugucacaucugcaguuacuuaacugaaggcuugaaacccucaaaaucgucauccaugaggguuggaguaaacuucuucuaaauuccuguuaagguugauauuuucaccaccucccaugaaucaugauuauucuuaauggcaccuagaauggugacucuuuuucagaagguuuucaauuuacuuuuuccagauccaucagaggaaucacuaucuguggcagcuauagccuaugaaaaauguauuucuuaaauaauaagauuugaaaguuuaaauuacuccuugauccaugggucacagaauggaaauuuuguuaccaagcaugaaaacagcauuaaucuccuuguaugucucccaucaaaacuucugggugaccauguacauugucaaugagcaguaauaauuauaaagagucuuuucugagcaguaggucucaacagcaggcuuaaaauauucaguaaaccauuaucuaaacagauguucugucauccggacuuuguuccauuuacuacagagcacaggcagaguagauuuagcauucuuaaagggcccuaggauuuuuggaauggccagugagcauuggcuuuaacuuaaagucaccagcuauuagccccugaaaggagacuuagggacuuucucuggauuaggcuuuggcucaacggaaauuuguggcugguuugaucuucuguccagaccauuaaaacuuucuccauaucaguaauaagacuuuuuggcuuucaccagaguagcauuucauauucacagcuuugcuguuugccccaggaggccuagcguuuggccucuuucagcuuugacauguguuucuaacuaagcuuuaucauuuuuagcuuuugauuuaaagugagagaugcuugacuacucuucuuuucacuugagcacuuagaagccauuguaaaguuauuaauuagccuaguuucaauauuguugugucucaaagaaauagggaagccugaggagagggagagagauggaggggcucgucaguggagcaaucaaaacacauuuguuaaguuuacugucuuaaaugggugcaguuuguggugccccaaaacaguuacaguaauaacaucaaaguucacuaaucacaaaucaucauaacagauauaacaaugaaaaagugugaaauauugugagaauuaccaaaauauggcacaggcagguaguuagcacaugcuguuggaaaaauggcuugauagacuugcuugaaacaggguugccagaaaucuuuaauuuuuuuuuuguuuguuuguuuuuaaaggcaguaucugugaaucacaguaugccuguauuaaguauuuggguauauagaauaguucuuccgcaccaagauggcuuaaaaauucuuaaccauuaaaaauccuaaauuaacgcuucuuugcaaaguucuaaguauagagugagagcagugguaguuaauuccugacucaagugcucuguacagcuaguucugugaccugccuguaggauccugcagucuuaaaccugaacuugggcuaagcaaguaagacugcuuuuuaaauuuauuuuuuaugugaguuacuacuuaaauucuuccuguucuaugguuaaagcaucuuguuuacauuacauuccgaauuuggcccaugcaacuggguugccacuggcuuaauaagacaagaaaagauagagcugggaagaccaaagaagcacauauuugccuggguucagauccucugaauuuuuccucuugucuuaauuagcccuugguuauuuucauauucagaguugccaagggcuaaagagacgaugcuaaggaaugagaaggccuaaaagguuuuaggugauacaaauaacuccaucccauauacgucagguuaucuacaggguucccuugcuuaaacauugauagaguuucuuagguucugaaauuuggaaucuagaucacuaggccaagagaaaccgcuagcugaucuauuuuggacuccaagugaccuacaaacucuguucugcuuuagagagaccacuuagagccauucugugugcaucaaaaaggaauccaacagggaaaggggauggcagauaucuuugguaggaacuccguaugcagugggaccaucugagugguuuggcaugcugcaccuuuagugggacgcuagcuuaccaugagggcuggauuauguaacaguguuugucuuuagacagauacaagguucaguucauuccugucuucauagagcuugcuuguaucugauuuguccaucccaccauaaucugaaguacugcauaugugucuucugucucugugucugaguaguaguuaaaauggucagaguugggagaugcuuacauaacuaagcuaacucaagcuaauaagguugccgcgcacuuuuccugcagaaaaggaacuuaaaguaucgaggauuguagucuuccugagauauauucaauuaacuuugaaacugcacacagcauuugccguggaaaccuaaacaacucaaaugacaugaaauaaaauuauuuaagcuucuggaaguguucuguguuaucuaccauucugacaaggaagcauuagagaagauucagcacgugucucucaugauuaaggaguuaggccaguguaauuaggaaacacuuucaaaacccacuccaucuagagacauuucuuguucuggaauuugagcucugaaacuguuuacuucuucucccaucacagugccuuucucuauucacugguuuacuguagggggauuugagaaucccccuacaguaaaaauccuccucaaaaaaaaagaggaaauuuuguuuaaaccuguuuggaguaugacuuaaauguuucuaaguauauucccugcuugcccagaccaucugcuuauucauauaucaaggcuuacuauguuaaucagaaaagaguugaguaugaaauguaaagauaagucaaaugggaaacagauacuaagaaaguaaugagucucaucuuucuggccucuguugaacuuagccaugguuguuccuguuuauugcguagagcagggaggaacugagcaugaauuuggaagggcaggggucucauacguaaucucccagauuaguguuuaaaucuccuccuaauuuuaucuagauacaaauguucuuauuucuuucuuauacagaaggauacguaccuuuuucuuaacgguguaucuuauaggagauucuuuuguauuaguuuauagagcauugcucauucuuaaagcugcuuggaauucuuuuguauggauacacuguauaaccagucccauacugaugauagaucuguacuaaauaacauguacaaaugaccuuuuauauagguaaauauuuaugauaacuuuuaaagagugagguuauuggcucacaggguaaaugcauuuauaauucugucaguuuuaaaaauaauuuugaggccaggcacaguggcucacgccuguaaucccagcacuuugggaggcugaggcggguggaucacaaggugaggaguucaagaccagccuggccaaaauggugaaaccccgucucuacuaaauauacaaaaauuagccgggcaugguggcgggugccuguaaucccagcuacuugggacgcugaggcaggagaaucacuggaacccgggaggcgaguuauuuucaaaauacuuaagguguuuguacuuauuuuuauuguuucaucauggccugacaggcaauguaguaucaaaccugauguuugcugaucugauaagugaaauauauuacauugaagguucaauuugaauuucucugagagcaaggguaagcauuuuguuguaagagcaguuuguguuuccuuucuguaaaguguuugcccauuuuucuacggcuuguugauuucuugggaguuccuuguaagcuuuauagucucuguaauuaaugaguuccaaacauuuuuccuaguuugucuuuugucuuuuguuuuugguguggugugucaaacagaacuguuuuuuuguuguuguucuuacauaguuuaauuuuuaaugcuucuguauucuaaaucauagccaaaaaugacguucccaugcaaaggaaugucucauguuuucuuuggauacuugcugugguuucauuacuuuuccguggaaagcucugauccuugugcaguugauccugauauaaauuccacuuuacuuuuuuccagauggcucccuauuguccuacuaccacuuuuugaauaguccauauuuucucccauugauuugagaugccaccauugucacagaccaaauucauauguuuauuuuacuuuucuucucuuuuggucugcuugugugccaucaucauauuguuguuaauguuggcacuuuauacuuuguguaaauaaaaauagggcugguaagccccucacugcuuuuuugucaagcuuuucagugacuaccauugauuaacauuuccuugugaacuugagaaucuguuucaccuuguuccaggauaauaaucguaagaacaguaacauuuauugacuauuuuuauauaaagaagaaaagucuugaaaucuuaggcuauguauagucaggugcuuccucagaaagacuggucauuucccaggcauacaucuuguauguacacuuguguaucugccauuagcguauaagccucaggaguaggaaagagcuuaucauuccaucccaguucuuauuaccauguaggaauuugguucaugaaagaaggaaacaaaaacugguaacuuuuuaauuauuuauauaaauuauuucugucauuuacauugcugauuguaauaggauuuaacacaauaagugaccacuuuuagucacuauauaaaggaagucagugguagugauuuacuauuuauguuuagcuuuucacauuacucuuuccauuuucauugcacuucaaagacucacuuaaauggaguuucacauguuuugaacauucuacguuguugggaggcaaagccgaagccauaguuaugaggcuuaagaauggaggacugugauagauuaccuccagguaacagauucguuuuaagggcuuuuaugccugcuuucaguaguaaauccuguucccagagugaauacuacucugcuggagaauccgucauuggucacuuuuaagugccuaaacuuuuuggcuaguauuaaaauuuucuugagguauaaccauuuuaugacaucaaucaugguguugauauauuuaaagaaugccuauaaauugcuagaacuuaucauccauuuuacccagauauaagacaggagccuuuccuauugugccagaaagcuaaaugggacucuuaaauuugaggauguugaaaugucuuaaacuuuggcaguugcucuguaaaagcuagcuagcuaaucuguucugguauaugucucuucagugugucuaauugacuaacacacaucacaaauauuaaggauguauuaugcauauuugaaucugucaggaugcuccagauaaagaauuuuagaggucuucugacucugaaaagaagcuaccugaaacuguagcuugcucaugggcaugguggcagagugaaugccugauccagugcauugcucuuaauaugcuagugugccacauuuuauucucuuuauacuugaaauuuacauauuauuucagauucuuuuucuugacaugggugccaaaugaaauuacacuuuuguacuacacuuuuuuacauuucuuuuguauuacaaaagugaccauucugauaugugaaguauauuuuaauaacugaaugaggagugugucagcgaaacuaaaacuuucaguugggucuuugucauuuuguaauucuaagaauauauagcuucuucucucuaaaauauaagcucgacaggguauugaauuuuguugguuuuucuuucauucacuggcauagccuaaauguauaaaaauagccugacacauguuaggcacuguauuagucuggucucacgcugcuaagacguacccaagacuggguaauuuauaaagaaaagaguuuuauuugacucacaguucagcauggcuagggaagccuuaggaaacuuaccaucauggcagaaggggaagcaaacauguucuucuucacaugauggcaggaagaagugccaagcaaaagggucaaaaccgucuuaauaaaaccaucagaucucgugagaacucacuaucaugagaaaaccauggcaguaacuguccccaugauucaguuaccucccaccagaucccucccacgacacauggggauuaugggaacuacaauucaagaugagauuuggguggggacacggccaaacccuaucaggcacucacaauauuuguugaaugaaugaugguuagagucagacucccuguauacagauccuagcuccuuccuauuuacugacucugugaccuugagcaaguuauaccauccuugugugccucuguuuccuuacuuuagaauggagauaauaaacuacuaaccuuagaguauucuuacaagaaaugugaaauucuuggcacaauacuaaugguugccauugcuguuccugaagauucagagcuacuugaugugcucuugguaguauuuucuuaaauucuguaacuggacugugacaauaaucuuaccauuagguauuuagucuuaaaagugagggacaacuuauuggagaguaccugaagggucucauggucugacuccucaggcuuuaaccacuaccagagcacacaguaggaggccaucucagaucaccuuuggcagggguccccaaauccuggcccacgaaccagcacuggucuguggccuguuaggaaccgggacgcacagccgguggugaguggugaacgagcaagugaagcugagcgccaccucuuaucagaucaguggcagcauagauucuuauaggagcgcaaacccuauugugaacugcgcaugggagggaucuagacugcgugcuccuuaugagaaucuaaugauaaauguaaugcacuugaaucauuccaaaaccauccuccaccccaucuuuggaaaaacuguuuuccacgagacuggucccuggugucgaaaagguuggggacggcugaucuuugcauagucucaaauauaaggauuauauuaagccagaaauguuucucauuaaggaauccuuuguuuugagcuguaggucguguuuuagaacaagucuguccucuuccauauugcaacuccuaaaauauuugaaaaccaguguguccacuugagagacagcucuaaacugaacaucucugguaacaagacauucccuuugauaauaaaaguucccauauuugaacagcauggaauagaauaacauugucucauagauucuagucuucuguuaaaaccgcaguuacuuuugcaccaaacuaacauagcuagaauaggauuggaguggcggggaagucgagggugugagugguguagcacauuguacaguugcguaguacaauuccagcugucagcucagucccgagucccuuuuaugugugcuguguucccacguuuccugcagaucuuacuccggcacuugcaagaucauaugacuagguaugaaacauaccuaggguaaguaucauucagcguaugaaacauaccuagucauuugauauugcaggugcaggaguagggucuuccucuuguuuuguuaaauguuaccuuguuuuucuuguucuggucuguuaaaagugccuuuugaucuaccuuauuccuuuucucucucacuuucaugugucaugucacaugucaauuaacauuuuauuuacagugaaauuacaaagauuuguacguauguagguuuuguuuugagaaaaaugugauaauucuuuauauucugcuauaccuuguucuuugaucacuugcagagcauuccuugauauaaacauauucuaauguauuucacucuauuuuugauugauguuuagguuguuugcaauuuguugcuauuagcacugcugcagugcaucccuucaguaauauuuuuguguccuauagaccauuugcuucucuuucaaaaauuuugugguuacuuuugcaguuauguuuccaaacgaacuuuaaauuauacuuauaaauuccauucucacugguauugcacugaauauguaauuugaggacugacaucuuaacaguauugagucucccccucaaauacugaaauucuacaauuucuacaauucacauuucucccccucaaauacugaaauucuacaauuucuacaauucacaauucaacugaaauuucuacaauucacauuuuuauauggacuuaggcaugcuccuguuuggauuucaguuacaauuagaggugauaaauaaucgguuuccccucuccuugaguuuuaugaaaugaggaacuucaucaugaagucucaaguaaacgaacauuuuaucuuucuugggauucuaucacuucuuaauguuugcccuuauagugauucagcugauucucauuuaaaguuuuuacacaaaaacaguuuggauuauaucuugagguuuucacuucagauacuggacaaguaauuaguauaaaggcaacuaacauggucauaauagaaguaugguguuuacucucaacauuuaucuucccaaaguugucuucagcauugaaauuuuaauguuugaccuuuuuaaauaggaaugaagauucuaguuacaauauauauuugaaggauauaggaagcaugauuucacacuucauagauagucacgucaugggauuaucuacaaaauuuuuuaucuuuuuaaaauuagauguuuuccuaggccaaaaucauuuuucagauguugcucauuccagcauuagaaucuuuauucugugggguuuuuuaagugccuuuuuguuuuguuuucagagaaaguuucauugugcaaaucuaacuucauggccucgcuggcuguauuccuuauaugaugcuguaaguaacuuaccuuaaauuuacuuuauauaugguaggccaugucauaauuaagggucauuaaaaaacaaagguuuaguuuuuccaguuucuagugccuuauaacuuaagauaucguuaagagugguggcucacaccuguaaucccagcacuuugggaggccaaggcagggggauugcuugaagccaggcauucaagaccagccugggcaacauggugaaaccccaucucuacaaauacaaaaauuagccagguuugguggcauguggcuguagucccagcugcuugagaggcugagguggaaggauugauugagccugggaggucaaggcugccgugagcugagauugugucacuguacuccagccuggacaacagagcaagacugucucaaaagggaaaaaaaaagguaucacaagacucuuuagaguuuuauuaagcaugugaaauuuuguuggguugggugauaguuacauuuagaacauuaaagcauccauauuuuacuguuuugguuuuucucuaaacaaguauauuaacuuacgucucuugaucauuagucuauuaauuaaugcauccaggaggguuuuugcuccuuaaaguuuaacacuaggcauugccacauuuugcaaaacuaagggacagugcugaaaugguuuaaagaaucuggauuucagaucagagacugacuucagagucugauuucugucacuuacucugugggccuggagcaaauuacuucuccaaggaccuaugaaauggauauaaugguagcuauuguaccuggugugcauagcgggcauucaauaaaugcuagccauuucccuuaaugaaucacugcccacaaaucuggaguccugggaaaacucaacaacaugcacgacacuaaaggaaacugcaguugaucuccgcucuuuagcagcuuuucagcaauuacaaagacacaauauaugaguuuuugcauguuuugcauaugcuugugaaaauuauguaguaaauaggugccaaguaagguauguagauagcaagugcuagugcaauuuauaggugccauaaucccuauggacugggucagaaauggccuaauagaaggcagaagagaggccaguuccaagcaggggcauagaacagaacaaucugcaagggaguugggagcauauaccgcuggguuaagacagugagugagaaaaggcuggaaggcagacagugcugggcaaaggagcuggagcuugaucauugcugcauacgaaaauggaggcauuuaaacugggacugagaugggacugagugauuaaauugcuaccaguguuaguuuuaagaguugaaaagcuuaauaguaaauuuuaauaagcccaugaacuugauuauggcuaccuuuauuuuaaacaaggagaccuuaauggacagaaucaagaaacagcuacgugaaugggaugaaaaucuaaaagaugauucucuuccuucaaauccaauagguaugaaaaguuaguuuccugccuggagccugggaugucuugcuauaaaaaauagcuuuuucauggaugcgauccaaucauaucuucuagguuuuaagacugauuaaaacauuuuaauucugaaaagcauaauuuccuuugagcaguugaaaaaaaaugaguauuuuaaaauuaauugcaauaaaauccucauauucugugagcacuccaauuuuagacaaguuuuccauaaaaaguucaaauugcaggaaguggcugucauccaaaaacacuuccuguguaaggacuccuuucccuguucuucaaggugccuuuaaaagaagugagucuaguuccaggacuugccuuaauuauagauacucucuuuaucuguuuauaagguauaguuuaguuauuuuucuagucucuuggcaaauaacuucuaacauggauuugaguucauguuuaacauaaaaggauuuuaccaaaaaaaguauaagaaaagcaauuaaauuuagagcuucugaaaaguguaucuuugacagcugguauauuuuuguauuguuuauacuuguauaaaauguguaaccuuaaagagaaggguuuauuucaaaaggauauuauccgauuuguaaguucucugaugcuuaucugacuccuaaguuuaaaacuugaaaaaccaugucuugaagauuuuucuuacagaguagcugcuugucuuccuauugaugauguauugagaauucagcuccuuaaaauuggcagugcuauccagcgacuucgcugugaauuagacauuaugaauaaagugaguaaagugaauauguuuuugaugcccauguuuuauucaggcuggagaacuaggaugcucuguuggggccaauggagcucuguauagaguccaguaauguagucaugcaauucagauuucaauugggaucuuacaaacaaacucauuguuuuguguuugucaaauaugaauacauuuaucaacuuagugaaaaauaacuugauuucugcauggaaauauccaagguuauauaucacuauuccuuuacucuagagaaggucauuuaguuuuauguaaauauguggcagaucucaguuucagugacuuucgugcuccaucuuuaaaaguguuuuugaaugcuuggaaggaaaaugugauauucagagagagcaauaucuuuauaaguaaguuucuugaugaucuaugugauuacaugauaaagugaaugccaguuuuuccuaccaauaauuuuucucucaaaucuuuuaguguacuucccuuugcuguaaacaaugucaagaaacagaaauaacaaccaaaaaugaaauauucagguaaggucuuuauuacguuuuuaauauacuugccuuaucagaauuauaaugaagacuguauuucuguuuuccauaaacuuuccuccaguaccuuaaaguuacaaacauuuagcaaaugaaauauagggaauuagcucacuuuugcuaagaccaucuuccagauuggguacucagagcaacaaugcaugucagggauuauucacagguaaugagcaugguaaaguaaaacaacugagaaauucuuuucccccuaauucuuguugacaaucuauauauuagacugucuucaauuaggcccuaacauagaugcuucagaaauuacauuucagucaucaguuuugccauauagggccaaaguaggacaugcuucugaacacauacugaugcucugauauaacaguguuugaaaaucauuuuaugacaaauccaucaguuguaaaucaagaagguaaggaaacugcuuucugcaaaauaaucaacugccccaaaaugaccacacaggaccuugucauugcacuuacacucucagacuccuuuagaagcauuugaguuuuauauucuuuacaaugucugucuugaggaggguuuuaaaaacaaguacuauuuccuuugggucaucacagaaaacauuuagacauuuagacaaaacaggccugucugccagcuguacccccaccccauuuucauacuaagauccugguauuauauaaaacugaaggauuaaaaacuguauagcucauaccucauuucuuggugaacuucaauaaaauucuaagcauuuaauaaaauuagacuucucguuuugacguguucuccauguugauucuuuguuuuaguuuauccuuaugugggccgauggcagcuuaugugaauccucauggauaugugcaugagacacuuacuguguauaaggcuugcaacuugaaucugauaggccggccuucuacagaacacagcugguuuccuggguaauauuaugguggugguugcuuuuuuuuuucuuuuuuuaccuuaauugggcagaaaaauccagaguccuaagcagaguugccacaaucuuuauaauaaaaaguagacagacaaaugaguaauuugcuacaaaaauuagccggguaugggggcaggggucuguacucccagcugcucgggaugcugaggcacaagaaucucuugaaccuggaaggcaagaguguugcagugagccaagauugugccacugcaguccagccugggugacagagugagaaucugucuauuuaaaaaaaaaaaaaaauuuauuuaaauguccuucauuccacaaauagcuagaaacaucuguugcacuuuuuguaucuuuuaucauugaaugaaaggaagaaaagguugacaacugcaguuguccucagauuacuguauccaguuaaauccaaaauuguuuuuuucugucagucauguaauucugaaaaucagcugucuuaugacccaguagaacuuuauaucuggaccauauucuguaguaauguaaaaccggagaauguuuacaaagcaaugauagacuaagaaggugcagaacccauugaauccugcuuuucuucuaguuugccuuuuguuuguuugcuucagcuuaaugauucucuaugauccugggaaccuguucaguucccucagcuguacuaucuucaguuuucaaagagggaugcuaagaagggauuacaugcuacucugggguuaggacuauguaucuuggauugcccuaucuuacuuggcacccuaugugaggacuaaaacuagaauacauuuguuacuauaaauaaauguggcaugguauaccuagggaaaaaaauaaggaaacaguugcaauuacaugguuuaucuuaagaacaaaauaccaugguuuguauuucugguugcauuaucugacaaucguucuuauuuuagaauauaaauauuuacuuuuugagacguguccuuccuggcccauccaguuuaacucagacagaagugcauuauuucugcagguaauugcuguuuucuaacuugacugcaauacaacaaaggaaaagccaguacaaguuagaauguggugccaguacaaguuagaauguggucuuggcaaccagcaauuucuauaaagaaauucuuaagauuacucuuuauuucuaugcaguagaagaaaaauguaaacauggcuuaagagcauaaaagucauacauauuacaaaauuagaaaauguuuuuagaaauguuuuuagguuucagggaacuguauggaucaaaucucaacuuagaaucucuaauccuuagaauuugccucuaaagucugucuucaugauagguuuauaugauaggcuuggaguacagaaauguuuccuuagcugauaucuuuccuuaauuucuuagguaugccuggacuguugcccaguguaagaucugugcaagccauauuggauggaaguuuacggccaccaaaaaagacaugucaccucaaaaauuuuggggcuuaacgcgaucugcucuguugcccacgaucccagacacugaagaugaaauaaguccagacaaaguaauacuuugcuuguaaacagaugugauagagauaaaguuaucuaacaaauugguuauauucuaagaucugcuuuggaaauuauugccucugauacauaccuaaguaaacauaacauuaauaccuaaguaaacauaacauuacuuggaggguugcaguuucuaagugaaacuguauuugaaacuuuuaaguauacuuuaggaaacaagcaugaacggcagucuagaauaccagaaacaucuacuuggguagcuuggugccauuauccuguggaaucugauaugucugguagcaugucauugaugggacaugaagacaucuuuggaaaugaugagauuauuuccuguguuaaaaaaaaaaaaaaucuuaaauuccuacaaugugaaacugaaacuaauaauuugauccugauguaugggacagcguaucuguaccagugcucuaaauaacaaaagcuagggugacaaguacauguuccuuuuggaaagaagcaaggcaauguauauuaauuauucuaaaagggcuuuguuccuuuccauuuucuuuaacuucucugagauacugauuuguaaauuuugaaaauuaguuaaaauaugcaguuuuuugagcccacgaauaguugucauuuccuuuaugugccuguuaguaaaaaguaguauuguguauuugcucaguaucugaacuauaagcccauuuauacuguuccauacaaaagcuauuuuucaaaaauuaauuugaaccaaaacuacuacuauagggaaaagaugccaaaacauguccccucacccagacuaaacuugauacuguauuauuuuguucaauguaaauugaagaaaaucuguaaguaaguaaaccuuaagugugaaacuaaacauguucuuuguucaaauaauguaaaauaucuacucauaauuuuaaaguucuaaaaaggcugcuuugccaccuaccucuuugcuuauauucaaggguuuaguggguccuuccuuccacauuuguaugauaacuuucguuuuauugguaguccuuugcuacuuuaaaacuaaucagguuaaauguuuacucaaauguaguaauaguaugaggccaaaauacaugccuugaagguggagugaaaucaguugagugucacacugcauauuuauguaaauagaguaaaugaaaauucaagaauacuuccaaucaggauaugccccugccuuauuuuuucuaaggucuacuuuuacuacuuuaauaauuuuggguuugugugacuucacuggucugguuuguuccuauaguucuuacacugcacuaaaacuuacuuacuccaggaaguuccugucaguagcauaguaccucucuguaggcugaacucuaaaccaguugcaaugaguuaccuugucccucugaaaaguuaaaauuucaguaugucccauaccguuuacuagcaaauaaaauuuucugaucuguaaaaacacacauauacuauacuacuacugaaaaugguuuuacacaugacaaaaccagaccugauagcuaaaucugcauacuuucuauacagaaauaguauguauuauaugacguugggucuaaaucuguauuuuggcaguacuuaaauauuuuaaguaaguauuucaaaguauuauuuuauaaugcaucuaauuacugaccuguaugcagucauuucugaggcuuucuugcaucauagccccugugacauuuccucuuagaaauauuacacucuacaaaauuguuuuaucaagguccaaaauuacuauuugcucauagaguacaaagauguuaugacuggcuacacagaaaggaaauaaauuaugaaaugucaguauagcagcugaaauuauagcagcugaaauaaacaguuuguauuauacauuuuauuuaccugaugaaagcauuuaggacucaaaucuuuagagaauauauaauaauagccauauccuuuuaauuaauaaaauaacacuuuaaagacaggcauauuaccauuguauaugacaccuaauacacauugucagauaccacauaaacauauuuaucuuccaauaccaauguuuguuuuauuaaaacaauaauuaauuaauaggcucaauagugacccucaaguuaaucccaugacuuccccaggcucugcaugcauaaagaaaucauugugacagaaaaauaucaaccacauacugaagcauagcuugcuagaacaaauccuguacauaugaaugccagcaacuggggacacauuuaguauucacauuuuaugcaaacuuacuuggucaauuauuucuuuuuuaagcacagguuuauuuuggaauucagauaagaacugacacaucauagacagucauuguuaagguaacccuguuauuucaauugcaaacaaacaauaaacguuuuuucuucaagacaguuaccacuuuuuaagaucuuaguacuacccuaugcaaaaacaguuuuuuuuaaaagccugaacagguuaagauagauaauagccaacuauguuuucucaggugaaacuauuccaaaagaacuguacauuucagugauauaaaucagauccagaaagguggaucucuguuuaguucuugaaauauauaauucacaaaauaagacccuuguuguucuacagagguccccuaaacugucuuuuauucugguguagucucuaaaaccucauuaagagggaggggagaaaauuuagucuuaccagaaaugcucugcuuuuuaguagccaucaguuuuaggucuucuuuauguaacucagaaguucaucuuuuuccauuugguaaccacuuuuuuuccacuguucucgcaacuguuguaauagagccccaauuucuuuuccugaagaaaugcccacuuuucugaugucauggccacuuacaggaaauggaggaauggaccacugcugcauuuccuuuaggagacagugcucuccuugguacuucaguaguucacauacacgaguaguugcaucagguucccuagacuacgugucaaaaucaaacauuuaguuucgucacacaugaaaacauacacuuacaaucuuauccuaaaauuuaaauacucaacauaaauuuuuucauuuaaaauaaguaaaauucacagauuuguagaucuuaguuuuaauaaauuaauucuaaauucgugacgauacuucauauuucugaccaagccuaguauauacuuacaucuauaaugaagucuugauaggguuucaaugggucugaacuaucuguugcuuuaauuaaaucuuuccuauuuuuaacuauaaauaagccaagguuuuucuccucuuuugcgaucuucaaccucaaauccaauuuugugacaucaucuuguacuuugaauaaugaggccaaaagagucacuggcuuuggugaaaaaccaucaacauuuuuacugacuuugucaaauucuucuaaacuugcauuagcagguaaaccuguagggacaaaagcauuuuucaccuguuuuuaguggggauaaaaaaccacucauauccuaaaccuugccaccauuuuaguauccagaaaugcuuugucacuaggauacauuauauagguucagucugauguuccaacuuaaaggcgaaccacuaauauauuguuauucucuccccugucaccuucaaaaccucuaaaauguucuuguuuccauuaaagcuacaucaagaguuccagggguaguggugacaguggugucagacucacaaggcauacucuuucuaaucacaaauuccugacuuuacacugauacaagauccaccccccauucaguaauguuacugaaauuugaaauaugcccaagcuuaccgaagugugauaaaccauauaaucccacuauucucugugaaaaugaauuacaacguuuacugaacaauuucuguguacaagucacucuucuaaaagagcuuuacauguauuaacucacugaauccuuuuagcuuuccuauuagauagaggcuacauuacuuuuaaaccgcuuuuuuggguuagaaacuaacccaaguugcaaagacuagauaaggggcugagcuuccuucaaaccuaggucugacuagagacuacucuacaagcaccacaagcugucuuugagcucuucccuacucacgacaaaacuuaccccauaacccaaac

SEQ ID NO: 14827 - RNA, 808 nt, Homo sapiens
acaggggaggggcguccugcgaggcuuucaggcugcugagccuguuccuuggcuggggucgguagggcuuggagccagccguucaaagucaccccugggaagcgcccgcaacccuuggggacgccucuccuccggcugccccccuucccuggaauccaggugucacuggggccggggaggggcuaggagcucggauuucugcuuugggaaguuuuuacaagcccacccucccccugccuugguuccccgagccaagaauuucagaaauccggggcacaaaaacgccaguguuugcggucaaggauuaaaggcgcgaggugucuuuauuuaaucugcuccgcccugcucggguuugcacgagaaaccaagccugggagcgacgguccacgcaagcggagacacaggcaagucgcgugagagcacuuuucugagcccgaguugcuugucuuuuaucgcccgugaggagguaaagaaaggcagaccucuccggugcacaaauaaaggagccguguugugacuugccggcucugagauugggaggcagaaaauaaauacaaaccgcgaccucaguccugaccguaccucuagcagccccucugcuccugggagcuguaaaugcuuaaguaaauaaaccgcaaaccagaaaaauaagggcuuaggaaagagccgcucacacagagaugcgcauccaggcggggcgcucuccaagagcuccgaauggggcaagguggguuucacccgcugccaaguaaugccugggcucccgggcuacacgcugcuuagggcuccggcuuuugcaaggagggga

SEQ ID NO: 14828 - RNA, 354159 nt, Homo sapiens
ugcaguaaccauguggaugugcugcugaagcguuuccucaagcucgcuggggugggaggagaggaggaggaggagguggugguggaggaggaggcaggggguggagagagagaaagcgcacgccgagaggagguguggguguuccgcuuccauccuaacggaacgagcucccucuucgcggacaugggauuacccagcggcugcuaaccccucuccucgcccugcucccccaaaccggcguggcuccccgggcaccaagguagcggcuggggccgggcagagggcgcggggaguuggcacuggcuccccgggcgcagaaguuuuugccccgcucucggggagaucuugauggaugugcaugcacuuggcaugcauuuggggguuccuuuacugcgggcaguuguuuuggggggagcucauuugaagcuuaaaaaacaaauauccucuacucuagugcguggcuuugggggcuccccauucuggucugauguggcauucccccaaguuggaaacuguugcugcagcugcaggaaauaguucuuuuuuuuuuuuuuuuuuugaagagagguugugggggugucauaugugagucugcucaaggaaauaaucuuucuaaaaauguaucccucucuugcgcuccgugguugggagaauaaugcauguguaggggccccccguggggaggguuuuuaaaaacggaagaaaaccggagaagcggugagggaugaaguguggacgaagcucauguccaaugaggaugcgggcuucggauacuuggccuucucgccgggaaacaagugcuuugggaucugccaaacacuucccuuaguuccagccucccgcacguucgaaguuugugcgugccuagucucaauugucaguuacauccuggaaauaaguaagcguaguuaccuggaaucuucgcccaagcgaucccaccaaccugccuaccaaguuugggggcgggggggcuguccccagugaaggaggcuaaagaagguggaaacuuguaauuuggagcauuucuguuagagcucaucuuccgcggucugguacucagucuucuuucuuucuaaauauuuaggagcugacuacagaggagcaggauuugcaccccucgcugggcuugcuuuggcaacagagugccugacccaggucaggugaguguggaagccugagugcuguagucaauaaugaguuuuuguccuaagccuauuuuaaguucuaucuaaaccgccaaggagguggggaguaagaaagaaaaagaaacuccguggcucagucuucaaaauuugccucugccuuuggugagggcuuuugggagcagagguccaguggacaguccguuucuuggaaguagcugagaauugaaggagccugaaaguuuaugagagaggaggggaaaaggccauuaaauggagcaauaaaacggcggcccauugccggucugaaaagcaugcugaugauuuaaauucugaaggauacagugcauuucauaugccaaaauguguaagcaguauuaacugccucucuccuucaagaaauagucacucuuuucuaauuuugaacgugugcuuaaucagaguagguuggauugcaagaaaugaaagugguugcugcaaguugaaagaauuagaacuuuaaaaagggaagugaguuauugaagcuuaaggugguagcauccagcccuugacucaagccaccugagugucaaggaaucuggcaggucccuguuguuuuggggcccgugguggaauaugagcugagagcagcauuuaucuguaaacacaacaguuccuauuuuuuccccaaaauggucagacugcauuugaagagugggagguuucaacgggugcacguacaucacuauugcugcagauuuggcuaucaggaguuuuuucuccugaaauguucaggaacaugguaaauaacaggguaacagagguagguggggguggguggcugggucuuaauaacuuuuuuaacauucuaaauauuuagcuguucccugggcuacaaucuuugggcuuuucuaaugagaaaauaaaagucagacacuucauuauagugguauagugcuuuuguuuccuguugauaagauccucaggaguacuggcggagugagaagcauuuggaugugagaacucuaguuucuucuuggaguucuguugacucacauggcugugugggugcucauagagccaaggauuaggcccaguuccccuuuucagaauuagcuguacagcaaggaaaaacugguccacagacucuuuucuaacugguugcuaaaaauaauaagauggacacauuaaguacuuguaagccagguccagagccauguaucucagaaacccugugcgucagaugcaggugaagaaacugaggugcagagagugaaaucacuugcccaguagcuaguacaaaguaggagcaggguguaaccucaggcggugaggcuguacugcaucccacaaauggaccucaguugauuuggggaugcugguggugagagggaagcuaggaaaaaugguaaacuuacugcuacugaugaaauaacuugcauaccucccaccaaugaugaaauaauacauaacauugauguaagaaggaaaggauguagccacaaacauagggauaaaagagugcagauauuugaggagguauuagauacuguaaugaguucauuuuggaaagccugaauggggagaguaaaaagaaacaaaaccacaaggaacauuauguaaguuaagcauuaggcucaccuccuagcugaaauacaucuugauuguuuacaucaaagaaucugaguagguuaaaaggaucaggcguuuccccaucugaauaauucgaaaguuuaaacugcaguuagacugcaaugugaaauguugauaccuuuucauauaccuuccaguuugcuuugcagccaguugugcagacguuuuuguucuccauuuuuucuuucaaguucauguguguguguguguguguguaugcauauguacacugaaaguacaaucugcucuuugaauaauucaaaucagaacagaaaauccuuucaagauaucauucuuaucaggcagggaaaguucuucauguucuaagugaauuacucuggcucuugccuugagacccaugaaagucauuugggguugacaaugguaucuauuuaaaccaagugauugucuuuuggagggaauuggcaucuuuucuuuaggaaugagaaguggaaugguugcuuagaaaaaaagagauagaugaacuccacagaaagaucaagagucuuuucuucaaaauauuuuuaagugaggaagaucaggguguugguauugcggggagggaggagagugggcagagagaaagauaaaaaagaaaccuuuaauccaauggugugcaaccaacugacuuccagaggggggaauaucacauggcuuuucaacucauuuauaaagauaucauggaaacugucugauuucuucaugagcagcucuuagaaaacaaacaaaaauaaaacaaacaccaaauaugaacaacagaaaaaaacagccaaaauaaaaguaggccuggaguuagguuucuaggucaagcugucuuuggcuacaucuaauuaaggagucuccacagggccagugucuaucuuguuuacuauugguuugauuuuuaaaaauaaaacacauugcauuugcaggcugucuguuaaccagaaguccaugcaguuuuuuuuuuuuccauuuuugcuguuuuaaguuugugcauagcucaauugaugaaugcaauuaaggcuugaagucggugaugugaaugacauaacuucuaugauuccuuacaauucucuugguuucugugguucugagaugauugcuaaugagaauaagccagauacaccacugaaaccgucacccauucaacuuugagauuucuaaauuggauguaguuuaaggcacauggugugguaaaucuauuuaacagacucuaagaccuguucaaguugugugcgauucaaauguuuuauucuuuauucaacaaauuucuugagcaccugcuauguacuaagauguauuccaggugcucaggauauagcaaugaacaaaccaucccguucccaagaggcuuacaucucaguuggugggaggcagccaauauaaauaaacaaguaaguauuauaguauuagagguaguaaaagcuauggagaaaaagaaaacugguuaaagggggaacagaaaauaacaaguggagaaauuagaucccuugugcauugccggugggaauguaaaauggugaagcugcuguggaaaacagcauggcaguuacuaaaaaaaauuaaacauaaaauuacuauaugucccagcaauuccacuucaagguauauacuuuaaaaaauugaaaguagggacgugagcagauauuuguacaccugugucaguagaagcauuaucacaguagccaaaagguagaaacaacacaagucuacugaugaaugaacagauaaaaugugaaauauacauacaauggaauauuauucagccuuaaaaagggaauucugacacaugcuacaauguggaugaaccuugaaaacaugcuaagugaaacaagccagaaauaaaaggacacauauuuuaugauuuuucuuauagaggcaucuagaguagucagaucccugcagacagaaaguagaauggggauugcugggggagauagaagacaggaagggggaguuaguguuuauugaggauagaguuucaguuuggaaagaugaaaaaguucuggaaauggaugguggugaugucacacaacagugugaauguacuuagugccacugaguuauaacauuucaaagugguauauuuuauguuauguauauuuuacaguaauuuuaaaaagcaacaaaacaugaugagggguauuaagggaguacucagguggggauuagaucuuuacuacaugacaucucagcacagaucugaaggaggcaaacgaguugacccuguagcugucagggaaaaaguguguuccaaaugucagagcagcaaguacagaggcccugagauaggaguguuugugacauguuggaggaaggagaagaaggccaggggagagugcuaggaguucaggagggagagggagucaagguccagaccuguagggaccagauuuugcaggucaacagugguuuaucugaggacuuguaaacucucacggaauucucagugugguuuucaacaucacaaaacuacauuguccuuucugaagagacucugguaagguuggcaggaucacauaccagaugggaacucgauaggggguaaaacccagauuucuggacugucugguuaaugacaggacuuaccuggaguuguaauucacuucaguagaaaaggaaaguuugacaaauaggugaacguacaguugacuuggagagcaaauuguaagaacauaaugauaauccuggaguuucaacacaaaccuaugucuuaccgccacccugcguuguauccagugucguuuuaagagauauuuacaaggaggacuaauauucugcucuccagcauccuugaggaauuagaagcuucacaucagugauucuccuuaauaagugaaguggaccccugcacaugugcaaacuuaaagcaaaccucaaauuuuguuacuuauuacauaagauauacauauucauguagcacacaccuuggacucggcuacucaggggacggaggcaggagaauuacuugagcccggggguuugaggcuguaauauacuaugauugcaucugugauagcuacuguacuccagcaagaccccaucucuguuaaaaaaauuuuuuuaaggagaaaaagauagcauauucauuguagugcaacauuaggaaauaaagaggagcaaugaaacaaaacaaaacaauucaacuauuagagauuaggguuucaggcuuuuccucuaaguaugcauauguaaaauuuacguauauauuuaaauuucauaaaaagggacuaacacaguaucucucauuugguaaauuaccuuuuguacaucuugaacaucuuuuuaauaaacagacaucugugucucauuuuucuaaaugugccuaccccuuugauggccuuucauuuuuauugagucuagguuuauacuucccugauauauauacauauauaaauagauauuuguaaaaaauacauaauauaauaauuuuacacauacacguauuuaacaguuugaauuaggauccaaauaagguaaauacauuacaaaugguugauguucacuaaucucuguauuuccucuacagaucuuuuuuccaugcauuuuuuuuguuguuaucgaagaaacugggugauacacgucuccacaguuuagacuuugcugacugcaucagugcaaugugguuuaacauguuucuguauccccuugggguaccauaauuugguaguuagauguagaggcuucaucaaaguuagguucuuuucuuuuuuaaauugagaaggggucucacuauguugccucggcuggccuuggacuccuggucucaagcagucuuccugugccagccuucccaguagcugggacuccaguaagucugcucuguaaacuuugcuuaggugggugugagauguuggaugucuacucuuguuauaugagcaccccuugaugcucacuaccugaauccauuaguucucucgucagugagaaaugggcugguaaaguuccugagauuucgacacagcccuuguugucuuugcuagcuuuuuugauuucuguauaacaagauguuccaggcucaucuucucuauuucuuaucccagaccaagaaucggccuuuucuccaaggagccuuugcucuuuuaagagggaaauuuuguuuguuuuguuuuuuugagacagagucuuacucugcugcccaggcuggagugcaguggcaugauuucagcucacugcaacuucugccucuugggcucaagcuacccucucaccuaauccuccugaguagcugggacuaugggcauucaccaccacaccuggcuaaucuuuuuuguuuuuuuguagggacgggaucucgccauguuguccaggaugcucucaaacaccuaggcucaagcaguguucucaccuugaccucccaaaguguugggauuacaggcgugagaccaucaugccuggccaaaaugguauuuagagaucuccaccuagggccaaguagguacucuugucauccucaucuuacagacgagaagacaaauuaaaaugaagaaaacuuaaaacuugaauuuccuaggugaaaguauuuccaaaaugcaauugaccuauccuugccuuuuugcaaagaauucugaauauaaucuaaacuuuuuuuaaaaauugguuuuggguuuagccuuaguguccugaggcuaagacaucauuguucuccccagaugagcaggaauguuacucuuguucuguauccguguuuuucaaacucuguggaaacccacuaagagguuguuaaaucaauuuagugggccuugaugaacuuuuuauuuuuaguuuuugaaacagggucuugcucuguugccaaggcuggaguacagugacaugauguuggcucacugcagccucaaccucccaggcacaagcgauccucucaccucggucuccugaguaguugggaccaccagcgugccccaccacuccuggcuaauuuaaaaaaaaaauuuuuuuuuguagagauugggucucccuguauuguccagguuggccuugaacuucuaggcucaaacgauccucucgccuuggccucccaaagugcugggacuggaggugugagucaccgggcccagccaaacuuuuuuuuuuuuuaaugacaugcacuagaauagaaaacauggaaguguauuucguggauacuuaaaaagaacuguguauguugcaacaaaauucuuugucucacauacacaaugaacauuggguuguaaguucaauaguuuucuuacucugagcugcagucaaaaguuugagaaacacuguacuacaucuuugccacuccaagugugguccccagaccagcguuacugacauuaacugggaacuugcuagcaauugcagacucucagacccuacuccacauucaaugaaugagaaccuacauuuuugcaagauccucaagugauucacacacacgugaaaauacgagaagauaugcauuggaggaugccugucccugugcuuuuucaguccuugucauuuagugguuccuuugcuuuuucauggcuagcucucaccuguucaggcugaagcugaccuuuguacuuuuccccugcagccuuauuuucagugaaguggaaagguaggcuaaucaccaaccugaggugagaguaaguaguuuucacaugauucccucuccaacaaacaugggaacuuugaugcuuacauuugggggagcuuuuauucgcuguucacaugaaggcagaaagagaccagaaggcacauguaccccuacuuagaguugugaagucacugcuguucaccugcugucaugggacaaugaggaacuuauguuuuaucauacuuucugaccugucccaucagcagaacuucuggauggcuugauauaaugcggcuuaucagaagaagaugaacauaagaaaaauaucacuagucuccaaguuucuugcuguucuuuugcauuucagaaggagcuuugucugggaaaugauuuucuuuugcaagaacagcuuaaaagcaucccaagcacauauuucugaacagaaaaagcugauacgacacccagacgacggacauucauuuguuugccuugucguguguguguauguuguaccucaugugucccuccccacccccgucuguccaccucgccagauccuucuauuccuuagggcccagcccaaacgcuuccuccuccgggaaguuuuuuaugauacuugaaaaucugucauuugaaacuccagggcccuaaaaccuauuuuccuuuugggccuuuuguguuuuuuuaacucauaagaauaccuggcacacaggaagugcuuacacaauaaguaauuuguauauauguuuuuucucccuuugaaggcugcuuggaaaaacuaauuuuuuguaccccucucuccuuuuuuuuuuuuugagaaggaaucucgcucugucaccaggcuggagugcaguggccugaucucagcucacugcaaccuccgccugccagguucaagcgauucuccugccucagccuccugaguagcugggucuacaggcaugugccaccaugccuagcuaauuuuuauauuuuuaguagagaugggauuucaccauguuggccaggauugucucgaucucuugaccucaugaccugcccaccuuggccucccgaagugcugggauuacaggcgugauccacugcgccuggccccuguaccccucuccugauuaaauauuucuugaacuggcaucuuucuuugaaaagccuuacagccaggcaucguggcucacgccuguaauccuagcacuuugggaugccaaggugggugggucaccugaggucaggaguuugagaccagccuggccaacauggugaaaccccaucucuacuaaaauuacaaaaaaaauuagcugggcaugauggugggcaccuguagucccagcuacuugggaggcugaggcaggagaauugcuugaauucaggagguggagguugcagugagcugagaucgcaccacugcacuccagccuggggggcagagugagacuccaucucaauaaaaagaaaaaaagaaaagcccuuuauugcagagggugacgugaggaccauguagagauauuaagcauuuccuuuugauagcuuuugagguguuguucaguacaaaucucugcaggacauuugucuugggaaacuguugaguauucauaaaagggaguggaaaaaucagguagugaaaccaagcugcuuucaggucauauugguauugcccuggugagccacaggauggggacuccgcaguaccgaguguugacugcuucuuggguaaggggcaaaacauggaacaucugugcaucuguuuccucuucuguagaauagguguaaaaauaaaaauaccugcuucgggucauugcugccgaguugucuaaaaacaaauguuugcagaaggcguuacagauaaaaaaacaaagcaaaaccuaucuauguccuagagcaguggucucaauggggacagggagagugauuuguguccuccaggggacauuugguaucgucuggagauauuuuugguuguucuaucuggcaggcagggguggggugcuacuggcauuuugugaacagauccuauggugcacaggauagccccccacuccccugccccaccacacacacacgcaacggagaccucucugcccuagaaugucaguagugaaccgguuaagaaacccuguccuugagugaauuuuucuggcuuggugagacuuuugucucucucugaggauauugaccuaacuucauuugcugguuuuuugagguuugggcuaugugggcagaggggugucucuucaggcugggacugacuucaacuuuuuaacaaaauaagcacccucccccucucgcccccucccaaaaccaaaaaacacuggccuugguaucuggagcccuguggucuaucuuugggcacucaucagcugugugaccuccaagaaaucacuaggccucagguuuguuuuuucuacccguaaauuaaagaguuuuagcuaaaugcccuccacucaccaaaucugcagcucuuugccuuggaaauauugagcuuuugguuggcuucucuuacuuuggccuugaagaauagaagccaugagaccaaaugucagugcgggcaucuuuuuuugagaaauaacuuuguagauauuguaccugguuggggaaaagguuauuuagcagacaugucugaaaaagcgaguagguuuauuuuuguguguguauguguguugcggcggggggaauggagaaugagcaacguuguauuauacuagagaaucacuccucugaacuucagauuuacagcugcuguuucugggaggccaugaagggccuugcuuaaagaugaaacuucugaguuggugacuuccuuugggacugccugaaaacgaaagcauaauacaauuuucuaugcucccagagaagugcuuuuugcaagagaauaaauuaucugaugauggggacaugcugcauuucugaggacgaucugauuagcagcuaaugggacaagaaggcaaggagggggagcugugugaaaacguguggggaggaggguggcauuauguccaagucaaaaaugugcuguuccuccucauuucacaauaaagaugauaucgccaagcaucuuugcucaaaggaaguccaaaauuaacccugagugcccaggaacaggagcagagacuguuguaaagggagccuuuuucucccucuugaaaaagucaaccguaaaugcguuagguuuucucuaccucguauuuacagccauauuaccauauauguaccugggugagggcaucgcagggagacuugugcucacucuguagggaguuuccuuggccucuugccaggagauugaucaaaugccagcaccucuuccuuuuucugggcauacuccuuuuuuuuuuuuuccugugaaagaccucaugguuugccaggcucggcccaucguuaaccugcccugcugggugcugcuugaccuaaaaagugaaacggugccuuuuugucuucguccuuauccucgguucugaggggccaacugccuuauggccucuuggcuugccaggugcuuugagcaaaagcccuguguguaagccccucucuuugcugccuaacuuuaaaggaagcuuuuuuccccuuguuuuugagaaggagucucaucugucgcccaggcuggagugcaguggcaugaucucagcccacugcaaccuccaccucauagguucaugcgauucuccugccuuggccucccaaguagcugggacuacaagcacaagccaccacgccuggcuaauuuuuguauucuuaguaaagacgggguuucgccauguuggccaggauggucucaaacuccugaccucaagugauccacccaccuuggccucccaaaguguugggaugacaggcaugagucacugugccuggccuaaaggaagcuuuuugauuuuuauuauuuuuaaagcaagcagcaagaaaaccagcaccaaaggacguuggcaagggccuuuuguuuuuuaggagguggagguaguguggauaugccaagaaagaauggggaaggcugauggacuuguuguuggcuccauuuuuuagcagaagaaugacuguccaaaugcaggugcuuuggggcuagguggcaaagcuugacgacuggaggauagacgcaaagggugcugugugagugagaugcuggcauucacuccucaccuggcugugcuuuggugguucugguuuuauuaggaauaguggggaaaacauuguuggaguuggcauugacauguugaggucaguacaucucaugugucccuuuuguauauucacuugucauuuggacuuugcuguuuggcagagcugauccucugcugauuauaagccuaagaaguuuagaaagaguaguuuaugagaauagaaaauagaacagauuagaaaguagaauuauaacagccaauaggaaugcuuccuccgucccccuuucucugugcuaaguaagcauauuuucuuuuucacaauuaauugucaacauaacuaugagauaagcccucauuauccccauucugcagaugaggaaauugagggccagauaagggagguaacuugauugacuucccauuacauuuagaauagaaggccaacuuuuuacccuggcuugugaaguccuacuggcucuaucuucucuacccugucuuuagccuguacuuucuuccuuuccccauuaaugcugcagacauugggcuggcuuucuguuucuggaauuugcuaagcucuuuucugcuuuauggccuuuguacuagccguuuacucuaccuaaaaugcucuuccgccugauuuuuuuuugcaugacugccucuaucuugacuuucaggucuucgcuuaaacaucucaucuuguuuuuucugaccagccaaaauugcauugucacuuaaucauaucaccaguuuuaauuuuuugcauauacucaucacuaucugauuugucuugcuuguuuuaucuguuuguuuccugucugucugcccucacuagaauauagguaucacgggagcagggaccuuguaugucuugcuuugaucuguauccccaguaccuaguauagggguggcauauaguagguaucaauaaauauguucgauaagaaggaagauuuaaguuucacauggaacaguucacuuucuagagcccuggcuguucaguuuuauauuuugcauuuucauccuguuauauaaaguuuccaaacuuauacagugagaguccuaagcacacagucauugccaggacaacucuuaaagaaaaguuuauggcagcaguuuucaaacuucuggcucucaggagcucuuuucaugccuaaaaacaauucaggacccuaaagaacuguugaugugaguuacaucugucuguauuuacaauguuagaaauuaacacugagaaaaugaacacugaaaaaauauuuuuaaaaaccaauuacacauuaacguauugacauauuuuuaaugaacaauaagaauauuuucccaaacaaaaauuuugagaagaguagcaauuuuuuuuuuuuuuuuuugcgaaucacuuugaggucugguuucacagaacauagccggauucacagaucauauaucuguuucugucuucagucuguuguuacaucaugugccuugcagccucuggaaaacuucacuguacaugugugagagacugagugaaaaugaaaauaaugccccaauguuauugugaaauaguuuugaccuugaaguuucccugacccuugggccaccagcuccuagaguacauagguaauuugaaaugugggguuguggcauggaacauuagagagagggagaaauugaaggcuuaagugacagggugcaauugaccaucucuaagucuggguauuguaugagaucuuucuguucagaaaaaaaugcauggggauacuuuucaguuguuuuugugaaacaaaauugcuuccuaaaguuccuccugaaaugcaaagaaacgcugagaauguggaagcuagugguacuuguccuacguucaucuuuuucuuaugagcaagauuauaccaagcaguccagaaguucugcagugggaugggucauuaaaaaauuauaaagcauagguuccucucugugucugagaauagcagcuucaaguguaacuuccuuuauaacuguuagucuccaacacuuacuuuguucuuuuuguagcuuuuggccucagaugaaguuguguccuacaauagaaauuagauugaugcuuauugcucuuagguucugucauaacugguguuuaaggaaccaggauagaagcuuuuaauaauagaugagcuauauucugugcuagccagcuucacuguuuaaggagguuaaaugauuacaaauucaggcuucuggggaguguuuugcgugugucuugggucagugauauauaagauuuucacuguuaagguaauugugugguaaaauacagaggagcuuggucaucaggaaauuaauggugcacuguggggacgaggcgagggguugcaggcaggcaggggauccaaaguaccugacucucaugcucagaaggguuucauuuaaggucagacugucagugggacuacccugccacccgauuacugaaagucagacuguucagccccaguggccagguggcuucaucuuaauuaaacguaggaggcuugccuuugugucuugguaaaaacuggcaggucugugguuuuggggucccuuaacuaguauaaagucaauuucucauuuccucccaagccuguccacccuugaagauuaagugaucccuuagguaacuuauugguuaaugaaguguucuacuuuagucucaguuucaggaguuguuaacuuuuaaauucggaauucuguguaggcgaaaaucaagguuuuuuuuuuuuuuuuuuuuuaaaugaauguaaugcaauuaguuaagugugugcaggagaacuaauagauggaaaaauuucaauaagugaguuuucugccacagucaaaugagugaguuuucuaucacacuaaaagcuuuuagaaaaaaaaaaauuccaaaccuaucuugagcugcugcuuaaaauuaaaugaacauauuucuuuuuuagugagguugugcuuuggccuguuuuaacaccagaguggaagagguucuaaauacugaauuacuaucccuuugaagagguuuccaccacccccacugccagcaggggaccuagauugauguuagaaggcgggggaguugaguugaggucuggccagcuuugguauugugaguuuggguacugaaaaacaacaguacuuuggagaugcuguccaaguaucagccaccucgugggcuuacagaggauuuaaacauuucugggaucuuuguuucuccagauguauuuccuagaguauugaccagguaagcaacauucaucaaguagaggaaucacaggacagaggugagugaagacuuugaaggaacaaaaacgaauguuuucauuucagacucauucagacauacagaaagugagcauaaagggccaaguauuguguugaccacuuuauguggauuauuugguuuacuccucacaaugacccugagaaauaugaaagguugcccccuuuuuuacagauaagagagcugagguucagagaaguuauggaaguugcuuaaggacacacagcugguaauuuaugaggcuggaauucagacucacauauucugagucuguuuccaaguguacacucuugucaguacuccaagccauuuuggacauguggaggggauggucaauggggauaaaaguuagaguaucuuuccagggauaaaaguuagauauuuuguuucuugcuuccaaauuucucauagaaaucuauugaaaagggccaaguagguuucuguucuugaucuaacacuguaaauuuggcuuuaauuuguuuuggagagcagucaucuaaaaaacaaaccaggugugguggcucaugccuguaauuccagcacuuugagaggcugaagcaggaggauuacuugaggccagaguucaagaccaaccugggcaccauagugagaccuugucucuacaaaaauaagaaugaaaaaacuuagccagacauggugguacgcaccgguaguucuagcuacucaggaggcugaggugggaggaucacuugagccugggaggucaaggcugcagugagcuaugauugcaccacuaccuuccagccugggugacagagugagaccauaacucuaaaaaacaaaaccaguauaaacucuucuaggcagcagauacaauagcacuaaagugacauugaacccauauuugacugcuugcucuaucccagguacuaccagguacuaggaugcaacaggaaagaagacaacugagguucuugcccucaugagcuugcagucuaguggagaagacaaacaaacaagugaauaagcaauguuaggacagugguaguggacccagguugcuguauagaagaguauguuggaaacguauaacccagaucugggaggucggagagggcuucccagagguggagacaucaaacuggggcugugaaggugagugggaguuagccacaagugguggugggagagggagggagaugucucaggcugagagacagcaugugcaaaggcccagggaacagagcauggugggggcccuggaaaaaaaaucauuauggcuggaguauggagagcagggcucaagguaggcagggcuagaucaugaagagcuccaaagagauguuggaagguuuuaagcagggaaaugauauggucugauuuauguuucuaaaauaucaugcuggauguuguaugccgaauagauugaggaggaaagacagauucagagaaacgaguaggaaggccuuagggaguccaguugagaaaugauacuggcugagacucagguuagcaggggcaagggaacuagaagaaucaagagauauaguaaagcuuaaagucagcaaaaauugaugcuggauuagacuuuuucauucauuuauucaacagguauuuacugaauaccuacuaugugcuaggcauugguguuuggaauacaguuguguauaaaacacaucacacacagaucucuagaauacagcaugugccuuguacggugucagacaggaauugcacaaguaaaugugaacuuguaacugagaugaaggcugggaaguagagauccaugguguagaguuuauaagaguggaauuuaacuucaucugaggggauggggaagauuuucugguggaaaugguaguugaauucagagcuggagggugacuuggcuauaauuagagcaaggggugggguagggacgagaguguugugggcuugagaaaacagcacaggcaagggcccuguggcagggaacaugagagagggaggacuggaggagccaccaggcuuugcugguggucacugagaaauggcuaugaaggaggaacagguugggcaggcagguaaauucuuuuugguacauugagaugccgugagccgcuaggagcaaaacucuaguagcugugggacaugagagacagauuugggaauccucuucacguaacagugacuggagccagcagaguggacgagaagaccaggaaagguauagagaaggcagagagcaauacagacgcugaagagcagcucuggcuucucuuccccaaggagaucuuucugcauuuauuuuuuucuuuauuugcacuuuucuugggaauagaaucaaaucuucccugcccccccuuuuuuuuuacgcacagcucagggagcaauuucaauagagggcaaagggaagcucagccagaggguggugucaggcucaacaaagcugccacagccucccucugcaagagugucucccagaggcagugaucuaccuuucuuugccuuggccaaagccacccuggaagaauccuguuuuaacaggugcuugcacccaucagaauggugguggguggcggucugauaguacuauuauauauugguggcaugccuacuucacgccagaugcuuugcugaguguuuauaaauaccgucuugcugaaccuuaugucagcuugcugagguaggugcucuuauucuccccauuuuacagcugggaaaagugaggcuuagggaaguucuggaacuugccugaaguucuucagugaguaaguggcagagcugggguuugaaccugggcacuuugacucuggagccucagcuccugccugccaugggcugagaggugcuuuugaggucauucugcgucaggaauugcggggaggauggugaugcuuugugaaaagaagcaaagccuuaaggagaaauaaucuagauagcauucacauaugcagaggucuuagaugcuucagagggcagaugaauagcaaaaguucugggaggcggcuauccuuuguggggcuaagggaggggacaggaguaauuguuuuauuuuuucacaggcagggucuugcucuguugcccaggcuggaaugcagugguaugaucacagcucacugcagccuggagcucccaggcucaagugauccucccaaguagcugggguuacagauguguaccaccaugcccugauaauguguuuuuauuuuuauuuuuuguagaaauggggucuggcuggucucaaacuccuugcuucaagccauccucccaccuuggcuguuuaagaugugaugacaggcaugagccaccgugccugguuuaggaguaauugucugaacaaggcuguuugaacaaagaauaggcucuauugcccagugagaccauccauaggcagcgcgauggggagauuucauuauugggugggagguggaauuacaugcuuuacaggguuccuuccaacuuuuauuccaugauucuguguuuuuugaaagguuagaaugcucuguggcuggcaguugaguguaauucgcuauuguucaccuuuuuucaucaggggaauuaggaaggauaaauuaucuucccugaaguaaaaucugucaucaugggucauauaggaguucauuuguuaugauacacaucugauuuuuuaaacaggggauccuuuacugaguuuaaauuuugaugcccuggaaucuuucagaauuccacuuaucucucguggaagaaaaauaaaaauaacuagcauagauuaauucaaguaugucagccacuguaccaggugcuuuucaagcauuauuucacccauugcucaccacagccucuugaaguuaaauuauccccauuuaacagaggaggaaaugaaagcagagagguuguggugggcuccuaauaacaagcuagaugauaauaauaauaauaagagcuuaggggcagagagccaggguggagugcgggagcugagcgccuaagccugcccucguguaugucaggcauggcuugucagcagagccgagcccucggugucuguaaguguuugaaguuccgcagcuccguggcagguuggcgccagcucuguuuucucugaggugguccuugucauggugugagugacauaggagcccugagugcagcugcuagaaguucacaggcacaaaugguccacgaucagauaaagaggcgggcucucccacccagcucugaacaacaggaagucuuccagaagauugcuccuaggcccaucacuucuggggcggacuuuccaccuccaccccuccacaccacagaggccuguucuguugacuuucccggccuuuguuuuuccuuccaggacaucacugauaauugcacuaaaaccuauccuccuccccccaucuccuuccuccacuucacuaaggcgaggccggaggagaucuccagagguuucuagccagaccagcaagcuuucugcccaguccuuugugaggggaauuaucacaugagaccccuggggaaggaucuguccuccccuacuuuuugguuguuuuuaauugggaccccuggcagauugcccagaggaucauuagcugugguggguggacuggccugugauuucagggggagauguaaaauguagcuaaagguuacuuauucacuuaucucggccacuuaauaaguaucuugguuagaagaugcuuaauuuuuuuucugacuuauggaaguauuacagagccaugguagaaaaauuagaaaacagaauugugcauaagaagaaacucaguucuccauaaucauccggaguauaagaacauuuaacauuuuaaccuguguucccaggaucacuguugauaaacaccuccacugaagaaucagauagaccuagguugggugcgguggcuuuuggcugucaucccauuacuuugggaggcugaggcaggcagaucacuugaggccaggaguucaagacccgccuguccaacauggcaaaaccccaucucuacaaaaaauacaaacguuuagccaggcauggcggugggugccuguaaucccagcuacucaggaggcugaggcgggagaaucgcuugaaccugggagguggagguugcagugagcugagauugugccacugcacuccagcuugggcaacagagcaagacucugucuaaaaaaaaaaaaaaagucugauagaccuggguuguaacaacccugguccuccugcuuacuaauuuuaugugauguggggaucuuaccucucuguauuacaccucagugucuucaacaacaaaauggcaauaaugguaguuccuaccuccugcuguggucaugaggauucacuaagagaacauuuguaaagcacucagcacaauggugggcaugagaaauccuugauaaaugccagcuauuauuaucagaaaagaaaauaaugcagaaccgugcuguaggaaugcaauguccagacaucuauugcaaugaucagcugcaagcaacaugggguacaucaugcuuugucacucgaggacacugaauugucugcuucuucccauuaagggccuggaaucuuucaguaagguauccagguggcggugaugguucacaaaacagcaggcauuuucuggccuagucuccacuagggcugaaugcuuaucugaagggugauccugaaaggagagccuuagucacacuggacaaggcccuaguccucuugcggagcacauaccugcucuucugcauuuggaaauucccugguguccuuucgggaugccaggguguacagacauaaauuuggucugguucaaaauucaaacaaauugucuucuaauaauuggucuuagaaguaugcugacuuccugacccuuuaagauaaagcuuuauaauauaagcgcagaagggaaauauuaaucccccuugauguuuuccauuugugccgccuuucuggaugcuguuuaaaacauugguuugccuuuaaauauaaaauauguaguuacgaagaauuaaacaaugacugacaugauucuagagugguacuuggcaaaccguccuucuguacauuauuuguguaucuucccucaaggucuagagaugcuggcucuuuuguuugagaguuuauucuguguucucaguugcugucucccucuauaaauaaguucauguuuaaugaaaugcucuuuaucucuccugcaaugucuggguuguuggaggggagggaaggggaugacaaaucagcuuuucccugcagcuucucauaagcagugaacugagguucuuuaacauaaguuugcuuucaguaacugacauuccugcuaaggugguagguugcuuccugaggugucaugcugaucauugcugcauaauucuuccugaaagaaaacuuggcacccaggaagcaauugaaggagacacaauaccguuccacacuguuacaacucuuguaacugugugggguaaauggcuucuggaaggggaagucgaguaaauugauggggaaagggguguaaaggggucuggguuuggaggagggguuuugggaaaaccuggguugcccugggcaucuccacagcagaugccugaggaaacacugggcuauuagcugcaguccacaccagcacacagucuucccacauaacugaguuuguuuuuuaauugucaauuuagcuuuuuacaauugguucccacuccucaauauuuauggcccugaugaaagcuguuucuaggagucacaucaauauuuuuguugauauuuauguguguguauguguguuuaaugauuucugagcuauguagagauuuccugagacuuaagagcuuuuucuaagacugccucuaacuagcugcguguuccugggcagggaaccuuauuauucuuacccaaauacugaaggaucugggccagguacugucuaaaggguuuucauccucuggaaguguuucuuggugaaggaugagaaggcaagacauuuaaguagcauuugggugacaugcguacaguuguggaauucugaaaaggccuaaaaggcugcuggaaauuugugguauuuauuggcagguuucuuuuuauuaaugucauuuuguugcuuugguaccuuagcccaggcacuguggccuugccagaagcagguuuuuauaccagguguuuccuucugacuuaacauucccugaagcaaauugaauauguuaauguuucauaagucagacuuuccagguaacucccuagucacugccacguucuuggcugaguucccugcaggcuuucuauucacugcaguuuuuauuaucaaggguccucaacuuguagaaucugauucaggcaugguuuuguuagaaacaaauguuacugugguuggaauauccugaaauuagauaauauacggggaaaaaguguuguugcauauguccuuacuuggcucauugaaucgccugccugucaaacuguuauuuaaauuugacuuuuaaguaaggcgcuuuggaaaauugagcuaagccaacucuuagugacuuuuuuccccuucugaacauuucuuuucuucuaacaaugcugcauauuuuacuuugucuaggauuuucaagaaagacaugucugacaaaaugucuagcuuccuacauauuggagacauuuguucucuguacgcggagggaucgacaaauggauuuauuagcaccuugggguaagagcaugcaauuucuuguguggcacgguuuguuuaagacaucauaacaucagcuuaaaacugugauuuuucuaacauaagaacgucaccguuuuacuuggcuuucuaagugcgguugaaaucacaaacaccaaaucucauguuagccaaguuuaaccucuuauacaaaaacacaauuuucuguauauuucugaaagagcaaaaccucauuauuuaggacacuauucugaguuuauuaaaauuugcuuuuccuuucuauauaaaagggagagugccuuuauuccacuauggaauacaguuuaaauggaauaaaguguaaagaugaauauuugcagagcccaaagaagugcuuuuuaguuuuguaaaggcucuucuuuucagauagugacuccuuuauaauauaagcaaagaccaaaccuccugggcugccuaucucuuuucuuugaagcagacauuuccuauuuuacauugcuguaugcauuugaaaauuauaaauugcauaaaguucuauaaaucagauuuuugcucuuuugugcuuuuuucccaaucuuuauacaacuuuuaaggguauaaauauauuucauaauguacucauuugauuaucuucucccgucuccuccuacgccuauugucuagaagaggaaaugagaggugaaauagucccaaaggcagacagaggcagaauggagaaucaagaugguuaacuccaaaauaguuacgaauggucuauauugucuuuguguagaaaggaguagugaggccccggggcggcauuguugaauuuggcaagagcuggacucaaauaaauugggggaaggaagaccagcagcuucuccaagaaccucauuuuuacagcagccagaccuuccuuucaauuauagcuauuauuuaaagcaugcuuguuuccugguauuugugcagaaugaguauuccuaggcucucaugcagguuacuccacacucagggagcaaauuauuauagauacagaauuauagcucaauuagacuugugcucccacuguagagagauuuuguuucaaaugucauccagugaaaaagaagucauccauggcugccugaucaccagauccagugacuuucuacauuugaccucucuccauuauggaccuacccuuaacaauuuaucuucuguggcuuuuggcaaagaggccuccuucugcccugccucugacucucccuccuuucuucaugguuggcuccuuccuguuuucaucgucuaugguugacucuuuuacccucuucuucuuuucaguaaugacagcaacaguaauaaaugaaaagcacuaaaugagcccaguggguauuugcugugugcuaggcacuaugcuaaauacugugccuacaucuuccuuaauccucacacaacugucuauggugaacauugucaucauugcuguuuguggaggcaaaacuuuugagcuucagagaggcaaagucacuugcccaagauuucacagcucagaaaauuccagacuccaaggcuagggcugccagcaguugcucucugcaggccagcuucucucuuuccagcuuccuugucugcccgcagcucucccuccuccuugacugugcacagccccuaucuggaugccugguuaaaccucaacccacucuauucccauguuuccccugggggucuugauuucccagucacccaggugccuccugagcccccgggaucuuaguaccuucuuucucuuccagggcaucucuucuuuaaaaucauaugaagugcuuuuuaaguguuuuccucaaacauuguaaacaaauuaaugaugagucccuccugcccuuuuaaagugaggagggcuucuuuuugaacuuuggguugcuaauacuuucuugagaugaauacuuuauuuucucaguugcuugcacauauuugaggauagcaguguaaaaaugggguuggaaagaaaguuugacaacccuuccuguuuuuaauauuuaugggggaccuguuguggacuacggugagugagugccagucguuaugggacucacuguguagcacuccagccccaucccauuuauauagauggugguuaccuccaaauggcuucaucuacugguugaacuugagaacuccaauaggaucuuggagggcaagugugugugugugcacacuacucaguggcaugcuucugaauugccuuuuuagcuuguuaaaaauaaagguucagcuuggugcgguagcuaacgccuguaaucccagcuacuugggaggcugagaugggaggauccuuugagaccaggagcucaagaccagcuuuuaagaccagccugggcaauauagcaagaacccugucucuuuauaaaaacaagacgggcaggauucuugggccucauccuacagcacagcuuuaguaagcuggguugacagaguccuggcgucaguauauuuggaaacaauaagucugaugaacaucccccucguuaagaaucccugagaccaacuuucauuuuacagaugaaaaaacugagaccgguagggguaaaaugccacagucaugaucaugccgcuaguagguggcagagugccaucuacaauucauuugucaucugagcuugacuggggcuccucuuaccacuuccuccccauuugagaacuugaugauuuauuuauuuuuuuuuuucuugagauggagucucacucugucgccaggcuggagugcaguggcacgaucuuggcucacugcacccuccaccuccuggguucaagcaauucaucugccucagccucccauguagcugggacuacaggcgccugccaccacgcccagcuaauuuuugaauuucuaguagugacaggauuuugccauguuggccagaauggucucaaucucuugaccucgugauccgccugucucggccucccaaagugcugggauuacaggugugagccaccaugccuggccauggcuugaugauuuauuaaccuagcccuaccuuggauucugagcccacccugucaagcauuauguuagcucugggggcauuacuauacuuacaggagcuuaagguggugguuuuauauauguauauucugcucuugauuuuuacaugagaacucaggccauuggcuacacuguucuucuuguuuauacagugaagucuugugucaugaagcugaaggaggcaaacugcuggugggguaccauggacacuuugauuuacccaccaaauagauacugagcugccagccuugggcaucuucuggccuucauggagcugguagccuggugccccuuuggagucucagucagugagguugggaggacagagaaggagaggcagagagugucuggcgcaggagaagcuuggucgggggggcuuuguggagaagguggggcucuuacccugaguccugaaagacaggcaggacuugaggaggcaaaagggaaucuuggagaauagaacaguaagggucaaggcugaauauuuaaugguaccuugcauuugggaugagaggaggcagcacagaugaauggaggaacccuggaaaaccaugguguguuagcugggaacaacugcaaguucuguggucacuuggaagauuagccaguucuaucaguaccaguuuuaggagcuuggacaaguuguguaacuucucagagucucaguucccucaucuguucaaaaauauauuuuuaagugguucuucuaaaagaauugugcaaguuagacuuagcagucaggacuuuaaauacugagucuuuauguaaugugagcuuauuuauuuguaauuuuuuguacuuuccccacuaguugcuuuugaugcuccacaguccuuucauaucuucaugaguuugugcucaugguucuuuccaccuggaaacgcuccccucuagccuccaacaucuauuucgaaucuuccaguaguuccauuagaacuuccucugucugcagcuucucagaugaccucaggcacaguucgcuucuggcuguauuuuuuuuucuuccuucucuuacagcccuuagauuauauucuccuuaucaguuuguucuuaaggcuccugcacuagccuugagcucccaaagagcaagggccuggcucauauucaccuggcacaaagucagcuccucagcuacccuuaguugaaugcaacagccccuugcugugucucgcgacuucagccaccuugcaugcuauacucagaucuaccauggacaugguuaugggaaaggagccacagaaaacaguagccuuaauguguccuucacagaacagaacccugggcuuuuggauuagguuuagauccaugcauaggaagccucuaguguaaagaguuccuggcaggagaauauggcaaucuaaauguugcgcaggaaaagcccugggauaucugauuuuugcauagugcuaagaguuucauuuucauacacuugacagagcauuuaucugucuucuuuacagccugguugaugaucguuguguuguacagccagaaaccggggaccuuaacaauccaccuaagaaauucagagguaaggugguggcuuuccuggaguagucaccuugacucacuugaaaauucuugaaguguguuguugguguguguguguguuuauaagcaaaauaggcuuauuuauuauguauuuuuuucagaguaugauuugaguucuaagcuuuacaacuugaaaaaugcauacauaaauuuaguaucaagauuggguuggcuuuuacuggguccuuaauuugucuauugaauauguguugacaagugcuaauucgguuuaaagucuuacauuuguacagguauuucuucaaacaaauaguauuuauggauccagucacagggaacauucauuauuucagcagaucucacuguccguuuggggaugcugauauucuuagauaccuucuuuaagagguaucuaaugauaccucacugaaugucucacuggaaugaaacguucuuaauuauugcacuuguuuuuugaguuaaaagacauaggcaggcugggcacaguggcgcaugcuuguaaucucagcacuuugggaggccaggguguggagauugcuagagccugggaauucuagacgagucugggaauucuagaccagccugggcaacauggugaaacacugucucuacugaaaauacagaaauuagcugggugugguagcaugcaccuguagucccagcuacucaggaggcugagguugggaggaucaccugagccugggaguuccaggcuacugugaaccgagaucgcaccacuguacuccagccugggcgacaaagugagacccugucucaaaaacaaaaacaaaaacaaaaacaaaaacaagacauaggcagggcagcuuuucuacccaaauuaguuuuuucuuuaggccuccugaauuugguaucuuucuccaaagguagcuuaguuuauuguaggaggucuuugaaauacacuugguaucuuagaugauaaacauuuguuuuucuuuuuuguuguugugguuagugguccucagcucuaggcacauguuagaaucaucugaggaaguuuuuaaauuaaauagaugcuuggggcuccauuguagagcuuagggaucaacuauagagcccuaacaucuauuuauuaauuaaauuauuuaucaauuaagguaaccucuggaauuggggaugauucuuuacagccagggcggaaaaccacuggguuagguauuugacugaugacuucagucccaaagggcucaaaucuugccauuugcagauuauauaacucaaguucuaaguucuuauuguuuagugguuuagaaacuguuugacuuuuuuggauaaaagcuaaauaaauuagaauaaaauagaacucagacguucagauggagaaaagccauuuggaagacauuugguguugaguugcauccaguuggcgugagacaaucaggagaauguuuucaccugaggauggguggugguaggggaggcuguuaaagagagagaauaacaguuguugauacaaguuguaagaggaacccaaggcggcuacugccuccaccgccuuuuucuucucaauccuucuuucauguuuccuuccaagacaagacaaaaucuugagugcugcaaaaaugaaauguuucguccaacgaucauaauucagucacucauagaauuacuuccccacugugaauauuaaaagggacaagaucaauugacugugccaggcccugugcuaagcacucugccugcauuagcucagggagccaucccuccucccuaggaagagauugauacccucggaacuuaagaaccuugucugaggucacauggcuggugacggauggagugggagccaugguucucaacuuuggcugcacagggagaucaccuggagaacucucagaaacacugauagcugaauccagcucagggauuuugaguuaacugggcauugggauuuuugaaagcuucucagguguuucucuugugcugccaagguuaagaaccauggcuaaugaaaucuaggcuaauaaaacuugaacuuuguuauucagggaagagcugaucuagguuucgcuuuugcagcugggaccaaggggagggauaugcguccggaaggcauugcuuggguccagcgugagcucuuaucuuguucuauauacgggccuugggagcugggagaugaaccugggagagauucuaauguacuguacgaaguuaacuaguggcuauuuguuuuuuacaaauacaugcacauaauuuaaaauuuuguuuuuuaaaucgacauauauuuaugguguacaacaugauguuuuagaauaugcauguauaguggaauggcuaaauugaguuaauucauauauacauuaccucacaugcuuauuauuuuuuuuggugagaacauuuaaaaacuacucuuagugaguuucaaauauacgguguauuguuauuugcuguagucacuguguuguacaguagaucucuggaacuuauuccuccuaacugaaaucuguaucccuuggccaaccucucaauccuccaccccagccccuggugaccacuguuccacucucuguuucuaggaguucaaucuuuuuagauuccacauauaagcaagaucaugugguauucgucuuucugugccuggcuuauuucacuuagcauaauguccuccggguucauucauguugucacaaaugaaccagggacuguuugaauacaggguuagaauguuaaaaauaaauaggacuauagcaggggaagucggaggagacauguuuuucuggcacgacuguaaaggugccuggugcuuggauguauguaugguggcugauuugaagugacuguuuugagauaacgguaauagucugacagaagcuauuuggaaggaagcaaacuccuuuuacagccuggccugguucuacagguggucacgugacagugacuugauuuguugagugcuuuucucccuaaauuaaaaauaaagguuucuggguugugagaugcuucguccuugugggaaaaucugguucaaaacaagcucugcugcaggcuuugggaauguaggucaggacuuccuuaauuccaugugcuaaaccagagguccccugcacccaggugaggggccuaggcagcucugccuuugcaggcugccucagugcuggaaagaucugcuucuccaccguggaacuugggcagugaguuuuaaaaaauuuuccaaagcauuccuucaacugcggugcagcauacuuugacguuuuuuuuuuuuuuuuuuuuuuuuuuuaaaugaagagaaagaucucucuuuuggaagcaauugcugcguuuccaaauauaaguguauuuuggagcugaagucauuuugauguuuagaaauugugcauagggcaguugggcaauuuggaggcauuucuaguccauuuccucauggacucguugcacccuagaguuuaacaaacacauauggaaaagugagaugcuggcaagcagccgaaugggaugauggagucuuuaucugagcaaucagcagagcugcauguagucauuuggguuugcucuugcuuccauuguuuccuugccaaguuauuuccuauauugagaaccaucauaaccuguucuuaaguaaauggaaauccaaggccuguuuaugcaauauuccccauggcuucugacuuugcaucuuuaauuuugugagcuccugagaucugcagcccuaaugguuaauaaaagaggcucuuggaucaggcuuccugguucauauccaaguuccaugaauucuuugcugugugacccugaacagauuacuucaccuuugccaaccuugguuuucucaccuguaaaaugggagaggauaauaggcucuaucucauaaggucauugagaagauuaauuguguguuaagaauuuaguacggggggagucugacccuuaguuaagaguuuaagccuuauucuuuucuuuguauucccaguacuuaguacagagccugguacuuguaaaucucauguuuaauuuuaugagaauaauuauauauuguuauuuuuuuuuugucuucaaauuguuuguggguggggacgugcacaugaaccccugggcuuggauuugagccccagugcucguguaugcaagcugaguaaccuugauagauuccauaauauuucucagcuucuuuccucacuugugaguuagggucaaacaauuccauccuuaucaagauaauaugcauaaaaagccuaauagagugcuuaguacacaguaguuguucagugagugguugcuguuaauuuucacaguagauauagaagaguucaacaucgaacagaagauauagaagaguucaacaucgaacacacuugcuuuuuuuucucugaugguugaaaguacauuuccaaagugaauugcuuuuuuugugugugugugugauuuccuugaauguaucucuugccucuaacuuccucuguaggaagaaaagguuggcugcacaucuguuucacauaagccacaucuuuuucaucugaaugaauuuuggacaauaucauuguccucguaagggaugaggagagcugagacuuagaauaauacagcaacuuuaguucuuuuauuaauaugguaccauuuuaaagccccaacauccauggaagguaaggcagaaccuccucuucucccugauuuguguugucuuugcccauaaucuugaaagaauagagaaggcaaacaucagauugaaacagggaauagaaacuuugugguuagugaauuccuuuaucuguauuaucuuuuccucuucccacuuuuaccagucccucccccagcucccccggugcuaaauauaaagauaucuacaaagaaaagguggaaacuaacaaccagucuucauuuugcucccagaaucucugcucuuuuuaaauauaaaucaccuccaggguuguuggaguagaaacaagggaacugggcuuuugggcaauuagauaggcuuuaguguugaucaugccauuauugcauaagauucgggcaacagucaggcucuugcuuucaaaaccuaaucuucucuguucacaucaagaggccagucauggcuccaaauucuugauguuggacagauguuaccauaucaauaauaucaaaaugugcagcuuuuaacuuugcagggagccccuuaguuucagaauaaaagcuguucgaagggaaacuuacaguucaaaaugaggagaaguuggggcaggaaaaaaugaggugaaaggaaucauuauucuaucacuaagugguucauaugaauuggggaggggaucagacagacugaauauguggauguuccagauaaguaucuuacauuucucuuucccagugaaguugguuucaagcaucauagucuaaucuaagcaaauguauugugaaaaaugaguguugaccuccagcgcugaggcccuacuguguaccagcugcuggccuuggugauggcaggacaagaugaguuacacuccuucuugcuuucaggagucuuagaguuucauggagaaacagacccacauuauaaguuacaauagccaauguuaauacagcauuuauuuugugcaaagcacuuccuuugaauuaucucuuuuaaucugaggaacccaccuaugagguguaggucuugauguucccauuaugcaguugaggaaauggaagcucuaagaaguuggguaacuugcccauagucaguuaaaugucacuucuuagaaugauuaucauucauuucacaaacacuuauuggguaguucccaugugccagccauuuguacuccaugaggaaagagacauucucaaagaagucuacaucaauauguagugaaaaucuuuaagaaacuucuuuagaguaauuuguugucuucacugcaacuauuuauauauaaguagaagcaaagcaggugaaauuucuuccuaccuaguauaaaaccuggccuacuggggaaaaguaaaugaggaugcuuuucauguccuaaucuuucgcugugcagcacccugagaccagagcgcaucuauuugguaccugaugccauuugagaugacaaguuaugagcugguccagugccaugugacuuaugagugucguagccagagcccucuuccaaaggcugggcccagugcuuuucuuccuuuguaguuuuauggagacaaggucucacucuguugcccaggcuggauugcaauuguguggucauggcucacugcagccucgaccuucuggguucaaaccauccuccuuccuaagccucccgaguagcugggacuacggacauaccccaucaugccuggcuucuuuuuaaauuuuuguagagaugggggucuuguauggugcucaggcuggucuugaacucauggccccaagccauccaccaccuuggccucucaaauugcugggauuacuggugugagccacugcacccugccacacuuaaugcacuuuuagccauugccccaaccagcugugggaugcgcaguauguuacuuacaguaggaugaguccuguuuguagugcaaacgagggucuggccuggggcaguauaacccaguuucugggcauuuccagaguaaaauguugguggaagaccccugguuccucaacauaugcccggcuagaaauaaugacagucugaguauugugcagucaccaugauacuggcauggagaagaguauguugcuuggcuauaaugagccgcucuuggaccuaaagcauggccaugaacuugaggaucacacuuguggccuuuuuauuuuuauuggugccuucuuuccccagucccagagugcuggcaccauguuagccccuuuuaguagcaugcugguggauuuaguaggauuauuuuauugagagagagaaggguuuuacaucucaugcaagcucuuuguaauugacuuugaaaccucccagcagcuuaggaaggguccucaaauaagaauggcauuuuucaugcuugagugauaagaaacacuugagugucaauagccuacuucucugaucuuggucuugccugcaauuuagguuaaauauaggggaaagagcaaccucuggaugccagagcuagcauccagcccagaaucugccaugaacugcuccaauaccuuggagaagugauuucgucucucuuagccucaguuuccccaucuguuaaauuggguuuuuccaagauuucauccagcuugaaacuuugcuauuaguggcggaaacaggcagguuaacguuagaagccuugugcuguccagaaauagguucuuauuucuuugggauuacaggucucuuugucaagauagaugagugcugguaauagccaggccuuaaccuuacccuuaggccagauggggacacaggcagggucuugggucacaaaggucaucuaggguggcuauaacaaacucaccggcuuagcuuucuuucaaacgacccuccuuugccgcacauuguuuuaaauguugcuaagcaacaguauuuuuugauuuuuuucuuuuggcaaggcaucgaaggaaugaauccguaucuuacuuaguuuuaaauacccucaugcaaaggggagggccuaacuuaaauuuuguuuguucuuuugauucuaauccaugacaggccuuucauaguagggguauaggacuuacuuucugccugucuuguuaaauaaggcagaaaaaucagucuauuuaaggugcuugucaaguauaugccuugaggcauauugaagguuucaagagugugugcagcugccuuguaggagagucuccuccaacuuguucuguauucacaaaaucaauucaaauuuaauaaaaagauuaauaguuuuuuguaaucuucauuucagauuuacuaguuuaucucaaucuuggaccaacagacuccauuuaaagggaacaaaacuguaauuuaagucaauucccugggcaacauagaauguucacaguguguuacacaaucgcuggggauggugccugcugccugauuaugcuggagucccacacacugcagcguaucccucacuggauugcugccuacuugcuucaagcuaugagaugcaugucugaaggcucuggguacccugaaaaugagcauaagggaauuuguguuuacuuugaugcccuggauccauucuuuuuugcauaccugagucacccuggaaaguagaccucagaccccucuuuuauagucauuuacccuuaugauuuaguugcuaauggagaaccauuuucacuaugugcauaaaaugcuucuagugcaauaaauaaguuuaccuuguccuccaauugaaucacuguauugcuuuugugacuuccuccauugagggugaaauugauuuggaaaucucagcaagcguaauggggucauauugucauauugucauauuguuauaugguucuccugaaagcaguauacugugguugauuacggacuuuuucuuuuggcaaaggguuuuauaaucccgucuugagcauugaugaagauguguggugaaucacuugagcuuaugauaacucuuuuccuuucuuguuugacaugugagaaaauuagagggauuuagaaagucuccuggggucaaagagcaauccugugccaaaacuaggguuggggcacaaccccaguuucuacucacacugucuuuuaggcuucuguguuugagccaugaauuaaaaauuuuuuuugguuccaucacccuguguaauuaaugauaaccuacuuuuuauaaaugcaaauaauagugaauaccuuguguagugcuaagagacauuagugaauauaaucuauuuaauuaauauacuuuacauacacucauuuauuuaauccucauaacaaccccauaaguaagaccgguaccuuucuacagaugaggaaacugacauguaagauguuuagugucugguccaagaucacguagcuagaaguggcagagcugggauuugaacccagucaaucuaacaccauaaauccuccucuuaacagcuacucuaaacugccuuuagaaguggacuggccuugaaauauucuuugacaaaaauuacccgauuucuuaacuuccuccucugcaaccccaaaguaugucauugugagcugcauugacacagaagaaaaagucuacagacaagaggggcaugcuaaccgccuacuuaacaaucuugaguauaguauuuaucacuaucugauaaauacacagcuacuguuuucuccucgccagauuuuggagcacucaaagggaccaaaucuugcccugcacuccuggcccagcaccuggcauaauguugguccuucuuuaaauacugguugaaaaggaauugguguucuuuucugauaugauuuugacugcucccaguucuagcaguguuuuugcugacauuuuaaauugaauggccgcugaucuuuuuacacugaugacuuaacgcugcccuguaaucuugcuccaaacuaccugagccuguuacucuugaaaagcuuuccuguaggcugggcaugguggcucaugccugcaaucccagaacuuugagaggccaaggcgggaggauggcuugagccuaggaguuugagaccugccugggcaacaaagugagauccugucucuacaaaaaaugaaauuagccaagcauggugguggucacauguagucccugcuacacaggaggcugaggcaggaggguugcuugagcccaguagguugaggccgcagugagccauguuugcaccacugcacuccagccugggcaacagagcaagacucaacaacaacaacaacaacaaccccuaaaacugucuuguaguugacucgucuucucccuggaaaguggaucuuauuggucucauucucugagagugucuucuccuugacuccuaauguuugaucuuuuuucucucuuucaugccuauaguuuugagauuccuuggcugcauucaguacaugagcaugaaaaacaaauaauuguuaaguaccuuccuccuuugugcuuggcuuucugauagggucaugcaugcuuuuguucuugaccguuggagcacacugugacauggguacuguuauguccccauuuuacaguugggcacccugaacccacagaggguuagcaaucaagguguaucugggauuugaaccuaugucuggaggaccacacagugucugccacuuaagugaauucacagaguugggcugcucagaaaacacuugaggcuucugauguccuagguuccacauuucaaaggcauguugcuucgugggaauaaagcuaacgcagggguaacuuggaggcuaggucuccauucgauauugaaugaugacguuuuagauuagcuccggcaacaacauuucucaccaaaguugcugcacagacuccucaccuguuucuguaauuccaccuuugccuccuuugugucugaguguggacaccuccuccaauccaccguuuacugcggcuaggggaaucagcacaggucugaagaugucauucagcugcuuggaaccucauagugguuccccaguugugcucaggauaaaagacacacucucaggguucccagcagucugcaugagucaccacugcuuaccucucagccuuaucugcaguaacuccuccagguucucugcuccauccagauggauugacuuccuucuggcagucagaauacuugcucuguacucugggacuuugcauguccuguuucuucugccugaaaugaucucccuaucucuguuguuccuuccuggaccccccagucuuucuaaugcccacucaaccuucaaaucucaggcaucuccucuggggcaccuuuacugaaccuuugugugcaggcaagcagcugcuccuuuugcacagacucugaagccagacccuguggguuuggcucucagcccugcuuuugacuggucaugucaucucagauguauuacuuaaccuggcaaugccuccacuuucucaucuggaaaauggggaaauuauuauguauaccucacaggguuuucaugaggauuaaaugaguuaaucuguguaaagcacuuacgggacuaccugguccauauuaaaugccauaacacugcuaauuuuugguuuugacuuuuaacuugaugguuuugacuuagcccuuccccccuauugcauuaacugugaggacagaaaccaugccugucucccuaaggcuuugcacagguucuggacuauauuaggaacuaaaauguuuguggaaugaaugaagagagaccucuaaggcauugcuucugagaucugacugcguauaggaaccaccuggaaucuuguuaaaguguagauucuaauuagguagucugaagugagaccugagauucuacauuucuuuuuuauuuauuuuauuuuuauuuuuugagauagggucuugcucuguagcucaggcuggagagcagugaugcaaucaaggcccaccgcagccuugacuucccaggcuuaagugaucuuccccccucagccuccuaauccugaguagcugggauuacaggcgugugucaccacacccagcuaauuuuuguauuuuuuguagagacgggguuucgccacguugcccaggcuggucuuaaacuccugggcucaacugauccucccacuuuguccuccaaaaguaucgggauuacaggcaugagccacggcacccugccgagauucuacauuucuaacaaguugucaugcuccugcaaggcucucgggagccacugacuguuaucuucccuuauuuuauggcuguccuauagaagacagauguucugagcccagagcaauagagaaugagggcuaguggaucaaagugcccagagguagaauaugaggcuuaaaagaacuuaauucugacuauuagugcugagcaguuacucaaagaagaggccugcuucaaauuacugaguuucccccgauucaaagagggcugaccaucugucggggauuuugcagagggaauuucugcucugggacagagguuagauggaugauuccauuugacuguguguguuuucccaccgaaggacccagcuguucuuucuguuuuugcuuccuguggaagcccuaugguugggagcguugggucaauaaacagcuggggagagcacagaugcacuguagacaagaaacucucuggaaacugaauggguucaauccaauugguaagagaacauuaguggaaagauggcauuauugaauguuugaaaaaaugaacaaauagaaaaaaacaauagcuuucuaagucaaggcuugccgaauccggucauaaugaguggguaagauguccuggggagacacuacagcguggugguuaggagcacaggcucuggagucagucauggguucaagucccugcccugcucuuacuaguuauaugaccacaggcaagucauuuaaccugucuaugccuuaguuuccccaccuggcugccauggugaauaacacuguggagcugauaggcuugugugaggaugauuuggugcauguguaacacaguaaauaccugcaauacagccucagcacucagugaagaguggcuauugugacugaauuugcaauuagcagcuuucgggacaucucuuaggaagcucaaacauggccuuugccaucuuguaaaacaucgauauguccguuuuaaaaacucagccaguggaguauacaaaggaauccauagccaggcagacuuuagccuuccugaauuuuuuagauuuuauugagugggccugguaaccagcuaugacagagcuuggggcuauuagaaaagaagccaucagggcuuuucucuccucgcacgagccuugaucagagccucaguuacugacgggucguuugcucgagaugguaauccugccuucuguauagaauuacaagccuagccagagaggaaguuguguuuaucuuaccccaaacagcaggcauuccagugacucuugacagacaggaggaaguuauugccaaucugcucuuucccaaaagcugcccuucccugcccccaacgugcuccuugcauguuuagagagguuucugccagccagccugccaaguggcauucucucccgggcuuugaggacaguugcauuugcagaaggaauguccagaggcuacuucuuuuucucuuuuaauagauuuaggggauacaagugcaguuuuguuacuuggauguauuguguaguggugaacuuuggucuuuuaguguacccauggccccgguagugaacauuguacccaauggguaauuuuucaacccguaccacccccacaccuuuuggaaccuccaguguuuauuauuccccucuauuauguccauguguacccauuguuuagcucccccgguggcggcuacuucuauauuauuggccaagguggaggcaucucuccccaaggugaguggucagccuggcucuuacaggaggcaaaaauugugcuuauucucauuggcacugauuugggagagauaaguggagaggggcuauaggugugaagaaaagaauacaucuuuucaaagaacccacguguuuuccuuuccaaaacaauagcuggaggucaguguagaaaaacuccaacuugagcaguugcaauaauugagaaaauaaguugggcaauuauuccucuaacugagauuuaaaaguuccuuucuucgucugguauuuuuccggguacauuugaguuccaauuugggugcuucugaaaugucuggauguuuugugcugcuaaaauuauaugugucuaaaaauguuaucagugaugacacuuauauauaagcucgcuuggacuuaugcuagcaaauuucugugacuaagguccucuccucccccuauaaccauucccagaaucguggcauuugagguaaagguaggaaauagaauaacccaacuuagguuuagcaaucaagugaaggacuaucacuugagaacuuugcuucggucuugucgacaaagaauacgggguuuuguuaccauaguuucagugaaaaauuugaccuuagcuacaauaacauacaguuagaaagaaccagcuaaucgguuuucuaaaauuaguguucucuaguacauaaaccaguaggaacagaguauuuaauuaaauauuauacaaggauauaaaagcccaggggaaugcagucccuugaucugggcggggggagggaggaaacccacagugcuccuuuacuggucucuugcaagcuacaagaacuuuacuucuuuuaaaaauguuaguauugguuuuauuuucagaucugucaggaaugaauuuauacagcuugcugagagagcaaaauaaaacauucagcauuauuuccaguuguccccuacaggguacaaacuaacaaggcaagaugugaaaaugauguugggcuaggauucugauaaggacacuuguuggugaucugcuagaugacuuuaugugaaggaaaauuauuuucuuuuuuuuuuuuuuaauuuuuuuuuuuuuuuuuugagacggagucuugcucuguugcccaggcuggagugcaguggcgcaaucucggcucacuccaagcuccgccuccuggguucacaccauucuccugccucagccucccgaguagcugggacuacaggugccugccaccacgcccggcuaauuuuuuuuuguauauuuaguagagacgggguuucacuguguuagccaggauggucucaaucuccugaccuugugauccacccgccucggccucccaaagugcugggauuagaggugugagucaccucgcccagccaggaaaguuauuuucucuccaaaaucugggcauuuuaaagcaacuaauuucuagacucuuguuccuuugaaugccuaaugugugauuaaguggggccaacgucuccuaguucugaguacagcuauaucugccucccccaacuccacaggccauaagcaauaaucuguaugaagauuauguaaaauuugacaucucuuuucaucuacuuaucaagagccccagcaguagcucauguuucugauaguggcuggaaaugucaucaauauugugugaacuuagaaagcugugguaccauuucuggaaugaaguggcuuccagauuuuguaauuucaggacaaagagguuucugguccuucauugacacucuucucugauuuuauuaucaccugcccuggaggcugcagaggugcaacuggaguucagucguuugccagguuuaucacugauuggaaacauugcucuggguuuucuugaacuucuauuguuguaucucuuugucaauuacauauugauacauuuucuuaauuucaguuuuaugauuucagcuuuuuaauuggacuuuaagauaacuaucuaauagaauuggaagggugagguauauuuaagggaauacaaauguuuuuguuugacguuuuuaccauuuugcauguuucuguaguggcaucucaacuauugcaauggaaaauauguccuuggcaagacucuuagaaacacagccucaaaggucauuggauugugcaagcuucuugacuauuuacaaggucaccuaccugaaugaauagaaaugcucccugcccuuaaggaauuugcaauuuuaugaagagagaugagugagaacuacuuuguggauuauucuuggagaauguugaaucccagaugagcuuuuaguccccugauguucauuguuuuuaucuaugccaucagaucacugugcccaaauaauuugaauucauguuaauaauagcuuacgaaaaaugcaguaagagagcuugcuggaaaagugacagcaugcauuuuaaauuacuucuaguugaccuggcuuucauuacccaaauauccacaggcccuuccaugaauauggauaauugaguugauauuuagcaaauaccauugaagagguuagaugugucagguugguuguuggaauggugaacuagacucuugauuuuggaugauagcuuaaacuaaccuaaacaaaagggggauuuuuuggggucaaucccagacgaacagcugaauugcaugaaggacaggagugcagcaggggcucaggaaaacacagauucaggcauuugaguacugucagcagccuacguccauaucuugugucuucuuucugugcaucuuucaccuugguuucuuguccuguccucuucggguuuugauaucaagguuauaccacacugaaaaugaguuguggaguguuuccuuuuuuuauucucuaggggaguuuguguaauauuggaauuaucuguuccuugacaguuugguagaacacgugaguaaagucaucccagccaucuguuuucuuuaugucaaaauuaacuacugauucacauuccuuaugucuuuaaagggcuguuucuuccuggguaaauauuguaagcucuguucuucuagaaauuuacccaugucaucuaaguuuucaaaucuauagucuccuuguauuauuuuguuccuagauugacugguuuuguccuugugguaggcugaagaauggccccugaaugucuucauccuaguauauguuaccugugaauauguuaccucauaugguauagggauuucacagaugugauuaauuaaggcucuugagauggggagaguauccuggauuuccaggugugccugaucacaaggguccuuguaggcuagaagcaggaggauucgaguuaauaggagaugggaggauagaaacaauagguuggagugauguagccaugagccaaggaaugcaggaagcugcaaaagucaagaaaauugauucucucuugaagucuccagaggaaugcagcccugcugauaccuugauuuuagacuucuuaccuccaugacuuugagagaguagauuuguguugcuuuaagccacuacguuuuugauuauuuguuauagcauugguaagaauacaguaguaauuguccuaauauuguuuauuugugcguucuuuuuuuucuugaauaagcacugacccauguuuuuucugucuuauuacucuuuaaagaaacaaauuuuggcuuuauuaauucuuucuacgauagguugguuuugaaguucauuaauguuugccuuuguuuuuauuuucuucauucucuuucuuuagauuuauuuuguucuuccuuuauucuuuuaaauuagauaaucaauuuacaaaucugacuucucaaauuguaauguuaagcaucuuaaucuauaaauucccuuaaaauauugccuuaaacuuaaacaaauuuacaagaaaaaaaccaaacaacccuauuaaaaagcaagcaaaggacaugaacagacacuucucaaaagaagacauuuauguggccaagaaacauaugaaaaaagcucgacaucacugaucauuagagaaaugcaaaucaaaaccacagugagauaccaucucacgccagucagaaugguaauuauuaaaaagucaggaacaacagaugcuggugagguuguagagaaauaggaauguuuuuacacuguuggugggaauguaaauuaguucaaucaucauggaagacaguguggcgauuccucaaagaccuagaaucagaaauaccauucgacccagcaaucccauuccuggguuuaaacccaagggaauauaaaucauucuguucuaaagauacaugcacauguauguucauugcagcacuauucacaauagcaaaggcguggaaucaacccagaugcccaucagugauagacuggauaaagaaaauuugguauauauacaccauggaauacuaugcagcuauaaaaaggaacaagaucauguccuuugcagggacauggauggagcaaacuaauucaagaacagaaaaccaaacauugcauguucucacuuauaagugggagcugaacaaugagaaugcguggacacagagaggggagcaacacacacuggggccuuuuaggggaugggugaggggaggaagagcaucagaauaaacagcuaaugcaugcggggcuuaauaccuaggugauagguugauaggaguagcaaaccaccaugacacauauuuaccuauguaacaaacacaugcacauccugcacauguauuccagaacuuaagauuuuaaaaaauuuauauguaugcauaugaaauaauuauaaacauugacuucaaaaaauugccuuaguuucuuccuacacauuuugacaugcaguauuuuucuuauugaguucuaauuauuuucuuaugucuguuauuuuuuauaccuacgaguuauuuagaaguauuuuuauaguucugauuuuaagggauguuucuaguucucuuuuuugaaaaaauguuuuacaacuuaguuguguguuggucagauaauaucuuuguuuuaucaguccuuuacaacuugagaggcuugcuuuguggccuagcaaguuaucaaauuuuaugcauguucuacugugcuugaaagaauauauauauauuuccaaucuuaggugcaaugugcuauauaugaguuuguugguuuuuuuaucuccuugaucuauccaguguugagagacauuuguuaaaauuuucuauuaauauuuugggcuuauggaauuguuccugauuaugguggugguugcaugaauuuguguauauguuaaaacucauagaacuguauacggugcuauggcuugaauguccccucccaaaacugagguuggaacuuggucuucaauguggcaguguugagaaguggggccuuuaagaggugauucauucauggacuaauggauuuaauggguuaauggauuaaugaguuaucauggaaagagaacugauggcuuuauaagaagaggaagagggacccaaguuaguacauuagcaugcucagccccaucgccaugggauacccugugcugccgagggacucuuuagagaguccuuaccagcaagagggcugucaccagauguggccucugacuuggaucuucuuaccuucuauaacuuaagaaauaaauuucuuuuccuuacaaauuacccaguuucagguauucuguuauaagcaauggaaagcagacuaagaugcaaaaaaaaaaaaaaaaggaaaauuacuuacagugaauuuuacuauaaguaaauuaguuaaaaggguuaaaaaaauucucacugugacaguaggugugcaauuuugccuuguaguuuuuaaguuuuuuaaaaagguuuuuucuuuugccuuacccucaguuuuuucuuuauguauaaugagguuauauuaguaaaugcuuagauuuauacaauuauuauuacuuucuggugaacuaaauauuuaucauuauguaagaaacauuuuucuuucuaaugguguuugacgucuuauagucuguuuugucugauauuaauauaccuacaccagaauuguuuuaguuaguauuuguuuaaauauacauuuuauuuacuuuuaaauucucugucauuauauuuuagagcugucucucauaaacuguacauaacuagagaacuacucucucugaccaucuuugucuauuaucuauuaauuggaauguuuaguccauuuacauuuguuguaauguauuuauauuuaugauuuuaauuugugggguuuuuuaaaucuuuuuuucccccuccuuuaaguuucaucgaaggcuuuuguguguguguguaugugugugugcacguguguguguuugagacagggucucacucugucacacaggcuggaguacaguggcuugaucucggcuugcuguaaucucugccuccuggguucaagugguucucccccugaguagcugggauuacaggcaugccaccaugccuggcuaauuuuuguauuuuuaguagagacaggguuucaacauauugcccagucuggucuugaacuccugggcucaaacuauccaccugccucaggcucccaaaguacugggauuacagaugugagacaccacgccuagcugugcuucauugaagguuuuuuucauuguuguucuccauucuguuauuucccccucuacugauuuggaggauauacuuuauauguguuuuuuuuuaauagaaguuaccucagauauuuuaacgugcauauuuaauuaacccuaaaguuuauaacuaucauuauucucuccuacaauacuaggacauuauagaauauuuaaacuccugucauccucucucagucuaugcuccuguucaugauguuagugcuuuguuuuauauuaaaacuugcauauuagauaugauuuuguuuuauauugucauuaaaaaaauuaacuuacguauuaguauuuacuauaccuaucuuggauaauuuuuuuucugccucaagcacauucuuagaauuuggagaaucuguuagugguaaauucuauuuuguuugaaaauauucacuuuuaauucucugaaaauuuuacuuuuauuuuuaggugacaguuuugcuugguuuagaauuguagauugauggguacuuucugucagcaucauuauuuuuuugccuuucauuguuguuaaaagcaaccuugcucaguauuuuuuuuuccccucugguuacuuuagaggaaucucugucuuugauuuucuguaauuuuacuaguaugaauauaggugucaguuucuuuuuauuuauccugcaugauauuuguuaaguuccuagauuugagguuguuuuuuguuagcaauuauggagaauuccgagcuguuaucuauucaaauaccacuuuuuuuuuuuugagauggagucucacucuguugccaggcuggagugcaguggcgugaucucggcucacugcaaccuccgccucccagguucaagccguucuccugccucagccucccgaguagcugggacuaccagcacgugccaccaugcccagcuaauuuuuguauuuuuaguagaaaugggauuucaccauguuggccaggauagucucaaucucuugaccugaugauacacccaccuuggccucccaaagcgcaaggauuauaggcaugagccacugcgcccagccgcuuuaggcuauuuuuuaaucucgccaucuuuuucaucuuugcuccauaggcuggacucuagguaauuucuucucaucuuuguuuacuauuucuguucuauuauaaucugcucuguauucauugagaguuuaauuugaauuauauuuuuccauuucuaaauguucuauuugggacuucugaaacguuuggucauucucauuccuccauauuuucaagcuucuacuuuacuuccuguuaccaaaaaagcacacuuuaaauauauucuaucucuaaaaauuacaguaggugcuaucucuacagaucuuauucuauuuucuacauuggcuguuucugaaaaugguaucuuauuucccuguguguuuugugauuuugacuaucagcuuguguuuuuuuggcauuucaucugugggaauuguuugaggccuggguuaaagucauguuucuccccagaaaauuguuuccuuuugccaguugccagagaugcugccaacucaagacuauuuaaaucaaauucuuugccugaaaauuuuaaaauuuuguuuuagguauuuuuugcuuaaauuuugggaauuuccuauauauguuaauuagggugacaaacgaguaugaggguaacuuauuuaucuugacuuuggcucuagguauaagagagaaaacucuccucguaguucacaaacaaguuaccuugccuuccuauuuuuaggguugguugguuuguuguucaccauugcauugaagcuguagcuucuuguguguggcgggggggugggucugagcuuuaugcaauggucucuuagaaaacuuuugaucuugaguaggugcagagcuuuauccccucuaccuggcacuaguaucauaauggaagguuauuagguucuccagauauucucagaguucucgcuuuagaaaggacauaccuuccaggggucuuguuuccacuucauugcgggcuucucuggauucccuucuauauaacugcuucaguacauuucaaaauguuuucuaauauuucauccagcuuuuucuguguauuaauugauacuguaagaaaugcauacuugcuuccugcuccuuuuuuugucucacugucauuuucugugugauugaaaacauugcuacccauagcucuuaaaauguauaauuuuacaguuauaaucauuggagaaagacugauccguguuugaauauuuaaacaagugccugggugugguggcucacaccuauaguuucagcuacucgacaggcuuaggugggaggauugcuugaccccaaggcugcagugagcugugauugugucacugcacugcagccugggcgacagagcaagagccugucucaaaaaaaaaaaagagaaaaaaaagaaaaaagcaauucuagauaaggaacuuugugguugaguuugggucagauuuccuccucugggucaaucugcuuaggcuggggacuuggauuaccuguguuaacauggaagcucccaagaaaaccauuuaggcuagacucaguuccaaaaacaaaucaaaacaaaacaaaacaaaaacaaaaacaaaacagguaauaaauauacaguccagguauccacugugaugguaaucaagggauaaagaaugauauuuguucaagugauccucuugccucagccuccugaguagcuggggcuauaggcacgugccaccacgccuggcuaauuuuuguauuuuuaguagagaugggguuucacccuguuggccaggcuggucuugaacuccugaucucaagugaucugcccaccucggccucccaaagugcugggauuacaggugugagccaccaugccuggccguauuuaagucuguuaggaaugauuuugacugcaaguaagagagaaaauccaccuaauaguggcuuaaaacauaagggcauuuguuguuuccuuagaaauccagagauaggcaauaucuuauguagugaaagucucaaaaucgugucuuuuugcuccacauccuuaguguaugggugcccccauccccaccauguucuugucacuucaugguuacaaaauagcugcagugguuccaggcauccuguuugcuuucaugauaaggaauaagggacaacacagugagcucuccuuucauuccuguuccuuuuuuuuuaagacaacaaaaacuuaucuucaugcuccuagcagucuacuuuuauuucauuagucaaaauuggguuuaaugcuuauuccuagcugcagagaguuugacuggaagugagguuuugucuuuucagccuuuauguuaagaagcagccaggucaccaugugguggaaauuguuugggagacaacaagcuuucuauacugugguuuauugguugcacauugaggaauccaagugauucuccuuccaucuaguuuuuagugucuuggugauugaagaauaccagcuuuugucgacaguacagguaauguaacuauccacaggagcaaguagcucuuacucuagccaucucaaauggaugcaagcaaccauacguauucaccugaugccaguauucaccauaaauaguaugaguguuagugacagcagaggcuuuaaugaguaauaggcacuucauuuguuuuauuggcuugcaucugagaaguaccuaagcuaauaguuucugcuuuuuguuagugaugccuuaguuuggcuagcuaaguggggcuagguaaagaaaaaagcauuuuauacacaugaccaaguuugggagggauccucucagucguuuuggacugacauugcuaacuucguaaagggaaaugcauagucugagauuuucucuuuaucugucaucccuuuuaagugauggcguuggcagagggucauucucuuagcuugcccauagcuuugcuuucauugcaacaacaacuuuuuauuuuuuagacagggucuuacucuguugcccagacuggagugcgugugguggugcacucacagccuacagccuugaccucuuaggcuuaagcaauccuuccacuucagcccccaaguagcugggacuauaggugugugccaccaugccuggcuaauuuuguuuauuuuuuuguauagauggagucucccuauguugcccaagcuggucucgaacuccugggcucuagcaauccuuccgccucagccucccaaagugcugggauuacaggugugagccacugugcucagccuggagcuucucaugaaucaaaagcucccugguagaaucaagaacaauuugguuaauaauuuucacccucgaacagaugagagaaaaacccaaaaugaaucaguugaucuguuuaaacuuuaauauuuauuuuccuuuucauccuaaaggaggaaguaguuuuucccagaaagcaguguggaaacuuuccuguucuuauuucuauacuuguauauggaggcugcuuaugguauauuaaagaauuuggacuggguacaguggcuccugccuguaauuccagcacuuugggaggccaagaugugaggaucacuugagcccaggaguuugagaccagucugggcaacaaggugagacuccgucucuacagaaaauagaauaauuuguugggcuugguggcacaugccuguggucccagcuacugaggaggcugagguguaaggaucucuggacccuaggagacugaagcugaagugagccaugacugugccacugcacugcagccugggcaacagaacgggacccggucucaaaaaaaaaaaaaaaaaaaggcuuuggaagcaucuuuuuuuguguucauaucacggcuaguaugcaaacuuuuuuuuuuuuuuuuuuuuuuuaaagacagagucuugcucugucacccaggcuagagugcaguggcgugauccaggcuuacuguagccucagccuccugggcucaagugauucucccgccucagccuccugaguagucaggacuauaggcuaggacccccaugcuuggcuaauuuuuaauuuuuuguagagacgggaucucacuauguuaccaagggugguuuugaacuccugagcucaagcgauccuccugccucagccucccaaagugcugggauuacaggcgugacaugugaucuugagcgaaauauuuaauuuuucuaugucuuaauuugcucuugaguaaaacggucacaacaagaacaacuuuagagguucgggggauuaaaggagauaugcaaugcucuugagacaacgucagguacauuuuaagcgugcagucaguguacaugauuaucaugauaaugauguaaauuuuucccccucuucuugaguucuucuugaguuggaagaaggaauucuuuucuuugagaggauagaguuggggagcagaaagugucuucuccaggcaccacggcaggaccuuaggauugcuggugcauuagagggugugagcacucgaaccugucaucugcuucuaugucauuuuuuccucaucacaacuuugugaaguugguggauuauacccauuuuccagccaaaagaggaugaccucugagguuaugaaacuugcccaaacuaagaauucuagccagagguagagccaagacuuggagcuaagaguuccugaaucuuuccuccuuuccaggaguucuugccucagacagagcucgugcaccguucacucuagcugguguuccucugaccagucaguagcaaaugcaugcucugccuucagccacagaaguccgcaagcaguaguguccuuuguguuguuuccucuuaaaacgucaucuacuuaaacagguugugaaucugucuuaaggauagacaaauaauuuaauggcagagguguagggugaugauucaaauucagugacauaaaccaagcgcugggccaacucugaccuuuuuuuuuuuuuuuuuuaaucccuuugaaucaucuugugcugcauucugaugaaaucuugacauaccacccugaaggaagugcugugugaagaagugugggcucauaagauaggaccaggggaagagaggggccacugaaggcuuaacuuugaguguuuggaaaacaacacugguuuaggagcuggaggacuugagucccagucuuugguuugucccugacuagcagugugaccuccaauaacgcucuugaccugucugggccuuugcugcuucaucuguggcaugaacacguuggacuagaaagugaaacacagcaaaacuuuuauugagugucuacuccauucaaggccugugcuaggcaugauuuauaguacgguuguaguuacagucucuucacugucucagauucccucacgucccugauaaacuuuaauuucucuuuuaggaaagauucggccugacauuuuauuuuuauucuuacaucuuaguuuuaagaagcacauagauuuaucacuuacauuuacucauaugaauaaauaacauauguauuuauuaaagccacuuagcaaaggaauuaaaacuuucuucuaaacuuaccauucauggaaagcuguaauauaagcaaugaaaagaccguucuucacaugugucuuguguuacugcuccugggccuccuacuuccauuucccucuagaugacauggauuugucccccuuaauuguauccaggccucuauggcuucaaaggacuuuagcacauagggcgguaggguggcacggugacaauaugaaagacucuguaauguaacuuggguucaaguacuggcuuuaccauuuauuacacgcuaauaccuuuggaacuuaguuacuuaaacuguagcauaauauccacaucaagaaaggugaucuguuaggagucucguaggcacauaaaaagguugauucccaacccccuucauaugcaguuacacugggaauuuaaguauuuacccaguccgaggaguucaaccucaaauacaucaaaaccacccuugcccuucccuccucaggacuuagugggugauagguggaauaucaaacaggacaccagccuguuucuuugugcggaggccuuugaguaucauucagauuauuuuuuuuucacucuguuaaauucaaguuacuucugcauccacuuacgaagcauagcuacaggauuggcucagucuaaguaccggccugugaguaagccauucuacuucuuauuucucauguugaauuuaauaaucagacccucucuuauuugucagcacuuugucagagcuauguagggugagggagucuuuccccagcucagcccagguuuguuuuuaguacuggauaaaguuaauaagacuuuaucugacuguaaguggaaagacacagccaagauuaaauugcaauugaguuaaaaccgguggaauuggauuugguuaauugauuguguacuaugucucagucagcauucaucuucaguuuuucaccuuuguacugcauucaaacaucaaguuuggguugguuauacauuuggauuuccuuuuccacaauauuuucuagcaacaucauucaagaacucguaaagugaaaaggggugugcgugugugugaaacuaggacauucuugucuuuuuaguaaauacucauuccuuuauuucuuauugcucuaauggcaugugacuuuaauuuggucuauuuagcaacuguuuaauuucugucaugcagaaaacaaauuucagcaccuuuucccgaagcccguaugccuccuuaugaaauguacagguagugaugaaugaacucuuuguccuguuuauuggaguugugccagugacccuuuucauuggucacuucaguucguucaaggugacaugaaaggcauuuuauuuggggggaugucucagucaagucaggaguuucauuugggggcuaaauuugagggcuaguaacuaaauugaaaagccacuagcccuccaauuuuaaucugaaauaacuaaugaccuuuuaaucuaaaguaacuucuuagaaacccacauucucuguaagucagagaaacaaguuuccaguaaguguuugcauuagacacuuguuccaauucucaccuagucugggaaccccauuaagaagaucuggguuauucucccuucucaguaaaaacugacuucuugaaauggaaggccgauguguguucccauguuaccaaggagucacuuuucgggagggggggacuuguuuuucuucuuggucacagagugcaaacaacaccaggccacucuugguugucaaguuagcaggaaagaacuuaagcccucuccauuuguuaauuuuuaugaauuauuaguuaacaugaaaauuguaguguguaaauguuuacaaagaaacuucuaaauaccaauuugccuuauaauacauaguuuaaauaaauaugaugcuuuucuuuuuaaaaauagacaaaugcacugacagggguauuuaguaaucauuguuugcauuuugucacagaauguuuaaaauugacauugcacauaauuuagagacuuaaccagggcgguuuaagcagaggggccugaaguuauuuuucuguggcaaaaaauaaaaaguaggaaagaacuucuaagcuucuaaaauccugacagccucauuguaaaugaagcauuaaagugcuuuguucauuucucacaaacaucagcccuugaauuuggaggaccccucccucccucccucucuuccuuuuucccuuccucccuuccuuccucccuuccuccuuuccccuuuucuuucuuuucucuucuuuuugaaaccuggaacauuuugguaucucugaccagaugaauuuuuucccaagugccuuaggugcugucuuccaucugaaaaguggggcugccguccucuucuggggaauggaaccaaagucuuggguucuucaucuuggguuuucaucaguagccucuggcccuuuuuuccuccuagaccuauaacuuggagugcugagaaguaagaaauugucagaauuaacugucucuuucucuugggccauuucucugcauauucucccauggaggugauucugacucaggaaaugcccccacauagucggaaccuuucgagggcagaaaagggaggaaagaaaaggacguggauaugucuacuaacugaaaagccaagggugguuuguucuucccugccgccaaaaaacaaaacaagauuuucuucuugagacaacccuucaaugccucuguuuucuuuagaggacuguuuuggcuaaugaaaucaaugucugcaggauuuccugugcuuucagucucuuucucuauaguuuuaacauuccccugucauuauuagcaaguugucugcuaacagcuuggcgcaugccagaaagcuauucucggugggguuaauuucuggcuauuaaaaguucucugagaccccagaucucucugagcagggccauguuggggauuuccagcacaugugcuguuuagacucaagggccacagcaagcuuccccaucucacagcagaaacacuguaggcacaggugacagcaaaugggcauugaccaguccgcugccagagcgcuuggugaccguccaacccacagacgcgcugccaucuaccuaacggggucgugacagugauuuuauugcgugcuucaugaaaaucauguagugccugguccauaauaaaugauugcagacuauuguuauccucaugccugggacauaauaaauaucccuaaacuguuacaugaaaaauagaaauucccugagagcauaauuaggccaguuaucuccaaguuagauuucguucaugggacaaauggcagacuuuuccagcaugggcugaaagaaguaaaaaaaagaagaaacacugagagguaggaggacugcuugaaacuagggguuugaaaccagccugggcaacauagugagauccugucucuacaaaaaauuaaaaaguuagcgaggcauagugguacacacauguagucccagcuacuagggaggcuaaggcaggaggcucauucaagcccaagcccaggaaguagaggcugcagugagcuaugaucaugcuacuguacuccagcuugggugacagaggcagacccugucuuuaaaaaaaaaaaaagaaagaaaagaaacacuaacuuguugaagauugagaugacuccacuaggaacaaaaaugguuggugaagaggaagaggacugagaauagaauagugcugccugccuuuguguuuacaucucacauagagcuaucuuccccuccccacagagcagauguagcugaagugcucauguguauguauuugaggggacagcaacuuggaagagaagauaccagcugcggcaucucauaguggagguuuggaggccaaggcagggcuucagggaagugccuuuucugcaacauguguuuuguugcucuuauucuugucuuggucugcuuguaacaacaacaaaaaagaccaucuggagucuagaaggcaaaaauaaugggaaugaagagaugguguuagaaucauagcaguaucaccguauuuaugggaugaguuauucuacuggcccucacuuuuggugcugagauugagaugugaaaucaugaagcgauucagaaauguguccuuaugaaaauacugucuucugauagcuucagcauacaggguuuuuuaugagaacagaucuuucuaaucucucagcguugccaagaaguguccaugcuucuuaucuagagagauuauuccauguuuuaauuauaaaggguugaguagcuguuucagggcugacguugguucuugcucaugaaucaaggucacaacagagcucaccccuggccuuggccagggacuuaauguucauucagcaaacaucugccaaacccucacuauauuuacagcauguguuaauuguagugggcuagauacagauaauacuccauguauauaguacuuuuaacaguuucuaaaggcuuauucucuuauucacaugaagaaucugaaaucagagaagucggcuuaaguuauauagcugguaagucaacaagcaauagcugcaaccagucguaucuuauuuuuugacuacaucucugcugucugaggcaaggucccuacucucaaaugaguuaacuuuuaauagaaaagauaauuugauugacucuaacgaacauuuauuacauaugcucuggagguuccaugugaaacaggcuugucuuuaaucuaggucucaggauagcagaaguaaucccauuuguauuuuuaucuguuuuguuuaggaugcuuaucacaguucuaaugcagaaauuauuuggauaauucugauuguggaaaaaaacaaacucaaagugcuuuuucuagucucucacucaacagcagucaacacagauuucugugacaaacggggugggggaaauucuccccaucaccaagcaagcaaucaauucugcagcagacaacagcuggguaucuucuauuuuaauguuuaacuggugauaguauuagaucccacagauuggaggcucagcccccaagaaugccccaccucccaccugacacaccagucugggccucuggaacgucugacugacuggcuuuaaguuuggauuccuaugaccaccucuuuggguuggauuaauuugcuagaguggcucacacaacucagggaagcauguuuacccauuuauuauaaaggauauuacaaaggauacagauaaccagaggaggagauacacagggugaggucuggaagggucuugaguguaggagcuucuguuccuauggaguuggggcccacuauccucccaguggguggaugaguucuuguucaccaucuugucugccuccacauguucaguuaucugaagcugguccuuuuggguuuuuauggaagcuucauuauguaagcaugauugauuaaaucauuggccauuggugaucaacuuaaccuucagccucucuucccucuccucuuucugggcugaaagcuggacccucuaauccugccuuguuuuuuucuggugaccagcuccaucuagaagcugccugggggcugccagcuaccagucaacucauuagcaugcaaaagacaucacuuuggcauuucugaggauuuuagggguuguaugccaggaaacagggucaaagaccaaauauauauuucacaaugugacaguaaugauuuauuuuaugccuaacuccgcugcuagauuguggguagggacuuucucguugaccccagcauccccaacacaaagugaaacaucugucagaaaacagaugugucuuucaucacaaaagcauguugaaugagugcacuauaaagaauagaugaggugcuguuuuaaagugccaugggaccacagaugaaguuuauuguggugggaggugaugucaugaguagaaaaacuuacggagaaggcauauuaagccgggcaacaaaggaugggcgggcauuaaacaugaauggagugaggguugggauagaggggugggacauuuuucuacagugaauuacaggaccaaagacacagaugggcagacuccagcuaugauuuuuuugacagauagacagggugugugagguugaggcuuaagugguuuauugguaccagauuuugaagucuuugauugacuaagacauuugaaguuuguucuugcuauuguuauuauuauuuuguuuugagggagggucuugcugugucacccaggcugaaguacagugguacgauuucagcucaauguaaccucuaccuccugggcuuaagcaguccucccaccucagccuccugaguagcugggacuacaagcgcgugccaccacgccuggauaauuucuuuuuuuuuuuuuuuugagacagagucuccuucuugucgcccaggcuggagugcaauggcaugaucucagcucacugcaacuucugccucccagguucaagugauucuccucccucagucuccugaguagcugagauuacaggugcccaccaccacgccuggcuaauuuuuguauuuuuaguagagacgggauuucaccauguuggccaggauggucucgaacuccugaccucaggugauccaccugccuuggccucccaaagugcugggguuacgggcgugagccaccacgcccagccuggcuaacauuuuuuaguuguuuagagacaggauuuugccauguugcccaggcuggucuugaaaacuccugggcucaagcaguccgcccuccuuggcaucccaaagugcucggauuacaggugugagccaccgcgcccagccuuacuacuauuauuaauuuuaaaaagaaccuuuauugguaucuuacuacacuaaauguauuauguucauuacuucauuuagcagugagggcaaucccaucuuauuggugaggaaacagguucagagaguuuaaguaucuugcccaagguaacagucacugaguggcacaguuagugaugaauucuguucucuuugauaggaauagaggcccacugauaccugugagcuuagcaguguaucauucuuuauuuugucagaaaugaguacaguguuuggcacaucauaggugcuccagguuuuagagaauacauuuuuugccgagucgcagaaggaaucaguacuuuccuuuaggaagauuagucugguaauuacguguauuggccuaguuaguaaauguuuuuugugggcaugaaucaauugaauccuuguuuuugaugcuggcuaugugccaggcacugguguaggugcuggggaccuacgguggugagcucacugguggguugggcuggagagaaaggggucguaggguggcaggcaggcugguugggaaggagugacaguguggcuacagguuacaucaacccccugagagagagcagaugggcagagacugaggacugagguuucaguuaacccggugguaaccuagaaucaugaugggggccagugacucgaaauaucugucucacuggucauuggguggaggaugacaaccugccccugauuuuaaaacagcaguuucuugucuuccugcuuguggguggauuaauuggguuacauauguuuaugaaugauaguguaaauacauuucugaugacaaucuggggaaaaaagcaaaaauggcaauaaaagaacuguugcucauauaucaauggauaaggcaauuaucuucucuaggagcacacagcauucauguguggggaauaggggugaagaaagauuucguuacugagagcaugaucuggggauggaacuguacccgcggaauguguuuccaucugucauaggcugugcuuuugaaacaacacaccauguuccauagggcuucuaauaaaggaugaaguguuggagaauucaguguuuuuauuuguagaaagcaccagaaucccauaaucaaagucaggguauuugggggauuggaaucaauuagaggcauuacugaauccagucaucccugccucuccugcuuuaaggugaggaaacuaccuuagguguuuccugaguuaggugacuuagccaagauuguacagguaguuauuacagagacaggacuagaaacuuggucuucagaggcaagcgauugcuuuuggcaguuugguguguaucuuuccaggauguuuccuauucauuugaaggcauauaggcguauauuaaaacauacauuuuuaugaauuuucuuaaacccguaauuauuauucugcaauuugguuuuuucaccugacuccuuucuuaacccauuuuuuguuaaugucaauagcaaaauaauaaauaaaccaugguauauccaggcaauggaauauuacucagugcuaaaaauaaguggguuaugaagccaugaaaagacauggaggaaacuuacuaaucuacaaucuaguuuuuuucagcauuugaggauuauuccauaguauggaugugccagaguguaaucagccauucucugagugauaaaaauucaaacuauuuauuuuuuaccaucaugagcaauacuacaauuuacuuaaaaaauuuauacagcucuuacuuuugugccccuugcuauucuaaaugcuguacaaguauuaaccaauuuaauccuuguuacugcauaaggaggcuugucugucuuauagaugaagaaacugaggcaggaagaaauuaaaccaucugcuuaacaucauauggcucgaagucaggauuugcacacaagcacuucagcuccagggucugugcucguagacacugcgucgugcuguguuuuagcagugagauccuucaccuagcucuucauucacaugugcaaauauuaacuaugugauggguagcauagaaauagaauuaucaaagaaacauuuuuucuaauuuaguuaaaaaacuuuauuauuauuauuguuagguuugcaacaacauugauaggaagguacagagguuucucauaugucccuuccccuacuccacagccucucucacuaguaacaucccccaucagggugcacagccucucucucuaguaacacccucuaucaggaugguacauuuguuacaauugaugaaccuaccuagacccaucaguaucacccagagaccaucauuuacguuaagguucauucucgaagucauacauuuuacagauuuggacaaauguauaaugggauguaucuauagaucacugaaguaucguacagaauaguuucacugcccuaagaaucucugugcuccuccuauuuauucuucccuccccccaaccccuggcaacuacugauuuuuuuuuuuuuaucucccuaguuuugcuuuuuccagaaugugauaauguuagaaucuuccaccagguagccuuuccugauuggcuucuuucacucaguaugugcauuuaaauuuccuccaugucuuuucauggcucuauagcccguuucuuuucagcgcugaguaauauuacauugccuggauauaccacgauuuauauauucauucacuuacugaaagauauguugguugcuuccaaguuuuggcaauuaugaauaaagcugcuauaaacaucccugugcagguuuuuguguggacuuauuuuuucagcuuauuugaguaaauaccaaggaucaucagagaaacucuucugaggagaaauggucaagcauucaggcacaagauggcuuuugagugcugauaauauuaucagugacuagccuuuacuuaacauugugcugaauguuucguaugcagucucucauuuaguccucacaacaccuagucagauggcaacucuuuacagaaaggacaauguaguaagauuuuuacagcccgauaucaccaauuuagugauugacaauugaugacuugagcccagaaucucaacucuuaaucaccguguguauuagucuguucucacgcugcuaauaaagacauacccgagacuggguaauuuauaaaggaaagagguuuaauugaaucacaguuccacaugacuggggaggcuucacaaucauggcugaaggugaagaaggaaauaagacacaucuuacaugguggcaggcaagagagagcaggugcaggggaacucuccuuuauaaaaccaucagaucuugugagacuuauuaacuaucaugagaacagcaugggaaagacccgccuccaugaaucaauuaccucccgccaggucccucccaugacaagugggaguuaugggagcuacaauucaagaugagauuuggguggggacacagccaaaccauaucacugugucauucaccaccccccacuuuuuuuuguuuuugcuauguugaccagguuggccaugauaauucccuuuugacuguguucagcugggccugcuuuugaugaaauauuuuggcuaaagcuuuugacagaccucugaguaguaaucuguggcuuucaagcuucaaggauuauauauuucuuuagcacuuggcauuguuuguaaacuaauuguuugagguuucuuuuucuuucacauuauuuuugcagauuuuauacuuuuuuccuauaucaaaguuauaguguagggauaugacucagaagccagauggggguagggguguucccaauuauucuaaauguaaauguaauuagaguuucauguggaugcauaccuccuuucuaaaaaaauaugguuauuuuagcgcucacuauaaauucacugguauucauaaauuuauggugaaacccucuaguuauaaagugaguuuuauuacauccacauaagcugcuuuuuaaaaccuccuccuucacuuucuuuucucuuuccuacaagaacaucauuuguccccucagaauaaguuuaguaaaguguuuggaccauucucaaaccggccaacuucucaauucaguuuaaaaaauuggaacguaugcuuaagaauagauguucugaguuagaauuucuuccaucauuugacagguuuaacauaucuaagauguagggggagaaucuuaauuggacauacagcuacccaauagaaugccugauaugaugaagaguuugaagaaaguuaaggacauacuaauggcaaauagugcaaggaaaaauaaaagcaauuagaaacuccaggaaaaacuaaaacugagcuaaaauugaaauguauucauauuacauuauuugagaugcauagaaaaauauuuacaugguuauaauauaaacacaaucaauuuauagacaaauuacaaagcucgugguuauaaaacaguaaugcuaaucaaccucaaugauaugaaaguaaaaauauagacaauagaugguaaggaauggaaagacguggaaaagugaagagggcucuaaugauaucaaaguugggcaguuaagaguuauuguaggugaugcaacaggaauuaaagggacuacuuuuuuaaaaaaugaaaacauacauaggcaaggaaauagcaguuuaaucuuuuuaaaaggaaaauaaugacuaggaaauaaaagaacuaugaauaugucuucucuggagaggcauuugggaaaaggagcuccuggugcagguacgaauccagaaaaauagagugauacagugaucccccaagaacccacuagccuuaacaguauuccacauuuuaccauuuuuguuucaucugucuuuuuucuuuuuuuuuugcugguaucuuaaaaaauucaaauaccaugccauuugaccccggauacuuccaaacgcaucucaggaaaaaggacaucuacuuagauaaccacaauaccauuaucauaccuaacaaaacuaacaauuccuuauuaccauauugaauuuuguuugauugaaaaaauacuuuuuaauuuuauuaguaguaguauuauuuagagauggggucuugcuauguugccuaggcuggucucaaacuccugggugcaaaugauccuccugccuuagccuccugaguaguuaacuacagcaugugcaacugugcccaccugaaaaaguuguuuuuuuuuuuuaauaguuaauacauucaagucagguuccaaacaaagcccccucuuguguauggguguuaugucucucuagucucuucugagucuuuuaaucuugaauaguccucuuuuccuuuuuaucaugccauugacuuacugaauaauauuugauguuaaaaaugugugcaugcauuaauuugauuaaaaauuuucaagaaguuuuaauuggcuuuuaaaauuuuaaugguuaaaaaguauagacaacuuuauauauuuuaaaagucuuauguucucuguaaggguauuuuuauaaaaacuuguuuuuaaugacuaaauuuaaacaucucaaaugcaggaaccuuuacauaucaguuauucugggcacaauucuuugcaugccaagaugaguaaaaaugauuauucuccaguauuuuuuagucuaaucagagagggcaguuuguggacaugccugccaaagcauuuugccacauggaaguaauuacuuuuaaagcuaauaguuaauggauuccuuacuaggagccagccauuuuauuaaguguuuuaaauuauuuuuauccauaccacacacugugggagaauccauauaauccacacaaggaaccugaagcccagggagauuagguaacuuuguguagggucacucagcuaguaaaugacagccuguauaggaacaaggucuuucuaauacccuuaaucacuaaacuguauagggccucccaauuugacaugcuagucuccccuccuaagaggcggcguuauguacugguucagagcaugaguucuagagccagacugcuugguuuugacucuggcucucccacuaaauagcucugugacuuugggugacuugcuuaaccucucuaugucucaguuuccucaucuguaaaauggagaaaauaguccuggcucauaagauuaaaugguuuccuauuugaaaagaccuuggaacaguacuuggcacguccaugaauuaaaaaaugcuuaaguaacugcagcacagaaauacugcauuuggcauauauauggauugguggaugcacagauggacaaacaaauaaaaaguagggagcaaauuguaggcuacuuuuucuuauauuucaccaauaaaaagcaaaggcacuucccccaguuaauguaauaagguucucucucaggucucagaauguuguguagauuuuuuaaacaaaauuguaauaaaauuuuauugaugguauacacauacauuaguuauuauuuuguagaguuuuuaaugcucaauguugauaucaacuuccugacuacuauuuuuaaagaaagaaggaaaaaccaaauugaauaguaucuguuuuuuccuucuuucuuuaaaucauguguuuauggaauaauccagaagcauaagaggcgacuuuuguguuaagcaugaggugacuuucauguuaagcuuucucuggaagaagagagaacuggauuuggacuuuuucuuucaaggagaaagaaaaaaauguuagucacauuacagccuugaaagaaucuucuugaacaguucuggaggaacagauuaacuuuggugcauguagauacaguaguucagccucugccacuuaaucuauccccaaggucucauggagggaagaaguagaggugacagcgacuuauuauaacguaacugagugguuagugaauguucuagaacuccuaucuugguuugauuggcuuuuuguucauguucuuuuaaccuuuugaauuuugcuaaaagauaggugcuuugaauccaggauccuagacaacuugggggccaaugaauugauuucaagauggccuuuugcugcuuugaggaugcaggcugaugacuuagguccuguguucauugauucugcuggagauguccauagaacgaggaggagaaucuuggguuuaaugucuccugauuuauuuuuagcagcugaccuggcuagcugugauuugcuaauugucuguauguaguauauguuuguaagugcugagucguuuugaauaaauagucucauaugaagugagaugaucuacuuggccuaguagcugauucuuucuggaauugauaaugacgagagugaaauucuaucuuaacaagugcagcagcugcccuaauggagaaggacgacguggaauuucccauugucuaccuguacuguccuaaaaauauacgaccaauuccagugacugauaaugauauugagaccgagugguuaauaauggcucaagaaaucccagcuugauuugaccagcuuuccagcuuuuuucuuuggcagguggggagugggggauuaaaucuguugacuuuugcaaauacauaauuuuauagaauauguguccuaagaacgaaacucacuacauuucuagguucaaacuuacuuuuuuggguccaaugcucaauauaggacaaaaaagaagaggaaaggagaaaauaagaaagaauguauauuaguuaacucagauuuuuggaucuggguggauuucggaugguguuaaauuggccuggggacuucuuuauuauuuuuuuuaaucguagcauugguuuguaauauucaugguuuagccugaaugacuuaaaggauuuauuuuuuaauuuaacguggguuaaaagaacaugagcaauagaccugccaauaacuauuuuaaaauauaaacagauaacuguuuguuuugcucaaaggucacauugaggauucagagcucaugacucaggauggcuauuuuucuuagaggaaugauuuagacaaguugaauugaauagcuccuaggccacugacauuuauucaauuuugucuuuaacauuuguuuacuuuuugaaccuguaaaacagggguguccaaucuuuuggcuucccuagaagaagaauuagaagaagaauugucuuaggccacacagaaaauacacuaacaacagcuuaugagcuuaaauaaauaaauaaauaaauaaaugcaaaaaaaaaaucucauaauguuuuaagaaaguuuacagauuugcguugggcugcauucaaagccauccugggccguggguuggacaagccugcuguaaaagacuggaauuuagauacagcucaucaaaauaucuugcuauucuaaaaguaauucucaauuucuauuuuuucuaagaaaaauuauuagacaguaauguuaaguugcagcaaguagguuugcauuuuggauaguaauagucccaauuuuauuaaaagguuggcuuaugauaaccauagauuucuuaauuuuaauuuuauuuauuuuguuugcacauacuauuuuacugauaguaugugcaaaaagauagugagugaagcaguuggacuaauuguuuacacuaagauuacuuaggaaggacuaucuggcauguuuauauuacauucagcaaauuguuuauaguagggaucauuuaaauaugcauuaccaauaucucagguuuuagauuugccaacccuguauguugagauuuuccaggaucuuauaauugcaccggcuagugguucucccuugaauaaacugcaagacuuugcacuuagcuaaaaaugacucaccuuugaaggugguacgcauucauuaaaaaaaaaaaaaaucaagugcgugcagugcacugugcaccaugcuaagcacuggagauaguguugagugagacaaauguagucucugcccccauagaacuuacauucuaguggagugagacagacaccaagaagcaaacaauacguaaugaacaagauuacaucagagugauaaacacuggaaagaauauaaaauaaggaggaugugaugcagcaugacugggggugggaugggugggccagcacuagauagggcaguuagggaaaucuucuggaggagguaacauagagguugacacuuacaaguuuaggaagagcuggccacuuguaucucuggggacacaguaugcuagcaucaggaacaccaaggguaaaagcuaugauguagguacgugcaguguuggagaaacaguaagaaagcugaacagcagggagccuauuggugugucuuggcccaugcacaccucagggaguagucaagaccauguaaaaauuaauuuguuggcugggugucacaccuguaaucccagcacuucaaaaggccaaggcaggaggauugcuugagcccaggaguucaagaccagcccgggcaacauagggacaccguacgucuacaaagaauaaaaaaaauuagcugggcauggugaugcacaccuguggucccagcuacucaggaggcugagguaggaggauuucuugagccugggagaucgaggcugcagugagcugggaucauaccacugcacuccagccugggugacagaaugagacccugucucaaaaaaaauaaaaaagcaauuuguccucucuguaugcauauugagaauuauuacauaaguuggguuuuuauuagccacgugaaguuugggugauaaaaauuugauuuccuacgaaauugcagaguacguguuucugguacccugaguuguguugauguucagugcucccuuuacucucucuuuggcuucaagauugaacggugcuagauuuuuucaugcggauauuuuugcguaccugugacuccacagaccagugugcuugugugcaggauuugguggguucaugguuguuuauuaaacaaaacuaauccuauauagagguuuuauucguuugcuaggguugcugcaacaaagcaccacaagcugaauggcuugaacgacagaaauuuauugucucaccuaaaucaaagugucagcugaguugauuuguuuucuuuucuuuuuuuuuuuugagacagaaucucaccgugucacccagacuggaguguaguggcgcgaucuuggcucacugcaaccuccaccuccgggguucaagcgauucucuugccucagccuccugaguagcugggauuacaggugugugccaccaugcccggcuaauuuuugaauuuuuguagagacgggguuucaccauguaggucaggcuggucucgagcuccugaccucagcugauccacccgccucggccucccaaagugcugggauuacaggcgugagccaccgcacccggccgggauugguuccuucugaaggcauaggaagaaauccguuaugccucuugccuggcuccuggugguuggcgggcagucuuugguguuccuuggcucugcuguauuucuucugccuucauguuugcguguguucuuuguacagguguggccuucuccaaauuuacccuuuuuauaagaaucuaagucaugucggaauaggucccaccccgcuccaguauggccucaucuuaacuaaugacaacuguaaugaacgaauuaccaaaugagucacguucugcauguuuuuguccuccugaaauuccuauguugaaaccugauaaccaagguaguguuaggagcuggguacuuugagaggugauugggauuagugcccccuuguuccucccaccaugggaggacacagcaagaaggugccaucugugaacuagggcccucaccugacucugaaccugcuggcaucuugaucuuggaauuccaggccuucagaacucugagaaauacauuucuguuguuuaugggccacuuaauuuaugauauuuuuuuaagcugccugaacugucucagacacuuucugagcgacugaggguuaggacuucaacacaggaguuuaaaaaagggguuuuccagcgcuagacaaauucuaaaagagcuguaacacucagcauaggaauuuuacaauggggacgcaguucaguucauaaaagaggugcauauaauuuggcuaaacucauugucucucacaaaugaaaauacggacaauaccugcaaacauuuugaagcuguuuaacccauuuuuugcucagacaccuggaagccacggccccuuuuuuauuuaauaacaucugguguguacugagcauugguaggcuccucugugauaagaucuugaaugugucaccuuguugauuccucauaagcacccucuggaguuuguucugugagcagccucacuugacaguugagggaacugaggcuuaguuccagaaagaaccuucagcucaucaccgcagcccuaguuucagcaugauuuuucuuacugcuagaguugauagaauagucacagccacuagcacuggagccugcccuagccacuaauagcaccuccacguaaaagguuucucauugugagguuaguuucuuaucuuccuaauucuaccaccugguccauucaaugccucccuuguucuuuaucccugaguuuauguaauacgcagcaguacugagaagauuaauuaguuaauacuugugaagcacuuugaggaugaaaagcucaugaacacuuaaaguuaaauuaaauuuugccuccuagugccaagaaauaaacagucuuucuccuuccugguuggggucagcaucuccccuuggcccgcaggagaguguguucccacagagagcaggcuguauugauugucuccccaagacgaaggucggaauggcuacuaauucucuuuugaacuagauuggauucugcaaacaauugaacagcugacucuaugcuaaguggaaaugugauugauauugaaacagaauuaaaauuucaacuucuagggaauuaaauugagugcaacuucagaaauuuggagaugaauguccaagugguuugaaaagcgauuuucauguuccacuaaguauauuaauaucaaaagugauauugauguuugagaacauugggcugcaguuguuuccuuguccuuuucauuuauugccauuuugaccuaagguuugugccaggaaguucagcuucacuccuagugaaucugaguggcguaaugcuggccccgucuugcucauugauuuuccugguagccaaaucccuguacaacgaacuguaacauauccucaaaugaacugcauaaaaguauguuggagauggagaggagaucuauaaauucagaggacaaauaaaucaaaaagugaaugacuuguaagaauucauaagccaaauucagagccaauuuggaaacugaaccucagauuuuuccagggcuguauucauuccuuccccuguuggauagaucuucuaagagccacccucaacucgugagucugauaauugcuuuucagauggacaguuaccuuaaugaacucugacuuuauguaugaguaguaguuuguugcacaggaguuguuuucccagaagguauugaccuuuauuccagucucuacuaugagcaaaccucuaucuguugaaucagcuccuggaaccucagcucugaauaaauaaagagcuuaaagguaaggaauaggugggucaguucagccaaguaaggccagauagaauuagaguugagagccaggucagaguugagaguggggagaaauagccaggacuauuuggcccaggaagccugaauggggacacaugcacacacacacacacacacacacacacacacacacacacugaaacacucugcaaaaauugagguguuucccagguuccuaaccuccugaaugcaaugcagauucuuuccuccaccuucccuucauuguucccauacaacucuggccuguaaucagcccaaccugggccugggccuuggccacuacuagauauucuguuggcaccaagaguagucaggaccaguuuucccucucuuaauuuccuccucaggagaguugaguguuuaucauauucucuucuuuuccucucucuuucucuguucagcuuaggcaaucuuccauucugcagucuuucuccuagcuguguaucuugagagguaaugcaauguagguuaagacugccugaguugaauccuggcagugccacuuaugacuugaaugaccucaagaaagacauuuaaucucuuuaccucaguuuccccaucuguaaaauggggauaauaauaccuauuucaguggaauguugugagaguuaaacaaguugauauguggaaagcucguaggguguggucuguaauguguucaauuagcauuaauugaagagaaguggagucuccccuucaauucuuaccugaguaacacuggacaauuucauacuuuguugucacuauuuuucuuuagcucuuacucuuuuuuauccauuccuguagcacuagugaucaggauaaaagacgugauugcuaauagaguaauaccuuguugaauuuguguaauguuccagguuggaggggggaugauaaagccuaagaagaccaaguccuuuuuucuugcaacuuuaaauuguuguaggaaaggagacauguugauaaugguuugcaguauaacauggaacaugcuagacuccaagucgaaacugagauuagagauaggcgaaugaagaugacagucaaccacgugcggugggcuugggggcugaggugggucauggagggcuuuauaggggaggugacgcuugagcuaguuuuuuuugguuucuuuuuugagacggggucuuacucugccacccaggcuggagugcaugcugccaucuuggcucacugcaaccuccuccugggcucaagugauccucccaccucagccucacgaguagcugggacuacaggcaugcgucaccacacccagcuaauuuuuuuguacuuuuaguagagaugggauuucaccauguuguccaggcuagucgugaauuccugagcucaagcgauccaccugcccuggacuuccacaguguggggguuacaggugugagccaccgugccccaccuugagcuaguucuuaaaggugugagagguucaaugauagacacuaucaacacucccaguaagucacguaauuaaggugagagugcugcucaguagauuauuuaucagguauguggucacugauuugaaaucuaugccaaagucggugcagugagguggggaugggagagccugaaggcgcagaccugagaagagaaggagauuaagagucugugauuuuuacauaguugggcccuggaggccagggucauuacauagaguuuguguuaaaacuuucugguagcuagugauguuguuguggagaaccucagaagacaaaauuaaaaacuuugaugggaacugagacaaaguaaaaacuaggcauacucuacugcugagauccuuacugucuuuuaggacugcaugcuuucaucuuuuucuauuuuaacuucucuuuuauucuucuccccuuugcucacuccacagagcuuugcugaacaccuauuaugugccagaugcaggggaucccaaguuggguuaaggcauuauuucuucccuggagcuaaccucacccaaaaggggaagauaguugugugaagaacuaauugacagugugaaguguggcugguaauauagggagcugugugggaggaggaggugugucugggcuaagaaggcagggauggcuucaagaucuugaaagucuugccacauggauagauagugaccagguagacagaggcacuccagcaaagguaacgcagccugcaaaaucaaggagauauggaaguccauaguuugaguaaggaaugagccauguuguguggcuggaauagagggagccaggugucaggcggauaugguuccagaugaggcugaaaauguugaugagggcucuaugaguguauuaggcuuuucuugcauugcuauaaagaaauaccacugagacugggcaauuuauaaagaaaagagguuuaauuggcucacaguucugcagucuguauaagcauggugcuggcuugugcuuagcuuuuggggaggccucagggaacuuuuagccaugguggaagguaugucacauggcaaaagcaggagcaagagaagaauggggaggggucacacgcucuuaaacgaccagaucucuagagaacucacuccauccaucaccucccaccaggccccaccccucacacugaggaucacauuucagcaugagauuuggguggagacaaauauccaaacucuaugaauggggcagguucuuugaugcucucuucaaggcgcauggacuuuuaucuuguagaauccagggggaucccaugaaaguuuuuuaagcuggaaagugacaucauuaaauuugccuuauuuuuauuuuaaagaaaguuaauuuuggugacaguguggaagauguguuuccuuauauuuggccauauaaaauauaaaauuugauuuuuaaaacauuuuaaaacaguuucuaguauucuaacaguauaacaguauguuuagauuuauaaacaaaggacauuuuauguuuuuauaagucaacucauuuuuaugacuacguuuucaauggaaaaaugaauauugagcgucaacaaacaaaacauugugugacaagcuugugcauugcugauucucuguguuggccucauccauaaacuaaagccucuuaaacucaaaucucugaugccuuuuagaaaugccuuuuacuuucuuuuuguguaguaagagggaucauggaaccuaugaucuaaaaacugggaagcaaugaugccaugugucugcaagcauagguaacacagcuguuuuagagaugucuuuaaaaggguacaugaguguuuugauauuugagaacagaucuuccagcuugucaugggaguugcauaguuuuagaaaucaguccuuaaccuuaaacuuuguucacauugaacucuagaauagcagugguuuuugaagagcaguuguugaaugcauuuaugcauauuuaauuuuuuugaauggcuauuaaagaccuaagacaauuauauucagguuucaaggaaagaacuucuugugggaguuuaacauuuuuaaauuguugguugguggagggcugguauuuacugauauucuugaguuaaugagucccaacuguaauagccacaauugugcugcccuucacuuuggagaauugcguauuuuuacacucauacuuugaggcuuacuauuucaguauagaaaacaaauauaguugccgaaaaaaaaugauuagauuucaaacuuuaucugaggcaaaugugaggucauuaauuagacuucuuucaaacuucuuaaguucccgagccucaugauauuaucaaauuaaaaggacagacuauugaaauguuaauuucaguucaucaugaauguuugcacuucucauaaaauagccauuucuguguuaaaaaugucuuauaaucugugaauagcauuuaagaaagcaaugugaaugugaguguauuuaaaaucauccucuaaguaaugcuuuuggaagccaguguacagucugaccuaacaauuacaaguagaccauguaaccacucauugaagaugaaugauguuuuuaugcuacaagaauuaaagacuguuucuuaaaagaaaacaagagacugcuuuuuuaguuuuuaaccaccuguacagcaaaucaugaauaggagaaucugaaugccugauagccuucuguauuauuuugcuuauuuauauauuuauuuuacaauaaacuuuaaaaugauauuuaauucuacaguagcuguggauagaucaaccacauucuguauaaucuagauuuuucuuaaagcucccuuuucuugcccuaucaauuacuuaccguccauauuuggccauuuuggggagccaaguuguccccacguaucaguggugauaaauggaucagaagaaaguugaucaaauccaaguguguuuuuauauaugaugcaucaguuaucuuugacacauagcaguuccaaaaccucaggcagacacaacaagaagugcuuuuuuguacaugugucuguggucacagagguucugcugaucuugggugagcuuacccaugugccugaggguuggcuugcuguuggacagagugaggugacugaaugacuuggcucugcuccaucugucucucauucuucagcaguuguggcaaugacaguggcucuagagagcuagccccgugcacaaguccgugaagccuuuguuugugucauaucugcugaccaaagcaugucucuuugggcugaguccaaagucaaggggcagagccggccugcccaccuaugguaaauuggcauuacaaaguuucaugucagagggcauggauacaaggaggagugaagagcugggacuaaaugaugcaguucacuacauaagauuuagaauuuuuauugauaacacguaauuucacuucuuuuucuuuuuuucucuucucuucucuucccuuuuuuucuuuuguuucuuuggaaagggucuugcucugucacccaagcuggagugcaguggcaugaucacagcuaacuguagccuugaccucuggggcucaagcaauccucccgucagucucccgaguagcugggacuacaggcacauguuaccacgccugguuuaaguuuuuaaaauuuuauguagaacugcuacauugcccaggcuggucuugaacuccugggcucaagcaauccuccugccugggccuccuaaagugcugggauuauaggugugagccaccacacccggccugauuucacuucuuaccuaccacacguguugucucccuucuuuaggccuucaucagggaauauuuggggguaaagaacagaaacccacucaaguugcuugaagauuaccauaaacagaacagggaagcucacaggccuauaaaaauaggaaaccuagaaugggcaggucucaccagaacugggacugcuagauguuagacuuugagacccuuguuucaucucugcuccucucuguuucucccccucugccccacucccuacucuuaugaccccuuguggccacaucaauuuuaauuguaugcaguuguguggcucaagcaccuacuaugaauuuagggauaugaauuagaccucacugucugagucuaauucauuucccuaaauccuagcucauggauuaguuauuccugagucuacuugugagucuccuagagcugagugcucagucuucaucucuuucuuuacuuugcuuauugagcggguccaguccuaugacuugaaaugcugucuugaugcugaugacucauaaguuucugucuucagccuagacuucucccuugaacuccagacucacauauacuacauccuacuccacauguccauuuggauguaucucauaggcaucucaaacuuacacccacauagaccacuugauuuccuccucauaauuugccucucccagucuuuucucaguaaauggcaauuucaguuuuccaguuauuuaaaugucggaaucaaauccuugguuaaauauucauacuuuaaaauuauaugcauauauuauaguucuaauauaguauauauauuauaaaagaacgcaaauuugcaagcuucaugugacacugauuaaguaaacuagaucuuuaaugucuggcuaauuaggaugcuucauauuuuuauuuacuaauaucacaagcauaauagauaaugugaguuucauuuuuuaaaaauugugguaaaaacagauaauacaaaauuuaccauuuuaaccauuuuuaaguguaaaguucaggaguguuaggcauauucacauugcugggagacagaucuccagaacuuuuucaucuugcagaucugaaguucuguucgcauuaaacaguaaguccccuuuuccugcucuucccagcugcuaguaacuaccauucuacauucuggugucuaugaauuugacuacuuuagauaccucauauaacuggagucauauuguauuuguguuuuugugacuggcuuauuucccauagcagaaugucuuaauaguugaucaguguuguagcauguaacaugauuuccuucauuuuuaaggugaaauaauacuccacuguauguguacaccauguuugguuuauccauucauuuaucacggggcaucuggguugccucuaccuuuugacgauugggauuagugcugcuaugaccaugggcgugcaaaucucuuugagacccugcuuuuaauuucuuuggcuauauaccagaaccggaauuacuagauuauauaguagcucuacuuuugauuuuuugaggaaacuccauacuguuuuccauuacaguuguuucguuuuauaaucucgccaacaguguacaaggguucuaauuucuccacaucuauccaaaccuuggagucuuuuuuuggcuucucuauuucaugcccuaaucuagucccucaguaaauccucuugacuuauauuugaaauauauccuacaucugacugcuucccaucuaucacugucaccuuuuucugagucaccauuggcucuugucuggacuaugauacuagucuucucacuggucuccuggucucaauccuugccccccuacagucugaucuccauagaacaaccagaguaguaauuuaagaauauaagcuacauauugucauuccucugcuuaaaacuuucuaaugacucccaucacacacugaggauaaaauucaaaguuguuuccuugguuuauaaugucuuaaaaauucucauuccuuugcuugccuggcuucagacacacugguuuuuguacuugccuuaaacacacuaagauugucccugccucagggccuuuguccucgauguuuccuccaccugggugucuguauucacagacauuugcccuucacagaggccuuuccaaacagccuucucuuaaaaagguacucacugucaacuuuuucuauucucuuaccguacuuucuuuuccucugugcacuugccacuuucugacaucguaguguauuuauuugugacuuucuuauggcuguuuuccccaagagaauguaaacaccaugaauacagggauucuaucucagcaucugaaagaaugucugauacugaaaagaugcucaauaacuauuuguggaaugagugcguaaaauaauauuuuguagccauguguuuaagcagcuuuggccauggcgacagaggugccccauguacacauggcgccuuagguggaggugguugcccaggaaaaugcuguaaucugucuaccauuucuagccaauuucuccagcuagaaauaauuuaugggcuauuauuguucaugaggucuaagugggaaaguauagaugccuuaucuucuuuuuuuuuuuuucagccucuuauugaaaaaaaaauucagggauugaugggaauuauuugccucugcccuuuuggccccagaucauccuuccugagucuuggcugcuccuuauuaccugcagucacauuuccuguuguaaugugagggcaaugcuucguuugcacaaugaaugccggaaauggauuuuaaagcauuauaaagcaaagccagaaauuccuccugcaggggagauggucgguugacaagucugugaauuauauaauagaaucuccucuuacucuccuuguaaaauauaccaaaauaucaaaaaacaaugggcuuuucuucccaguuuguuugggaucauacuggcauccuccuguauuuuggggcugugggauuagaaucauguauaacggcuuuguuuucccccggcuagguuugugaugaaguuguucugauggaaacagucaguuaauucuaaaggaucugcacacgcuugcugagcagaguacuucuaccuuaaauggucuuccaugcugugggagagagcuccugaugcgucagucacagugauaaugucaugggauuggaacaucaauuuugccuguucccaccgccucauggccuggagaagucuauuucagucuuacuagucuguuagaagcaacaguaauuaaaauggaucugcaggcuucuggggucuuuggauagguagccagaggucuaucaauugcaagagauucaaagaugauugcaaaugcagugugagggacacucccugaggcccuccuagagugcaagugaugcuuggcuuuuuguacuggauggugcuuacacauggguguacguuuaugaaaauucagguucucuacuuaugauuucuguacuuuucuugcaaauauguuauauuuuagugaaaaagacuuucuuaggaaaacaaaccaaccauaguuucuaccugcaagaagaucuccugguggagauacucaaauagaagaucacacagucaacuuagugccaagauuaagcaaagcguauuaugggagcacaaauaaaagagaucacacucaucuuugggggaggauagaggaaaaccagagagaagguuuaaaugggauuuaucuaucaucuuuuccuggcuuccuccauauagaauaaggauuuauaugaggaaaccagaguaaauggguucaauccugauucugugguagcaugcuuggaaguuaaaauaugcuuggaagauaaaauauugccuuaaaaagcagaaaauuuauuaaauaucaucacccucagggaguuuguugaugauugucucuccagaccugucucacuguuggcauggauaacuagauugaugaaugacuaagagcugaaacacaagacuguguauuucucaucaauguguuuuguuauugugaaauauuuaauauuauuaagagcuggcagugacccuguguuggaggaggguaggguguguuuguguaagagcagugagaaaguaauggcuaaaaaaaguugaugucuucuuuaaaaaaaaaaaaaaauguugccagcagcuggaugcagugucucaugccuguaaucccagcacuuugggaggcugaggcagaagcaucgcuugaggccaggaguucaagacaagccugggcaauauagugagaccucaucucuacaaaaaauaaaaaauuaucuaggcauggugaugcaugccuguagucccagcuacuuggguaguugagacaggaggaucgcuugggcccgggaggucgaggcugcagugagccauggucaugccaccacacuccagccuggguggcagacugagaugcugucucaaaaaaaaaaaaaaaagaaauguggcuggugauaagagauuuauagucuaaugaggcacaaagucguuuuauuguuuguuuucuuuauaaugaaugaacaaaaucauaauaggcaauaauuaauauaggaaacauugcaaggugguauaaaaugaauuucuuuacuguuaaguacauugagcucauagaaggaacugaugaauagggaauggaacugcugggcgauuggaguuguuagaguagauaguacccaaauuggucuuuggacaaauagguuggaaccagaccugaaugugcauaagaauaucuugguaacaaguuaaaaauguagauuccuggguccaacccccagauucugugggucugaggugaggccuuggguuauggaucuucacaaagagguuuagguguaggugguucagacaauaccaugagagauaaugacuaggagucuuggcagggagagagggcaggauugguggaaggcaaaugcuuggaagcaaaaaaggauagcauucagugaagaggcagacucauuccugagacagaaaaagaaaauuuaucuagaaacaauaaauaugccaggcagcuccuagcguuggacggacugauggcaaaacgggucauggcaauggagcccguuauccguggaaugcuacaaucuguagcuaauguuuuuauuugcagguuccuucagaacgaagucaauauuuaaaugaaaauauaauucuugaauaauuugcacuuuaacauguggaggcuggaacauaccuuaaagguuauuuuccuauucaacccugucauuuaagagaaaggaaugggagguaguaauucaugagggaucagcggagauuuggcugaaguucagagauuuccugaagggucauaaacacuuauuuguuuauucaucaaaacuuauuaagcaccuccucuaaacacccaguccugggcuagaccccgggauccugcugaaaagaagaaaaucaauacagccuugccuuugggaguugacagucuaaugaaggugucaguuguagaacaaguaugggaauuuuuccuacaaugaauuguguuccccacgcugccaguuauaugugguagaguugcauuccacagaccccccuacugaauacacuuuuauugaaaugagggcccugggcacaugaugacacacgauggcacaggacgagccacacggcucucugugcagcugcaguguuugaauggcuuucuaguuggcccugaguucuuucauuguaugcaaucugcugugauuuauuuggaucguguacagcagugcuuuuuaaacuuuaauuugcaaggccaucacccagggcucuuguuaaaaauacagauucuguaggucuagaauaaaaacugaggugcccuguauuuucaccaaacuugcagggaugcugacguugcuagcaggcgaaccaugcugacuagugcuagaugucuggagagagcagaagucuuuugggucacugaagaucuccuaaauugagaucagguugguuuuuguuaguguugaucaacugauuuguauuuuuucagcuuauagccacaaggccuacuauauauaguagcuuauaauaacgaggugcauuauaacuacaauaauaccuuugcuguugaaauuuguccagaaaaacaacuuuaugauggaaagucguguccucuguaaccucuaauucuuuuguacgucacugaaaaaaggauaacauuuuggauaaaacaaaauuucuugacuucgccaacugucacaaaauagcagaacagacuguaauuacaagugugacaaacgugauaaaggaaaugaggcuagggcugucuagauugggguccucuaacuguaguuauuuggauagaggccauauugguuucuuguucugcucucccccaccucaaucuuacauuacugcauaaguuggcauaggcuggcacagaaaaucuugaaggauaguugcauuuuuaccugaagcucauccagcaaccagugccagugaaacugugcauucuauacucaucuugaaauauuagcccuuccagcucauaguuuguuuauagcaagcaaaaagagaaaaaggauuacuuucagauugcuauaacgcuugacaccauugggcuuuuuaaagguuguaagugaauaaauugagcucuuguguaggcauguuucuuuuuaaaaaugguuugauaugagguuaaaaacuaaauuauguaagauucuauagaaaacauuuuuuuucugccacuuuuuuuauuuuuugguuucuagagugaucuuuuuccucucuuuucuuuugagugacaguaucagagaaugcaaaaaucauaggagggagcgguucgguuugaccugauggauuaauuguguauaggccucugcauucaaaugaggaguugugugucugacaacaaaguugcuauuccaaguugcuuugccagugagaauuuuuauugugugugugugugugugcauauacauauauauagugugugugccagugagaauuguggagcucauaaugucccacagccagaaggggcuuuagugcuuagccugaccagcugguccuguguucugugaugagcuucuucaguauuugaguuaccguuguucauagagccacgugcuaagugcuccuccaaccaacguuuguguaugagauuuaaacgugguuggcgcgcucaugauugccauacugaguuuccaaggaacaaugaaggagggcuagaugacugcaccucugaaaguuguucuuauuguugauuuuuaauuuauuuugguuuuaucuugugugaacacacaacccuuacacugguccauguagacacauagcaaacgaaguaaacagugagcuucacguugucauugagagagggggccccacagggucaaggcaucuuuuguuuuuuuaucuugucguucugaggcuuccaaaauacugaguagaacaaaaauuccauugacccaugugauauugcugauuuugcuuccaggcgaggcuguugugacgugaacauucugauacaaagaagcaccauuuggguauugacuuaacguagcaggcucagggucaccuuaccugggucucaguuccggccccauagcucaucagcugugugacauugagaagauuacuuaaccucuuccagcugcaauuucuucuucuaaaagaugugucguugugaugaugaaacgauauuguccaguacaugcauaguaccuagaacguuguuacugcuacauuguagcaauacgauugagcauuugcugaucccuguaaauauuaguuauguaauuuugaugauaauuucuuauuaauaucaauaaauauuucuaaauacuuguuacuaaauggcugaauauguauauauguauaacauauauuauacagcuuaaacauugaaaauaauagauuagaggaaguaugauauagauucuguaaccugaucaagagcuaucuucauggaaauuaauuuucuaccugcagguuaaauaacucugaaauugguuucuggcuuugcuuagagaaaggaaauauugguuaaucaaucacaaguugaguguauccaucuuuggugguuucccuuuaaacaaaaagccuguuacggaucuugcuuccuuuccguaggaaaguucauuuuagaaaguauauugagucaggguuuuuguuuauuuuaaugauagagaauugaaaauuggcauuaucagauggcaugauggguucuuucuggugcuguuugaaucaggguuagacagagacuuugugggacuguucuccuucauugcauuuucuuuauaguuccaucccccaaagauuccaggcauauuauaucuguauugcacaauuagaucuaacuguauuuugaauguuaaauucagccuuaaaaaaaaccuuuauuagccaggugcgguggcucacgccuguaaucccagcacuuugggaggccgagacggguggaucacgaagucaggagaucgagaccauccuggcuaacacggugaaacccugucucuacuaaaaauacaaaaaauuagcugggcguaguggcaggagccuguagucccagcuacccgggaggcugaggcaggagaauggcgugaacccgggaggcggagcuugcagugagccgagaucaugccacuccacuccauccugggcaacagagccagacuccgucucaaaaaaaaaccaaaaaaccuuuauuauuauuuuuuaaagcauauaugguucacgugcccuugauggaggauauuaacauuaaguauucaggagugaggaggaagguuaaguuuuagguucgauaaggauugucuggcuuuugguucaaacaagugguuuuuaacucauccagccauuccuuaugacccacauuacccucucaaagugggggcaggacaggagaaccccacagaucccccaccuuuuguuuuguaagaacugccaagccaauuguucaaauuagccuagucaucuaaucuccuaaugucccuggcaggagaacaagugauacggggaggugacagaugaacagcagagagcuugcugugccuguguccugcagcucacugguaaagcgugucaaggauguggccuuugccuugccgucccagguguuguucauaguccuccacuacuguccuuacccccaaccucuugcagggccagaauuucuguugcugagcccauuacaacagauccucagugagcaagccgcagaggcuguacugagcaugccuaguccuucucccaaaccugccagucacugaauggggccgccucuuggggaagagggauacagugggcacauagggugaguggcgcccuugagcagauuccgacaguaagaguaacgucaggcaggaggagugaacguuuccaucucggagcagccaauauuucuucuguaaauaccaaucacguuaggugccagagcaguuaacuaaccucucuaccucugaacuccauaacucauaagacuuaauuguguugaccugggauauaaaccugucccgacuccuccacauaccaaacucaaacguuucagaagcuuaaaauaccgcuuguuucacauacugauaaaaaauuccaaguaauucccccaaggaucauuuagaagguucccaaauccaccccgacagcccagccaccuuggagaguguuuuugccgaggcagcaucagcaggguagaggaggaccaggcaaggucagcaccuucugugcuacagagaggcccaugugagucuuguccucuucagaaggcggucugcaugaugaaacacaucugcagugaugcuguggugcuaugcuagucucuguccugacuucacucccugguguaggguuaaaaacucccaggaaaggcuucuuuguucuucccagaccaguaugguguauggugguugcuuuuacaucaguuuuagguggguugccauauucuccacgagccucuuuuaggaauauuugggaugguagugguaaucuauauugggagccaucucaacucaguauuaaaugagucugggacaacaagcaacacccaccccauuacaaguuuuauaugaagcaaacaucuauuuuugcuuugugcagacuccacuguauaaagugcuaaaaauaaccaaaugcucagaaaccauuugugaugcaaaaaugacuguagggggaaccguguuguuuucugcccugguuauaacuaaauaguguacggcaggaauugugcccaagaacuaguuuugcaaggucauucugaggcuuuucugguguuggagggaccuacaguugucccuguggacucaaaaugucaucuugcccacacaaacuguuaaaauaauuuagacaggcuuuuuucuuuuuuauugcuuaaaagaaauagucuguuugggucuugaagauuuugugaguuuuauuuuuuuuuaggauuuuuuuuuuuuaaaaaggaaaauggaaauaaacagaucacagguuaggguaaccagaagacaggguuguuacgccuuuaaaaauuuuagcacauuuccuaaugcugcugucauuucuuaagucaugcuaugugugagacuugaauacucggugcucccguacuggccucaguguuguuaccaagaagugcauuugccagucuuaucaaacuggcaucagaaaucaagcucugagcucagagguuagauaccgcuuauuuuuaucaaguaggcaauuuuccucuccccuuagcauaugcgcuuuggguucuagacuuguucgaacaugccaaagaaaccgcugguuaauuuaaugccuagaggccauguuccuacugugucuguaggaaaauguccucccccacccccgccaccccagccugaguauguugaggagccaguugacaaaauuguuagcaugcugugaagggacggauggucaccuccucuucuccccacgcguccauguguaugcacucagccuguucuccggugugggugugaagauggacauagucuugugugcuucucuauucugcugagauuuguguuaucagcuccacacuucaaggacaaaaaaagauccaagaugaugagugguugaccauguugcaugaaaaggaaguggauagagaggauucauucuggaacagacuagcaauugacuggacaacguauucuuucuaagccucuuaacccuuuguauacaucucuuuauggcugugaaagugucuuaccaucuguuagauuuuuucugggagaugauuagcuuucagaaaccuaaaugacucaagggaagugaaagcaauacuagacuuucuagaaaaauguauggaauguguucuccuucuuccagcucugugcgugcuucagggaagcugcugccucugcuuuaguaugucugugcucuuugggcugguggcacguugucugagaccugaagaagacaguggugaaaucuaaaucagaacccuaggcagauuuuccuucuuucuuucuuuucacccaccagccuuuacuuuagcaaucuuccucuccaauauuuauuuaaaauuuucucagcauguacaaacucuuggcauauaggagaagaagaagauuucuaaaaaaucaagccauuucuccuauaagggagaucugcuacaacaggaaauuggauuuggaccuucuuuggaagcaaaaaaauacagcuaaauaaacguuuaaauggaaguggucucauaaauauuuucaguuucaaaaauggaaauucauugugucacuuuaugauaauauccauguuauaucugaacuucaugcucuaaaacucuacaaauguagacuugggaaaaaaaaguuagcguuuuuucacuaacuuuuuuuuuucucacuaaucauagcauggacacccguuccaguuuguguuauguguuucacagggaauguuuagcagcuucguggguuugaaacuuccugaagguuguugcaggggcugggaugagugcguuacaggccucuccuuggcaaaauguuuuuccguuuguaguuucucagcauuuucucuuccccugugcaauccaggcuaguggaauugagauacucacauuucuaucauccagcuggcuaguuuuaggaaagauacagcuugagccuguuccuccuuggcuuuuagcuuucacuugccuuauuugguaaagcugcgggguucguuauuccuggaaagggcuguuucaccaguuucaaggacuauuucccacuuccaucuaguucugcgcugggaacuugagcuugguugcagcucugggguaucugauuugaacuggggcaguugcaggauggggguacccugaagaauucucaccacccauggcugguggugauguaccccucacuaaugagauguuuacacaucagauacauaguucaauguaaacuucccuuugaaacuagguacucacaaaagaugcuggcuuuuuugcuucguccaagggccuggaaugggcauggcuuucucgcuuuucccagggucuugguauuuagauugccuuuuccccaauuauccuuuucauuucugcauucuuucuaucucuuugggggcuuuuuccuaucccuuauaagaaacacauaauuuugcucacguuaaauuugcacauccuaaguuuuaaugaagcucacaguuuauuauuaucuucaguaccuccucugauguuguuuauagggaaacuuauucuucucauguucauuauguaugaagucauguucucagcacccaccucacccccuucuugucccccaaaccaacuggaauccagaauccugacaacuuauccuucucugguuccuaaguagcauuguuguaaaaauaauuagccuaaguuuuaaagagaugagaagauguggcuuauuccuuggagcuuauauucguuuugugucuuagccuaaaaacgaaguuuacaggccccccaguccucagaaagauaguuauauucuuucugaugaaaggugggaacggggaagcggggaggagaggagaggagaggaagugagguugauguaagugaauccuucucucuuugcccagagaguuaguggguuuuuuuuuuuuugugaaaggaaguugaauuuauuaagaguuuggagggagggggccgaaggaaacguuuuucccucccagaaugcggaggcugccacucagugggagaauuagugaagcuccggaacucacuuucauuuucaagaaccuguugguggaggcuuuuuuugucuuuggcuuugcuucucccuuccagcccugccugucacagaaagacccccguucaucucccuugcccugcaguucauuucuggaguguaggugugaaguuaagggacuguccccaucauaggagaugaagcaaaugaagagacaaaaugaagcaaaugaagaggcaaauacaagacaucuagaaaucgacuggguggagggaguaaaggagaaaaacagaaggguagcuuuugaaugugaaacaccagaaugaaaacugacuugcccacugucagaguguauuacuggucuacccacgucagugagagcuggugagacccacccuccgaggguccuaacugugugcggcuguucccugcccgggcaguuguguugucaucuugauacucaguucaguccuauacucuucuggguauuuguuuccuuuuagaaaauagcuagcaaauuugugaaaauucaaagcaauaugcuagguauguuaugaaccuauuugccuaaugcugggccaagcauagaaacccaaccaauuaccucucuauauagaauauacagaauguuuugauuuaacugccuuaagucauucugcacuagagaguucugucucucaguuggauuuaguuaccuguccuuaucaguccugguacacaaaacucuuugucauacuaauuaugauuacuacuacuacuaacaugcacuuuuauuuuuuaucuuauuuauuuauuuugagacagagucucacucugucacccaggcuggagugcagugguacgaucccagcucacugcaaacuccaccucccagguucaagcaguucuccugucucagccucccaaguagcuaggauuacaggugugcaccaccacgcccggcuaauuuuuguauuuuuaguagagacggcauuucagcauguuggccaggcuggucucgaacuccugaccucaagugaucuaccugccucagccucccaaagugcuaggauuacaggcaugagccaccgcacccagccuaacaugcacuuuuuuuuuuaacuguguaauucuuuuuucuuuuauauuauacuuuaaguucuggguuacaugugcagaacgugcaguuuuguuacauagguauucacgugccaugguggcuugcugcacccaucaaccuguuaccuucauuagauauuucuccuaauguuaccccuccccuagccccccagcccccuacaggccccagcaugugaugauccccuccuuguguccauguguucucauuguucaauucccacuuaugagugagaacauguaguguuugguuuucuguccuugugauaguuugcugagaaugaugguuuccagcuucauccauaucccuacaaaggacaugaacucaucuuuuuauggcugcauaguauuccaugguguauaugugccacauuuucuuaauccagucuaucacugauggacauuugaguugguuccaagucuuugcuauugugaauagugccgcaauaaacauacaugguaacaugcacuuuuaauacuuuuguugcaccuguucuguucugaaagcuuuacccguuucuaccauacagcaacaccaugaggcuggugcuagucauauccuugguuuacuauugaggaaaacugaggcuuagaggauuaacaugcccacagcaacaugguuagcuagaaguguuaacccugguagucugacucuagaaacggccuaacugcuuugcuaugcugcuucuuacugcuauuuaagucacugucuggcggcaaguagccuugagugcuuuuuuuuuuuuuuuuuuuugagacaaggucuugcucugucacccaggcuggaguguaguggcacgaucauggcucccugcagcuuugaccucccuggcucaagccauccucccaccucagcuuccugaguagcugggacugcaggcacuguccccaugcccagcuaauuuuuuaauuuucuggagagaugaggucucccuguguugcccaggcuggauuuuuuuuuuuuuuuuaauacaacuagucucuggagcucgugguacaaggacuaccuagauuaaaugcauauugguuuguuuggugaucacuguuucuugcaugaggccagaucuuugcccugcuuuguugcuaugcucucuuuuaaacuucccuucacuuguuaccuuauugugguuuucucugacucuuguucauacaccucuuagguaggucuccgaccugcggguucucuaaggcauugauucccaagcuugauuguacugggaaucacccgggagauucaaaaaauuauauucccuggcuccauccuugcaguugguauaagacucgggaauaaauauuuuuuacauuucccuggagauuucgacgaccggcuugcuuugcauuaaggcagaguuucucaaacuuugcagguguacugugugaucuuauuaaaaugcagauuccgaaacagccugcuaucugaucugcacugaggcccaagggccugcauuucuagcaagcacccagugcugcugaugcugcugguucacacuucucaugguuuuuuuuuuuuuuuuuuuugagucagaaucuuggucuguugcccaggcuggagugcaguggggcaaucuuggcuuacugcaaccuccaccucccggguucaagcaauucugccucagccuccccaguagcugggacuacaggugcaugccaccaugccccgcuaauuuuuguguuuuuaguagagacaggguuucaccacguuggccaggauggucucaaacuccugagcacaggugaucugucugccuuggccucccaaaguacugggauuacaggcaugagccacccugcccggcccacacuucucauuuugaguagcuggggucuggacugugcauuuugacuguacucucuuacccuuucagucuauuuaguggauugugucucacacuggcuggaauuuguggcuuccaacaaccuacuggagguaauugcccacaggauaaagugagaaaaaggagcaaaaugggaagauacugaaagagaaacugucucaauuugggaaggacuuguuaaaaagacaagcauugcuaauuaguagcuuaguaucuaaucuuugucacugaaggcugcaaaucaugcuuccuggagucuucuuaaagacagcuucugcagagguuuuaacaccucucaucugacuuuuguuaaauagccugcuggaauccaaaauagaagcuguguagggagauucucccuaagcauauuuacugccaagccugcucuguuaagacuguauugauuuuccccccucuugguaugaaauuagucauauaaaaucacaaaguccucaaagacauuugguucaaucugacacuugaugcuuagcuguccccuuaagcacccccacugagggaucccuagaccuugcugcauaucagaaucauuaagagguuuaagaaaugauuuucuauuauauaagaaguagaugcauacagucuucucauauucuugcugcaaaggcuuguuccuuguucucuuccugacccuagagcuagcuauuaccagaaugcucuguaacuuugcagacuuuuuucuuugaguguacuuacguaugugcauaccuguuucuuuuuuuuuuuuaaagccuguuagugggguguauuuuaauauuacacuggguuuuuaaacguguauucaaagcagcugugaagucauuuucucacuuggcuuugcagacacaguucucugcugguucuccagaacuuccucugcuguuccuucuggaucucccugacucucucuuccgcuuucucaccucuaaaugcugggcuggucccgggcuucggccuuggcucucaucucuaucuguguucacucucuagaugaucucauccacuccuugagguuaaaugugcugaugacuaacagauuuguuucuccagugcccaucugucucccaagagcuaaaugugcaucuccaacuuucuaagugacacuuccacuugaauggacuucacaggcauacuagacauaauuugucuccaacuggcagugucucccugccucaaaccuguuccaucccuggucuuccccaucgugauguauagugacuguuuuggcuuguagugucuugauuucucucccucccucacacgucacaucuuagccaucugaguccaguuuucuaggccuucaguuauagucccaauuugccuacuucucaccaccuagucuacagcccucauucugcucuaaaccgucauugugcuacccagaccauuguuucccagacuucuuugacugcacuucauagcaagaaauuuauuucagcugggcaugguggcgugcaccugugcucccagcuacuugggagggugaggcagaggguugcuugagcucaggaguuugagaucagccugggcaacauagugaaaugcugucucauugugucucaaaaaaaauacacacauauauguguauauaaaacugcaaccuaggagacauauucauauauauaagcaaaagguucacaaagcaguacuuaccuuuacuguuugcaguauagucugauauuucauucucuuauuucgugaaaaaacaaauggugguugaggcccauuucaugacccaguuucagucgugaucugcagcuugaaaaacacugguuuggauccuugcuauuuaaggugaucuguggagccagcaacauugacauuaacugggagcuuuuuagaaaugcaaaucucaaccccucuccuggcccccugaaucauaacaugcauuggaggagaugcccagguaguuugcaggcaauugcagugugagugucacuagucuggaaugacugcuguggccuucuaguaguggaucuccuuguuuccaguccugauggcucacagucuuucuaccauggcuggagcuggagugguccuuauaaagccauuugggucauccugugccugcuuuaaccagccucccaccucauguggaacagaaucaagccagguucucaacccuggaugacugcucauuaagauuacccagaagaauuaaaaaaaaaaaugcaaaacgaacaaaacaaaaccucaugccugggauacaucacagacaaauuggaucagaaucucuggguaugcggccaggauugagaacagcuguaugagaagaccaggccccugccugccucuggaagugggccuaucucgggcucuccugguucuuucagcucuaaccauacuggcugcuuuccuguucccugcacacagcaaacucauuucugccccagagccuuugugcuuaauguuccuccugccuagaauucucucuugcaggacucaugcccucacuuguuucacgccucugcacagaugccaccaccccugagagaccucugugaccuuccugucuuaccaacuuaucccucuagcugcuuccccccuuugugucuccucuucgucuugcuuuuuuuuuuuuuuuuuuuuugucuucauagcagguacuacucucaacacuguaugucguguuacuuccuuacuuauuugcucuuuaucuuucucuguagaauuuaaguugcaugaggacagagaccuuaucugucuuguugaacacuguauuccugauaccuggaacagugucuggccauaagcagaugaugaauaguauuuaugaugaaugagaguagucagugguugacugcauuaugguguuucuggcuuuuuauagcugaguuggcccugguuggacagaagcaagaaugcuucaucccugguaaacggucagucuggucuucuccauguauuuuguucuucuuaauaauaauaauaauuuuuuaauuauaauuacuauuuuauuaauuauaauaauaauuacuaauuauuauuauuacagacugggacucacuguguugcccaggcugaccuugaacuccugagcucaagcgauccucuugaauagcugggacuacaggcaugugccagcaugcccagcucaacuuugguuuuugugucuuuuuuuuaaauuuuagguuuggggguacaugugaagcaugggaagauuugucacauagacaaacacgugucacggggguuuguuguacauauuauuacauuacccagguauuaagcucaguacccaauaguuauccuuucugccccucucucuccuuccacccucccccuccacaaguagacucuggugucuguuguuuccuuguguucauaaguucuuaucauuuagcucccacuuauaagugagaacaugcaguauuugguugucuguuccugcauuaguuugcuaaggaugauagccuccagcuccauucguguucccgcaaaagacaugaucucauucuuuuuuauggcugcauaguauuccaugguguagauuuacuacauuuucuuuauccaaucugucauugaugggcauuuagguuaauuccaugccuuugcuauugugaauagugcuucagugaacauaauugugcauguguauuuaugguagaauacuuuauauuccucuggguguauacucagucaugggauugcuggguggaaugguaguucugcuuuuagcucuuugaggaaucacccuacugcuuuccacaaugguugaacuaauuuacacucccaccaacaguguguaaggguucccuuuucuccacaacguugccagcaucuguuguuuuuugacuuuuuaauaauagcuguucugacuggugugagaugguaucucauugagguuuugaucugcauuucucuaaugaucagugauauugagcuuuucuucauaugcuuguugccugguucaacuuugauucaggaaagcauuuccuuguuucuuccuaagggaggaauguaaagaggaaaaauaaaaaauggcaggauagccugacuauuuuccugaagaaacaugacugucuucaaauuaucagaucuuugccuugaauugguuuugcuuuuuugauaggguguggaagacuuuucauuuacccugaucaaaaacauuuuuaaagagaagcuuaugaucacuuguaguagcuaagauugauaucagaaugugaaauaucagaggugauccuggcuuggauuuggagaugcuguauugaacauaauggcucacuucaacguggcugauuuuuuuuuuaagucuucauuuggagcagugucaguuuaacagucagaucugacauaacuguauuacauaaucagacuuuucaaggauacagauugaaagggcuuuucaguuaggucuuagaacuucuuuuauuuuguauccuuugagaucagucuuccugcuuuugaucuuuugcccuugauccauguuucuucaguagguuaauuccgagcugggguuccgaggaauucuucaguuuaaaagagaacacacaauaacgucuuuguaauaacaaaauugagugaggucagggaacuacgucaguccuguuugagaaguaucacuaaugccuaccugccauaccugggaaugcuaguaaguugcuugagcaguagugauucaggugcgagauucagucccgcauacaaacugacugucuuguuuuauguuuuguguuuaauagcauuuggucucucuuaugcaccuugucuuuuaguucuaacacauugaugguauucauuguacguaaacauuugcaucaaauuuugcucaugaaguauaaaauauacggucuuucaucuaucgugagaccauuuuuucucuuuaggcagagugauuccucuuguuuucccuuuguggccuuuggauuaaucaugguccucuaggguacagacaccugaaaauucagcucauacaggaauuaguuggcucccauaacuggcuggagcucggugguugaagugaugcugucaugucuccaggggcuggacugucugacacccucuccauguuucaucuuugcuucccucuagguggacuccauugucaggcagguccucccucuuaauguccacaccaucgucugcaacucuggauuugcaagcucuuuuuagcuguguuaguggaaggugaaugucuuugcccuguuucucagcugguuaaaucccaccaacucugaggcagugaggucuuagcacuuagaugccucuuugaccagggcugggucacaggcccaccuuuggagcaaggagauugagugaauuccauccaaauacagggacucugaguggugggagacugguucccuuaggaaauaugagaaguauuauuggaacacugcgggaguggucuuagcugggcacaccaagaccaacuggcuucucugguguaauaauugaaagugacccaucgucugauaacugaggaccagcugugugcuagaggagaacuugcucgaagucaggagauuucagcucuucuuuuugugugugugauuuagaaaucuaaauacauuuucacuaacucauugaacaacacgaugcggugugggguugaaggagauuuuaggucuuuugaucauugcuauggcacuuggaacugucuaacaauaccuguuguugguacuuuaccuguugguuucaugggugauauuuauucugaaguuucgugaacuuagacaugccauuucccuuugcuuaguaacuguuguauuuguaaaaaggaggcuuagacaaggucacauuuagcucuaaaacuuuaugcugucauuuaggcuacuccuucuauuuucaagaggaaauaugagaccucaagaaggcgagagaucagaauugguugcauuuuauaguuucucuaagagcagaaucuggguugcauuuuauaguuugucuaagggcuaaaauuacaacgugaacacaagaaagcuggugacauauuuuuuagaagccucaaauuugauucagaaacauaaacugauaauuauaugugaaguucagaugcuaaugccuugggagaauacaaaaauaagaggggccaugcuguucuuuggacauauagaaugcuauaaaagauaaaaggcaaccguguuuguuauaguucacuuauaagacaugaucagauaaaugcuaaacagacuuguauaauauaccaggagagaccagugcaaaagaaacaugagacauguuaucaaagacacacaggauauggugggagaagaagcuggaaaugugaauugaggccuauugauugcuggguuaaggagcucaggccuuuauucuuggcaaugagagccuuugaugauuucugguugggaaaggagaugaucaacaguguuucugaaagccauuccuacuggagagcugagauaauuggagccagggaggcuaccaggagaaucuaugugggagauaugauaugggaaaugcggggcuugaaccuguggcagaggcagcaagaaugguggagguggccauagguagaagguagacuucgggcuuguucauuggcuuggggagauacaagugagagagagaaguugaaggagucuccauccuuucccaccuucaccagggacucacugguacagaagaaccaaagcuucaguaacccaguuuuaggucaggauaauaggaggcaugauuuguauuccagaguuccucacgcaaucgggcugaagucauccuccuuagaacuuugccuaaaaucccaucgugaugggcuuuucccccuucccugucuugcuuccuuuaccuccuuacagguuuauccugggagcacuuccuuaauaaaucacuuguaugugaaucacuuguuccaggguccccugaaccaacccaagauaaagauucguuuuuaucuuagguaaaucaaauccaggucugguguggcagcugcgugaucgaugagagccaaaucccuugucucuacucucccauucuuagugugugccuauucuuagguugucucuuuaucguaagauggcuacgcuagcuucagccauuguguucacauuccaggaagcagaagagaguaaagggcaaaaggaugcaccuacccauugagggagccuccuuuaaaacccuuggccaacccagcccuccaccucccacccccaccauggccgucucagucauggauaucugcaagugagaccgggaaauguguggcaggaguguuuuaaucugggcccguugucaucuccuauaauaaaguggucgauugguaaggaagaaagguggaaugaguacugaguaugcagcagucucugccacaaaaguuaaaacugaaauugagaguguagaucguaucacccuggaugaggagggggaaguauagcaaagugguuaaggguauagguucuggauuuagaccugguuuucaaacccuuccuuugugcucauguuugccugauguaugacuugggccaauuacuaagccucacuuuucccuucugaaaaauaagguuggugaaaauagcucaaaagguuggcaugggaauuugcugagucaaguaucauaaugaaacguguauuagucuguuuuugcauugcuauaaagaaauaccugagacuggguaguuuauuagaaaagagguuuaauuagcucaugguucugcagacauauaggaagcaugaugcuggcaucugcucggcuucuggggaggcuucaggaaacuuugucaugguggaaggcaaagggagugcagacucaucuuacauggccagagugggagcgagagagagaguggugaggugccacacacuuuuaaacagccagaucucgugagaacucacugucacaauaacggcacuaaggugauggugcgaagccauucaugaaggauccaccccugugauccaaucacuuuccaccaggucucaccuccaacacugggaauuacaauuccacaugagauuuggguggaggugcagauccaaacuauaucaaaacucuuagacucagcauaagaccugguauauauuauaguuaauuuuggccauuuuauguaugaggagcuggggugucggcuuagagauguuuuuaagagcagagagugaacaggccuacaaggacagcaaggccaagaguaggagcuggggguugcagggagguggaugcuuugaggggaggugaugaagaaggucgcauggcaccaagacuggagaggaugaggucugagaagucaguugacuuuagcauuuaggucacugaugaccuuugagagcauugugguagcauggcaguggcggaauguucuuaagaaaucagaaaggucagguauggcucucaugucguagaugaagaacuauggugacuguauguuuuucuuugaaacuggccuaagugcagccugcccugccacucccacaaccacucaacugaugaaggugauaccagaaaugaaaucagauccccugauuuauugcagggggugggggcguuugcugugaauaccagcagcgguuacagaauugugacacguccaaauuacagacaaaugcucuucucaaaacuucucugcacuuuggaaagcucugcauuucaccgagcuuaaguugcuaucuauguaucuauacuucagguaaguuucuacagcgaaauuuccugaugagccaagaauuaagcaaaaguuccuuagaguuuauuguaaacggucugacuuuaugguaaaaagccaaggcuuuuuaccauaagauaaacucuuuccaugaguuuuucuuuccugcuuuuaaaguauuaguuuuuaaaaauguuuaugucuacucuguauuuaucaucuuugguuccaaaucgcagacuuauuagcugagugaaguaauagucuguucacuauauacaaugguguuuguugcuuuacuaaucacuuauuuaaagcuagcacgguuggaacaugggguuuauuuguguuucaaaaggcuuagcaacugguggucacagauggguuuuuaguuaucugaaccagguuguuauuguaauaaagguauaaagugucaccuuuuugguuugaggucauauggguuauaugacugccucugcuagaauccuuuuaauucugguagauggaacugucuuuccucccugaaaucuuagccucuugugaucagagcugcucguuagcugcuggucuucccacagucaccuuucauuuguauacccuggcaguguuuaaaccccaacuccuccaugcucauuauauagggcaagccagaugucacucccugggggaauaggaaucugguuguaauucacauggaaacaaguugacuuuauauuguuucucugggucaguaaaaguacgucaccuuuuagaggcugauaguuuuaguguguugauauguuaccagggguuugccgcuuacuguauguucagcaaaagagaguuaggauuguagagcauugagugaguacauuugcucagagaggacugcgugagaaaaggaacuauguggccugucugaaggggucuucuuauucgccuccagcuucuugcugccaugcagaaauaugagccccguggugccaaauccugguucauuuguuuuguuuguuuuuuaaggaaaagauguggagguggauuugaaugugaaauugcccucuuuuaaaaauaguggcaauuaauaccagccuguuuaaaacauuguguaggccagauagaauguugucugugagcuggauuuggcuugaagucaaccagcuggcaaauuuugcuuaagguaauguuuuuuaaaugaagcuacuauuaguccaguaaauauauccagaugugcagaacagcaaguaagguuuuauggggauuuggguguauguagaugaugaagacgucauuugagcccccacggagacuguagugugguaaggaaaugacacaguaauccgaggccguauagaaguauccuaagagagggaagacaaaaggguguuggaauuucccaaguuggagagaugacuucuggcuggcaucaccgagggaaaggggcauuugggcuccucugugaaagagaugaggcaagggggcacauucuaggcaccagggagugugcaucaaauuguagaaaugagagagaaagcaagcuguguuuuggaaguggucagugacccgguuuggcuagagguaaaguccagguuaacuuugaucuggaaacugcaaccuggugugauaugugauccuauuuagccauuguucauugcagguaaccuccuagcuuggcagaccauuccuggcugucuggccagaguuuaaaguauacagagucacaguggccuucucacuaguguucaugccugaacuugguuuugcaaacaucuguggagaccaaucccauguacuaggaggcagauaguauuagaagacucagauucagagagcuagguugauaaaccauccuucagcuuuccugcggugugauucugugacugagugccugcugagucuuccguuuccugcgucuuauugguuggcacauggcaugggccuuuagcaccuaugcagggucuauggggccuugcauggcuagaacuuuagugcuuccucucaguuaaaauuuguaccauccuuccccucuccccugguugaaaggaagcaaauccuccucugugaccugucauuggcuucugugcaugucauaugguaguaaucucuuuaaccaggaugugugauacuugaguguagcaaggagguccucuccucacuuaggggagacccuuguuugaacagagaauuaaaaaauaaaggcaggcugggugcaguggcucacgccuauaaucucagcacuuugggagaaugaagugggugaaucaguugagcccagaaguuugagaccagccugggcaaugcagugagaccccgucucuacaaaaaaauacaaaaauuagcugggugugguggugggugccugugaucccagcuacucgguggggccgagacaggaggauugcuugagcucgggagguugagguugcagugagccaugaucacaccacugcacuucagccugggagauggagcuagacccugucuuaaaaaaaaugcagaaaaguuuuaggaaauaugguuaucacuucugccuuuaagauguucauaaguggcugaguuauauauuaaaggcucugugaagucuugcaauaaagaaauugucccaacuuugucccaauguaguuuuccaaaauuauaccuaaaaauuugggcucuaaaucagaguguuucaauucaggugcaauuuuaugucauuuccugaacuucucugaaucucacuuuacucugagaacaucgucaaacccacugggugucccgguaccucucacaguggccauauccacuauuuuuccucuuuuguacaguguggcuuccagaacuaaaggucauauucuagguguggucuauagugcacaggaucauuacugaugagcuuuuuuuuuuuuuucaucuuuucuggcuaucaccuaauuuugggaaaaaccuauugaaauguucucacuuggagacuaauauugagaauacuuacugaggguuuccuauggguaaaauauuucauuuuuacuacaguccucagauggggauccuuuauuguuagucccgguuugcugauauggauaugggaucucagagagguugaauauguugccugcggucacagagcuaguaaccacagagccuguguucauggccuucacucucuguagcugcaaaucagcagcucauaggcugacuccugcucacgcuuguuuuuuguuuaacuugcacaguguuuuaaaaucugaguuaauugguuuacccuuacaguuugggagauuuuacauaaaaaacaaauuucuggcuuuugggggaaaaugcagaaaaucuagccacaguggauuagcauugccagaugacaacaagugucagaaacuaaguaaagcuuucuucuuuugaggggagaaggacuuuuacagucuugccaacauccuacuuccuuugguccucaccuuacaguucuugagugauggcuguaggcaguuggguuugugaugcuguacuugauugaugaaaacugggaacaagagaagcagugaacucuaaacgugaaaaugguugaaugaaggaccuugguugcagcaagccuuccccuacuccgacaguggcugcuguuuuugcagcugaguucugcaguguguuggacuugacuucccugauaccagcaggaggcacaugugugauauacucuccacuggaucagucuuggaguggacagugucagguuggagugccaauauguaggguguuggauauaguugucaguuuugacguauguaugaaaccgugaaacucaccacaggauaaugaagaucuuagucucucccagaagucuccuccugcccauugguugucccuacucccuccuuccuacacugguacaugcccccaggaagccugaugugcuuuaucgcuguuauuugcauuuccuagcauuguauguacaaauggaauuguacagcaagucuucucuuuugcccgagcucuuucacauagcauaaguauguuacaauacauuuguguuguaugcaucaauaguuuauuuagucuuuuugucuuuuuuaaaaauuuuaccucuguggcauuguuucauugcauaccacaguuuccacucaaggcagauuuuuggacaugcuggcccccaguuucugguacccacagccauucauucuacacaucccucaaguucccuugugaauuagaacugguguugaggauuucuguggucguguauugauucugugauucuaaggagauuccgagccccagguuuuguuguggguggucuugcuggggauacuguggaugggcucuuugagggcccacaggcuggagcucggaaaggguaccaucucuacggaccuuccuguuuugugugugugugugugcguguuugugugugugucugugucuguuuugagaagaauuuaaauagcuuuaauuuuucgccucuaaauugagaacauuuuccuggcauuugucaaauauaugugaauguuugugucuucuacguaaaaugauaguccguggacuguuuaguaacuguaauguggggauuauggugugaaggguggcauuuugggaaugugaaguugaugguagacauauuccuugggaggucaggauugggucacaugagcuaauuuccugucgcucuaaaauugauucacuccccacccccaacaagggcgacucccacagaaugucaguagccaucagacaaugcaggaauggagaaauaaaaauaugagcacuauuuaauuuguugauuguguggggacaacucaugacagcacaccaugauuuuuguguuguucagagauauucauucauuguuaaguugcauuucuuccuggaguaaauuaauucuuuucagaaaguaaauauuuucugaguaacuaauugaggaauucuguucuucuuuuguuagugguggugggcuguggagaggguuugguagacaugaaucaccuguuagauguaaaggggaaggaaacccauaauuuauggucaauugauuuuucaacauagauaucagaacaauuaaauggggaaaaauauucuuuuuuuuuuuuuuuuuggcacuggggcaacuggauuuccacaugcaaaaaaguaaaguugagccaggcucauuggcuccugccuguaaucccaguacuuugggaggccaaggugggagaaucacuugagcccaggaguucgaacccagccugggcaacauggugaaacccuaugugugcaaaaaauacaaaaauuagccaggcaugguugcauacaccuguagucccagcuacucgggaggcugaggugggaggaucaccugagcccaggaggucgaggcugcacugcacuguagccugggcaauggagugagacccugucucaaaaaaaaaaaaaaaaguguugaacaccuaccucacacuguaugcaaaaguuaacucaaaaugaaucaaagcucuaaauauaagagcuaaaacuauacaccuccuagaagaaaacauagguguaaaucuucaugguccugaauugggugacagguucuuaauaugacaccaacagcauaagcaauaaaagaaaauuagauaaauugcacuucgucaaaauuaaaaccuuuccugcuucaaaggauacugucuagugaagagacaacucauagaaaaguagacaauacuuucaauuuuuuuuaugauaugggaccaguauauagaguauauaaagacuucucacagcucaauaguaaaagacaaauagcccaauuuaaaaauaggaaaaagauuugaauagacguuucuccaaagaaaacauauaaauggcuaauaagcacaugcagaaauguucaguagcauuagucauuagggaaaugcaaaucaaaaucacagugagaaaucccuaggauggcuagaguaaaaaagauguacaauaauaagcaguggugagaauguggagaaauggcaacucucacacauugcuggcaggauugaaaaugacacaaccacuuuguaaaaguuaggcaauuccucaaaagguuaaacauagaguuacuauaugauucagcaguuucacuccuuagggauauacccaaaugaauugaaaacauacgucuacauaaaaacuuguacacgagccaggugcaccuauuuacaccuacaauuucagcacuuugggaggccaagguggguggauugcuugggcccaggaguuugagacuagccuaggcaacauggcaaaacccugucucugcuaacaacaacaacaacaaaaaauuagccaggcaugguggugugcaccuguagucccagcuauucaggagacugaggugggagaaugacccgggccuaggaggucaaggcugcagugagcugacauugcaccauugcacucuagccuggguaaugggagugagacccucucagaaaaaaaaaaaaaaaaaaaaacuuguacauaaacauuuauagcaacauuauucaucguagcuaaaaaguagaaacaacucaaauguccaucagcuaauaaguggauuuuaaaaaggguuguagacacacaguggaauauuauucagucauaaaaaggaaugaagugccaguaccugcuacaacaugcaugaaccuugcaaaccucgugcuaagugaaagaagccugucacaaaaaggcuaccuauuuugugauucuauuuauguaaaauaccgagaauucauagagacagacacuagauaacugggcucuugagagaaggggagaauggggagugacuauuaauggguauaggauguuuuugugggggauaaugcaaauguucuggaauucgauagugguggugguaccaaucuguggauuuucuaaaaacugcugaguuguacucugaauuuuguuggaugugaacaauaucucaauaaaaaugacuacauguaaaaaauguucaagcuuacugguaacaaaauauaugcagaugaaacaacaggcaucaaauaaaauaauaaaacauccacuuuugacuacaaaacaagugaaaaaagugauaaaggggaaggaaauaaggcaagacuugcuuuuuagaugacaggcauuuuuuauuuuguuuuuuuuacagucagcuauaauuuuuaaaauuauuucuuuauuuuuaaaauuucaacuuuuauuuuagauucaugaggcacaugugcagguuuauuacaugaguauauugcaugaugcugagguuugggguaugaaugaucacccagguugugagcauagcacccaauagguaguuuuucagcccucacucccugguccauauguaccacauuuucuuuucuuuucuuuuuuauuuuugguuuuguuuuuguuuuugagacagagucuccuucugucacccaggcuggagugcaguggugcaaucucggcucacugcaaccuccaccuccuggguucaagcaauucuccugccucagccuccugaguagcugggacuacaggggcgcgccaccacaccuagcuaauuuuuguguuuuuaguagagacaggguuucacccuguuggacaggauggucuugauuuccugaccucguguuccacccgccuuggccuccaaaagugcugggauuacaggugugauguaccacauuuucuuucaccaguccacuguugacagggcaccugggucaauuccaugucuuugcuauugugaacagcacugugaugaacguacgagugcgugugucuuuuugguagaacgauuuguuuuccuuuggguaauacgcaguaauggcauugcuggguugagugauaguucuguuuuaaguucuuugagaaaucuccaaacugcugaacuaauuuacauuucuaccaauaguguauaaguguuuccuuuucucugcaaccucucuaacaucugucuucuuuuuaaauuuuuuaauagcuauucugacugaugugagauggagaugguaucucauuguaguuuugauuugcauuucuucagugauuagugauguugagcguuuuuuccuguguugguugaccaucuguaagucuuccuuugagaagggcuguacauugggugaguuuucagaugugucugaggauauguuuuaggugagaggcacauacauuuaacagagguuauggaagacuucugugcuggcaaggcucuuuggaacacagugaugaguaagaugcuggaccuaugcuugugggcuuucguggaguuguggagguggaagggaggucagguaggcaggauggaagucaggagucucugcugaggcaccaagauguaaagcaugucccauuccugaggaugggucaagguauuuauaaagguguuagcugaaaaaguuacaacuguauuacuuggagaacugucuaugugucuccuuugcuuagggagggaugggguguucaauucugaugugggaucagcgaggagaugagcuaucuggcugcaaugacaagcaauguaaaggagcauuucagcuaauuuggcaucaguuugccugagaaaggaauucaugacucuuucauggacacgcaugggccgugugugaaugaacugguguggggucaucuuagcugggaaggggcccugcgcagaagagaaccuagggguggagcuuaggaucugcaguaguuggggaggaccugugacuaccagaauagagaucuuucccccugaagagggaaugcagagagaggccucuagcaauggcaggcuuauguccaaaaugccuauggaaaugccagcaagaacagauggacagcaucgugaguccucagauaugaugcccgggguaggacacaaccccugcauggaguguuccagcuggaaucuaaccaugagaagacaucagacaagccccaaaugaguagcaugcuauuuuuuuuugggugggggggauggagucuuguucugucgccuaggcugaagugcggugacacaaucuuggcucacugcaaccuccgccucccaggcucaagcaauucuccugucucagccucccugguagcugggauuagaggcacacgccaccaugccuagcuaauguuuuacauuuuuaguaaagaugggguuucacuauguuggccaggcugucuagaacuccaccucggccucccaaaguucugggauuacaggccugagccacccugcccggcccuauaguuuuuuaaaugggggaccacauauuauuuuaaaauguccuggucaugaaagacagagaacagcuauaaaaaacauggcaacugacugcaguaccugauccuaagccagauacugauuggaggguagaaagugucagaaaggacauugucuggucaaaugacaaaaugggaaugugaaccauagauaagauaaaagcauaggaucaguauuagauuugcugaaguugauaguagugcuggggucauaucagagaauuguccuauuuuuagcaaauggacacugaaauacgggcaugauauaugugacuaacucuaaaaugguucaggaaguuauuuuguauguauguauuauacaugcagaaagaauaugaaugaucaagcagcuguguaaaagguuagcaaaaggugacucgguauagagugguccauguaccauuucucuugcaacuucuguaaauuugcaguugucuccaaacaaauauguaagaaaaaaugaccaugagugcccagcuuucagcaucuaucgcugaggccuagagugugaagcuggcgugauuccacuggccuuuccuggucuucugguuguucuccucucuccacauccucugccuccuccaaggugaaaucagaaagugaaguaggcaacagggaguggggccgacaucagacaggaaagagagaagggaucguggggaggaaaaaucuuagcuuuggcugucaggugggucuaaauuauuuuaauuggaucauuaccauuugcaacaguuuccagaggcuugaucaacuuuuucuuuucccaaauccaggagcaggggaaagagccuuccccacugaauaaauuuuaaaacaacaguggaagacaaauauguuuucugauuaugucauacagguucuuaauggucaccauacccauugcacagacaaauucuagggcaguacuagaaugaagguaguguuugggauucuggaggaggcagugacgaacccugugugguaggguggaguaggauggaggacaaaaaagucuuccuuuggcaguggaacuuugagggugagcuuacagcaggauagaugaagggugucccagguagaaaauggcacugaugcugcugguaacaugggaauacaauuuguaaaccaaaagguaucugaggcaggucucaaucagugugaaaguuuauuuuaccaagguuaaggugaugccuggaaggaaaaaaaagaaacaaacacagaaucacagaaauagucugugguccuugccuuucuccagagaugauuuugaggacuuugguauguaaagggcaagagugugcuggaggggaggcagggaggguaugguaaaacacauguugcaagggaaaaggagcagguagcggaauguuaauuauguauucgucucaugcucagccucaugcacuuuacauaagauaaagugaacauagaguagcuaccuguggagauauuuaaccuuuuaucuguagcuaucugcuuaggaauaggaggaaaggcucuugcaugacucagcuuucagguuaauuuuuuuccuuuuuggcauaauaaauugggguccgaguuuuuauuuucuuucacaaguuucuggcagagggaaggaaaaacuugggaaaggcacagaagagugcugcaugguuuacauuugugagaccuguugugaauuuggaauggcuggagugaaguauucaugggggagauguuuuaaaggaaugaaacuggagaagugcaggggccacgugagaagucugacauuccuggcuaauauucuuucuaccacaccaaacaacaauaauaucgaaggccucuggauauuuucaugggugagcuguuacagaugugucccgucagcacuugggaaucacccugauugcuggcagugacuugaguccuagaaccuuguugcucaguguggucucagaccagcagcuuguuagaaaugcagucucagaccccacccagacuugcugcaucagagucugcauuuuaacaggaucucuagaugauuugacugcacacuaaaguuugagaagcgcuguuguuagaauucaguuauccugcaggucaguguuucucagagugugguugcagggccgcuugccuuagaaucaccugaguacuugcuuaaaaugaggauuccuaggccacgcuuccacccagguccguguguuuuaauaaaguccccuuauaaaccacccaauggguucuucuugcccacugcccaaauggggccgauugaucaaggcaggggaauugcaagagagagaguuuuauacacauagugcugacuaaauggaagacuggagguuuauuauugcucaaaucagccucccagagaauuugggggcaaggguuuuuucaaagguugguuggggaaagguggggguggcaggcaaugggugcuugcugcugauuugugggggugcagucauacggguguggguaaugguccucuggugcgcugaguugcuucuggguugggccacucaggagcaguuggcagguccagguggaggccaucaguagucagauuugcaacaaaacuugaaaagauaccucaaaaggccaaucuuaggaucuaccacagugauguuaccugcaguaguaauggguaaguugcauaucuugugacuuccggaauaauggcugccaauugauuaugucuacaccuuagcagaauucaggcucguccaucugccuagccugguagccucucauuagcuuuacaaaggguugaguuuuggggaagggcuguuaucauuuauacuguaaacuaaaugucucccaaaguuagcuuugccuaagcccagaaacaguuaagggcaguuugaagguuaacgggaagaugaggguuagccagaucagauccuccccacugcuacaauuuucucaauguuauacauuuugcaaaagcaguuuuacccuggcaauuaugauuuacuccgaaguuugauuuacuccagaauccucuggagcauuguaucauuuuaaaaccuucuccaugugacugucaggagcagccaggguugagaaucacagcccuacaggauuugaggcagaggugucaaguguagaauuccagccaucaaguaggauuccaagaaguacagcaaagaagcuucuuuugagacacgauucagaagggucuagaaugcuuuuugcuacacucacucuguuguauucaucaguccaucuucccacuuuugcuaacuuuagggcauugguucucaagaaggauagggaggaagguuuccuccuauggaucucauuuggggcugauuuuagcccccagaagacauuugguaaucuggagacaguuuugauuguuagaacuagggaguggggugcuacugauagccaauguguagaagccagggaugcuguucagcaucuuacaagauacaggacacccccacaaugaggaauuacagaugacacccaaaauaucaguggugcccgggcacgguggcucaugccuauaaucccagcacuuugggaagccaaggcagguggaucacuugaggucaggaguuuccgaccagccuggccaauguggugaaaccucaucucuacuaaagauacaaaaauuagccuggugugguggcacacgccgguaaucccagcuacuugggaggcugaggcaggagaauugcuugaacccuggagguagagguugcagugagccgagaucacgcacugcacuccagccuggauaacagagugagacuccgucuuuaaaaaaaaaaaaaaaaaaaaaaaacaaaagaaaacaacaacaacaacgaaauauauauauauauauauauauauauauauauauauauacacacacacguaugucaguggugguguugagacauccucuucuaaucuaaucaccauuuuggagggguggggucauucuugaggugccauccuugagaaucucuacuaugauaagccucuauuuggggugggaagguaucauaucuuucaggugguguucuggggaaaagaaaaagcuugacagucauuguucuuggcagauauuuggacugaaaaaaccuguuuggugguaggcuguguuugcuaggauaaaaauaaaagguaagcaaaggaaacauaggucaugaaauaagaaagcagcuuuucucuuuauuuaggguauauacacgacguuuuugaguaaguccugauucgucuaauuaguuguuucuuguugggcuuagggugggcgaaagggucucuuuggaaggaauguguucauuagggguacguugaauauguacagaugucaaaacuauaugaggccauggcccaccucacacguggucggggcuggaugggaaaugcugggauggagggggaaggacucuggugcucagggcugggucacaacguauucaauggagaacauggagggauggaaugggacagauggggugguggcuuggccaccucacauguggucggggcugguuggaaaugcuagaauagagagggaaggaccuuggugcucagggcugggucaccacguauucaauggacaacauagaggaauagaacaggacagagcuuccuuugguccuucuugucucucuguggagaaacggggccaaaccagcagugacagcucugcucagccugccauguugccuugaacucugagagcaggacacgugaggaaaaggcacuguugcggacuaagggaugcccggcccagaugagcaagggaggggggaccaggucagcuguacuugauguuuccauucuacauggugggcuguaucaagaagucuggcccacugcacagaaaauucauucuagggccacugugcuggcuggaaugcaacagauuucuguggcaucucauucuuugcuugucaucauccaucccucuuccugucccacccauuggcuuguccaguggauccugcaaagcucaaaugagaaaccuucuuacugccucucccaucucuaccugggcuggguuagugcuccucugugcgccagacaccuuggaguuuccuguugguuccucccucucccugaugacacucggggaccagguuuuauugacuuuguaucugcagcacacaagcacuuaauaauuguuugaaugagagagaaauaaaauugcuucaagagagacagucugcucuuccuuuguguagugggaguuccugauaggaaaagaguuuuuccuggaggaucucgaugaccaagccaauagcuuauguaauuccuuucaugccagcugcuccaggcuuucugaaugcccuuuuguagauguggcauauccucagagauucuuaaguauugucauuuuuuuuuaaauagccagcggaaugcacagggaaauuucauuugccuuuaaugagguacugagagguacugaggauguagaguucuccucagcaaaggguuuaacccgaaguccaugguuacuguuuguuacucacagaucuaacuuagggcagggcauucucauuuuuuuugugcaccacuuauuccacagguccgcccagcuauggccuccuuuccagaacauacugguuuucagguggaguggcaaauuuucuuuuuccuucccuuucucuuucccuuuccuguucccuuucccuuuccuuuccucucucuccccuucccccuucccccccuucuccuucuccuucccuucccuucccuuccccuuccucuuccccuuccccuuccccuucccccuucccccuccuucuccuucuccuucuccuucccuucccuucccuuccccuuccccuuccucccucccucccucccucccucccucccucccuuccuuccuucccuuucugucugucugucuuucuugacuuaaagaaaaauaacugccagccaugguggcucacgccuguuaucucagcacuuugggaggcugaggagaguggauugcucaagcacaggagguugagaccagccugggcaacaugucaaaaccucaucucuacaaaaaaaaaaacaaaaaaaaaacuauauauguacaaaaauuagcccagcugagugcaguggcucacgccuguaaucccagcacuuugggaggccaaggcgcguggauuacuugaggucaggaguuugagaccagcuuggccaacauggugaaaccccgucuuuacuaaaauuagagaauuuagcugggcaugguggcacgcaccuguaauccuagcuacuugggaggcugaggcaggagaauggcuugaacccaggaggcagagguugcagugagccgagaucacgccacuguacgccagccugggugacagagcgagacucucucucaaaaauaaauaaauaaauaaauaaauaaauaaauaaauuagcaggugucguggcaugugcguguaguuccagguacucgggaggcugaggugagagagucaccuguucagagggaggccgcggcugcagugagcugagaucaugccacugcacuccagcuugggugccagcgagaccuucucucaaaaaauaaacgaaaauaaacuugcuuugaauucaaugaauacuugcuugguuuuuaugaaaauuuuacacuugaaaauaaauuucauagaugauuuuuaaaacuuccuauuguaaaaauaauuuaagccuauuuaugaaucaagagaauaaaaguacaaugacucuccaugcacaguggcuuuccaugucugaagguuccaauccacagauucaaccaaccucaggucaaaaauacucagaaaccaccucccccaaauaguaauacaacaauuaaaaauaauacaaauaaaauuauagcauaacaaguguaucaggcccuuuuuuuuuuuuuuuuuuuugagauggagucucacucugucacccaggcuggagugcaguccaugucggcucacugcaagcucugucucuuguguucaagcaauucuccugccucagccucccgaguagcugggauuacaggcgcccaccaccacgccuggcuaauuuuuauacauuuaguagagacagcguuucaccauguuggccaggcuggucucgagcuccugaccucaggugauccgccugccucggccuccuaaagugcuaggauuacaggcgugagcugccgcaccuggccacuauaucaggcacuuuugagcaucuguggauuauggaauccaagggguguccugggcccaaucccccauggauaccaaaggacaauggcuguaccucaacacccaccuuuaacaaugaccaacucauggcuaaucuuguuuuuuucuauauccccccacuucugucccccugaucauuuugaaguacaugucagacaucaucucauuucauuagagauuacauuuuaaaacugcugcuuauugucugggcaugguggcucaugccuguaaucccagcacuuuuggaggccaaggcaggcggaucaccugaggucaggaguuugagaccagccuggccaacguggcgaacccccgucucuacuaaaaauacaaaaauuagccaggugugguggugggggccuguaaucccagcuacuggggaggcugagacaggagaauugcuugaacccaggaggcggagguugcagugagccaagauccugcuccugcacuccagccugggugacagagugagacugcaucucaaaacaaacaaaaguaacaaaacugcugcuuauuaauguuuuaaagcugucuggauaugugaaucccaaauaucagagacagaucucagucaaauuagaaaguuuauuuugccaagguuaaggacgugccugugacacagucucuggaaguccugagacaugggcccaaggugguuggggguacaguuugcuuuuauacguuuuagagagacaugagacauuaaucaauauguguaagauguacguugguuggguccaguaauuugggacaacucaaagugggggcuuccagguuaggaguagauaagagacaaaagguugcauucuucugaguccuuugucagucuuccacuaaauauacaauuuagucuggcucagugaaucuguauuuuuacauaaacaauaggggagaggaagcaaucagauauacauuugucucaggugacccucagagggaugacuuugaauagaaugggaggcuggauugcccuaagcaguucccagcuugacuuuucccuuuagcuuagugauuugggggucccaagauuuauuuuucuuucacggaagagggaauuggggggaacuucccucuguugcugcuccucuaggcacuuguccuugggccagggaaugcucauugccugaguuuccugugggugacgcaaauaccaaggccauaaggggagucggugaugucaucucucucucuucugccuuucucucuuccuuauagaccagcagccuccaaccuccaaacccugacaaaacaaagcauguuuuuccagcagugcaaauuggacauuguuaucuuuuuacaugaagggaaaauuuguuuuccauuaucagcaggaucauccuucuuuucauggggacaugaaaagcauuuuauuuuuauuuuuuauugagguauuucauauaugcauguguauacagauauauaggcauauaugcacacgccuuaaauguauagcuggauggaauuuugcauaugugcauuuccacauggcccacacucagauugagauagauaacauuuccaguccccaagaaggugcuucuuuccagaaaauaccaccuccaccucuaccccugacagagauaaccacuguuuuaaugcugucacucuaguugcgccuguuuuugaacuucauguaaguggauucauucaguauaaauggacucuuugauuuggcaucuuucacuccaaauaaugacugugauacaaaaaaauuagccaggcguggcagugcauaccucuagucccagcuaccugggaggcugaggugggaggaucucuugagccugggagauggaggcugaagugagccuugaucacgccacugugcuccagccugggugacagaacaagaccuuaucuuaaaaaacaaaaacaaauaacgauugugaaauucauccauguuguaacaguagcuuguuuuucauugcaguguggucuuccagcguugcaguguaacguggcugugucaccuguuuaucccuucuaucauaccauagcagcuaguauuuauugaauguuuacucugugccaggaucuguuugaaggacuucaagcaaaguaguuuaauuuuuaaaguuaauuucugaguuagcuaugugguuauuaccucuuuauagucaggaaacuaaaacuuauagagauuagauaauuuucccccaaaucauacagcucacaugugauagagcuggaguuucaacccaguccgucagguucuagauugaugaacacuuuagugcuuccaggucuagauuuucugcuagacgcaugacaugcaacuugagcuuuuacaacaggcaugcaguuucugggugaugaucucuuuucuggaggaagacaugcagacacagagagcuuucagcacauagacaaggcugcucacccagggaggggaggaaacaggguuguuggaaaccuggaaaccuggguuucuggauucccuuucucuuauuuuuuucagcguuuucuugggugauggugaaagccuuuguguauuuucauucccagcagagcacaaugccuuaucacucuaugguucagcuaggacucuuguuugcaaacaacagaaacugacuaacauaagcccaaaaggaaacuguucaagaauauuguauagcucacagaaucaauaaggaggcuuggaauggggcccaggcacuaugggaggcauggcugcggagccagguccaugugugggaaccuuuggaagggugcugccucugucacagugaccccugucccguacugacacuucuccacauugcuccuggaccucugacccaguuaucacagucuuuaauaagcccugagucuucugcagccuucucuccaggugcagaagucagggcagagcaucugaacaacuaagugugggcagguaccuguguucgggcuacugguuggaaggaaccucuggccccuuuugucuuccacaauggggagaggacuugccuuuccaacugauuucuuucuuuuuuuuuuuuuuuuuuuugagauggaguuuugcucuuguugcccaggcuggagugcaauggcacgaucucgucucacugcaaccccugccucccggguucaagugauucuccugccucagccucccgaguaacugggauuauagacaugugccaccacgccuggcuaauuuuguauuuuuaguagagaugguguuucaccauguuggucaggcuggucucgaacuccugaccucaggugauccacucgccuuggccuccccaaagugcugggauuacaggagugagccacugagcuugaccccaacugacuucuuaucaccuuucccuguguuuaagcugauccacauacaguaaucauuguaaguagcuaaauaaaaguuuaauugcuugaacuagaucaggucaaaaaggaaguuucuccucauguuuccaguugauuaauguguuggugagugguggaccugcaagcaggagaggugguuaaaggcagagggcagcagccugggguguugucagcucgaguuuucuauuuagagaaagcaucugguugucugaaguggggaaaaaauuagcucaucuuuugucuucuaauaacacggucuauguuuuuugcagauggguaaugggaggguuuuuggcauuuccaauuggaaaaugucacuuaacuucaaaaggcuaccgucauggcuggagaaaugugauuagcaugcagcagacacaacaguguuucacugguuuccucuuguacugaacuggaguuaauugcuuguuuauggaaggcuugcuggagauuuuccuuguguuaacugcaauuuuagauuauucuucuaccuugacuauccauucauuuauuaauugauccuguguuuacugaauauaucaggaauagaaugauuaauagagcaaauaagcccugaccucaugaggcuuacagucuaauaaguuugaauuggguuaguucuuaaaauauggauuauuuuauauuccccucucauuacuacuuuuaaaucuuaacccccuugguggggaauuaauacucccucuucccuguguuaaucauuuugucuuuuccuucugaaauuuuuauucucuuuccucuuauccuuuucaaaaacaggaaaagauaugaaugcugaacacuucccauuuucauauucacugcuuguguauaucaccuauugauuucaucucauauaaaauugcauuuauauaugcuggcugaaugaagaauuuuuaaaacaaugguagcucguggauugucuuuuuggucaaugagaugguuuugaagaguucagauucugaaagagaagggacuauguuuaauugcugcaacuccagccagaguguugccuggggugugggguaauaagaaagaaugaaauagauuauuuauugaccucaaggacaggguguagcagagaugggcuggaugcacgggaaacuccuaucuucuuccugggcacagcuaaacuucauuucuuagcuugucugcaucaugguggggucuugugauuucauuaucacugaagacaugugagugcgaguguugcguugccuccaggccaaagcagugaagagucggugugccuucucaucacucucuucccuacagcguccuucugcuuguggacguagugagaucagagaaccuaugugagaauuucuuuggaaugugugcccuauagcagaauggcuggauuacauguuauagguuauacauauguacuuacuuugacuuauaccaguugccacucacaguaguggccccagugugagcauucaucagcaguguaggaagauuucucuguccccauugauacuuggcauuuuccagugucuuagucuauuugugcugguauaacaggauaccacagacuggauaauuuauaaugagcagaaacuuguuggcucacaguucuggaggcugggaaguccaaugucaaggugccagcagguuuuggugucuggugauggccuggucucugcucucaagaugguauuucaaauacugcauccuguggaggggaggauggcuguucuucauagggcagaaggacaaaagagccaagagagagaccugcccaaccccaaaagcucuuguguugaggcauuaagcccacucaugauagugaagcccucuaaucaccucuucaaggcuccacaucccaauaccauuacauugacaauuaaaugucagcaugaguuuuggaggagacaaacauucaaaucauaagauccagauuuuguuguuucuugucagucuguaguugugaaaaacugaacaccaauugaguaccaaaaggugguuaaaaaaauugaaauauuggcugggcuugguggcacaugccuauaaucccagcacuuugggaggccaagguggauaaaucgcuugagcacaggcauuuaagaccagccugggcaacauggcgaaaccuuauuucuauuaaaaaaugcaaaaaaaaaaaaggcuuacaggcuuacaccuguagucccaacucccugagagguugaggugggaggaucaccugagucuuggagguugaggcugcagugagcaaugauggugccacugaacuccagccugggcaacaaagugagaccgugcguaucucaaaaaaaaaaaaaaaaguuuuauuugauauaugcacauccuuuaaaaagucaaauauaggguguugaggaggugggggguaauuaacugcuuaauagguacagaguuuccuuuuggggaugaugaaauguuuuggaacuagauaaagacgaugguuuuacaacauugugacuguaguaaaugccacugaauuggucacuuuaaaaugguuaauuuuauauuaugugaauuucaccacaaaaaagucaaauacugauaaacauaacaguaugacaccucacgccuucucacuuuccagaggcaacaauuucaaauauuuuaacauuuucuucugauauuuaccacuguguuucuagaugaugugugucucuugaugucuguagaugaauguauuuuaaauaacauuugucaacuuacuguuauuguuagcuuugugacacuucucuguuccuccuccauccucccacuagaguuaugucccaguuuucuggcuaaacuaauauucagucuuaauauuuuuaugacuauguaaauauuguucgcuaaugagccaaagacauauuggaauuuucauaugcaaccuuccccuagaguuagugauugucuuauuuuucuuuauuugcauagcucuuuuguagcguuuaccgagucuucccucucuccaauuccucagcauguuuuccaugugccggauccaucggaugaucugacccuccuguuccucaccaccguccucuaucccuggagcacuuugccucugcuccagguuguagcagugacaugcccuacauggugucacugugggacuuucuuucucacaucugucugugggauggaugacuagcauuaagcauauuaagcauacugucucgacuauagaacaaggguuggcauuugagcugggccagggcaaccucuuugauaaacaaccacacaacuauuuaaaaacuguucucuccauuuuuugguggaguacaaccuccagcagcuuccugauuuuagacuugacuuuauuguacuuucauaccuuguuguuauuucgauacaguucagaauucuagauugagaauucuuuuuagucaguguuuuuaagauacugcuguguuauauuugagcuuccaggguugcugugagaugucugauguuauucuuauuccucuucuuuucuuugagccuucuuuuuucuugcuggaagccuuaaggaucuucuccuugucccauuagucugaaauuuugcaaugacauguaugggucuguauuuucuuaugcuggggaauuacuggguucuuucaaccuggggagucaucuccaguucuaggauauuaucuuguauauuucuuugauuguuuccauaccuucaguuucuuuuccugaauuuccucuuguauuggaccuauggauuguucuguaaguuacuuuccuuucuuauucuuucuuuugcccccuuuccuuccuuuccuuuccuccuuucuucuuuccuuaccuaccucucuccucacuccucccucucuccuuuccucuccuucugccccuucuccaacuuccauccccuucugccgcccuuucccccuuccccugcccuuuccccuucccccuuccccugcccuccccugcucuccucugcccuccccugcucuccucugcucuccccugcucuccucugcucuccccugcucuccucugcucuccccugcucuccucugcucuccccugcucuccucugcucuccccugcucuccucugcucuccccugcucuccucugcccuccccuccucucuucugcccuccccugcucuccucugcccuccccugcucuccucugcccuccccuccccuccucuccccucuccccucuccuucucucuuuucucuuuuuccucuuccccuuccauuucucuuuguuuuuuguuucuacuuucuguaguacauuaaaacauuuuuugucauugcauuuuaaauuucucagaguuuuuauuugguugcauuuuaaaguuaugugcuuuuucacuuuugguuauuauuuccagucuuugaggauguuauaguugacuuuuuuccuauuucaaaagguaaaaaccacucugaguuugugagucauacaaaaauggucugcaguggacccaguuugggucuugagcuauaguuagaagacgauguuccagacaccugcuggagagaagccuggcugggguggagccugugcguuucaccaucccagguguggauuuuuacuuagucacuuuacuucuauuucuccuccucaguuuuacaugccuucguuguacaugguacacgcagcugcagagccucaaugguccauuuucucccaagauuuagucuccugcaggguuugagaaggaacagaugucuggacuauaugggguggguggacacaggggucugacugcucuuccuguguguuuucauccaauccuccguuacugguccucaucccacuccugucacccuugaugccuggagcccccaguuacuaagccuuuccaggguucugcagugcuaauugcguguuuuuucaugguacccugugcagaaacagaggccucacuuuacuucaucugucaagcuccaucccuccauccucuuuccaucuuuauuuauugcaacuugggaagauugauuuggguuuuguagaagauggaguuggguuuuuucuucuaauuuucuuuguggguuuuuuuuuuuuuuuuuuuuggugguagugaacaguaaagagaguagaaagggccuuuuucugcucugugaagcuuugaaucaaguucaagcuuuugucagccugaauuaaauuauuuuuugaauuugaaucgggagauugggaucucccucacuccagauguauagcuacaguggauuugugauacugacuuccucaacuuuccuccucuccaacuccccauccuuccucuuuuucugccaccccccacccucugacaccuuuaaauaacugacuguucuauauuuucaacuuacuaguugauggacagccuacucacuacucagcauuucagcuuggauguuucguaugcaucucaaacuaagcagagccaaaauuaaaauucucgguguccauuccucuccccacaaucccacuccucauucuucccuuucuugguagguaccaucacuguauuagcguaauguugucgcacugcuacagagaaauacaagauauacaagaggcuuaauuggcuuacaauuucacaagcuuuacaggaagcacgaugcuggcaucugcuuggcuucuaggcagaccucaggaaacuuacagucauggcagaaggugaagggggaagaggcacaucacucaugacaagagcaagagaucaaggugggaggugccacacacuuuuaaacaacuagaucuugcgagcacucacucaguaucaugagcacagcaccaaagaggugguucuaaaccauucaugagaaauccacccccaugacccagucacuucccuccaggcccaccuccaaacuggggauuacaauucaacacgagauuugguggggacacagauccaaaccauaucaaucaccaauaugaaagcucccuuaggagcaucagccaggcacaccagguucuuccuuugcugaagccuuugugugguuuccuacuguguuuaggaugagucgaugccuucccauggccugcacugcccugcacagugcagcuucugcuucccucucaagccuuaucuucugcagcucuagccuuugccuacuacuaccaguccugcuuuucuacucaaucugucaguuuucuuccagcucagggcguuugcacgugcuguucccucugccugaggggcuuggcccgaguuuuaugaaggcuggcuccuccuuucuccuccugcaacuccaaguucagaugccacaguccuagaguugccuuuccugaugacccuguagaaaguguugccuccccaccucagcccuagugcauccauagauaaauuuugccuccauaguacuucuaacuugcuguaauucaacauggauauuugaccaguuugucccugucacugguauugugguaacagacuugugcaacuggaucccugcuguauuuucagcauccagucuuguaccagcacauaguagacuuuuuuuuuuuuuuuuuuuuuuugagaaggagucuuguuccguugcccaggcuggagugcaguggcgugaucucagcucccugcagccucugccuccuggguucaaacgauucuccugccucagccuccugaguagcugggacuacaggcgcaugccaccaugcccagcuaauuuuuguauuuuuaguagagaugggguuucaccauguuggccaggauggucucgaucucuugaccucgugauccgccugccuuggccucccaaagugcugggauuacaggcauaagccacugcggccagccuuugacuuucuuucuuucuuucuuuauuuugagauggagucuugcucugucgccaggcuggagugcaauggugugauaucaggucacugcaaccuccgccucccggguucaagugguucuccugccucagccuccugaguagcugggacuacagaugcccgccaccacgcccagcuaauuuuuguauuuuuaguagacacgggguuucaccauguuggccuccaucucuugaccucgugauccuccugucucggccucccaaaguccugggcuuacaggugugagccaccgcacccggccuaaacauuuuaauaaguaguaauugaauccaagaaugaacacugggaagcuuagagcugaaagugacuucaguggacauaucugcaguuguuucuggagcacuggggauuguagcacauuuaaaucauuaauucaacaccauuguugugcuucuacucaaucuuuagacccugggcuaccaaaacauacaaaacagacagaagucucugccuucagagaccuuacagucuaguggugaaaguucuagcaguggggaggagggcauggacacagugggguuucugcuggucuggcaaccuuuauucuuuuacuuggucacugacauggauaccucugaaggucggcugacuuuuuugcuuucucacuuugcuucugccccaacccagagugcuggaagcacaccuguggcuccccuugcucccaucuccucuuaagugugcaccacaaguccugauuugauagucaaacucaucuauaaagcaguugagcauucucccuccagccuggcuccagcaugcccuugauacaauggaagcucaccuguggccuguucugucuggcuucuagcccacccagccccuuaacgccugcuucaaccccuuuauucagcugcauucuccuuugcuaacucaauguggcauaugcucuaacuuuggaauauuccaccauaauuuuuugaaagcuagcuuaguuuauuccucaaaggccuaaaauaauacuugucacauaagacauucuuuguggcauuucuuuggggugaguucaaacaacaguguaugugugugugcaugcaugcauacgcacacauauguacacacauguguucuccuucccccaaauaaauauuaaauauauucuucugguuuuccuguauuuguacauuucuauacuuagcagaguguuagggcccagugcaaguuuaauuuugcucugcugugccauccaaauagcaaagggcaauauggaaccugcaaauugcaaaauuuuggaagguuauucuaacauuacauuugaauugcuuaauuuaauuuucacuuugaaucaguugcuaagcaacugggaaggcagggcaaaaucagcaaggcuaauuucguucuguuacuaguauguuagcaucucuuauauuuacacagacaguugguuguaaauacacuuaaugcaaugcaauacucuguuucgcccaaggaaaauaguugauguggaaguuggagcaaggcuuugguuggauugauguuauuuaaauacacccucucaccuuaggggaauguaaaguuaucggaaguuuugagcuugugauguagccccuuuguuaggugacgugcuugacuugcugguacugugaacaguuguaaaaugcuuuccauugucuguuauccuuuggcaucaugaauccacccugagugucccccacaucuaccuaaaucaguuuuuugggaaugcauaccacuuagugucaucauaugaagcaugcuggagagaaaaggucauuuuacucucuauagcuuacuauuggugaaaacugacauuguuaaccccauuugguccauaaaguaagucaugugucaaauguuaaugccagugacuuaaauaucuugaauauuuuaaaaagucauguggucauuaaggaagccauucuggcccaacccaguuucccgaauuagauuaagauuaaacaguaaggugcagugucucacgccuguaaucccagcacuuugggaggccaagguggguggaucacuugaggucaggaguucgagaccagccuggccaacauggugaaaccccaucucuacuaaaaauacaaaaauuagcugggcaugguggugagcaccuguaauuccagccaccuugggaggcuaaggcagaagaaucacuugaacccgggaggcagagguuacagugagccgagaucgugccacugcacuccagccugggcaacagagccaggcucugucuccaaaaaaaaaaaaaaaaaaaaaaagauuaaacuauaaugcaguauucuguuauuuguuguuuauuauaguuuuauauuaucauuaacaccuugaaacacauagaugcuuugggauaauguucaggccugugucaaagaugggauaguuaauguaaacuacugucuccuggucauguaugguuauucauggagugaauggagaauucacauauauuaauauuaagcugguaggaaaacugcugcucuggauguaaugucauuaaauugccacuaauauagcaaaugaccaugaccugugucuuuccuaagagguggggagagcagauuggucuuuuaaacuggucuccugcuuuaucuuuuguuuuccaaaguccuagagaguaucuuucauaugcaguagaaauuauucaguagauggauuagauucuugauaaagauagcuaucauggucccauauuuaccuuauaacugccugugacuagguagaaauauuuagugaugaaggagauuacagaaacuggaaaaauaccuauucuacaauuaagugaucuuuuuuuuuuuuuuuucugaacagucucagguauuuguguaugcaguacauaguaacaguuaauuauggaucaugacuagaagaaagagugaucugaauuagaggaaagaccuaguguuuauguacuugacugcaaauccauuuuucuuauuuugagauauuuauuugacuaggacaauagcuagguauuuaccuguucaaggcacuuuaagggaaucgguuuuaaugaauagguaagaauaaauguacaguuaguaacuuccuuaaaugcuuguccagaccuacuuucagggugucauuuuucugaauaucaguauccacuucaaguucguuaauuuuuuauuuuuauuuuuuugagacagagucuggcucugucgcccaggcuggagugcaguggugugaucucggcucacugcaagcucugccucccggguucacaccauuuuccugccucagccucccgaguagcugggacuacaggcgcccgccaccacgcccggcuaauuuuuuguauuuuuuaguagaggcgggguuucaccauguuagccaggauggucucgaucuccugaccucaugauccaccugccuuggccucccaaagugcugggauuacaggcgugagccaccgcaucuggcccaaguucauuaauuuuacucuucagauauuuacuauuugaaaacucaguaugucaaaauguaaacuuuucauggggagugucaauuuuaaauauugguuuccuagaguaguuauugguuuguugaugacauaucccugucagaaaaaucuggugaagcccaaauauuagcuacuugagaagcugaggcaggaggauggcuucaguccaggaguuccaggcuguagugugcuaugauugucugugaauagccauugcacuccagccugggcaacauagcaagucccuaucucuuuaaaaaaaaaauugguggcuauacccuaaacuuucuguguguguguguguguguguguguauuuuuaaaaguuacaaacguguauuauuguaguaacacauuguaggcaauauaaaacaaguggaaaguagaagguaauaacucagauuaagauuaaacaauaauguacccuguuauuuaugaugguuucauauuaucauuaauaccuuaaaacacauagaugcuuuaggguaauguucaucauuaaaaacaauauuuuaagugguuuuaguuaugauuuuuaaugucuggauggcuuuuuccagaucugauuagaucaucauucuuuuugcuuuacaagagcucuaagggaaggguugguucugccuuuuuugguuugcuggguugcauuacuauuaccuuugauguuuugauuuuucugcagaaaucuuuugaagccacuuguccauuuuaugaauguugguuauaccacauaagacaauguauaaaguuguauaaaccgaggcaugcuaaauggaagcacaucgcagugcacugagagugaggggacaagggcacagacuaucuaaaugccaguuuauauauuuucuuucugugucccagaaggucaucuugcacacaguacucaagagaccacugcccuaggagagcccuccaaauaagcaucuuauuuauguauuuauuuuugagacagaaucuuguucugccgcccaaacuggagugcgguggugugaucuuggcucacugcaaccucugcuucccaguuucaagcgauucuugugccucagccacuggaguagcugggauuacaggcgcguaccacuauaccuggcuaauuuuuuguauuuuuuaguagagacgggguuucaccuuguugaccaggcuggucucaaacuccugaccucaagugauccaccugccucagccucccaaagugcuaggauuacaggcaugagccaccgugccgggccuguaauauuuuuucuaaauugaauaguacugaagagaguuggauuuguauaaaaaaaaaaauacuuguaugcauuguuguauacagcaaggacuauuuguccuuguauuuauuuguucauuguaaaggaaaugagauaacuaugggguagcauuaacaacguggcaaaacccaucccuacuaaaauauaaaaaauuagccaggcuugguggcaugugccuguagucccagcuacucaggaggcugaagcaggagagucacuggaacccaggaggcggaggucgcagugagccgagguugugccacugcacuccagucugggugacagagggagacucagucuuaaaaacaaaaacaaaaaagcaaaacaaacaaaaaaaacacaaaacacugaauuuguacagcucugcuaccaagugguucuguagaacaaucgacucacuuucuuuaagccuugguuuccucggcggugguggcaauuaaauucaaaaagagauuugucaaagagcuuuguacucucauuuuauaucuauguaugauguaauuuuauguaauuuuuuaaguggaaagccuuuuuuuuuuccuuaggcugagucucuauacacccucaauggcaauuucuguuuguuugcuucacuucuagacugccucuuuaagcuaugucccaugaaccgcuacucugcccaaaagcaguucuggaaagccgcuaagccuggggccaacagcaccacagacgcagugcuacucaacaaacugcacguacguauugccauggggcugucgauggggcaguagugaguggcugccuuggugguaucuggguguaauggugggagacugcuuaugcaacccuccaauucuagcagccagcuuucuacuuuuuuuuucgugaagggguagaagggaaccgaccguagagagggauagauccuagucaucuugagaugucuggagaguucuucuuuucucagccacucucuuugcauggguagcuuuggauggagaagugguuaugaguacaggcacuggaagcaaacugccuggaauggaauccugccuccaccacucagcaacuggugcucuugggcacguuaugugcuguuuuccacuucuguuaugucaccuguaaaauggaaauggcaguacccaccucaggaggucauugugaggauuacagaaaaugagacauaaaagccacaugaauggugccuggcacauaauaaaugcuugauaaguuuuggcuguuagcauuguaucuguuguguuaucuggcauauuaaagaugugcucauuccacugcugacgugcugugugaccauagcaaguuuuugagccucucucauccuguuucaccuucuguaaaauaaugacauaguucuuuuagugcccugcauuccgaggcuaaucaggaaguucucugagauguuuaaaaggagacaugacguauagccaguguacuaacaucgaaauugugccccauuuccuguucccugagcuacuucauuuucuccccgucauguaacaucaucuuucuaauguauuuugguuacuggcugccucccuccucuggcaugugaguuucuugagggcccaggucugugucaguguugcuuguugcagugggcuuugugucuacaacaagguugggcacuuaccaggcacucccaucaaauauuucacggaaugcacagugaucuuuccuggggcucagugaugacaguugaagaccuagagcaucugugagccccaagcaccucaagagguccugccucucaccuugcuccauuuuugaccagcguauggcuaagucacagccagcugcauuuggucaggugagggucacgugaagggaguccuacaugcaguguguguuguuucagacgggcugugaugaaaagcccaggcuccucaccucagggagcuuacaguccagcaugaggacaccuaagcucacucccauugaaccuaaagugaaauccagacuuucugucaucaucuacaagaugguccaugccuggacccugcugcccccacagaggcuucuuaacuacauucuggccguaugagcuuuauuuuauuuuauuuuauuuuauauuuuauuuuauuuuuugagcaccucagacucucaacugucacaugaccuuugcacccucaguuuguccuguugagaacauuguuuuccuggcucuucuugagcuaggacuuugagccuuugugucucagccgaagugucaucucagcaaggucuuccccucccaccuuaucuaagagaugucuugcuuguuuuucuccaugauagcacccugcuuauaucuuucucagcacugaucagggucugcaauuauauuuaguagcuucguuaauuaucaccugucgcuuauuagaaugacagcucuaccaggugguggcauuaucucucuugcucacugcuguaucccagcuucuguaauagugucuggcacauaguaggugcucggaaauaauuacugaauaaugaaugagcagugugcuaggugcuagagauagaaguauaacagucuuaacccugugggagcugaauaucaaagaauaaagaggcagugauaaguacuauauuacaggacaaaccacacaaagcugugggagcacauaggaagggugccaaaucggucuuugcuggauaagagggugugauacaguggucagggagggcuuccuggaggaagaaggaagugccgaguaagccucagucggaggcacccaugggauuuagaggguagaagaagaagaaacaauggacucaaagacuuggaggcuagugauugcuuugaagacuucuggaauugcaucguuauuugaauaaugaugauuauaucagacauccucaaucccaacaaaagcauuguaccuucuuuagagcaaauauuauauggcuuuaugaacauggaauaaaauucauaaauaauagauaccaauuuuaaaaaauuauaaaggagaaauaaaaggaaaguaauaaauuauauaguaaauugaauacucuucuuaagucaaugcucagggaugacugcucuggaaggcgugaggaaguaagugcuugcaccucucuguauaaaccccaugagugaggcagcuguagacugugacugguguagguauaugguauuggcagugugaaaagcauguuaucugugacgugguuuucuaaaagggcuucaagcauaaucacaaaagacauaaucucaagugccauaaucccaaauguugaaaucccuaaaaauucaguuccaaaagucuaaaucccuaaaguguaaaauccugaaaaucacagucguaggauauagcugcauguuaggccagcucuuguggacugucucuguucaaaugcccauaaucuauuccugcaauacacuuuuucuuauaucagauuuuuaaaguuuuuuuuuuacuauuuuaaauuguccgcauuauuauuauuauuauuauuauuauuauuauuauuauuuuuaaggcagagucucacucuguugcccaggguggagugcaguggcgccaucucggccuacugcaaccuccgccucccgggcucaagcgauuuuucugccucagccucccaaguagauggaauuacaggcaugcaccaccacgcccuacuaauuuuuuuguaguuuuaguagaggcagcauuucaccauguuggccaggcuggucucgaacuccugaccucaagugauccacugccucggccucccaaagugcugggauuauaggggugagccaccgugcucagcccugucagcauuauuuuuuacaauucacuaugcuauguguuuaaucuucgcaucauuuucaauauuggagauuuaaaugguguggcgacuaacauuaaagaguucugauucauuuuaugcauucuuuugcaaguuuaacuucaugaaagugcauuguuacaacuugacgugaauaugugaaaacaugggaacuuccccugcaaauaaagggauguucuuccucgaugaaugaagagauguuuguguuugugaaagauaaaauuacuugagcucucagcucuuugggcgacugcauauccaguggugacccucugugguuuugaucgaucuugugaaaagacucagguugcuggucaugguauuucagaugacugcaguaugagcuuggugcacacaaucaccaaccauagugauacacgauuuuacauuucccuuuuugaccuauuucuuuaugguuaaucugcgcauaaucccugugaccauuguuaguauaccugaguauuuaugcuugcaaaaauauguauguuacuauuccccauuuuauuguauaaaauggccugugaaguguucuguuguguuuuuauauguuucucaaauccucuuuuaaaaauaucaaucucuuuuaaagaauuuuaaaauuauuuuuuccggaauuauauuuuggggauuuuggucuuuuuugaccuuuggggauuuuaacauuugggauuauggcauucaggauuguugugccuuuugggauuaugaucguaucuuuuuccaaaauaaucagcaguucuuaauuauauuaugaauaaugcaaaguacacucuuuucuuucuuaaguaguacuugcacguuuggaaaauuuauuaauaguauuaauaaaaccauggaaagcugugauuucuguugauauguaaaauggaguggggugcuagguucagguaauuacagauacccccaggcuggaaugcagugaugccaucauggcucacugcagccuugacaaccugagcucaaacgauccuccugccuuagccucccagagugcuaggauuauaggcauggacuacugcgcccagccgacagauaacuuuuuaacuuaugugaauauccagcuggacauacaauuguaugggauaaaugaugguucauccuugcauaggauuguaacaugcguucacuuuacccagcaucccuagcuccuguccacugaacaucaguagcacccucuuccagucacugcagcaauccauaaucuccucaaagucugugcugggaacaugggaaucuaguugaauagguggggaagguuggucaguccugcauguauguauauuuagugcauaugcccauagggggcuaucuuucuggagggucuaugugucuuuaguuguccucacuuugcuuuucugguauaaagaucauuuuguucagugagaucuuauuaauacaucuccaacucuuuccucuccuauacuuuuuaccacagggguuguaaauucagauuccucuuggccauacgggaaaucaacaggaauaaagugggcuugguggguaguguugccaaguggagagucccaugggugggucuggaggggcagcucuacuucccuacugucacugcuugggaaugugggcugagagcugcugccacgucuuccacuuuuuaagagaagauaaaaauccaugcuuuuaguguaguaucucaauuuuaaaaagauguugggaacuaauucaauuaaggcuugaaauauacacucaacaccaaaagaaauggcucaggcuggaugugguucuucagccccauuugcaaccugugcucuauauguuauguuucaucagcaaguccuuucgacacuccuuccuaugaaugaacugugaagaaaacagcaugguugaaaaaaguucaaucauaaggugaucaaaaauggucaacuccuuauuaaaaagaaaaaagagaaaaacagaaaucucucucaugcuguuuauguuuuuaaaaaauaaaaaaggaagccaguucuuuucccugauuuaagauuacugaugugacuuucaggucuuuuuuuuuuuuuuuuuuuuuuuuuuuugagauggggucuugcucuauugccaggcuggaguguaguggcacgaucucagcucacugcaaccuccaccucccggguucaagcgauuucccugccuuagcguccugaguagcugggacuucaggggugcgucaccacgcccggcuaauuguuuguauuuaguagagacgagguuucaccauuuuggccaggauggucucgaucuccugaacucaugauccaccugccuuggccugccaaagugcugacauuacaggcaugagccacugggcccggccucaggucuugaauguugacuuugugcuucacuuucugcaguuccuacuuuccuacuuagcuggaacuuuucccccuagugucuuaaaguuaucuacauauuucauucaauuuacauucccaccagccaauacgauguuguauuuuggacagccacuuugccuuuggaacugauggccagucuccaguggguuuucauuuuuauuuuucucaacuacuaugcagcaccccaaucagaagucagacuauuuuaaauuaaugccauuuaaggaauuaguugucuagaccacuugacuuccuuuugacuaggaugagcaacaucaacagcacuuugaaggagagugacaucuaguggcuggauacugucuaugcuuuuuccuucugcaggaauaacuggauuuugacucucuuggucauguuuuccuaagggucucuugacaaaaugagcuucuucccauccgcaaaucacauaaauuucuucuaaaggccauuacuacuguuuucugacagcagcauagcuguuaccuugaaacaagcaccuacauuguuuuguucugagaaaugauuacuuaagucacagcuuugaccagcuaggaagagcuagaggagugacagguccuuauugucuggguacuacauugcuuguuuuuagaagccuugcuucaauaucgcauuacaugauucagagcuuguugacuuuaacaaaauaaccuuuccuuacuguuucagucaccuuucuauugucauucgauaauaguuucucuguugcugaaauaaaauaacagguggcuaugauggggcagaccuugauguugcuuagggaacauggugaauaauagugguggaaccauuucauagaguguuuuuuuuccccuuagaaauuaaaaacagcccgcaacccauuauucaagggaaaagaguaauagauauuuaaauuaucaggauuuuaaaguaaugaaaagguaacacauuuaagaugccuuuuucuuuuuuuuuugagacagucucaccacucuaucacccacgcuggugugcagugacauguucccggcucacugcagccucagccuccugagcuuaagugauccucccaccucccugcccaguagcugggaccacaggcacacaccaccaugccuggcuaauuuuuguauuuuuugaagaguugggguuuugccacauugcccaggcuggucuugaacuccugagcugaagcaauccacccaccucggccucccaaagugccaggauuacagacaugagccauggcaugacuuuaaaaaauucagaguaccugacacagagacaugaugaagguguuuuugaagaaacuacacacuuguauuuuaggaggaguauuccaaaaucugugaguaggaaaagcaaaaaaauauuaauugaugugauucguaaauuguguuccucaaagauaaccuuggguuuuauuuugauguuuucccuacucuccuacccccuauucuguuccugugucuccacauuuuaaaguaucaacaggagugugcuauucacuucccuuucuuguugcccaggcuggaguacaguggugcgaucuuggcucacugcaaccuccaccuccuggguucaagugauucuccugccucagcuuccugaguagcugggauuacaggcaugcaccaccacaccuggcuaauuuuuggggguauuuuuaguagaaacgggguuuggccauguuggccaggcugguguugaaccccugacuucaggugaucugcccgccucagccuuccaaagugcuaggauuacaggcgugagccaccguaccuggccucuauccucauuuuuaauggcuacacgguuacuuccuuguuuggcaguacugucauuuuagauaagcagccucuaugggcagacguuagguagggagugauauucaggaucuugacaacauuugccauucugaaaaaaguuguauggccuugugcauaugccagguuguccucuuaggagaaacuccuagaaguggaauuguuaagucaauguuauguugagugaaaaguuuuuuggucaauauugccugaguauccuuuagaaaggugcuaacucaguaaagguacuaauucaauaucuuucuuuuuuugugguggggacggagucucacucugucgcccaggcugcagugcaguggcacgaucucggcucacugcaagcuccaccucccggguccaccccuuucuccugccucagccucccgaguagcugggacuacaggugcccgccaccacgcccggcuaauuuuuuguauuuuuuuuuuaguagagacgggguuucccuguguuagccaggauggucucgaucuccugaccuugugaucugcccgccucggccucccaaagugcugggauuacaggcaugagccacugcgcccagccaaaaggugcuaacucaguaucucacagugagggcccauucuuggaauguacuugagggauuuaaccaaccagaucucauucuuucugaggguagaaacagccuugaucaguggccuguaguguuuguaccuuguuaccuuuucaucuaccuuauugccuugccuccuguugaaccuaaaaagaaucauggauaguuuugucuaaauaccagacuuggguuuguuuguuuuuuuguuuguuugcuugcuuuuuuuuuuugaggcuggaaugcaauggcaugaucucagcucacugcaaccucugccuccuggguucaagugauucuccugccucagccucccgagcagcugggauuagaggcauucgccaccaugcccagcuaauuuuguauuuuuaguagagaugggguuucuccauguuggucaggcuggucucgaacucccgaccucacgugauccgcccaaagugcugggauuacaggcaugagccaccgcgccuagcccagacuugguuuugugaggggauuuauauaaaaacuaacaugugaacugaaaugaauuaaauuugauauuugugcauuuagaaaagaaaugggaaguuuucuccuuaaugagaacuuauaggaaaagugaauucuuaaaaugguccauaagcuuaauacauuuagugcuaauucaguggugaugugaaggcucaggcaucauuaaacuuuauaacagaauuaaaauaguauuaacucuuaguuuaacagaguuuugacaaaguuuuagaugugauauuugagaaugucuuauuuaucuguuuuugagauggagucucugucacccaggcuagagugcagugguacuaucucagcucuuugcaaccuccgcuucccggguuccagugauucuccugccucagccucccaaguagcugggacuacaggcgcccgccaccaugcccagcuaauuuuuguauuuuuaguagagacagcguuucaccauguuugccagacuggucucaaacuccugaccucaggugauccgccugccucggccucccagagugcugggauuacaggcaugagccaccacuccuggccaagaguaucuuucuuuuaagagaagucuuuagauauuuauucuccaauguuguuuuaauuuucuguucuucucuugccuuucauaugucuuuugacaaaugacuaugcucuuuagagcugcucguguuuaauuagucuuuaauguggaauaugccuucuugaugguuaauuugacauuucuuucuagaugaaccaguaaccauugcguugcuguuguuauacuguacuuauucuaagcauagguagaaacauaauauuagcauuucuuaaacugaagccauuggacauucuugagaguaaggggaaugcucaugagcaguuuuucucuuaaagaugagcucuuugaucauuugaguccaagaaaugcuacuuaagaacucucuaaaggugaauccuuucagcuugggcuuugaacagagaaaaaccauauuugcauguuggaaaauguuauauuuuauuuuacugaauccauugaguuuuuucccuuugauauuuucccccucuugaguuugcagucaguguuagcugagaacucuuaagcagaaagaacaaauggcucuccgcaaagaauaagccuucauuccaaauggaugcaguccaauguuauguuuggaagacuaccugcagaaccuguggguacuguagaaaucucugaagggaguguaagcucaggugugaaauuagggagaacaagaggugggaggcugcuaaggagaguauuuaugcagaggaaagaaaagguucaggaggacugugcugagggcaacuugcaugccaaagauugccacguugcaagcacugguauuauuucugaaugugucuugcacccaguggauuuuauccuugugucacugagaauagcagacugguaacuaauuccaaaagagagagagggaaguuuugaaugggcuguuguuuuaaagagcugauacagauggggucaacuugcagugaucuaugcuaaccuguguggaucauuccccuccuguaauaugguuucauuuuggcuuagaauugcuucuggcaguucauuuuucucaaaagaugugcuuuccuaaaaacaccuguguuccagguagaaauggaacagaugcugacuuugaaggaaacagaaagguucuugaccuagccaacuuaggucaccuuuugaaauguuaaucagcagaacauuucuuaguguuagaaaguagcguauaauaauaaugguuaaaauuuaugaucaaauggcaauuaugugucuggcauacauuuucucugaucucuacgauggcccuaaaaggcuuguauuguccccauuuugugaugagaauacugagugaggcuuggugggauucaguaaagaggacaagauaaugaagccgguagguaggcgacccaagaccacguccagaagacucugugaaaaugaagacacauuaccugggaaagaggacccacuggcaccugguagcaucuggccccaaggaaaggagacccucuaggaagagugccuucgaaacccuucugaagaacacucuuaucaucaggguuuuaccauccaucagauucaauacugaauuucuucucaguuauuuuacuucccuuucaccagucuauguuugggagauggguugggauaacaguuugcugacugccugggaugaagcccguugcccuuuaccauuauuguagugugguaacagugcuuucagaguugcacaggugaaugaauucgggaagguggcccugccagacuauucuagaaccuucuauucagcuuuaccauguucccccccuagcaugucacauuuggaaugguaaccucucccagucucauuugugacuauacaguuaauccaaauguggauuugaauacuaucucugcgacuuaauaaaugcaugguuuaaaaaacauuauuaagcgaagauuuaaauguacacagaaguggagaaaggguauaacaaaucccuuuccuacccaucaucuaacuagcuaugcaagggugaccaaauuuuuuaaucacuuugagucaauuucuucuuuaaaagugggauaauaauguucuuuucacggaaugauuauaaaauugauuacauuaugauuaaugucuaacaagaauagcuaauaacuccaugugugcuacaguguaucagguaccgugcaguggaguucaugugaggugcagguaccaucugauccuuauuuuacaaaggaggagacccaggcucacugauauuaaauaacacauucaaguucacaaaaccacaaaccacccaaauccagcauuuaaauucaaucuucuuuuacuccaaagccuuaaagaggacuuucacagauuauaaaggggcuaugcaaauucccucccuccccgacccuauuuucuuugaagauauuucagcuuuugacuuacucucacccuaagcaaauacccaugaauuccuuaaagaaagaaaaaaaagcauuuuaaagaaggcaaaaaggccagccaagcaaaggcggaguggaugggcuguuugaaccccuuggcucauuucuugaagccucaggguguguccucagggauuugcguauuucggugguucuuguaugaacuggcgacauuuguucugcgucacugcagugggauagaacacaugguuuccucuuugugaucaaucuuucuucucaaugcacagcacgcugcagacuuggaaaagaagcagaaugagacagaaaacaggaaauugcuggggaccguaauccaguauggcaaugugauccagguaggucaaggcagcucuucccuucugaagcugaagcguuacaaagaaugcagcugaggaaacaaacaccuaagacaggguuuggacaccuuuacagcaggacuccauggaggcagccaguuuauugcaaaaagucuaguguuucuuguuagaugugauagacucuuugggcuauucugcuggucaucucucagcgugagcaucuacuucucucugucuguggcugaucauuucacuccagacacuucaaaugggaagcuuccuacuugaaaaggaaccuggcuguggcaguucuguuuaauuuguaaugcuugaaaauucuuccuacuucggugaaaauuagcuucccuauaacuuuuaucuacuggccuaaaacagcugcucccaggagguaauaagagcaauucuguaccuuugggacuuuuuaaauaaaaaauauuuaucauuuugauacauuuuauacuuaucaaaaauauuugauuguuuucaugucuacucucauggguugcuuauccuuugugccuuuaaauuugccguggagauaaaacacaauccaggaaaagcuaaacagguuuugcucagaagaucucucuggguccaugccagucuugcaggaagcccagggccacauguggcuuucuugauuuguccaggcacaaagaguaguaguuaccaacuauugagcaccuagacccauuuggugaucuuccuucauuauuuuccuuuuugaaagauuuugccugcuauguaaaccuuacuaauuacauaggaguccuuccccuuucucuugcuauuagguauagagcagggcuaaucaggaagaugggaacacuaguaaaagauuaguaaaagcaaccuuugggguuuaaauggguucuuuacauuaggccuuuugaaauagugaaaguagcuuccaaaaucugcuugaagauuagauccugccagucccacucaugcacuuccuccuccuuaaguuccauccucuucagaauggacacagguguccaggugggcuucaaguucaaugucagcuuuauuacuaggccaggccagugcccugaaauucagaguacaggacuuccugauuugguuagauuggagaauauggcuugaaaugaagaugaaaggugcagaggcuaaggacauaaacuuuuaaaugcauuccgguuuagguuuuguaccucacugugagauuuggggcaagaaaucuugccauguaucacuuugcucaccagcaaaauggaaaugguaauggcaucugcucuuuaggaugguugagaggugccugucccagaauaagcaguggauacaccauaauuaaucuuaguuauuauuacuucccccagcccuggaucuuggggccuaccuguagguaacuuucguuuauaaacaaacugagucuggcaccuagacagaugugugcaggaccagagguuacucaccaggggaacaguugagggguugggaagacguugccuucuccuuauuuauuuuagcuaggggucaucggggcuuauggaucagacagguuauucuucuaccuccaacugcgcuguucggggauuuggaggaccuccuaacaguucuagcagcuguaucuguuacaugugaaaaggaggauaaucgcaauuagcaauggagucuuuugcugguuguaccauuucucaagggauugggcagucuuucguauucccuuccgcuuucucuuauagccuguugaguugggaagccuuggccaacucuuucuggucuagacugacuaucagacacguuauauccccucuaggucuucagucuuuccauauuccucauguaauuauuaccccaaagucaagaauaaaguacuuggaaauucaagccauuuuuuccaaaugaaaugacaauccccuaaagggguugcauuuuauuuuauuuaauuuuuugagagacagcgucuugcucugucacccaagcuggaguacaguggugugauuucggcucacuguagccugcaacuccugggcucaggugauccucccaccucaaccuccugaguagcagggacuccagguguguacccccacacuugguuaauuuuaaauauuuuguagagacaagaucucccugugucgcccaggcuugucucaaacuccugggcucaagcaguccuucugccucugccucccgaagugcugggauuacagacaugagccacuucgccuggcccugcguuguuuuuuaaacuguugccugugcucagaguggccuuccucagcuccaccuuugugucagggcaugccacacugcaguuccuuagcccguucacauagggcuagguccaccccacugacggauggcagguuaugauggcacaguugaccugagcaacauccaucuuguccaaggcuuugcugaaaaauaaaacaugauaguuuuucuuguauucugcccucucuuucugcucccuuuucuguucuuccuuuucuaaucaucugcagccguaggcacuuugugauucucuggcuucaccagcagcucaauggugggaggaauguuugcuacauaguugguaugauugagagaaggaaugguagaaaauucagauuugcugacacucacuuuauucucuugguggguuuuuagcuccugcauuugaaaaguaauaaauaccuaacagugaauaagaggcuuccugcucuguuggagaagaaugccaugagagucacauuggacgaggcuggaaaugaaggguccugguuuuauauucagccauucuacaagcugcgauccauuggagacagcguaagugcggauucuccaccuagaaagucuuccgugccaugcuuccaagcaugacuguauauuagaguuaaggaggagacguugaaaguuggaaccagaggcuuguccuguguaaagagaagggaauugcuauggaaacuaguguuugggaaacagggaacuguggagagaagugugaccuaaauacugucacuguguuuuuccuccuggaugucugaaaacauuguaugaacagcccauugcguuaggaacuuuaccacaaaaacagcuauuccguguuaauguccuggagagggucccugucauuccagauccauuaguggaauagaaauaucuuuucuauuuuggaaauaaaguucauaaaggauagaggauggaaaagaaacaaccguaguaaagaaggagaguagaauuugggaucagccucauuuguugcugugucgagaagccggcaggcuccccgucguguucagcaaugcaguaggucuggagcagggcccacuccugaggguuccacaguauauaaagccacaggaaggcuuuucagggagacuuagagcaguccugauauuuguuggcugaauuagucagccauuacgugggcauauacuucacagugacugugguuaaauucuaucagcuguauuuuugaccuuguuaacgauucuaaaguagcugcuuuuuauugaaaaauaugccgcaaacagcaugaaauagucucaaaaugcucaaccagccuuaacuuuaaaacugguuuugacacuuuuuaauagugccauuuaaauuuacaagcuuugggaaguuuaaauauguuuguguauuuguguguauaagauagggaauguaccagaaacaucuaguaccagaccauucccucauaguugguaaauaauugauccuuaacagugaacagaaagaaaagcccaguaaaacuuagguuucaccaaaaguguuggauuuauugaaugaacuuauauucauuuggaguuagagaaaauucaauuguauaugcuccucaaaugugauaagcuugaaaauagaugguuuuucauguuaggaaaccaucuuuucuaaccaaaaauaaaagacaagugugccuuguucugaauuucauuuucagcacauccuuugguuuccuauccuuuaaacgaaucuguguguggccauggcuuaguugagaagaugagauggacuugaauuuaaaauaauauuuuacaaagaauagguguagacccauuugugggccaugaaaucaguuuaguggcuugugacuauccuuuuugaaagugggauagaacagaaagaucagacuguguuacaucacauaaugauaaguauuguuuuuuugggggggggguaacuuuuguuuuaguuacauauauauauaguauuauaauuauagaaacaugcguauaagucuccauggcuguauauaugacuugaucauagaccauguauuuccgaauguuauaguaaaaauaugaaaguaauuguuuuagaaacauaaaguuauggcuuugucaaagauaaagacuuacucugacucuaucuuguuuuuucuuaaauuuaguuaaaacuuacuuauauagguaccuuaaacugaacaguuuuuuuuuuuuuuccugcucugaacuggcuuugaaacaucucuguauaaucagugacacucgaggaacaacauucaggcuuagccuuguaaacaugacccccucugcacagggucagguuuuaaagaaggcguggugugugcuacaucuuuauacuugcuggggauaggccuugccuucuucagcacagacucauaugucuucuagaacugcccaguggucaauccgcaguccuuaucaguuuugugcaaagcucuauugcuccuuuccauuccagguggucauaggugacaaggugguucugaaccccgucaaugcuggucagccccuacaugcuagcagccaucaacugguagauaacccaggcugcaaugagguaaggacauugaguuaugugugugggugugguuauccugcaggagcgggucuggcaggcgccagugcaugcgugugcugagagugacuucagcagugacuuggggcagggugcccauucugcaggugaagaaacaggcccagggucaaggcugccguguaagguugugcaacugugugcaguggguaguagaugugggcugauacucacucuagugcucaguuugugaagccuugcgucacugagggguuguuuuuucauuggugaagccagagaugaacccuuuuacuaauuuuuuucuggccauaggagcaccuuuuucuaauuugucuccauauacagggugccucuuuuuaacuguucaaaaaggaacacugcagcuuaucagcagcccugcaagagugauagcuugcuuuuggcaauacaucuacuucuccucuaaauuagcaauuauaggaugcaaggauguuacuuccuugugacauaaauauuugucugauggguaaagacauaaacucuucagugggauagauguggguucacauccugucugccuuuccaagcucugugacggcagguugguuacccggucucccugcauaucaguuuccuuaucucugaaaugggggcggcggucggaccuauuuuucaggguguugccaagaauuaaaggagauugugcguguuagcaccuaaaccuagugccuggcacagauuuagugcacaaacaauggcugcuguuguuaacaaugaucauuaacauuuucgaguguauacacuggacucauuuuuuuucccuuuauggcucaucccauuuuauaaguacuuauuuucaucaggccuuuacuuucuggcuacagaacaagagacuuggaggaaaaugaaaauaucauuccagaaaggcaggaggcuugguuccauuagucaugguuggaaugugcauagugauuggugcaaaugaaccauuuauuuccaaacucugccagcaggccaguugauuuugcaggugcugugauuuuaguggcgucaaucuuuagaguuuuuagucucaaguacagccuugcuuccuaggcugcggugagaagucugggggcuggaugacacaguuguugugagggguacgugaaaaaauaacucgaaucuguguuucaggucaauuccgucaacugcaauacaagcuggaaaauaguccuuuucaugaaauggagugauaacaaagacgacauauuaaagggggugaguuugaugcuuuaugggcugagcauuacuuggcucuucuugggggcagcagucuaauucucuuuuuaaauucuuuuuuccuuaauucuuucuuguguugacugucagggugacguggugaggcuguuucaugcugagcaggagaaguuucucaccugugacgaacacaggaagaagcagcacgucuuccugagaaccacgggccggcagucggccacaucugccaccaguucaaaagcccugugggagguggagguaaggguaggguggagaaagggcuccuggguuuagaggauaucagccuguauauaggcucucucucucucuauccuacaaauauucauacauacauauaccuauaugugucuauacacccacauacacacaccuacacacacacacagaauacauguguguguauauauauaagucacaaacaaguacuuauacccaccuuauuccaaaaauggguuggggauggcauagugaaguaagugcaucauggcauaucauggugcugcauauuugugcagaaggaaagaauaaguacuuuggaaacaaauucaaaaacgaaauuagaaauagcuuucucugagccaucuaaucccuucuauuguuuucuuucccuugcucauuuaucuaucacaacaauauuuaaccaggugucuaccugacacaauacauaggugaugcccacauuggugauggggcagaaaugagaagauauacacccagauaacuggaacacacaaggggauggugaaggugguaagaggcauauuccacaugcucuggagguuucagugagagagggugaaugucugggugggugaagaauuaaggaagacuuccugaaggagauagcaucugaucugguaccugcaggaugauuuguauuucagaaggaagagaugaauggaguagguuacuucauguaagagaauggugcagaauguggaaacgugaagcagcgugggauaaaacucaguaacuuguuuggugaagggcacgggauaggcaugggaaauuaaacagaacuguuuuuggagaccagaggcugaagggccauauauccaggcuauagggaguugggauuuaauuuaugggcaggggagaaauuuggaaaguuguuugaggaagggaauaacauaaucagugugcaacuuaaagaagcuagaagauucugcccacagcauguaauuuguuguaaggagagucuagaauugcaggacaaagaaggaaauguucugaaugcuuggugaaagaggcaaugagagcuucaacuaacauggagcucuuucuucaccucaagccuuccuuucuguguaauugcagcaugaauuagaauucuaauucaaauuucuaauuugaauagauaaauuuuucugucucugcuugcguucucuuuuccuccucccuagcuucaauuguuucauguugcuacugaggucuagccuauguauaguauaguaaagugcccaagucaagaguauacaacucaaugaauuuuuacguauacguucagccauguaaccagcaccuagaacaagaaauagaaugauagcagcacccagaaggucccuugagccucucuuucuaggcaauguuuccuuuuuccuccuggagacuucuauugccuguucuugaacuuuguauaaauggagucauacaguauacagucuuuauguucuguuuuuuuuucacucaguauaauuauuuugagauucguauauauucuugcauguaucagauuaauuuguuccuuuauauuacugcauaauacuccaucauauggauacaccacaauuugcuaaucuauucaccugcugauggacauuugaguuguucccaacuucuggcuauuucaaauaaagcuucuagggauauuuguacacaaguuucuguauggauguaacuuuucuucauuucucugaauuaaauaccuagcaguggauuggcuggaucauaugguagccaugguaugguaugguauggcaugguaugguauggcaugguauauauucaacuuuauaagaaauugcuaaacuguucuccaaagugauuggaccauuuuacauucccacaaguaaugugugagaguucuaguucuuccauauccuuaccaacacuugguauagucagucuuuucaauguuacucguucuaguagguacauagugaaauuucaauguggguuggauuugcauccccuguuugauuuaguagguguguagugaaauuucauuguggguuugguuaacgauguugagcauuuuucucaugugcuuauuuggcaucuguguagcuucucuggugaaauguuuguucagauaguuugcccauuuaaaaaaauugucuuaccacucuuuuaacauggauguuguaagaaucaaguucagccggacaugguggcucaugccuguaaucccagcacuuugggaggccaagguggguggaucaccugaggucgggaguuugaaaccagccugaccaacauggagaaacccugucucuacuaaaaaauacaaaauuagccaagcgugguggcacaugccuguaaucccagcuacucgggaggcugaggcaggagaaucacuugaauccaggaggcggagguugugguaagccgagagugcaccauugcacuccagccugggcaacaagagugaaacucugucucaaaaaaaaaaaggaucaaguucaucuugggcauuguauagaaaaguuuccacaguuaugauaaaaaggaaucuauauaaaguuuuuguuaauucccacccucuauccauuuuccccuuucuuccuccucucuacaugcauuugcccuuuaguuacucuaugugucuacacagggaccugucaauccuacuagauuauaaacuccuugagagacgucagaaugaaauaucaguugucagauucuuuuaacaauuaugucuucagaguuuuugcuuuaacaucuauaaaaagguucauuuucucauuuuaagcuaauuaaauacgcuggguaaaacagaucacucauuugccuaugaccuuuuagaaaaauuguuuuggccaggugcgauggcucaugccuguaaucccagcacuuugggaggccgaggugggcgguucacugaaggucaggaauucaagaccaaccuggucaacauggugaaacccugucucuacuaaaaauacaaaaauuagccaggcaugauggcacaugucuauaaucccagcuacucgggaggcugaggcacgagaaucacuugaacccgggaggcggagguugcagugagccaagauugcaccacugcuuuccagcuugggugacagagcgagacccugucuccgaaaagaaaaguuguuuuguuacaauacuguacauaugcuuacucuaaauuugcauugacugugcuuuaguguauuuguaaauggugaacucaguuucugaaauaaaacuuguuguuugcaaaagaaaaaccugcaaaaaacaaaauugcuugagaggcagaauuuggucuugaacuuugucauugaagauugaugccccaugguccccaccacagaguuuuuuacauucagaacagucucucagaaccacuucucauguguaauuuggauacugguacaaaaaaaaauggagacuuucucaucuuucagaguuaguuuaaaguaauaaugcaaacuaaggaaacauagaaaaucaagaaaacaagggaagaagugaaguguuguuucacugauuuaaugugccuacuuccauugagcuguuuuucuaugaacaggauauuuuugcauaguugauaccauuuuauaaacaauuuuccaccuuguucuccugaauuucauaggaagacguugaauaguucuuucucucauuuuuuaaaauggauucuggaaagucaagugccccucaaaauaaaagagggaagacaacaccauguauuuuauauuuguaguaaugagccaggguuuacauuauaugucuguagcuuauugaucacccccaaacaaauacuaugcucauuagcagucauucccuauuuccccuucaauauccucccauucuccugcgcuugguagcuaaucuacuuccuaucucuguagauuugccagugcugaauguuucauauaaacagaauccuaucauauaugguccuucauaucugacuucuuucaccuaggaugaugucugaguccaaaucaggcugcuguuauaaaauaucauaaacuggguugcuuauaaauaucagaaauguauuucuuacaguucuggaggcuggaaaucuaagaucaaggcacuggcagauucagugucuggugagggcacucuuccugguucaucugcuguguccucacauggcagaaagagaggggacuuucuggggucuguuuuauaagggcaguguucuuauucaucaagacucggccucaugaccuaaucaccucccaaaggugaaguauaacguaaacgaucuccuaauacuauaaccuuaugggguagguuucaaccuaugaauaaugagaggacacacacauuuagaccauaccagauaacauguugaaaguguauucauauugccacauguaucaguacuucauuucuuuuuauugccaaguaauauuccauuguauggauguaucauauuuuauuuacccauuuaucauuuaauagcauuuggauuguuuucacauuuuggcuccugugaauaagucaucugcugcuaugaacauucauaugcaacuuuuuauguggauauauguucucaagguucuugggagcagacuucugggucauguaggaauucuauuuuugaccuucugaggaacugccagaaugccuuccacagugaguggcugcaccauuuuuuauucucaccagcagugugucagcgucccaguucuccauguggccuucauuuugaaggacuuuuuguuggauauagaauucuagguagauaguuuuuuacuuuaaagauuuugauccauugucuuuuggcuugcaucauuugugauuauucgauggguuaaaaaaauguuccuuguauauagugucucugccaugcauccuaccccaaccucagcugcuguaaagauuuuucuuuuuuauuucuaguuuacauuaaucugauuaugauaugccuuagugugugugugugugugugugugugugugugugugugugcgcgcgucugucugugucuguguguuuaccuugcuggaguucauugaguuucuugaaucuauggguaugugucaaaugggaaaacuuugagucauuauguuuaugauucaaauauuucuccugcccugaccaacccacgcagacaugugcugggucauuugauauugucugacagguccugcguucaugggucacguuuuucugauucuuugucuaguccuuuauuuacugaacauuguaauacaaguuuguugaguauguggagucuguuguucuuuaaagaguacugaauuuucuuuuguuguacacuaaagugaccuguggaucccuuugcuccuuugaaggcuuauuuucaagcuuuauucagccagguguuguguagaguuaauuuuggggcuagguuaacuccccuuccaagaugggaccccuuugaugugucuacuaacgcacaggguguuccacaugaucccucagcuuuggcuuuccagaaucaggacuccucccagcccugugugcgcucugggaaaguucagcuuucagacaccuuguuuuucuucauuuggcuucauagggucuugccuuaugcauaugcagucugauguucagcccaaaacucaagggagccuccugugcagacuuccagagcuuuuucuguguguaguucuguaugcauuaguaccccauccccacaaauucuagcugccucagucucccuaaacuuugaucugucuccuuaacuccaugagcuucaugcccuuagcuuggauucuuccucccuaugcugccauccagagaggacccucagguagaaaaucaaagcaauagccaagcuggccuuguuuguuucccuauucucagagaucaccauuguguaccaccaguuguccaacaugugaacacaguuguuugggauauuuuauccaguuuucuaguugucuauggcaauuucaucuauucucugcagugucuaauuguuuauggcaccaacuaccacugcuaguuaacucugucauggccagaagcugaugugacauuuauuuuucugauacauuggccccggcucugaguuucacauuucagagcacaggccugcguguguguucuagcacaugaguacaugcguagauugcuuugacaguucuccacgaaaguccuuuuuauuggcugugcuuuugguagguaaauuucagaaucugcuacuucauuauggcuaaggcaaauaaccugaaaaccacugaaguuuuuauuccaaccauuguauguuaacuaggagacucgaugccuucuuuggagagacacugcuuacuuuucaguuuggaugcuacacgugacacuggcaauggguuuguugaagaugcugauuuucuuuuucuagcuuauaaacaucccuccugaacuaugacuugugauaccuccgauuuaaugucuuccuaguguagguugacauuucauugacuccuguugaucauucuugcaggugguccagcaugacccaugucggggcggagcaggguauuggaacagccuuuuccguuucaagcaucuggccacggggcauuacuuggcagcagagguaaguagcagcuccugugguuuucucuuucaaggcugacgcaccucaccgccuuuccucauucgccuguagccgucguguuguaaaaggcuuagggaaauacacucagucaccuugcuuuuccuccuguuuuucuguuuccuucugauucauuuuccuagaagacucaaaaaugauuaccacauuuugguaggugacagggaugcugaucaagauguggggagaaaguaaguuagaagaucaugccgaucuagguuuucgguauuauuuuccauuucgcuuuuauauacgacccuccccacgucuugucuaccagccccacaccuagcaugagcgacugaggcugcagcagaaacaugauauguggaaccggaagcacuaagacguauaaggaauuagauaaucuuauaaagaaauuuggcuacucagagcauuaguggaauagacaguggcuuaucuuuuacuuguaggaaugucaaaaaucacggaaauuaacuuuaccuuaaaugucugugaaggggccaggcacaguggcucacaccuauaaucccagcacuuugggaggcugaggaguucaauaucagccuggccaaaauggugaaaccccgucucuacaaaaauuagccaggugugguggugcacgccuguagucccagcuacuugggagggugaagcaggagaaucgcuugaacacgggaggcagagguugcagugacccgagaucgcaccacugcaguccagcuugggugacagaaugagacucugucucaaaaaaaaugucugugaagaguuuuugaggagacgaaagacucaaugcugaaggacaggaggaauuuaccuuuuaauuuuuguaucaaaugaagcagccauccuacugugugacaugucgagcuuuacucugaucugcugggagauguaugaugcauauuucuaucagauucuagucgugcaucaaaagacccccacuguugucugggaccacccaugagacuacugagagauuuccaaggugauggugggugucagcacugcuccugugccugacccgaggaaggcuggcucuuaagugugcucagccccccacggugccuaauacaugaagugaugauuuugauauauuuaagaacugaagaucaagaacuccaaguucaaauuugagauaaagccauagggaauuacagacccagcuaaucagcugugagagaugauuuaugugguuuccugaagacuaauggugguggcauuaucugucauguuuugaagcuaauguagcucuugcuggaggccuacauuuuuuauuuuuagcuaaaaauaggauuaucagugacuguguauugaucuuuuauucaucucaggcuuuuaacuauugcuuugccagugaauucauugucuuccucugucuauacuugagagccgucucuuggugacugguggauguuccaugugugcuguacccaugugaccuguaucauugucguggcaugcugguuuugugaacagagggaauggacaaguucuuagcuguucaaggauguuugcaggccuugaagucuccugcaaguggggcccaguccuuaagaaagcaauggauguuuuaauuuccuaaugauucuuuuucaucagguagacccugacuuugaggaagaaugccuggaguuucagcccucaguaaguauggacaagagccuucuugucuucaucugguagggugcggccaaaugaucuggagcuccauuuaagaaacugucacuguggucacggagugcuggggaaggaggaaccuuaggcucccuuaaaacacgaucauguucugugcuucccuugagagggaccauaguccuuugugucucgauugguccagggacuguuguugaugaugguauuuccauguguaguaacggggucuccauuucuaaguuggagaaguucaugguaucacuuggaagacuccuaggguuggagacagugacaccucauauggaagauggucuuuucaaaccaauugccuuauugcuguugaccucaauccaugacucacacagcuuuuucagggaguaaguaugugagguggauaguguuacugaggcuauggagguaacacaugaggcuuagugcaccuggcgugugauuagauacucagcuaauccguccuugauuucugcaaggucagaaauaggcuuuaguguauaggaugguuuagaauuuuaagugcaaaauggcucuuucucuggagaccauaucgccaaguaaugcugauacguagacacuuuggacuucagguguccacauuuauggguugaagaaggcagcgguuguguuacauggaaaggguggguauaaguaagacaguuuucuuguggagugcuugauucuggucuaggauugaaacaguugcuccugugucugacaugugugucuacacgaugaucucagcagugggcauggaaggugguauugaggguguuucuuucuuuuuuuggcaagauuuugaaaaagaaauggagggauuuucuuaaggcacuuuaaugaagggaauugggugaagggaauucaaauuguaauuguccuuggaaaguguugugaauucugcuguuaugguuauccuucuaguuaugucuuggugaaauguuggcuuugaaagacacucugacugaggccuuccugcuguggguuuguggauuugcuggggagccucuccucccuuuugugcuccuuacugggguacccgaggcucaccuuccuuuuuuucauccuugucaccccuauuucuagaguccauuuugaaagcuuugcuuccacaguuaauauggcuuggaaaacccugacccaguuuaacccucugucagugcaugaggaacucugugguaaaacuucucugcaucauguucauguuguuauuguuugaacacuuggacugggagggacgucauguuucacaggaugguucuuguccuugcaccuucuuuauuucaagagaaggagcugccucuguguggccaacaucugguggucuccaugcugccgucuguggugacauggaggaaaucuuaccucugagauuaggcaagcuguggauccuuucggugagcgcugauguccaagugaacuuugugcucuggcggguagagggcugcucuccuggccuccugguacaggagggaagacuggcauuuauggugcaggaggaagagugcaguuuaaauaccagaccuaccauuuaugagcugcugugugaccuuggacaaguuacuugcccucucugagccucaauuccuucaucuauacaaguggcauuuuucagguucucccagaucauuagcauuuuuagugccuuugcguccaccagguugucugggcugcacagcaguguauaaaaggaguuaggguggguuuuaggaucuuccugguacagaggaggaagcagccguugagagugguccagacucaucccccaucucaggcucccucagaguucaguggucuuuugacguuuucgugcuuuuuggcgucagagaggcggaugugccagcagccuugggugcagaucuagacugcaucacucuggcuacuucgauguugauugggggugggcugcuugcagaggaggggugcauggagaggggaucuuacccgacgcccacacggccaacagcacagaucugcccgguggcaagguguuaguacugggaggaccccaccccccucauacucuucuugguuuggaaacuuggauggaaaaccucgaauuuuuuugaguugauugguuucccuaagaacagcuucagugccugugguuuuugccucggaccucacuuggcuuuguugugcucguccuucuaaauucagcacccugaagacacuugcuuggugccagagggagaaaaaggaccaccagaggcucccgcuccucugccaggcuucugcacaugugccuuucuuuccacuagguggcaagcgccgacugcacaaugaaaggaugucaggacgcugccucucagucacuuuuccagacacaguggacguaaugcaauugugauuuuccucucaacucccacaggucucugaaacuuaacugccagccuguagcugaguccugugucucaaaccauagccaggucagaguuuauuuugaaaguggcauguggaguaauaugccagaugguucggagagaacaaauguugcucaaaguucuuacuccuaaacugcaguuguagaaguguucugucacuguccagguaauucuuccuuuagcguagauagaauaaagggucugggguuugugcaaguaaagggaugagcaauuagaggagaaauugugagaaagggaagagauacagguuuuggauauuaaaagaaccuuuuuuaaaaaaacacacauagagguugggggccgcagcugaacuaacaggcuauugcccugugcuccugcauuucaggccccguaagaguuagauucucccaggcucucuccuuugccuuugauuugauuuccguuucuugauucuuuuguuuuccuggugaagucuccuuccucucugucuggaaagggggcagagcuucagccuaagaaaagcaggcuguagugacaaagaaaaugugcuuccucaauagaugcagguggaggcugucauccugcaaggauguuagacauggaaaaucacgcgauguagaguugccgggcugagcgcgagcuggccagucucuucugagcagacuccuugucuaagcccccuccuugaauaucuguaggcagaugggcuuuggagccuagaauaugcuuuuuuaguuucucaggaaaguuuucaucauuguuccucagccuucgcuaucagagauuuucuucgcucucagccaaaucccugaugucucaggagaggcccgucuucccugaccugucaucagcagcccucucaauuaaugcuggacaucuuuuucagggcuacgcugacuucucaaauauuucuuuuggcugcguugggguugcugcuuacgaacacuuggauucagguuuauuuuguuuuaguuuuucuccugggaaguugcuauaucauauugugaguagacaauuaucacuguagaugaauccagcugcccacaaccaaaucugcaggaugaguuuccucaacauccccucuccccuagcuccugcggauggauguaccuagaguuuuuuuuuuguuuuuuuuuuuuaaucaucuggagcacuccuuccacggucaucucuuaguguaacugcacguuuuugaaagauuuuuuuuuuuuuuuugagacagagucucacucugucgucuaggcugaaaugcgguggcgcgaucucagcucacugcaacuucugccgcccagguucaagugauucuucuguuucagcuucccaaguagcugggauuacaggcgccugccaccacgcccagcuaauuuuuguauuuuuaguauugacgggguuuauauuggucaggcuggucuugaacucccgaacugaggugaucugccugccuuggcccucccaaagugcugggauuacagguuugagccacugcagccagccugggcuaauuuuuuguaucuuuaguagagacgggguuucauuaucuuggccaggcuggucuugaacuccagaccucgugauccaccugccuuggccuccccaagugcugggauuacaggugugagccaccgugcccggcuggaacauuuuuauugcaacacaaagagguagagcguaaauaucccuggcugcauggccaguugucaucuuuuaggacugcucuguaacugugguccuuuuccugccaacugcugacauucacgauccuuucuucuccguuccuguggauuguggaauaauuguagaaagugaaggcuuuggcaugcaugguucuugauuuggugacuuuaccuccucagguggacccugaucaggacgccucucgaaguagguugcggaaugcccaagaaaagaugguauacucccuggucucugugccugaaggcaaugacaucuccuccauuuucgagcuagaucccaccacucugcguggaggugacagccuugucccaagguaucauuuuaaaauugcuuuuccccaaagaaucaggccugguguagguggccugaccagguuucuuggaauccaaaucguuacugccuuuucuuuuagauuuuuauaaaggauuuggugaaagguuugcacugacugcccgguauggcaacugauuuuuuuaauggcucaccauugauaaguucucaguaguugaaugagaagugcuauauuuagguaaacaagccaaaccauaagcccaaguagcucaauuuuccuaguucccucuacucccuuccuccuuccccaaaccuugggagagcucuugguuuggggaaaaaggaagggaguagaggaaacuaggaaauugaauggaaauagaauaaaccauugaaaagaaauucuacaagauaaaauaccugaaguucacuguuugcauaguaaauuuuauuaacaaguauugagacauucaaccagaaaucuuuaguuauuuuuuuaaauuuaacuuuaguuuuguugcuuaagaaugcauuuuucaggggacauaacuggacuauaaauagggaaacaagcuuacucuuaacaacagaaucaacaauauuaauaauaauggcugacacuuauugagcgcugacugcaugcuagacacaaagcuaaguacucuacuuguguuauauaauuucaucuuucucaaaaaacccagugagagauagguauugcuaucacccuuucuuguagaugaagaagcugaggcucagagaguuuaagcaacauaucauaagucagugagucccguagcagaacccaaaaucuuaaauguuuaagacacauaggguuauuugggccauucugacucuccaauaccauguugguuaauggaaaugucacugucauuuauggauuacacguauggccccucgugaaguauuaguuguguuucauccauucagagguagcuacugguaacauuuuuguuuauguaguuuuagacaagucucuggucacacagagaugacugugucauuuauuauagaugggaucauaagcuauuuuaaacauuuuuaacugaauaguauguuuuauacauaucuccaagcgaaugaauaucaguugucauugucuuaaauaauuguuguaaucaggccgggcgcagugccucacaccuguaauccgagcacuuugggaggcugaagcagacagaucacuugauugaguccagguguuugagaccagcuggacaacaugacaaaaccccgacucuacaaaaaaaaugcaaaaauuuaaccgggcaugguggcacacaccuguagucccagcuacuuugaaggcugaggugggaguauccuaagccugggaggcagagguugcagugagcccagauugugccaacuguacuccagccugggugacagagugagacccugucuccaaaggaaaaaaaaaaaagaaacuguuauagucaauuguaaucaucuuuaaauaacaguaguaucaacuaguuaauauuguauuaacugguucauuauuggacuguucuguuauacuguauuaauacaauauauuaauauagguauucauauguaauauguuaauauuacauuguaacaauagaauauaauaaauuuguauucuauuaacuaguccauuauugagauaucagauuguuuacaguuuuuauuguuacacauaaugcuuuguugaacaucuguuugccucauuugcaccuguacuaucaccacugaaggaagaauaccuaaaaauaggauugguagaugaaauuauagauauauuuuauguguucuacaaggugcuagacuucuuuucagaguuuugcuugauuacgcucucaccaaccauacauaggacuuacuucccuaagcucuuguugagacuggguuuuagaucuuuggaauaugauacaauaaaaugauauuguuuuaacuuguguaacuuuuauacuaaggagguugaaucuauacuuccauguuucuuuguauuucauuauuaaauuacccguuuguguccuugucccauuuucacuuccaauauucauauuuuucuuauugauuuguaacagcccuuuguguguagaguaauaaccuuuuaaugcaaugggcuacucuuuuauuuucccaggcuauggugauuuuuuuucaacuuuguuuaugaugguucuuuuuuuuuucuauauagauuauauaaaauuuaaacuauguaaugagaguuauccgucuuuuacuuuuaaaauuuaggaaucuuauauuuuguuauaugauucaaaaggcuuucccuacugcaagauuaguaaauacucauuuuuuuccagaaauuuuaugaucucauuuauuguuucacugaucccuaugaaaauuucaaucauugcuguauuauuauuucuuguuauaagcacuaauauauacccguaaauacuuccuguugcucugucucaugcucuguuuaugcugagacacucauucauggaguaugaucuuauauuuagaaguauaauauauaacaguaacuguagagucguuaugaaugauuuucuauuguaaaugcaucagaauguggcuuggaccuggaccauuugccccuucguguauacugcccaguguaugcaguaggaaaccacuuugcuauuucuauuuugauagauuauauucuagacuaggggcuauagaguaaaccucaauauuuauuucccuaaaacccuccuuuuuucccuguuaggaacucuuauguucggcucagacaccuauguacuaauaccuggguucacagcacaaauauuccuauugacaaggaagaagaaaagcccgugaugcugaaaguaaguccugggacuugccugucuccuuuuggucucguguuuccuaaugaaagggcuccuuugaggacagaucagggaguauggagcguggagauuuguugcuuuggcgagaguguggucauggccgaacuugaaugugacaaaagaauacucuccacgagaccugaguggagcaaacccagggcuuuugaaauaacuacaacuuuuuaauuuuauuccauggcuucugccauaaugguugagcaauuuucuggauuucaacugcauuucaugacugucugaaggauaauuugggcuggggaauguuugcuuuugucuugagguacaucaaguaucuaguugauuucccccaaucucuauuauuuguuucucucuauaugucaauauacacuuuuauuucaugaauguucucuccagccccuuuacuuucucucccuacuucuccuucccccugucuccagggucauacaguauaaguaaauagacauggggguuuucuuuuaacaaguggaaggaugcucucauguaacuuuucuuuuguuguggcauuggggaagguuauugaaauuuuuuacuucuuuacugaacauuuuuagauuuauagaaaaguugaaauaauggugcagugucuauccuuauaaugcuccucacuuagaaucauuaauuaccauuuuccauauuugcuuuuucucuguauauuuacaaacaucuucuuuaguuaugagaauuuuggaugcucccuguaacaaaugaaguuaaaaaugauauuaaugccuccuuccugccacacuggcccccauaauaccaauuuccagagauaacaacuguuaaccauuuggaguacguccuuguagauuuuuuuccuauaucauuuuaacugcaagauagcucuaguaucuugggaucagccagugucucguaaauguaguguuugauuaaagucuuauccuucccauccaagagauuaucucacaaggaccaccuugaauuucagauuggcaccucuccugugaaggaggauaaggaagcauuugccauaguuccgguuucuccugcugaaguucgggaccuggacuuugccaaugaugccagcaaggugcugggcuccauugcugggaagcuagagaagggcaccaucacccagaaugaaaggaggugagcacucccgcaugcucagcacagccgcccucccgcacugagaguuucugacauccaugggguggagugagagaauggugacucugaacagcuaaacaugggguagcaggccuuagcauuuauggguggcuucaauguguaacuuuuaagaaauaguacuuuugcauucauuuuuugagucucuaaaauuaugaagaucagguguaguggcucacaccuguaaucccaggacuuugggaggcugagguggguggauuacuugaggucagcaguucgagaccagccugccuaacauggugaaaccccaucucuacuaaaaauacaaaaauuagccaggcaugauggcggaugccuguaaucccagcuccucaggaagcugaggcagaagaauugcuugaacccaggaggcggagguuauagugagccaagaucauaccacugcacuucagccugggugacaaagugagacuccaucucaaaauaauaauaauaaucaagugaugaagaccucacucucucuuucugucucuaaguuggucucuagaaccacauuacuaaaugucagggaaugagguuacucugagauaaaauuuugugucugauauuucauaaaggugaucauccuuuuguggacaaugauauguuuugugucuuucacucucuuugauacuuggcuucuguugucaguuucaaagaaauuggaaagugugggucugccccuguuuaacuggcucauucguccagaaggcuuccaaggcaaagcuuccagccugcugaacacugaacacaucugucucuaauagcgucuuuccuccuaaggucuguaaccaagcugcuagaagauuugguuuacuucgucacugguggaacuaauucuggucaagauguucucgaaguugucuucuccaagcccaacagagaacggcagaaacugaugagagaacagaauauucucaagcaggucggugagauguggcguacuggggauuuggcuuuaugagaaaucauaaagcaugagugguagcucaugccuguagucccagcacuuugggaagccgaggugggaggauccccuugagcccaggaaauggagguugcagugagcugaucgcaucacugcccuccagccugggugacagagagagagccugucucaaaagagaaagaaaaagagaaaucaaugggaucauugagggauauuggugauucccaccucaaaggcuugaugaauugauuuuucaauagacuauuuucuagagcaguuuuuagguucucagcaagauugugcaaaaaguccagagaguucccauaucuccucuuguccucacacacuuggccucccccacuaccgacauccuacaucacagugagacauuugugacaauuuggggaaucaacauugauacaucauuaucaccugaaguccauaguuuacauuaggguucucucuuggcauuuuauuuucuauggguuuugauaaauguaugaugccauuuagucaccauuaaaauaucuuacagaauaguuucacugcccugaaaucaucugugcuccuccuauuugucuguccuuccugcuaacccuucacagccaugaacguucuuacugcaugcauuguuuucccuuuacagaaugugacaugguuggaaucaaacaguauguacccuuuucagaggggcaaauuucacuuagugauaugcauccaagguucuucagugucuguccauggcuugauaguucaguucaauugauuuuuagcguacuuguuggauaucaaucaugugagaguuuaccuguuaggaaccucaagaaacauucagcugacaacuuuauuuuccucaaaaauaauguaaaguucaaugugaccuuaagguuauuucauacauuugggagauuuggcauauucuauaaacucagaaggcccauauaggcucuuauagagugcccuauaagucaccacagaaucuuuccguaaagaaugaguagugguugacaggaaauacauagaugauauuguuggauguaaauguaaauaaacugguauaaagacaaauuagaggcaguaaagugacaaauccagaguagauuaaaugcacagagaugcauaccauguccuucuguaacccaacuggagauuagcccacaaacuugccaccggaauuccuggccaccaaagcuaaaagagaaacauauuaguuacaagucccacugguccccauggaacaagggauuugagauuauuuuuucauguuggucuaugauagacagaauuuauuaacaauccaucuuguuucaacaagaauuuccaguucaagaguaaauguccagcuguuguuucaugugaugauucucaaauuagaccucuggcuuaaugcccaugcucauuuguacaauaguaauuccugagaggcaaaaaauaacugacucacuggcaggagccuucauugauuacuugugcugggcacuagugcgacuuaaaauuaucauccauuuucauccuuacuacaccucugugauauaggcauuauucuuuccauuuugcugguaaggaaaugcggguuuacuuugacuguaaucuguacugcuagggaguaauaaaggcuuguguuuccaccuagaaucugcugauuccauugucuguguucuuaaacgcuuugcucuaagcacugugcuguuagguguaugaggaccaguggaguccaguagacuuaauucagcgcgucucccaucucaguugaugggcugaaugcaguguucagguuauggauguguugggauagagaaauuuucuaauguaauccagccacccuugagcuugcauuacuuccaaacagaggguuagcuuugaagcccuaagugauugccauuuuugcuuuucauuuucacaaacagaucuucaaguuguuacaagccccauucacagacugcggugauggcccaaugcuucggcuggaagagcucggggaccagcggcacgcuccuuucagacacaucugccggcucugcuacagggugcugagacacucgcagcaagacuacaggaagaaccagguuuggauuaagcauuggugggaugugguugucaguuuccucccugaaguuugugaacuuuccuccugaguuuuuagugucacaugucuauuuauagaauggaugcagaauaguucaguguugagcuugcucuugggaaggaaacacaagcccaggaagaauauuauuaccuaaucguuaagaaacguacuggagaauucucuucugcagacaucuuucuaugagauuucugguuuuggaguugguuuuacauuuauagaauuuuuuaugacguauucccuuagggcuuaggggugaaaugaugccauguguuuauauuaaagauauaguggagucuuuucuuccugcaccuuuaaaauucuccgucucuuucuagaaacaugaucuuuauuuuguuucugauucauguuuuaugacauucuaagucauugucuauagagauaucuuauacauaguuauauuuuacauauuauacauaguauauguguauuuauauacacacacaauguauagucuccuaugaaauaaauguccuaggagcuccaaacaaccuucagauucuaagaaaaccugagaacuauauugcuacaucauugguucuuaacuggggguaauuuugucccccaaagaauauuuggcaacaucuggagacccuuuugaguuuuauaacuucauggugcugcuggcaucuggugaggggaggcuagggaugcucucaaacacccagcagugccaaggacauccccacacaaccaagaauuauccugccuaaaaugucaguagugcugagguuuagaaaauuugugccacauggaguaccguaggcaugcaaaaugaugcuuaucauaaccuugacucuuaccacuuuaugugaacuaucccugccuuuuggggcaaaaggcuuuuguuuuuaagguuuugacugccacuauacuggacuuuuagaguuuuuucuuuguaauuaaagguuuuugucaugucaucauaaagauaguguugaucuugaauagugcuuuuuuugaaguguaucaagcugugauugcuuuaaauccaccuucagugcguugauacuguaauccaauagccagagagauuuuauucuguuccucucucccaucuucagaugaggauacaucugggucuguggggugugucaagacacuuugcuuguacaugaggaaacaaacuaguuacucuuggaauugcuggauuagacaucuuugcuuaguuguuuucggauccuuuaccaguuggcagaugauaaguuccuacacaaugccuccuuauagaauacaggcugaaaaccauggccuguuuucauuauguuaauccuaaauaguuaaccgggauuuaggaauuaaugggaaaaaaauuaaagcaaguuucaagggccacuugaauuuugagcaagcagucuaucuuggccagggaagcaucuuugaacagaaacaaacagguauuuguaagagauuuccuugaguucacaaauauuucuauggaaugugauagcugaucccaaaagagagaaaccagagauguauucaugaguuccaugcauaugauggauuuucuuagguauuuauuccugaccuucuuaugcuacucauugacuuuaaaaaaguauuuuuaccacaaauaaaggaaaugaaacaggguaacauuguuccagaucuccagguaggcuuuaucuguguuuauuuagcagcacagaucacugggggcacaguuaaguccucuugaauuaggaauacguuuagagcugaaaaccagcuuuggaccuuuuugaaaaauaaaucacuagauuaaaauuuauacugugcacuuaauaaaauauccacguguaaauacaggcuauuuugcuuaauuacauuuguguggcaggcuuagaaaaguaaaggaugugaaggaguuugcagcuguugcccuaggauagaaaguuguaggaagacccucccuuauacuguaaugucucuuaggggcaguaguucucaucaggaaacauugcugcuuucuuuagucuacgcuuaaccauauugucauuuauccuuccuacugacgucucuuuucucuccuuauaaaggaguauauagccaagcaguuuggcuucaugcagaagcagauuggcuaugauguguuggcugaagacacuaucacugcccugcuccacaauaaucggaaacuccuggaaaaacacauuaccgcggcagagauugacacauuugucagccuggugcgaaagaacagggagcccaggugaggcgggagugggguccaugcaggauggugucucugccuguaagaugcagggacuuagcuggugcuuuuuacuacguuuccuugugcugcuagugacaaguuuugauuaguuaggucuggagaggcuuuuugaugaguaguggcaagaacuugguguuaaaaugagaccugggggugcauuccuagcuccagugugucccaccuggaugagcuuggguuuuuuccugaacuuuaauuuccuuaucugcuaaauggguaguuaugaaaauuaaaugagaauaaacgcaggugacgugcaggcacuuaguggaugcagaggaaaugacaaauuguuggccacucauucacuuuuuaaaaaauguucuuaauuuuaauuuuuaauuuuuguggguacguaguagguguauauauuuaugggguacaugagauguuuugauguaggcaugcaauguguaauaaucacauuguagagaaugggguauccauccccucaaacauuuauuuuuuguuacaaagaauucaguucuauucuuuuaguuauuuuaaaauguacaauuaaauuauugacuguaauuaccccauuuaccuacaaacaguaggucuuauucauucuguaauuacccaauuuaccuacaaacaguaggucuuauucguucuuucuauuuuuuuuuuuuuuuuuuuuaccuguuaacauccccaccuccccccugcccucccacuaucuuucccagccucugguaaccauccuucuacucuguguccaugaguucaauuguuuugauuuuuagauccuacaaauaagugagaagaugcgauguuugucuuucugugcuuggcuuauuucacuuagcauuaugaccuccuccaguuccauccauguuguugcaaaugacuggaucucacucuuuucauucccuuuuucuuuuuuuuuuuaagauggagucucgcucugucacccaggcuggagggcaguggcgagaucucagcucacugcaaccuccgccucccggguucaagcaauuguucugccucaggcuccccaguagcugcgacuacaggcacgugccaccacacccagcuaauuuuuguguuuuuaauagagacgggguuucaccauauuggccaggcuggucuugaacuccugaccucgugaucuguccgccuuugccucccaaagugcugggauuacaggcgugagccaccgcgcucggccucauucacuuuuuagcaccucuugcuuaucaguuaaacacuccccucccucaguauaaucaguaagagucuugcaaguucaguuguugguugagcguuuuuauuauagauuagugaauucuauugauuguaucucauucacacagaucugcuccucuuucguacacccucuccccauuucuuuccccuucucuuguccuucuaauuaagacccauauuuucaguugaagcgggaagcaauuuacaaugugggugucacaaaugauuacaauggagcacggacacaguugcuguaaaaacaccuacuaccacccuugaaaauaacccgcauuuucuggagccugcucaagggcucagguagugagcaauggaagcacuuccguuaauuaucucauuuaauccgcaggacagcccucagaagugacacauuauccuuuucuguagacgagcaucaauuaaagcacagugaaauuaguaauuuccccaaaugaacgcuccauagcagaacuccgcuaauaagauccuaacugggcuuccaacacacguagccaaacaucagggcguugccucucaccacugugguuccccugugucuccaccacaccuuccuuaugugagcugcuuucuugucuuguuccuucuucucaucuuugccucaucaccucuuccuugaccacagccacuccugucuuuccuucuuguuuccucuuccuucuuucuggcauguggcuuucuggugaugccauaaacauuggcaucaagacuuagaaugcugcugacaugucuugguaaagguauguuggaccugugcacuuaaggaagaauugggguccaggagccuaaccucugcucuaucuacagaaaauguuuuguuucuguuucuguuuagauucuuagauuaccucuccgaccucugugucuccaugaacaaaucaauuccagugacccaggaacugauauguaaagcugugcugaaccccaccaacgcugacauccugauugagaccaagugaguggggagccaggguuuagauggaaaacaugggguucauucaguguuggugcucaugaggaauaaaaccuagcccuaucauuuuuugaguugaucuaaagucaguguggcuggcauuugaucuucuuauuggaaaagucuugauuaggagaauucccgaauuugauuuuggugucaccuccucuucauaguggugucacuuauuuugcauacaaguuuagaagucauguaaacucaccggggagcauuuuauacagcuacauuuuaagaguuuaaaacucuuuguaagugugaccaucaauuuaaaauuucaaaugacauaaugaauauucaguguuaagauuaagucaguguugggaggaguuuuaaauuauuacuguucagaacauguuuauuggucugcagaauuuuuguuaccaguaguaauucauuuuuggcaaaggagcaguuuuccugagaaguacagugccgguaauauggacagccuuaaaaaacauacuaaauuacguccugagcuagugauacuucauugauucacauguauaacucaguuuugggcuugggcuaaugcaggguuuuucaguuuagguauuuucacauuucgggcuugguaauucuuuguuguggggcugugcuaggcacuguaaaauguucagcagcaucccuggccccuacccacuuagaugccaguagcaccucuccauuucgguugugacaaccaaaaaccuguccagagacauugccugguguccacugggggcagcagcaccauagucgagaaccacuggguuacaguauaugaagauguuaaugucaggcucucugcggcucugcccuugggggaaauacaaaacaaaaagugucuuuccaugugucuuuaugcugaaaguaaagcuagaucucaaaguauuuuuaaaaauaguaacuuuucccuccuccucuuguuuucuagguugguucuuucucguuuugaauuugaaggugucucuuccacuggagagaaugcucuggaggcaggagaagacgaggaagagguguggcuguuuuggagggacagcaacaaagagauucgcagcaagagugugagggaauuggcucaggaugcuaaagaagggcagaaggaggaccgagacguucucagcuacuacaggugcgugggacacguguggggcucagauuggggugccccaaaacaguggcacuuaggaauuuguugcucguuuguugauuacuucaaggaaucacaaggagucaucuuguaagauugucuagaaaaaagccagauguguguuuuaggaguuuggaguguaagauuucaguuaguugacaucuggauguggcugguucccaaaaaggaugagugcuugccucagucccuggugauaguuuauccuucagcagcauggcccauagauauggugguagguacguaagaggcaggcuguggggucacaucccuaccucuccgcuuaccaguuuuuugacauuggccaaguuugauuuuaugcucuaauuucuuuaucugcaaaaugaaggugauagugccaaucucaccaaauguuuauagacagagacagaagauguguguguuuguauacacauauaucuacacauucauccauguaucuuucuauaacuacacaaauauauaauaaaaagcauguacuuacacuaauacuuccaauuccauuccaacaccauaggauuuauucuagccuucaccuuuuccauuucaugacucccuccagcugccacgauucccuguauguuuacccaucugcccguuucccuguguguaccugucucaccucugccacccaccuccacgguccccagugucuccuuggcuccagcuguaagaccugccaguccugccaccugaagggaagggaaggggaagaaagaaaggaagugaaccaauuaauacuuuuaaaagaaaaggaaagggaagauaaagcaaggcuuuuauuauuuuuuaauaaaauaaauaaaacugcagauaaaaugccuuuucuugccuccuguauucuguucuuucauucaugugugauguacgcauccuauccacauucucugugugcugcauuuguaugcaucuguaaaucauauguaguauuuuaucucuacuuaaaauuuuauauaaaugggacuguacuccaaauaccauucuaaaacuugccuuauuuauucaauacggguacugaagccauauugaauauaucugcguuaauagagauuaauccauuucuguaauuuggacuguuggaugauauucuguuuuauugauuuaucacauuuucaucgcuguuugauauuugaucacaugcugcaguucuucaugucaggaaacaucuucauucaaauuuuucugaguauauguaugaauuuccauuccacacugggaggugggcuuggaggauauucauauuuuaagcuuuacuaagcaauucuaaauuggaugugucaguguacacacccaccaguuguagacgacaagcuuuguuucuucaugucuuuguuaaccuugaauaucaugaugcuuuuuaauuuuugguaauuuuauaagugugaaauagacucaugucuacacuugcauuuccccgacaucuaaugaggcugagaaugucuucaaaucaugauuauuagaaauacauagaguuuuuaauucagaaggcaguauuuugaaagccuguggcuuucucguuauuucacauuucaaguauguuuacucuuucaguguuugaugaaucuucucccaagugaaugagaaagagugccuuaauuggucagguuccaguuaacaacauucacuugcaauuggaugaagaugaaaagugaggagucuccuacuuuuguaaaugaaauguuuuuuuacacguguaggaauuagagugacuuacaugauauaagaucuuuaaaauguuauaaaauuucuaauuaggcugaauaugugugauaucuugaacauuuccuacauggucuuuacuguauaaaacacagcugaagggaaagaaauagacaaccaucuuaggccuuagcauuccccccguuuauuuuaaaaaguaaacauuaaggaccuaguggaauuaggucgucacauaauugcuccaacacagcuggauagacauguguuccuguuggcugucaacccacacucuacugcacagcuugaauaguucuuuuaucugcuugguaccaaagccaaaauccugguauacaagagcaauuuagggguguugauguaugaguuuaguuggccaaaugucacucccaugacagucagggcugcccagacgacccuucauucauccugaaugauuucuggagcgugagcugugugcccuuguuccuuccucuagauaucagcugaaccucuuugcgaggaugugucuggaccgccaauaccuggccaucaacgaaaucucaggccagcuggaugucgaucucauucuccgcugcaugucugacgagaaccugcccuaugaccucagggcguccuucugccgccucaugcuucacaugcauguggaccgagauccccaggaacaagucacccccgugaaauaugcccgccucuggucggagauucccucggagaucgccauugacgagugagccuggcaccugaaaaccucacuuuacauuauucugugcggcaguagauagccccauauggucucauuaaaucuuagaagaaagaugaaguguugguuuuuucuucaagcuuaaaauaaaauuaaguggauggcaaauauuuuuuuccucaagaaugugaaagauggcaugauuauguuuuugguuuuuguuuguuuguuuguuuguuugagauggagucucacucuguugcccaggcugaacugcaguggcgcaaucucggcucacuacaagcucugccucccggguucgugccauucuccuuccucagccucccaaguagcugggacuacagacgcccaccaccacgcccggcuaauuuuuuguauuuuuaguagggacgggguuucaccguguuagcuaggacggucucgaucuccugaccuugugagccguccaccucggccucccaaagugcugggauuacaggcgugagccaccgcgccuggccccgauuguauuuuuuauaucucauuuaucuccucuuucauucugcaaauauuuaaguguguacuaugugccaagcucaagaaauauaucagugaacaaacuagaaagcaaucucuaugcuaguugguggaagacagacaauaggcaagauaaacgacucaaauauauaguuggugauauaugcuaaggagggaaaaaauaaaguagggucaagggaugccaaggguuaggggauguugacuuuugaagcugagugacccaggaagaccucucugggaauaacuugaaauuuuguuuccuuucuuucuccuuucuuuucagcuaugauaguaguggagcuuccaaagaugaaauuaaggagagauuugcucagaccauggaguuuguggaggaguauuuaagagaugugguuugucagagguucccuuucucugauaaagagaagaauaagcuuacguuugagguaacucaugaugaaaucuucuauguguauuaucugccucucaguggucauuuuucuauggggcaaauagaaaauaugugaguagguugugauuuuggucaugaugcucugguuuuguaauggaaaggaauucagcuugguuuuguuccagaauaaaauaaaacggauaccagucacauggcuuaauaguaguuaugggcuuaaaagaaauauacaaggugacuugaaccacauaaaaugauagaacaucacuuuguguuaaaacugacaagagagaaacacugugcuugcaaucugccauagcuuaaucauuugcagaacauaaauccuuguuacuucugaguuaacaacguuucugagacugcuuuugccuuuuaagagcuguauugcugaggaucgcagaguguuauuaucuguguccuuauugggaauaacucugcuugccugguguuaauauuauccuugggaagcuguguagagcaaaugaugaggucuuuuuuuuuuuuugauuagucaucagagcagaucaguagcuuuccauuucuuauuuuuccuccuuaugaaacaaaaugaaaauuuaucagaaagugcaaggaaaauacaugccuucucuuaccauaaggaagguccaagucugucauuucuaaacuggucaacaucaaauggaauugaaggggaugcaguuuauguaauaccgucuucuucuuuuauuuuaauacaauagguuguaaauuuagcuaggaaucucauauacuuugguuucuacaacuucucugaccuucuacgauuaacuaagauccuucuggccauauuggacuguguacaugugacaacaaucuuccccauuagcaagauggcgaaaggagaagagaauaaagguaacaaugauguggagaagcugaagagugaguaucugagggugcccauacaucugagagaugcccuccagccuuuccuguuaugcucaugucauacccuauaugugaugccacauccuuucuuuguucauuccuucccaacuuuucaucgugaacauuuucaaauacuguguaaagaaaagcggaaagaacaguacgauggagucccacguacccaugacuuugagucaacaguuauucacguuuugcugaauuuuauuuuguauuuauguguauuuauguguauuuuauuuuguauuuauguguuuauguaugagucguguguauauuuuguugaacaauuugaaaguuacuuaacacuuugaauguuuauauaacaaauacauguccuaucauuguucuugacauucgugagacccuugauaauaauauuuguuuaggauguaagaaaauccaggcuucuaucuugguggcuauuuccacuuugugagaaggacaaucugccuuugcauguuuauuucuuccucguuuuagggucagaguaggcagauauugguaucauguaucaauuauuguuaacuggucuucugcagcuagaacagaaagaaauacauugacuuaucucuauuugcuaggucuugugcugagucauguugcauuauaccauuuaguucuuuuguugagcuccuuuauuuccauuuuguagaugaggagacugaggcuuagagguaguauggugcaccuaaggucaagcagcaucaggauuuguaccuuguuaacuuuauguaccuaguucugugcucauaacaagcacauaguugaugaucaauaaaauuugggcagggcauagugauucauaccuguaauacuaacauuuugggaggcuguagcaggaggauugcuugaggccaggaguucgagaccaggcugggcaauauagagagaaccuaucucuaccaaaaaaaaaaaaaaaauuagcuggguguggugaugcaugccuauaguccuagcuacuugagacguugaggcaggaagauuguuugagcccagaaguuugaggccacagggaaccaucauugugucacugcacuccagccuaggugauagaggaagauccugucucuaaagaaaauuaaaaaaaauaaaauuugaugggcaaguuagugcacagaaaugccccucuggggauuuugaagcccgugaucuuucuguugcucucagaagcccagauuuuugaugugcauuuaccuuuccagguuuccaggguccugagauuauguuggaauagggauauguuaaauaauuucucucaaagagccccugccccuugacauaugccucugagcauucucuagagacauugugaccguggucucuccuggccuuuccuaggcaguaacgugaugagaucuauucauggcgugggagagcugaugacccagguggugcuccggggaggaggcuuuuugcccaugacucccauggcugcugccccugaaggcaaugugaagcaggcagagccugagaaggaggacaucauggucauggacaccaagcugaagaucauugagauacuccagguauccacuagcuggagcugggguagggaggguaugucacagaggcgccauucagauccagucccucuguucugauggagcccaaggcuuucugggaagaaaaugggggcaaauccuuagcucaucccuccgugucauuuaugagcuggcuccucuuaaucccuuuacugcuuucuccuacccucccaacauggccaugucccuccagccaugucaagacuugccauuguuaucuuagcuuuccaugaucauuggccuccaugccaacccucugccuagaauucacuuaccucugugucuccauguagcugcaucucugcuuauugaucauaacuagguucaggguuccaucaacuuugcaaagccuuccucccuucuucccuuuuucauucaaucaacaaauauuuauugagaccaacucugugccaaguccccuuaagcacugggaggguccagcaaugaaaaaaauagaugaaauuccugcuucucuagaauuuacauuuugauagaggggcaugggcauguauuaagaauaagugcuaagagacguuaaaaaguaaaggagggucaggauuguuuggagacacugaggacagggggcugggguuauuguguuuggugagguuaucagagaaggccucuccaguacagugacaugauuacacaccugaaugaagugaggagauagccacacagauaucuugggaaaggguaucugaggcagagggagcagcaaacacaaagaccccauggugaagagggcacauuugggaacaggugggguucaagagggaaugggagaagaucaagucggggaguaaauauauauagcuucuuggacagauugccuguaaggaugcacagagaaguggggacaugggcagagagcgauuguugguaacaugguuuauuuuuguuguaauauuuuuuaaguggguggguuauaacaagcuuguauggugaauaggaaugaucauguauacagggagaguuuguugcuguuuggggagagaauaauuguaagagcaaaguccuucuguaggcaagcggggguggaaucuaguauauagggaaggcuuggucguaggcaugaaacccucccaagccucucuacagcuuugaaccccacccgacaaccugcgcuucccucuuucugugccguguagguaacuuuuauucaucaacaaaaucaucugcuccuuaauggaaagaauuauguguuagcaccuucuuuuuuuuuaucccauguugccugaucucaaccccaacagauguaguagaaauucauaaauguuuaagaucuggggguuuuauuuuuuagucugaaaucacccuuuaccaaugcuuugaaaguuuuaauggguugucucaaagucauguaauuaggacgauaaagacagcuuaaguaaaggagaaaucuuacugaauuuaugccugagcaacaguagagaaagauuccuuuuuuaaaacuuuauuuuuuaauaaauuuuauuuuuacuuuuauuuucaauuuuuuuugucgagacaaaauauacauauaaaauuugcaggccaugguccauguguuccaaaguggugucuuggacguuuaucagaaacgacgcagugcaaaacuuggucacaucuugagguccacucaccguggugaccuaagaaggauuggucgauugagucauucuuuccacggguacuuauugacucccuaccaugugcacugugaggaaugcaaaaaugauucgaacaggggcuccauccacagggguuuauagucugaugggagaauaagguaugaugaagcugcguggauguggaaauaaaaccaccagaaaguucuucugagacuggaguccgggaguggggucaugugacuccacaugguaaagaucagagaaggguugauggaggagguaggguuucaucugagccuuuaaggugcaugggcuuuguacauggagaaacaagggcccguucucagguggauggagcagccugaagccgaguaccaugggaugcaggucagugggcaguucuugcugagcagagacauagagugugcugaggggaaguugucagaagugaguuuggaaaggaggaccaagccacacugcacagagcuuugggugucuaaaaugcuaaggcuuauucucuguugagccuuugaaagucuucaagcgggagcuuaacauaagaacaagugguuaggaggcugauuuggugaauuugguucuguaaauggaacaggcaggagauaaugaggccuugagcagggagaaacggcaguaggggagaacucuaugagaagcgguaaauggagaaccaccaggacuuagucucugauuagauguguguccaggaaggaggcgcugaugaucaggcaacugacugagguugaggaaacccaggcagaaaguagaugaaggcaagacugacaauguuaguguguuagcgcucuccagagaaacagaacaaauaggauacauacagauagacaagaggggguuuauuaugggaauuggccucacgcaguuacggaggccgagaagucccccagucugccacagcaagcugugucccgggaaagccaguggugugauucagccugagucccaaggcugagaaccaggggagcugaagguguaacucucagucugaggccaaaagccggagaaccuggagcucugaugggcaggagaagaugagugucccagcuccagaacagguggauucggucuuccuccaccuguuugcucuauccaggcccuccguggauuggauggugcccacucacacugggugagagcggaucuucuuuacucagcucacugauucaaaugccaguccauucuggaaacccccucauagauuuacccggaaauaaaguuguacaagcugucuagguguccuugaacccagucaaguuggcauauaaaauuaaccaucgcaguuacuuuugugaaacacugaguuugaggcccugggaagauagcaaauaggauguccaacagucuguaggacacauacacugagagcauggaggcaggccagagaccuaucucccucuggaagaggugauggccacuggacugggaaagguugcugggaggcuaagcagagacaaggggagaacggaaggaagaacgugagugagaucccuacaugaugucagcugcucaaucuuucuuuuugguucuagcagcaauccugggaaaagugacccuguguuggaauaaagggugagggaauacaggaggcaaaagaagaggguguccaaggguuuguacccaaaccaggggaaacaaccagaaacaggaaauaggaaccaagcuaauuuuccauaguaaaaaacaaauuuuuuuuuguuaauucucuuaaauccaaagcaggcaacuucacucuuuucaguguuaggcccagaguugacauucaauacuuacugaaauggagucuuguuuuauagacuccauuuauggagccaggagugagugauuuaguguuccaauuguuaaauuaauugccaggaugcugaagcuuacacuagaggcuaaggugcuaugggcagacuucauaugccccauggaagucugcuguuguuaaaaugacuguugaaaucuaagccaaauacuuggcucacuuagugcuuaagguaauugaugcagcugauaccaggccccgccagugugugguggcuuggcagagucaagaugguauguuaauguaaccaaucuguuuccauuuccacuugaaucuuuaguuuauuuugaaugugagguuggauuauaggaucuccugccuccuguguauauuuaagcgagaguuugaugaaagcaauucccagacuucagaaacauccuccggaaacagcagccaagaagggccaaguaauguaccagguuagugauucagaauggaauuucagccauagaaugggaccuggcucuaaggaaaauggggagagcaaacaguaucuucuagaaaaagggugaaaaugguuuugaggauuauugcaccagggcaucauccuggcaguuacucuuuuugagcaagugaauaauugauagagcccagauuccuucuggguuggaucuuguuuccuuccaucugggagugucuuagugaugagacaguugagguuuccagcauuguggcuacccaccucccccgcaaaaauaccaaaauaaaaacaguaacaaaaaacucuccaggagacuucuugaccacuagcagcuuuuacucacuuuggaaguuuuucccugcccaggaacuaguggugacgggagaugguaggaguagaaauaaucccaucuaccaagcccaagcuuccaugagugagaucauugcuguccuuuaccaggggaccaugcagugagggaggaaggggcaggaauguggaauaugugguuaaugucaucuggguuagucacucugcauagcuuugcaauauaauguucugggagauuugggguuaacucaacagcuuuacccugcaaaacuuauggaugaguucaccagcagcauguuugcagaccuuccugcaucugaagugguauguucuaacuuuucaggugcucuugacuuugaacacauugaagaacaagcagaaggcaucuuuggaggaaggaaaguauauuuucaguuacuguuuuguagggaaggcugcucuuccagagcucucagaggccuucccuuuauuauguuaguaaauauuuagucucugggcuuagguuguuuuggugcuaucuuuggaacuguuaguacucaagucagaguuaacuugguuggcuugauugggaggagagagagagugagagagagagagagagaaagugugugugugugugugugugugugugugugugucccaccuaggacagaaaggauuuaaggagauuucucaaaauaccuacauuacaagauuauuuuuacauagugaggaaaugcaaucaaaagaagaauagaaagagagaggggcucaaaacagagugaaguuaguaagaucauguccugcugcugcugcugggcuacaauuuuaucccugagcuccuuacaggcuaugcaacaaagaaagcaaaaucuggucuuucauuguuccuaauauuaauguaugaaccccuuuaaaaaaaaaccgcacuggucaauuuugacuuaagacauuauuauaauuauggaacucuuauaccuccaaguauaaaauuugguauaaacaccauaugcacauaguucuuauaauuagcacacuugguuugauuauugcuuuauaacauauuacuccaaaaaacuuaaggauucaaaccaccaccauuuuauuaauacuucuuacaguccuguggcuugauuaagcuggaugguucuucugcugguggucacuguugggucugucauacuguagugaggugguaacuggggcuggcaccuccaaguuggauuauucacauuucuggcacuauagcagagaugccugcaaggccagaacuucuuucucucucuguccauguggauagcuugggcuucuuuacagcacgguggcugacucaaaaagcaaauguucuaagaggacaagccaacaguaugcaagugcuaauugggccucugcuugcauugcaucuccuaauaucuuauuguucaagcaaaucccauggccaagcucauugucagugugggaggggacuacauaaggguuugaacacucuguuggggcccaccaguguuaauagucuaccucaaugcuuaauauaaaaccugugaaauuugaauuagcaacauuauguacuaugauggaagauguuuuucugaaacuuaaacaugguauugugaguuuagcauaauacagguuccaugugcugugugaucacucagcucucccgccauuuuccucauagugaacagcauugaaaccuucacaccuuuuuggaauacauagcaugaauacaguauuuauaagucuucucugugcuuuucuuauuagccagcaaccaggaaguuuccaccauuugucauucauuugacucuaaacccaauauaggugcagacccaauaauugacuagcagugcucaguuauggaguagucugccauuugaucuaggauaugcuuauuaauauuuaaauauagucaggcaugguagugcauuccuauagucccagcuacucaguaugcuaaggcaggaggaucauuugagcauaggaguuugaauucagccugggcaacauagcaagaccucaucucuaaaaacuaaauacauaaacuaauaacuuaggagaaacacauccucuugcaguucucagaccacagacgaagcccagcagaagaacacccuauguagauguugagaaucuaaugcuagucuugucacuuuggcuuaaaauuugacuuaucuuuuaauaugacaucuuccuuguccccucaccucauaauauaguugaagaugaagcaaggcuguauuguuaaaggagcuaaugaaaagugaaauugcaugucuggagaucacagugcuagaaaugcaacuagguuaggugcaucugggcccaaggggcgugagaggaggcauuugucauucauuuggccuuuccccaccuugugcuccuuuagugaggagaacaccccacuggacuuggaugaccacggcggcagaaccuuucuccguguccugcuccacuugacgaugcaugacuacccaccccuggugucaggggcccugcagcuccucuuccggcacuucagccagaggcaggaggugcuccaggccuucaaacagguagcucaggucacccacguguguguugucuguccaagaagcuguugugugcaccuaacggauugcguucauuaagguucaacugcugguuaccagccaagauguggacaacuacaaacagaucaaacaagacuuggaucaacugagguccaucguggaaaagucagagcuuuggguguacaaagggcagggccccgaugagacuauggauggugcaucuggagaaaaugaacauaagaaaacggaggugagugaaacacaaguuaugcugccaaaguggauggaugggcuucucgaaacuagggagcauccucuucugguuuuagguauaaaugugauaggauuuauuuucaagagaucugcuuguuaagucaccaagaucacaagcuguuugccuaggaaauaagcuacgaaucaaaguuuagcuaugucuccugugcagccuuggaccauguagaagagacugcgauauugagugaauuagcaccagguuucccuuacagacccacuugggaauugaccuguucucuaggcauggcccagcccacuacuaucccuucccaaggaaacccauagcaaguagguagaugacuggggcauaagcccagcaugacuauuguaaaacaguauagaacucccuuucuuuccuaaaggucgaugcuaacuguaaaaaacugacaguagcccaagaguuguacagaucacacuuguguucacuuugguuucuaggagggaaauaacaagccacaaaagcaugaaagcaccagcagcuacaacuacagaguggucaaagagguaagcuccucccccaccaccauuuuuccuuucuuuaugaauucucuaaggagcuuuaguuugugauagucaaguugaagguacacacauuugagcuuuuuucuucaugugguuuaacagggagaaaguagagcucagagguuaagcucauggguuuuggcaucagaucugggcuccacacccagcucuucuacuuauuauuuuuguccucagcuuccucaccuuuuguaggugcaaccuuucguaggcaccgcauauuucugaagcuuuacaauugaaggaaggacuaauugagaauacugucagggagucaucuaagugccugguacacaguguccccacugagagcuguaguuuuuuagaaaccuuugcguacgcugguucaaaguugggaggcugggagcuuuguguguuuuaccccagagcaaacucuucccagggucucggcaaugaugccaggucauuccauuuuaagcgauaucucugaaacugucccacuuguuguugaagccauaauccccugcuuauucuggaagacgugaccuuagucuuauggauuuggcuugauggagucaacagaaaugccacauacugaaggaauuuuguuuuacguuuuuaaugcauuauaauccccuuugccucccugcccgccaccacccucugcaaucuuuuuccagcuauaguuccuaguuuucugagacugauuucuuucauucuacuagauuuugauucggcuuagcaaacucuguguucaagagagugccucagugagaaagagcaggaagcagcaacagcgucugcuccggaacaugggcgcgcacgccguggugcuggagcugcugcagauucccuaugagaaggugagcggugccucaugcacagcagcugcucucaggauggggcggaucccuggguuuccccaaacucuucacaucuggauauuguuagugaagaaaugcauccagugugacuauugugacuacaaagcaauuucagguauugauaugaaacagagcaucugaaaaauaaaguaaaaucacccgugaauaauccucauccccaguuuuaagauucuguaaagaaagagaguccauuuauucuccauacucccaagacauauuggauagagacaacuuggucugugucagagcuuagagcuauaucuacccaugaguugguguguuucaauuucauuugcaaugugacucaaccaauuuaaguaucaccagcuauuaagugcauguaggaacaugggaugugcccacuuuugaaguccucaguaagacgcugacaucugcuuaaguauuuggauuuaucaggugaugcuuugaucuaggucuucuuuucuguugcuggaaguuguacuuugccucuaauuuuucacauuagcguuugucauugauacguauuugauuuggggaggcaggagcaggcugacagugcuuugcaugcauguaggcugacaagacacuuaugaaaucauucauucaagccuacaagacccacucggguauuuguguugugcccacuugacagaugaggagacugaggcuuggggagguuuagaggugaaaagcucagacucaggucucuugaguugacuauuaacugcuagagagacugauuugcuagagaagacucaccugaugaaggcucauuucuaggugcuugcagggugccaggcgccaugcugaggccuuuauacacauuauuagcucaugccauccucaagacacguggaugagauggguggugcuaucuuuagccccauuuuagaugagagagcugcagcgggagagguucaguaacuugcguggauggcacagcuguguagagugaaacuggcuccacuucacuguggaucuggggccugcugccuucccuaugccugucgccuucuacuccaggaaauuuccuaugaaaggauccuccuccucagucauggggaccauaugaaucgggcaggucaggccuuucgguagcuauaaauaaaguccaagcuuaaucccugucguagguauaauaccuagcuaacuuguaguugauacaggugugcauuaucauccaaacuuugccugucauuuagacuagaaccaacaagcugaucuacuuccuuguguguaaggaacgcgagggggucauuugcuaaccauaguguugucucauaauaucaucaguuucccuaaugagaguuaugccuucauagagcaggcuuaaucuacagguaaccagaugugguuggaauuggugacucaaaggaagaauaucauguguguguauaucuguguguguacaugugcacgcuuuuguuugcuuuuggaugggcacagacuuccaaagaacgguggaggaaucccccacagguaaucucuugugacuugaugucuuuggggcuugcuuuccuuggaaaaauccgcuucacaccacaaggguucuucacuuagcuugugcaccagcagauuccuuuuauacggaaggacuggagguguguggaacuguuuaagguuacagcugucaaccagcaguggcugucugucccaagcccucugauuucuuagagcuagaagguucaccaccccuccuguuaauaagggacaaauguaauccccauuauguuguccugggacuugcuauuaauguccuuguaaauucuccucuguuuugguuugauugucaaagcugggagcucaccuuccucccacaacucuguuuugucacagaguuauuuuucuagaccagggguuagcaaacuacaggcaugggccgaaucuaauccaccaccuguuuugaacagcauaucagcuaggaaugguuauuacauuuuaaaauagucacauaaguaccuacauaauguccuugauacucccucucuacccacaaagcccaaaguaugugcugccuugcccuuuaagaaaaagcuugcugaccucagucuagcccggaaccaaaagcuaacauuuacagaguaaucacugucuaagcacuucaugugacuuuucucacuuaaucuucauaacaaucacaugaagugugcacuuuuguuaucuccuuuucacggaugaguaaacagcgacacugagaggcuaagaaaugugcuccaggucacacagccaggaaguuggagaucugggauaagaguagcgcagucagguuuggugaccugcauuccuaccugcuauccucucuugccucugaaaugaggugauggcugugaagacuuaggaagacuauugugggcuguaagaauaugaaggaugauuuccaguuuagaaauucuuguucuguuuuuacucucuuaaauguuugcuuguuuagaauuggacaaaauggccauggguuuuauagaauuggcuuauuacggaauauuuaacucuaaaauacugaguuuaugcuauuaauguaugaaucacauaauccaaccacgugaaaugccagggaggguauuauccccauuuugcugaugggaaaacuaagucugagguuaaaaauuguacuugggaugauagaggaguuacggcaggcacaguugcucuaaugugugaucucaggagauuuccacuuugccaugggagcugauggcaaaaguuaaugucuaauaggucggacaacuuaaaaaggugaacccaagagggaaaaugacuacucagcgucagugaggaagucagccccaguucuguugucagucccuguuuuuguuuacuuuuaaaauuuuuauuauuuuuaucuuuuguuagagaugggugucucacuauguuggccaggcuguucucaaacuccugcccucaagugauccacccaaaggggugggauuacagguaugagccacugugcccagcccgucccugucuuuagaaguaggggguucagaaguuucaguccuugcuggauaauggacucauggaugccuucuauuagccuuacucugcagugcucccucccacccaaauaagaucuucacuuucauccaaugagcauagacaaguuacuggcuucuuuucagcgucagcagugcagccccucaauauuuacccacaacagguccccagcaaacaccuucugacucccacguuagcaggagguguuggguauaggagaagcuggucuccuggcccagcaaucagugcuuucaucugucuccucccacacaggccgaagauaccaagaugcaagagauaaugagguuggcucaugaauuuuugcagaauuucugcgcaggcaaccagcagaaucaagcuuugcuacauaaacacauaaaccuguuucucaacccagggguaagacuugaggccaaucugcaaaucuauagagggaggagggcagggaagagggaggaggaacagcuuguucuuuggcuguuguggcuucuggggcuuguuauaaugcaacauucauuccaaaggggaacauuuucaucacuuaucacgaggacauaaauacucaucuuuuggggaugagauggcaggaguuggggaggggaaaaggaggaaagugagauggauaaaguaagauacgugucuauauuuuccuagucaaguccuucauuguaucaaacuucagcaauauagaagugcuaaaugucucuccugccaccugcuacugaagucaugcauaaaguuuucuguggcuauguauacauauauaauauuuccauaucaaacauaucuguaauacaucuuaguuuguuaaauauauuucuagaaguauauuaaauguauuguagguuuuguaaagaaaaaugaugccacacucuaugcauugucuuguguucugcuuuuuucacuuaacacauuauggaugccuuugcaaaucagagagauauaaauuuuucucauucuucugauggccaaaugacauuccauagaauggcuguaacuuuuaaaaaaacauucucauauuaauggacaguuaggcaaugucugauuuuuaacuuuguaaacaauacugcaaaggacaucuuugugcaugcacacacucacucacucaguaguacugcuaacacuuuccagaaaaaggauugcuggauuguaggauaauauagguugagcaucccagaucugaaaaucugaaaucugaaagacuccaaaauucaaaacuuuugagugccagugugaugcucaaagcaaacacucauuggagcauuucauauuuuagauguuuggauuuaggaugcucaaccagcagacuauaaugcaaauauucccaaauccaaaaugugaaacccuugugcucccaagcauuuuggaugagggauacucaaccuguguucccucagugucauguuaagagaaagaaaagucaaaagauaaaaagauuaaagccaccaccucaccccaaauauaaaacucaauaacuguggguaaaaagugaaaaauaagccuucuagaagguaacaugagaaucuucauggcugugugguaagcaaaauuuucuuacaaggcaugcaaagaacacuauuuuugaaaauugauaaaugggccuucuuuuaagaacuucuguuuguccgcugacaccauuaagagcauccaaaggggaggcagagaguaaaagacauuugcgaugcacguucucaacaaagaauucauauccagaauguacauaacacacucaaaaaagucacuaaggaaaaaguugaccuucuuuuaaaaauaggccaggcaugguggcucacgccuguaaucccagcacuuugggaggccaaggcaggcggaucacuugagaucaggaguuugagaccagccuggccaacauggugaaaccuuaucucuauuaaaaauacaaauauuaguuggguaugauggugagcaccuguaauucagcuacuuggaggcugaggcaggagaauagcuugaacucaggagguggagguugcagugagccaagauugcaccacugcauuccagccugggugacaaagcaagacuguaucucaaauaaauaaauaaguaaauaagaacguaaaggcaaaaaacuugaacagacacccuguuggagaggauauccaaauggccaguaaaugugacaaaguguucaacaugauuagacaucagagaaaugcaaauuaaguuauguuuagccacaauaagauguggcuaaaauuuaaaagacugacaauacuaaguguugacaaggauaggaacagcuggaauguagaaugcaacuuguuaacaucuuuugaaagcugucaguaucuucuaaagccaaacauacucauacuuugugacccaacaauucuguucuuagacccaaaagaaguauggguuuaaguucaccagaagacauguguaagaauguucacagcaacucuaguauuuauaauacuaggaauguuacuaucuauuaaaacuggauccuacuccaaaugcccuuccaccauagaauaaagauacugucauauauucaugcaauggaacuuacauaucagugaaaaagagugcaagagguuuaagaacaggcaaaacuaaucugguuauauaagucaaaauaguaguuaaauugugagauaaggcauaaaggagaccuguuuuguuucuugaucuggguguucaaggucccuuuauaaucuauucagcugaaugcuaaugaguuguuuacuuuucuguauguuuauuuauaugucaaugaaaaaagcuuacuaaaaaagaagguaguacagaagcaagaaugagagaaacauaucuucauggguuuaaaugcuucccuuguguguguuucaguggacucuucuuuuucucacuuuuuaaucuguucugucagcuuuuugacuugucccugugcucuuuuccucacucuugugccagauccuggaggcaguaaccaugcagcacaucuucaugaacaauuuccagcuuugcagugagaucaacgagagaguuguucagcacuucguucacugcauagagacucacggucggaauguccaguauauaaaguucuuacagacaauugucaaggcagaagggaaauuuauuaaaaaaugccaagacaugguuauggccgaggugauuguuauauauuucuguauaccuccaucugguguucuguagaaauuuuaaaauuauuuaaucuuaucuguaugaacuugcacccucuucaggagccauacagaaggacagaaaguaauugugugugcauaugucugugucaucucuugugugagcuuaaguuguagauauaggcaagaaucugaucugauauuucauagcaaccaauuuaaggaaggauggcuuggauuuuucugacaggggacagaaagaggaauaaggaacugaauuauagggaauggagauaaaauguagucaggacccagugagccagaacgcuuccauucuuguggauuaugaauuuuaaaaauuauucaccuaauuaauuagauggaaaaaauuuugccugaugcuuuuugaggagcaguuggucuguggaaucaaggaaaagccuuacuugguuuauuaugaauucacuuugauuuacaaucuugucuacguauaugguuccauuggcagggaggguagugugauuaagaguugaggccaacgugguggcucaugccuguaaucccagcucuuugggaggcugaggcaggagcaucacuugaggccaggaguacaggaccagccugggcaacauaguaagacccuuguuucuacaaaaaauuuuaaaaauuagcuggguguaguggcaugugcccauaaucccaguuacagaggaagaucccuugagcccaggauuuugaccuugcagugagcuaugauggcacccacugcacuccagccugggcaacagagugagacguugucucuuagaaaaaaaauaaaaaaaagagagagucggcucaaccugggauacaaaugucaccugaaccccuucacugaagggugccaugagauacauuacuugaccuuucaacuccucagugagcuuuucuauaacaugaagauacgcagauuucacuuuaaagaguugauaugugggguaaaugagauaauggugacauuaaugccuaacacuuuuuggaagccggucauacucuaggcacaguccuaagcaguuugucuauaauaaauuauuuaaucuacauagcacugugaguuagcuauuguauuuguccugguuucacagaugaagaaacugagauacaaugagguuaggaaguuugucuaaagaguuuaucuugguaucuggcaucuaaucauuagagcucauaaagguuagucauuaguaaguauugaccauguuuauuuugacuucugugccagcccuuucuggguuuuuuguacuucauguacugcugaugaaaucgauuuauucuuaaauaaauuugcaagaagccucaucuuaggggacaaguuauaaacaggaaugccucaacuuuuugaagaguaaguauggagaggaaggcauaucuuaauuaaaaguaauuuguugauugaagagauaagaugguagaugaaagaauuguaaaggggauacauuguaaagcauaaaaauaagauggaggcagggcacauuggcucacaccuauaaucccagcacuuugggaggccgaguuggguggaucaucugagguugagaguucgagaccagccuagccaacauggggaaaccccgucucuacuaaaaauacaaaauuagccaggcaugguggugcaucccuguaaucccagcuacucaggaggcugaggcaggagaaucgcuugaaccaaccugggaggcggagguuguggugagccgagaucacggcauugcacuccagccugggcaacaagagugaaauuccaucucaaaaaaaauaaauaagauggaaacauuuaaaaagaaauaucauagccuaauugguagguauggaaauaccagugcaagcuugcaaucucuguuuccacuugaugcauuaaugcugguaugcaggcuuucucuuccccuaauagcuuucuagggccagugugguauuucuguaucuguggacuaaaauuaugaugcugaagauuucuaguuguucaguuauauaaaugaaugaagucaaaauagguaagacugauuugggaagauaaaugcuaacagaaccucucucuuccucugugaauagauuuuuuucaugcugccccaccccugcaagcuuguaaucuaaacccacccuguucuuuauguagcuggucaauucgggagaggauguccucguguucuacaacgacagagccucuuuccagacucugauccagaugaugcggucagaacgggaucggauggaugagaacagcccucucauguaccacauccacuuggucgagcuccuggcugugugcacggaggguaagaaugucuacacagagaucaagugcaacucccugcucccgcuggaugacaucguucgcguggugacccacgaggacugcaucccugaggugagcgagcccagccuggcugugcccuucucguugcuauguggugugugcugucguggcucacugggagacauggugguggcuggccugggggagcccucauggcucugaaagcugcagcucauuuuguagugggauuucaguucccuaaaacauuuucucgagcauugauuuugcaugaaaggaacacggaagaaguuagucguucuuucuguaucuuuaagaacagugaggaaaaaagcuucagcucuguggacuaauuuagccuguugagcaaaggggauaugaccugaaugaacuuuucagaaaugugacgaagaguagguugagaucuaguccauaugaauguaagacuuaguaaguuaauucuuuaaaacaaaaacccuuauuacagaaauaauggccauuauaaaaaauuuaggaacuacagacaaucaauuaaaaaaaaaaauaaugaauaccuaaguuuugaaguuaauccuuccaggcuuccuuuuuuccuacucauagauuauauugauuaguaaugaaaaacuggauuauaaaguauauauuuaugauauauaaaguauauuauaaaguauauauuuaugauauauaaaguauauuauaaaguauguauuguagguuuuacaauguguaauauuaguuuguaguacacauuuauauuacauuaaaauauaugacauauaucauauaauguuuuuagguuauuuugaaaagcuaaaaacagucaugugucgcuuagugguggggauaucuuuugagaaaugcguucuucggugauuuccucauugugcaaacaucauacagcgcacuuacacaaaccuagauggcacagcuugcuacacaccucggcuauaugguacagccucuugcuuccaggcuacaaacaugcacaacaugugacugucucaguaccgaaggcaauuauaacacaauuguauuuguguauguaaacauggaaaagguccaguaaaaauuggguauuauaaucuuaugggucacuguuguguaugagacccaucauugaccaaaaugucauuagucaguaccugaccauacucuuugaaaaguucaaauaucaaagacuguaacgggguaaaccaugaaaagucuuauaaucuguuuucccaccacccuacagaaaauaauuuauuauguucuuguguauuuuucuagaauuuugcacauaaacgcauacaguauauauacuuuacuuccccacccccuuuuuguaaaugcagaagaugauacucuagguauacuauucuguaccuuaacacuguaacuucuuuucauaucaauucauaaaaagaugccagauguuuuuuuacaguugcauaaaaugccauuguauagauguacugucacggcccuuuguaaguguggaacuaauuuaugauguaaugagauaauaaugaauaauuaauugcuguaauaagaaagcaaugagauugcauucuuuucacagucuuggccacaguauguuaucacacuuuuggguucucauauaucuggcaggugaaaauggucauuucaacauaguuuuaauuuacaguucacuuguuauggauaaagaagguagaguuauaacuaguauuagggaugagagaagcgucguguuauaacaagcauuaguuuguuuuuuacucuuuuuuauuugaaauacaacggaagugcaaaaaaguacauaaacucaguuguauacugcaagaacgauagaacgauuauaaagagaacagcuuuguaacugccacccaggucaagaaauaugcaaaaaccuccccccauuccccuuuccuguccucaccucccccaagggcugucuccugaggguaaccacaagcugauuuuuauguaauccugcaguugcuuuucuguauacaucccucaacaauauaguuuaguuuugugagguuuuggacuucuucuguguaucauuccaugccuuuuuaaguucaguucuguguuguuaagguugauccacccugauauguagcugcguucauuuccuuugcuuuggagcauuccuuucuauuguggcaccaugauagguuuuucauucuucuacugaugcucauuuuaguuguuuccagcuuuuggcuguuaggauugugcauacauccuggcccacauguguacacuuccguccaggguguguggauagucagaaguggaagugcuggaucacaggaggugcauuucuucaauuugaugugauacaguccaguuguuuuuagcaugguugcuccaguuaccauuccuccucccaacccugcuaacauuugcuaucaucagauccuuuauuauuuuuuucaauuugaugguuguaugauaguaucgcauaccagcuuaauuuuuagaagcuucauggagauguuuacagauaugauucacuuguuuaaaguguacaauugagugguuuuuaauauauuugcagaguugugcaaucaccaucacaauuuaguuacugaauauuuucaucaccccaaaaagaaaccccaugcccauuagcagucacuucccauuuccugccaaccccccuaauccuaggcaacugauugucuuucugaauauauggauuugccuauuugagacauuucauggaaucauacacauguggucuuuuaugacuggauuuugucaccuacaugauuuuucucaaggcucacacaaguuguagcauguaucagcacuucguuccuuuauguugcugaguaauuuucuauucuauacauacaccacguuuuguguguccaucagucaguugauggugauuuggauuguuuccgcuuuuugacuauugugaauaaugcuacugugcacacuuguauacaggauuuuguauagacacauguuuucauuaaccauagugguuuuaauuucuacguccuugcuuccuaauugaaguugagccccuugccguguguuuuuuuuuuuuuuuuuuugacauuugauauuccuuuaagaaauaucugauccgguuuuuugcuuaccuuuucucuggggguaucuaucauauaagcacagaucuaggggcauucuucauuguuacacgccuugcagauaucuugucccaacuugggcccauuuaccucuugaauggugccuuuuuaugaacagaaauucuuaauuucaaauagucaaacuugucccuguucuguggucagagguuuugccucauucuuuaccuugagaucaugaaaauauucucuuccaaaagcuuuaugguuuuggauuucauaauugugaauuucaaauaucagaaaaucauagaaguaagacuuggcaguggggaaugggaugaccauuuucaucgguccuugcugugaaguugaggcagcuaaugaguuccauacacaccaagaugguuuuucagaaaagcuucuuucuaucuugcagguuaaaauugcauacauuaacuuccugaaucacugcuauguggauacagagguggaaaugaaggagauuuauaccagcaaucacauguggaaauuguuugagaauuuccuuguagacaucugcaggguaaggcuuuuggaacugaggaggcagaguuggagagugagagguguguguguguguguguguguguguguguguguguguagcaucuuugugcacacaugaagaaaacagcugcaucauuucuacucuaauccguggcaugaggaggcacuugugacuuucuucucauguauccuuucuuccuuuuuuuuuuuuuugagcuggagucuugcucuguuaccuaggcuggagugcaguggcacaaucucaguucacugcaaccucuaccuccugggcucaagcaauuauccugccucagccuccugaguagcugggauuacaggcaccugccaccaugccuggcuaauuuuuguauuuuuaguagaaacaggguuucaucauguuggccaggcuggucuugaacuccugaccucaaaugaucugcccaccucagccucccaaagugcuaggauuagaagcgugagccaccacaccuggccauucuuccuaccuuuugcucuuagccgagaauggauguuauuuaucaaucugcagggaagagagguuauuucugguuuucaugucaccccuguggauugguuggugaaugauaaccugggcauauuaaaauucaauuuauaaggauuuauuuuccuugguaauaugucugugcuugaagggcacuucccugagcuugagcauuugucuccugcaaucugaacuugaggauucugcaaaacucuucacuuccauuuacugcuuuccuggcucagccucaagaguggccuuaagauacuucauuugguuuugcauugggccuaauauucaugcuaaagccacaagacugccacauaacaagcauaccacagauuuaaaaugaguuuugugaugguggaauuuggcaagcagauagauuaaaagauucuuuagaagauaauugucagauacauaccaguuucagaaacauuguggugugaaaaaggugcacuguagaauccuagaaugugguauuuucugcuugacuguaugauuacuagugugagacagaagccuauaagaacuuauuuuccuucugagugagaaccguauuuaguaauauuuggucagguguugguuucacagacauauuuuuuuaaaaaucucaaacuccuccuaguuuuuuaaucccauuagccuagggauuuuggcuuggaauggcaggccugcuuuauuuguuuaaaucagugcucugugaaauuuucuguaaaggaccagaucguaaauauguucagcuuugugggcuguucaucucuuucaugacuacucaguucugcccuucuagcaugaaaguagccauggcaagcagauuuggcuguguuccaauaaaacuuuauuuauaaagauaauuacuggcccugauuuugccgauccuugcauuaaauuacuuagaaaugcuguaaaaucaguuauuaauaucauucuuggaauauguucucagacugucuaguuuuaaggugagaacaugagagucucuuagaacacuugauuuuuaugucauucauucuuuucagcauaagcaauuuuaucucuuaaauuauagaacuaaugaauucaguaauaaaacuugauuuuuuaaaaaaugugcuaacccucucaauggcaaaucuuauucuaggcagcagaauuaagcagaguacgggugaaaucguaggugucuccucaccccaaaacguguauagucaguuauucugaaauauggcuugcuauuuugaacaauguuguguauuggucagauuuuaauugaauggaagauuguuguaggauuggagauggucaggccaggugugguggcucacaccuguaaucccaguacuuugggaggccuaggugggcagauccauugaguccaggaguucgagaccagccuggccaauguggcgaaaccccaucucuacuaaaaaaaaaaaaauacaaaaauuagcugggcaugguggugggcaccuguaaucccagcuacuugggaggcugaggcacgagaaucacuugaaccuggaaaaugaaggccacagugggccaagaucaugccacagcacuccauccugggugacagcgugagacucuaucucaaaacaaaaaaaggauuggagacggucagguccacaggaccucaguaacauuugacuauuuggaugaggaaaccauggucuagaaccgaggaauggauuacucaggagagcaguuuucuuuuaggggaaauuuaagacaccuguagucacugugcuucuuacugccguuugggguuuuggauuuuccagacacacguaggaagcugcaagcgguggccuuguuggucucauacccauuuuaauguuugugauuuugcaucaugauauccaagcugaucugcuucucuuuuuuucaugauuuauauuuuauuauuaugauuccuuaaggggagaaauauuggccagcaggccuuuaccuuucauuuguuaaaaguaacccacaggagggagucgcagauuucuuaauguuugguguagguuuugguguaaugcuuaacauacccacuugucuuccaggccuguaacaacacuagugacaggaaacaugcagacucgauuuuggagaaguaugucaccgaaaucgucaugaguauuguuacuacuuucuucagcucucccuucucagaccagaguacgacuuugcagguaagaaauaaccaacgucaagcagaauguucacgauacaccuucugcaguugggcuugaugugaauuugggaguaagcaauuguaaaugaacuggucugcaaggcauuaauacaagauauauuucucuugguggaagauagcuuugaugggauuucuuggguaaagaaguaccuggggauauuuucuuauacugaaugguucuguuaacuguugauuuucuccuugagaucuuuucugcuuuuuuuguccuccaguccucugcuucccugcccuccaauccuagagauaacauuuauaaaacaucuagcacagugccugacacagaguaggugcuuuaauaaaugguagccugugcuauuucugucagacuauaagcuacaugaagacaaaguuaugccuuacaugcauggucaucucauauacuacucuaucccuuguaccuggcauugugacuggcacugaguugcuaauuuguugaacaaaugaauaaaugagacucaggagagcgguagagaccagagauaaacauguacugguugaagccuuagccaggaaaaugaagcggugaacgaaaagggaccuggagagaacacaaauaauggaggaugggauguaaaagaggcagaacaagaucaggaguuuucaugcaggcaggaugcgauuugggaccucaggaaugaagaaaggggaggauuuuaggaaaaaagcagauggugagccaucguguccuuuugcucuuccaggagguugagugagcugaugucaccuguauuagugcauuuucacgcugcugauaaagacauacccgauacugggcaauuuacagaagaaaaagguuuaguggacucacaguuccauguggcuggggaggccucacagucaugguggagggugaaaggcacgucccacauggcagcagacaagagaagagaacuugugcagggaaacuccccuuuauaaaaccaucagaucaugcgagacucauucacuaucaugagaacagcaugggaaagacccaccccacgauucaguuaccucccaccaggugucucccacaacaugugggaauugugggagcuacaauucaagaugaaguuuggauagggacacagucaaaucauaucccaccagauugccuguugcguuuggaugguuagcagguggcuacucuuauccauuuaaucaucuuuuguacacugaggugucaaauaggagcagaucagguguuccaggaauaggguucaguggaauucaucuagucaagagacacugcuuucuuugagcugggcuguuggguucucaucccaaauccagcacuuacuggcuaauagggcaggcgauaaugcacugcuuccuucacagggugauggugaaggcuaaauauguauaaagugcuuagcacagagccuggcauguaggaagugcuggggguaaaugaccguucucauugggcccuuugaguuagcuccagagcuaacaagcagccacaaaacucagggacuaaauccuagguuuccccugccaguuucccgggcugccucugcuccuguccucuauuaggaacacagcuuacuaucuuggguggcugcaggcaauaggacagaaaguacuuccugaagaaggcaaugagauucuggcugccaggugaacuucauggaaagagcauggagguuugccaucagagacucuugcaguugaccuccugcuuugccgucacuucucuuuucuuuuggauaauuucuuuuauccuugcugggccuuuguuuuucaugcgugacgggaagguaauuccaagucacagaauuguucacugaggccugaaugagaucauaugugaaaugucucacacauagcaugcccuuaauaaauggagauuaucugaaccauguuuaucagggagguucugaauuuuuaauuaaucuuuuuuauuuucuuaaaauagacuuccuuucuccccugacgcuuuccuuuuucuuucaucucagagaccucuuucgggguuuucaauacuuuuuucuuuacuauauuaacuuccgcuguuuuuagaggggcuaugcaaguuguccccucugaaacgaaaagaccaguugaauagcgcagcacacacagcuaucuaucuuugccuugcugguccaaagcuacccuuugaauggagaccaaaacuauaauuuuuuaauguacucagaaagucagugucaaauugauucaguggauguuugaguacucuuacuuuaaaaugaguauaaauuuauaccuuuguagaaaggaauaaaucuucucauguaacuucgaaguacucaucauaauaaaugaauauuuauaaagaguaacuauccgaauucucuuuaugucauugaagaccuugccagaaauaaagaaguagcagucgaggugagauccacguaucaguuuguuuuugcugauuaaagacauggguucuacucaguggauauaaugucuggaaggaacuuuggggucagucugccucaauccacuuauuuuauacauuggaugaaacugaagcucagagaggugaaguaauuugccuaaagucaugcagcugcuugguaacuggauaagaauaccagucuuugaacuguggauccauugcuccuucuugugcucaaacuuaguuaaaauagcaucaaguuaaugcauugcccuaaaaugcuucugaguugcucucccuuggcuagguaacuuauggaauuuagcucuuauccaggcauccccucucacccuugccucaggguccauuaacaaggcagugucugucucugaucugggguccagugguucaagacaaugucucugucucugaucggaucaucaguagucuacaaauaaaaaucuguuuuucacguugccucuuuuggcuucuugcagacucgccagccugucuuugugcaacugcugcaaggcguguucaggguuuaccacugcaacugguuaaugccaagccaaaaagccuccguggagagcuguauucgggugcugucugauguagguaagauaccaagucaguuuggauauacgugaugaaaaugaauugucugacaguaguaaggcugccauuuauugagcacucauuacaacucuucuaaaguuacacagacaggaaguuucagagccagacccggaaccaaggucuucuugauugcugggcuucuuuuuuuaucuaccaagccagcauuucccaagggaagagccagugaguccuaagucagauaggccuagauaaacaagcuuccaugguuguuaggcaauucuuuggcaaguaacgauacacacagcuuauucaaggcccugggaagucccucauucaagaaacuaauuuguuuaauccagcaaauguacuugaccaugugguaacuuuuuccuggaaagcaccugucacauccuaaggaacacccuuucucagaaauggugcacugcucccuucuuccccuugaguagaaaugauucuccauuuccucugugacuccccuccugucccgccucucauaggcagccuuugaaaggaaguuaggaaaauuucuuuuuccuucauccugacuuuaucagacuccaugacuugacccauuccccacccccuauuaauguugugcaaagagguaagcuuccugccugaaguugagaagagaguuaccugccuggaguggccucuuagauccuugcagacaguaacaagaagagcaagacagguguaguucucagcauuauuuaguggcuguccagcaacugucaauuguguagguaagauaucaagucaguuuggauauaccuugggagauacguauaaucuauuaggacuguugccugauuucgguagucucucgcccaguuccuuuacucuccuaugguagguguugaugucuuuuuauuauugguguggccguauuucacaguaagaaauuagguuuuggaaaauauauacacgacagguucauuguguuauaucuuagaaacagggcccugcaaugaaauucccagauaacccuauacuuuuuccauacaggauuaucuaucaaaaagaaugugccuggugaacuaauguggaaguagaaagccaaauaccacacguucucacuuaaagugggagcuaaauauuggguccacguggauguaaagaugggggacuacuagagggguaaagggggaaaagcguugaaaaacuaccuguuggaggccgggcgcaguggcucaugccuguaaucccagcacuuugggaggcugagacgggcagaucaccugagguugggaguucaagaccagccugaccaacauggagaaaccccaucucuacuaaaaauacaaaauuagccuggcauggcggcgcaugccuguaaucccagcuacucaggaggcugaggcaggagaaucgcuugaaccugggaggcggagguugcggugagccgagaucacgccgcugcacuccagccugggcgacaggagcgcaacucugucucaaaaaaacaaaaaaaucccuaccuguuggguacucuguucucuaucugggugauggguucgaucauacccuaaaccucagcauuaagcaauacacuucugcagcaaaccugcacggguacccccugauucuaagauaaaaguuggaaaaaagaaaaaaaaaaguugugcuuguugaggccaaaggaaacguaggaggaagcccuugccacagagguuaguuuuuguuuaauauuuuagcaagugguugacuugacuaguagcucagugcucauuagagaggggaagucuuuccauuugucuugguggugauaagacaaaagacaaggagaguugaugucuguggaacgguaagacaugaaaacagcacuacccagaguccccucugugccucuugggggucgcuuccucaugacuaauaccacacccagaacccacuguguuaguuguuuagcuuaugaauauccaaggcauagaguuucuagcugugacggguguacccugugcauccugcuuuucaauuguuaauuauuuguauuuuuccaaauuucccacuuucuauauuagacuguuagaaaguuguuggcuggcuuauaguuuuuuuuccgcuaaauuguguguguguguauguuuuuaaaugggauuuaaauaauugcuucucagauuccucuuucaggauguuggaguuguuuuuacaauuagauaguugaguacuuucuuugcuucuaguguuuugaagcauugaagacaggaaaucauuguuuuuuggacauuuucccauauggaaaagagugauuauuagucuuaauuaucuuccuuuucaaaaucuuuuauuuuggaauaauuucagguuuaugggacuguagcaaggguaauacagagaguucccacaaaucccucacccauugucacccguugucagcaucuuacauuagcagggcaccuuugucaaggcuaggaaacugacacugguacagugcuauuaccucaacuccaggcucgauucgaauuucaccacuuuucccacugcugucccuugucaugcccuuuuucuguuccaggauuugguccagguaccaccuugcauuugguugucaugucucuccagucucuucuggucugugaccauuucucagccuuuccuuguuucuuaugaccuugacagucuugacaaguacuagucaggaguccuguagagugucucccauuauggguuugacugauguuugucucaugcuuagacuggaguucuccuuuuuuaagacgaagaaagaagcaccuauccagaaagaggaguuuaugccauugugaaugcuaccuuuaggauuauguuugggauaacccagcauuuuuguagauuguugaacaaaccugaaaaauaacuagcaaaugauucauuggccaaacgaguucccugucuugauuauucuuaaaauacacacacaccucagugacccuaagaagccauucauugaggaaacccauugaacuuuaacucugacaugcccuggccuuaugaccugagagcauuuuaacauuccuaagaacugcuuccccccagaauucacacugggaaacccugaccuaaaagaugguaaaguugacuugagcuucucagucuuuaagcucaauaccaggcaagcuggcccauucugggugugaaaaaccugcuggauggggacuagggcauuacguccaucuguagggugucccccauaaaaguuguaggcucacgacucaucuuucuccugugcagccaagagccgggccauugccauucccguggaccuggacagccaagucaacaaccucuuucucaagucccacagcauugugcagaaaacagccaugaacuggcggcucucagcccgcaaugccgcacgcagggacucuguucuggcagcuuccagagacuaccggaauaucauugagagauugcagguaaugccugguguugagagaagugaugcuuagccuggccucacgugauugccacacacagcagugcauccuugagccacagagcaucuaagcugggccgugggaagaugucggugugcugaacgaauagucaaauguuauauauguagggccaggagugggaaguuacuuaggaauagaaaaguuccugaaaagugauggucuuuaaagguuacuccuagauuugcagauuucuuggugaaaaauugggacucugcucuuauuagaaggaaguauugaaguauuacagaggauguuuagaguaagagcauaaauguuccauuuuccccaucacucugggguuauuuagccucuugaaucagcaggugaacaaggguggugauaccugagagaagaauuuuacaucagaaugagccagauggaaacaaaaguauuccuuccagcuagauuauuuaccuuuuuucguagaaucuaccaagacaucugcucuccuuuuguuaaaggggagaguagugaguauuagauguuaagcacuuaaacaugcaucuuaacauuaacguauuuuuuauacaagcaccucaguugaugcucucacagguaguacauaggucacaguuugagaaucgcagauccuuugaaugagcccacaagcaguguuuaagaguguagucucaggccagugccuggguuaaauuuaaauccuggcucugccgcuuagaaaugguguaaucuugggaaaguuacuugacuucucgguccuucagauuccuagucuguaaaacaguagcaccuaccucgugggguugaugugaggauuaagagaguugauaauaugucccaguuaccuguauuucgugcaguaaaucacaacaauuaccuuauucucuuuugcucuucuggagguugacugggcuccgcuagcuauuucuugcuuagagucuuucauggcguugcagucagauagugacugcgguuggacucaucuugacaccuugcucacucgcauauuuggcaguugaugcugguugucaggugggaccucagcuggaguugucgacugaaacaucuccauauagccugggcuuccucacaucauggcggcugugucccaagaugaguguguguagagagagacaagugaaaacuuuauuguuguuaugaccuaguuucagaagucacauagcgucacuuuuacuguacucuuuuggucaaggcagucucaaagguucacuccaguucagggggagggaaucuagaccaucauucagugaaagggaugucagugucacauuguaagaagaaugugaaagacaggauguauugugguauagccaucuuaggaaaauagagugcacauaaaacacauagagcagugccuggcauguagugagcacucaguugagggcugcuauuauuauuauuacuauuauuacuguuguuuacugcuaugauuguaauaguuacugagucucuguacaguuacacaaccuacuugaagacagaugaauucguuaaaucauucaucagcuccaugcuaggcucuggggauacaguggucagcaaaaccagaaaugaugaucuuugucucauaguaucucaaguaucagaagggagaaagagacauugauuuuaaauauagaauggugagagggacaagugagaagugcagagaagugaggagcgcuugaaagauucugaugaggaaacuaauuuugucugagguuagggaugagggucaaggaagaccuugcugaggaaaguaacauuuugaaccaagaugagaaggaacagcaggacuuaaagaauaaaagggagggaaacagcauguguaaagaccguuauaccgaaaagaagaugaaaauaaaaguauuacucaauuccagcuagauuauuccuuuuuuuucuuagcgucuaccaagagaucugcucucccuuuguuaaaagggagagucguauuagauggguguuaaacacuuaaacgugcaucuuaacuugaccuaugaaacccugcucuuaugagcaaaggaaguugaguguggcuggagccaggaagcuggggaggcuggcgggauuucucgggucaaguuaagaauuucagccuuuaucauaacacaaccaguucuuaaauaacaaagagaaccaguucuugauuccugauggagugcuuccugaucccacuaugcuuuuagaaaggcgggagggauguuguagacuccucacuccaugagcauacaguauuuucucgccugcucaaaugaaacaaacuaucugcaaucaaacaugcugguuucuugugcucuucuuagauuuauuaugcauauucuugggaaguuaaaugaaacgcguaggugggcaguacuguucuaaggacuuggccagugacguaaaggauuugcauuauccaguuauuuacugucugaguuuuugugguugaugagauugccuagugcagcaaaaguuguaauauaagaaauucacucgcaaacagaccacuucuauaauuaauccccaucuagacauccuucucacuuaaugcuagcaucuuuccccgcccauugcuuugccaucuuuguugaugucuccuugauugcugaaugcuauacauuugacaguacaaugcaaaucaauugcaauguaaaguucaaacugugcaaaagaugcaggauuucaugaaauacaugaacaugauaagaacaacuuuaauccuguguaaauaccguagacaaagauuugccagagucaggaucaauaacuauugaagagaauauugacugggugcuuccaaaagggaugcuauggggggaacugauaagagccucagaauuuugcagaaaugacccuuuuuugacugugcugugaaagucaguaugaacuaagggauguugcaaaguaccgucuuacagucuuguugggaaaauugccccacucaaaauuauuugauugauucauguaucuuuaugcaucuuaaaccuuacugagugauuacauucaucacccaaauuguguuaaaucuaagauuaaauuaucuucaugucauuaguuucuggaugaaagauuaguuaauucuuugucaaucccaacugggucccaauuuaagcagcuuuucccaugcaaauguccuuggguaaccaggccuuccuguauuauccaacgugcuguguuuggccccugucuuagccaacaugccuguaggcagguucugagucaccaaaccauggagcaggcuuuagcaucuuuugaagauaauuucucaucuguuuucuaucauuugccuucaaaugguguuuguuguguugguuuugcugcucuuucaacuucucucuguuuuccuuuccuacagcuauguguuuugcauuugaagaccaucaugcuaucaggguacauguauuuagcauguugauacagcauguucauucauugguguccucauguuuguaugacuuuauuaugugaauaauucaugcucauugaaaauaaacaacacugacaaguauuucuauauagaagaaaaucagaaucaccuguaaucccaccacccagagaaaaccaguaguaauguuuuaauauuugauguuuauccuuuagcuagauauugaugauguuuauaaaaauaggauuauuauuguuugaccuuuguuaugcccaugucauagacaucuuuccauguuguuaaauugauuuuuugcgucauauuuuaagcuacaugcagugguaccuugaguagcauaagggccaccuugaaagaagggguggugggaaaguugacuuguuuucacuuuguuuucugcaucagaggcuaauguuucagguaaccauugggcaaugucuaauaauuugagaugccagacgguacuaaaguuacucuaaccuagccuacccgugcaucaguguuuuagggcagaaaucaauguccucacccuccuguggucagcgucugccugagccguugacugaggcuguguuuccguuuuaggacaucgucuccgcgcuggaggaccgucucaggccccuggugcaggcagaguuaucugugcucguggauguucuccacagacccgagcugcuuuucccagagaacacagacgccagaaggaaaugugaaaguggcgguuucauuugcaaguaagcggccucucucucugggguguucauuugccagaaccuugaugaccucacaaagcuuuuguucccgaagaaggagacguuguccuguuuuuuaacuuugaugaaugcaaggucaugugcuaaaguccuguucugaccuccccaaaguaaguuugucuauuaaauccugcuuacugacacuuuuuuguuuuguuuuguuuugcuuuguuuuuuggugagaaguucuuauuuucacugcaugcccauucauucauucauuacagugcacccaccgugugcugugguacagacauaaaaaagccaugaucccucagcccucagaaaucucagaucuaucgugaccucaccaucuuuuccuaauaauuuuguaauuucuuaguuuaugccuugugcguaaucuguaagcaacaagcagacccaugguuagaaaucuccauuagauuuuugccccaaggccggacacgguggcucaugccuguaaucccagcacuuugggaggccggggcuggugaaucaccugaggucagggguucaagaccagccuggccaacauggugaaacccuaucuugacuaaaaauacaaaaauuagcugggcaugguggcgggcuccuguaaucccagcuacucuguggcugaggcaggggaaucacuugaacccaggaagcagaggcuacagugagccaagaucgcgcuacugcacuccagccuggguggcagaacgagaccuugucucaaaaaaaaaaaaaaaaaaaaaaaaagagauuuuuacccuaagauuaguuguuuguuuagcuuggggcuggacucugcaugugaguuucuuacuuuucugggccccucuaaggacaagcuugugcauaagggaacuguguguauuggccucaaccaucauccucaugaguuguuuuuguuuuacaguguuggcauauuugacccauuuuacuggcaauucucaguggauaaauagccacgcuuuauaaacgagcaggucugaguggaccucugucucgguucuccucuccauauaaucucuccauuguauguggcugacuccugcccagugagccuguuugcugugauuuaccagcaggugucacuauugagacacaguugcuaacuggcuguucucagugcagggaaugcccugaaguaucuuuaaccugagagcucuuaauaaauauuuguucauuaacggacuaguuaaaauaaauugcuugugaagucuuuuuaauuuaaaauuagcuucaaggaaguaauccgugguuuuccccccauucagguuaauaaagcauacaaaacagcugcuagaagaaaaugaagagaagcucugcauuaagguccuacagacccugagggaaaugaugaccaaagauagaggcuauggagaaaagguacugcauuuuauuuucauggucaaaccagguuuuacuaugaaacugaagggagggaccuuucaaaacccaccuuagcucaggcauuacugacugaggggcuagcuuuuuuuaaaagaaagaaagaaagaaagaaaaagcuguuuauccugccguuaaagggagcuaaaucauaugacugucuuuuuuaaaagucaaauauacuuagucgucucuuauaggcugauugccacauaaucuaaugucagagaagugguaauaacaagauuuuccaucuauuuaaauucccagugaggagcaaaugccucuuuuguaucaaaguaugcguuucugauuuuuagguuucagccaagcauaccuguggguuuacuugccucguucagaugagcuguugcgcaauccuuucagugcaucaagaaacgcccuccacuucuaacugcaauuaaggcaggcauacacgucaccacuucugagggagauugggaaauggacagucccgugaccugauuguucuuaguauaugcagugaacaaggauauaccagauccauuccuuacaccucugauguuggguagagcaggacagaaacaaugucauucccuuuccuuucagcccccagcaacaaaugaugggcgugaauugaaaucucacucauuuucauuugaagguaauaauguucaguaacggucagcuagcuacauuuagcaacaauuucugaguaggugaauaugcugauaucacugacuuaucaaaauacccaguaagucauuuuucagcucuaggaagaagccuugauaauuaaaucagccugccuugucaaaaucgaugguggcaaccagauugucacaaguauaaaugucugcaggaauguugcuuucuaaccuaucugucauuaauauuagagcaauguuacuagugagacuccuuggauaagaaaacagaaaacggauuuugcaguuucuuaguuuauaccacggggcauaaucuguaagcaacaagaguuccaugacuagaaauguccauuacauuuuuuagaaacuaauuagaacauagguuucuguaacucaguaggaauuuugcagagaaaaccugccagacaagaguuuauaaauauaaaugauggaagugaagaccccuggcaaggugagaagugcugggauggccuguucauaccuguauaggcaccuaguagaucucuuaaaaacaagaaaagaaaaaaggugggggguacgggggaaggcugauggcagagaauacacuuaccagacaaauaaauauuaaccauuuauuucacaagaucuucauuucucuuaaagugaguuuucagaaacauuuauaaaauaugaaucuaguuacagaaacuugcucuccauaaaaaagguuaaauccaccaaagcugagugaauauuuuugcauccaugggcauaaaaccugauuuuucaaaucuggagaccacaauuuucucuuauuuggaauaucuauuucuuuccauaaccgagguauuuaaaguaaacuucggugccucuauucuagugacuuacaaguugugauuauacaugcaguucccugcaguugucuuuuuauaaccuggaacguagaagcauuguccuggaguuuccugagucucuauugccuggcggacaaguaugucagggucuuugaggcuauguggaaggugugcugcccugcucccugccccuacccauuagugccaacugggagagcaucccagaccccaggggaugccgcaugagaaaugucguaaugcauguuauaaagcucauggagaaagaaagggcauaggguugagaggacccucaaaggagaucacuuggaaagaguaaauuauaucacaguuuuguagagguuccuggggucuagcuuaaauccuuuucagcuggugaagaaaucagucacaccuaagcagagaggcuuggagaagagauggccuuucuuuccagucugguuagggcugucauucccauccaugaaugugaacaaacuauaggccagcaaggaaaaugccaugaaagcaaggaagaugcucuagaaacccauguuagccacuccaaaccugcaagacuugucgugcuucuggcccaaugcuugacugccaggaaaugcuacuuagccauuccuauuaauugagcuucaaaagagagagaaggagaacaagggacacuaaaguauuucugucuccugaccugguagcugguauucacuuugucugucucacuaaggcuuuuugaagaugcuuuuugaugguuuacuggcugccccguuugacuaaagaagcaugacgcacagggcaggccgacuuuuucaagggcagaaauaacccggagccaaagaacuaagcuuucucaagcaaaccaguuggcuugagucaauauaauaaaugagguguucuuuggccugggugcugaggacgacaccacggugaguguggaggccguuucccuccucccaucccuguuuucugaugaguggccucuuauggagcuugucccaugacugacacuucccuggugauguccagaauuguucugcuucucugcccucuccugagccuucaccgccaaagaaucggaucuggaggggcccuggcauggcuucuuccaacucucccugugccuacgaggaggcuggggcuaagagcugagagacugcccgaggucacgugugaagucuagaugagaucaagacuaccgucuggguuucccaaaucccugugagguguccucuccagccucuccugaggugguguccaccaugugugggcuggguuuucuugccuuuuuucuaagcgauaauccuuaaagaugacgagacguagguaccuuuacccaucuuuacuuuuucauucaacuuuaguacuuagucaaggucacagaugaaaaagaaaguugacaucauucuuuauuauccuguucaaaaacuuuggcgugccuguuugggucucccugccuuggggaagaaaggccaugaagaacugucacccauauuaccaaauagacuaaaacaugauagaaucacuguaagacugaccuacacuuuuuaaaagucauggauauucacuaguuuccuagauuauaaguuacaaugauaacauugaucgaccucuugucaugugcuagccacuauacuaaacacaucugccuuaucucaguucagccucagagauagauaccacuauugucauuaacuauuuuauacgcaaggaagagaaaacauaggcucugagagcuacagaauuugcccgggguuacauaguuaauuacaaggcaaccuggcuuucaaacccagacaguccgauccuagaguccuagcucuucaccacugcauuaucagugaacagauggacaccauuugaguguuuugagguccaccuacagguugaaccuguaaguuuccuuuauguuacacgauuauguaaacaauagugggcauuagcccugagagcacuaaauguaucaaaacuuaaacaucuagucuucagcucauugcugauuuuucacacaguugagaacacucuccaauagacgccaagugcauuuacaaagugugauugucccaaggucauccaaaaccuguaguuuuggucaguucccacacagaggaaucagacuagugaguagcaagugguugguucacuugucuggguccagugcccccaagaagugccuguucaagaacuaucauggccggauaugguggcucaugccuguaaucccagcacuuugggaggccgaggcggguggaucaccugaggucaggaguucgagaccagccuggccaacauggagaaaccccgucucuacuaaaaauacaaaaauuagccugacguggugccacacuccuauaaucccagcuauuugggaggcugaggcaggagaauuacuugaacccaggagguggagguuguagugagccaagauugcaccacugcacuccagccugggugacagagcaagacuccaucucaaaacaacaacgacaacaaauuaucacauaugaugaaagguaggggcugacugaagaagauggccagagauuuuaaucaugaccacuuaggaauaaaaaaaaucuuuaauucuuaugucucuaaaaugcaaaggaccaccaaugcauauacuucucagaucguuaaauauaaaauaaauauuaaaauuaucaccaaaauaaugaugaaauacauuuuugcaugaugcuuauagugucuuuugguccuguguauucaaaguuaauaaacuuuaaaauuauaucaggacuuuauaaacacucugugugcaaugccuacuaaucucugcuuuuaaucuacaguuuaaaccaugucuguguugaaaagaaaauaaccucccacagcuaaauagcucuaaaauuuaaucugaaucacucucuaacucagaaaaucuucaagccccuagacccugcuugagaaggaaacauaauuauuuuauguauuauuaauaacugguuuuguuuacuguggguuuuuauuauuaaacugcuguugacuuaaguuauuacucaaagagcuuuggaaagaaauucagaggccaggaauuaauguaaaaggauaucuuagaauguauuuaaaauccauuucccuucugaauaguaguagcuguuuuaguacuagaaaguauaugaccucagguaaugccuggguuuucauuucauacaaauugucagucuccuauuaauuaccaaagcgucuuugcuccagcugaguaaaguauuaacauuuccagcuacuaguguuucugacagcaacuuaaauuugcaaaacauacuaaauguuaacaaagccuaauaaaaaaucaguugaggaucauccaacuauccuuaaacaagcguaauugugauacuucucuugugcuuuuguuuuucuuggacacgaugcugauaaaucccaugucacuaauaucacuugaguuggcacuaaucauccuagagggaauauaguuuccuuuaaucauccacaggaccaggcuggggauaugcuggucuuauuagcugcugaaguuacagcugguaccguuugagcuucugacccccgacugagucauaaaaugaagcuaaggaaagaauuuucuucuaaacugggcuaauucuacucuagucuuucacucuacucuuucccacccucuucggaaaaaaacauuggggaauuugcccuugcucccagcucgguucauguuuucauguccacaagcaagcacacggcugucugcacaugugguuaagugaccugcgaggucugaugccugauaugugaauaaagcguggcagcaucguguccguuuugguccugagcagaugucacugugagcucuggccguguccuaagcgcccaagccucuuaggaugguuacccaucuagcaaggcuuuaaggagaaacgucagcaauaagaguaaagucuauaaacuuggcuggcuuguauuuccuuuccuaacauuuccuucucucucucuccccuuuuuucuuuuccagcuaauuuccauugaugaauuggauaaugcugagguccuaauuuuguuguuuuuuguuuuucaugucucauggugguguuuccgugacaccuucccaguuagcccugugauccuuccucuagucucacagcgucgaguaucuggcuuuguguggugugcccucugggagugaguggagucugucgugucuguguuagcauuucccaugaguuuguuugccauuaguccuuggagaucucaucugagucuagaugaagacuuucuaaacugcaguaagauuuuaauuguucacugucuaaaaucucagcugaauuugugguugacgcuggccauuaaccuaucucugaaagucaguuuugaaauuggccuaaagaacuucucuaucugugaguaaagcaucugauacaaaacgauacaacagcauugguauaauuugaaaguaguaaaaaaggaaaacucauuacccucuuggucuacguauugaaaaguauugagugugagaguucauauaaaacuuuuuuuaagcgcagugugaauuccuacgugcuaguugagacuuuccauccgcaggcucaccggcaagguuagaaauguccuguauccauggcuucucuucuaggaaaacuauguauagauccagaaauugaauaucauccaguggcuucuguacuuauauaucaagcuaguuucccguacccagaauuaccauggagacugacuaguggucauuuuguuugggaucugggggccucuugaauguuuucuguuuugugcauuucuucaguauuccuugcuguauuuuuagguugugacacaugcuagguaaaugcuaccagaaaauuuuaauuugaggaauucauguacauaauugagaggguuucauugguuggcaaaucaagcaaacuggacaaaaacuuaauuugucuuuuaaaagucacuucucugaucuacuucagaucucuguuucuucuuuuaguagaccaacuaaugccuuuagaugagauagagcuaccaaauagaacaugcugucuacucuaguaucuacucuaauuaauacaccguaauuucaggaauacuaagaaaugguucagauaucccuaaggaggguuugaauuaccagcuugaaacagaaagcagcaugagugcuuauguugaauuuggcacaguugccuccggaauggagcucagagaggcuaagugacugguccuagcucacacagcuagacagugacuaaaucaggacaaacacguggcuggcuuuccugaugugcuuacuguucuaccacagucaauuccauaagcacagauuuuuccuuauauuaauuagacgggagcaggugagagggccaugccuucugggaagacuagaaggugagaaaaacaaaagggagugcaccaacuuaauuaacugccguuaacugcagggaauuuugccguuuccuguuuagcauuccuucuuccggguuauuuauaugccagaaaaaucacuucuaugcugaauuugauguuggcacccuuuaagacucuuguuucuacguagaguuguaaaugccucacugauuuaaauuuuuccucugaaauauugagguugaguuucuauuugcuuaaguacaaaugaagucgggaaaggaaaaccuucccuaaucagagucugugguguuauuaauacacuguuuugccccauaguaaucaguugauguguuugcuugcucaagauagaacuugggucuccuggcugggaguuuauugcucacuuauggaaagauuccacaguuggagcagguguguuuguaauuauacucuaggaaauagaauacugucuguuuauaaaagaggaauguucuggcagccacucagauucuuugaaaauucccugaagaagcaacuguggauccccuucugcguuguuccccuggcaacugccagcgcugggacaccgaugcccuguccccagccccucaggcugguggaucuggcccucucagcggagaugccuccuuggccuuuauaauugaugccguucuggaagcuaccacagcuccugugguuucucccccaccaagucguuugccgguguguacuccuggaaaccugcagcccacagcuggaguucugcagaagcuuaaugagaauucgugcuggcccgggauuaaggcagggccucacaucugaacugcguacccauguuccaaagucuaaaugugguggggaagagccccaaggcuguguagggccugcccaguggcccacugaggaagggacgccaugcuuugaucauaaaggccacuugaugugcaauuaaugacuugauaaaaaguacaaugccuacugaggcccugucagugcucugagaaaacagggugaaaugaggacacagguguagauuuccugcaagaaaagcgcaugguauggggucuuccccgcugcauucuagaauaaaauuuuguuugaaaccaggaagaggagggguuguuuguuuuuuggcaagcaaagaggcagggucuccauccuuacccccugauuuuucuuaauccccuggggcuggggcagggggacagaugggguggaggagagagagaaacuccucauguuguuguaccuuccgcucagagcugggugaauuguuacacauguguacaccuguguagccgccaccuaaaucaagacacagaauguuuccaucaucccagaaaguucccuccucuagccauucuuggcuugaaagaguuaacagcuggugcuaaagacauucauuuauaugacuaauauuugagugccuguuacguccagggggauuuggauacaguggugccccaaaugggcacagugucugccauucuggagauuacaguuuuguggggggcaaagggacaauaauacagauucaugcaagaugacagcucucagcugugagacacauuagaaaggagaagcucauggaauccggggacuucuaccuaagcagggaggccagguagcggcuuaggagaucaggugaugacaggugaguggccccaacagguaaucaugugaauugcuuuccuaugcuuuaaagugcugcacuaaucaaacggauaguuccagcgaaguacucccgagguggugagcagaacaguaguccaccuaguuuucauagaugugucuguagaagggauugguguguuuagaaagcagguacugugguucaguggacgugucuguuucuacguauuugagaugugauucccacugaaucacugccuccuuggaacuguggaaucucuggagccauuggugccagcuagcaacuuugcccuccugcauugcaacaaaaaagcuaaauucacauuccagcuacucagggcggcugcagccugcauauguuaacuccucgacuucuccuacuugagcugcuucugccggcaaaagaugccauuguaaaauucgagguagagggggaaacaggagaaacaaagagugauuaaauuucaccuucagggggcguucucaugacgcccaacccaggguggagauguccuacuuuuuacauugcugugaacugcuggguuggguaccugccaguguucaggcagcaguuacauaagagcugcuuuuuuuccuggaauuuaggcucacugcugaugugugaccuucagcaguaauugccaauaaaugcaguggggcuguuuacuguuagacacuggcaaccacagagcaaacucaacucagaacauacagaaccuauugcaaagucaguggagggauauauauauauauauauuuauauauauuuauauaugucuguguguagauacgugugugugcguguauauauauauauauauauauauauauauaugcauaucacugagauuauuccguaaugacugaaguuguauaauuuggucaugucagaauguguuuuuaaaaaaugaacuuugcuauuggguucugaugagcuuguccuauaaacuguaggugaaaccacauuguuggagcuaaauaauuuuugcuuaguucuguuucuaaaaacaaauagaguuaguaaagauaguugucucagcagauaggaagauuuaaaguuguucuacugaaaugcuagauaacuucuauuuuagcucaauuuucuuuaaagcuuucuguuuucuuaguguggguuuucagaggcugaugcaggaucgggcccagcaaacauauuugcaagccuguucacuguuggucuccucugagguuaugagugaguggaaaggaacucugaagacugauucgagcggcuggagauacaaauugucuuugauuugcugauaacuagaucuacgguacaguuacauuuuuugaauugcauucgguuucuaucagguuagucauagaaagagacaucccauuucaaaggaaaauucuagaagccccaggguaggaaggggauuacugcugagggcaguagaaaacaaaggguauuugcaggccgcgaucugugcuggucugugauaggcacacaugaagcggauggauggaugugcgugggugcuguugugcagacaccagaaauagucaccuuaggaagucugugugcuccuuuucauuuaagaaugauaaaguauaauuucuuucauuuguaguagaaauuugucccuugauaaaaugcuggguacauuauguguugcaagugaguagaucagugucgcauaugcauauauucaguuacuacccaagguaccauaaugagggccugauucguggccucauccaggaaggacacuuaagauucagugacuugaggugcaguuugaauuucuauuucaaagccauucauugggagucauuuuucuauuaaguuagguuuugcucaccucgccuaaaaacacugggaagacaagauugcagaguaaauaugaagaggcaguagagggcacuaguugguuucucaguucaaaaccagagcacaucagaucacuaugaaucgccugcugaugugugagauuggccuugacuggaggugccagcgccugaacgcagugacugguccugggacuaagcaggaauacagaacaugggaauuucagagagcccgugcccucaaaauguucccccuaaacacauguucaaugagggcuucaccuuucauguaaaaaacgugacaauaaaaauauaauuccauuuauucauuuacuaaacauuaucuuuuccuugggguauuauacauuguauuuauacagaucuuauuugaacauauauauccuauuaauaugcuuauauuuauugaaauuacagcuuauugccauaaaauaaccuuauccucaaggaaacauagccaacauccgcauuagaaggaagugcuaguauaggcuaugggugguuuuaccgacuuagauaccauguauggccuggccccuuccaugccuggcccauggguuggauuauuuagggaacuugccagcuagauauugugaaaugaaauuuacugaaaauaaaccaaggauuaauuaguauuuuaguuagaaggaauccuaaagaauauuugcagccauguguggugacucacaccuguaaucccagcacuuugggagcccgaggcaggcggaucacuugaggucaggaguucgagaucagccaggcccacauggugaaaccaugucucuacuaaaaauacaaaauuagcugggugugguggugcaugccuguagucccagcuacucaggaggcugaggcaggagaaucgcuugaacccuggaggcggagguugcagugagccgagaucaugccacugcacuucagccugggagacagagcaagacuccaucacaaaaacagacagacacacaaaaaaagaauauuugcuuuguccuccuugaguaggucaggaaguggaugcccagagagguucagugacuggcucagggccacacagagagccagagcuaaacccuggaugagccauagucacaggaugcucaugcagugcucugggguuuuccagucuauuccacgaagggaucacauugaaaaguguuuuucugguuagacacgauucuugaagaugcaaagcauccucuguuuucucaaacggcuucguaaaauuuucaagggaaaagacaguuauuaauuuaaauuuaauuuuuguuuuaagaauuaauuaaacuaauuuuagaacaagcaugacagcaguuuaacagaggaaauagugugucaguacaaucauaaaacauaaucccugccgggugauuaagaaauagauauauacuaccuauuucuauucugaaagaauucaagaugcuucucuggacaaagagagcacaggcaagagaauucaaacagacgacauacuaguuccaucuuuauuuucuuuugcuuuuguuuugauuggcaaagggguaagaggguagcuccgugcauuccuauggugaauccaugccuauaauucuuuuguucugaucauauuggaucaguauaaaggaugcuguagugggaggguuucccaugcaaauaguagaauauaauacuucugucuauaucucugucugcucuaaaaugcaugggaaauugcuuuaauucugcuuuuucucauauguucuuuuugcacuaagggaagauagcaaaaauguuuacacaguuuuaauucuuuagcauacagaauguaaggguagaguuaaaaaugcauucuuggauugugaucuuucuaucauuuugaaaauaccuuuaccugugcucugcuuuuacuuuccuuccccacucauguccuuccuaccaccagcacugucccuccccaccccgagcaggaggcugcaugcuucagagggaaguuuucucccugagauuaguggaguuggacucaugcaggaaaggucgucuguccagaauugagugagcaacccuuguugucuuugccgaaguaguuuaaugcccuggaucuuucuuucauuuucucuguugggaaauagacaaaagacagaaaucauuagauuacauaauauagcagcccuauauuaagaggcuuucuucccucuuggggaucaaacuaucaaaaggguaauguugagcuggacgaagacaccaccagauuucguagugucacucaucucaugcuuucaacaccagcccuggccugccaccugacagccaccuucuggcccugaggugagugugcuggagcccuguuagaggccaaggucacauaguugcagcgugagccucggguuugucucguggccucagacuacaccucacacuagucacaccgcuggugugugacuuuggucccgagaugcccagguggggucuggcaguuccaucugacaucucuucucugcuccaggcacauguccuuuuggagggcagauucacggcacugucugcagauggagcgguggacuuuucuccaggcacaccuuuguguagccccugcaugcccucucaccccuucccccucaccugcauguccuuucgaggcauccuuuuguugcucauccaugggcuggaaauuauuaaaucaagggggagggugguaucuguguggcauggcugggauggggccaggaaacccagaccaugaagcccucaagggaaacgcauggggugggaaacucaucuccaaaguaacccugagugcaggaaaccuuguuucucccagagacacuggagcagggagacugcauccccuaagcccaagcuggagccuaggucuucuucucugcuguaggacaggauguggagaauggagagacaugggagaaagccuaaacccacaggagacauguggcacguggaacuuucccaagccuugggccccugcuuucaucacuaccccugcuccccugagagccuccguggacacgcauacuauugcuuuccuugucucgguggacugagacaaggaugugcugugguuuuuccugucacuugcuuuguuuuaaagcaucauuccuccuugguuagugguagacuuuuuuuguuucuuucuuaucuuaaauguguucccccaucgcaggucgauugucuccuccagcacaaccacauucaguuugauuugaagguaucuggucaccuugauugcugaagcccacuucggcaggugauccagcaggguugccucaucucugauccuuccuccuguguuuuguccuugaguguuggucucuggacuucucuguggcccacgagaugcaagugccaugacuaacguacuucguuuuacucccaauuagcuuccuccagcuccggauucugagaacgccacugagguguguugcccgccuauauuuguagcgccagcgccagcaaauauggaugccucucaguuguccugguugggugucugaauuguuguaacaaaaagucucucccggugguagauguaggagggaggucucuaggcuggcugggaacagaucauugcugacguggauguggcucucaguguagaaaguucugaggagcuggauccaaacugagcauccuccaggugccaggacaugguucuuugaaaguucucacucagaaccaucuuaauccugagacauuuagcugagacaugugaggauguuaagaccuuucugcuguuauacaaaauugacuuuggguccugugcagagaugaugcacuuuugaaguuauuauaaaucaauaauaaagaauauuuauaauuguagaaaaagcuacuaauaaacuuguaauuuugcaaugcacuuuuaaaaauauuuuuauuuuuuugagacaaagucuuguugucacccaggcuggagugcaguggcacaaccuuggcucacugcaaccucugccuccuggguucaagugauucuccugccucagccucccggguagcugggauuacaggcaugugcaacaacgcucagcgaauuuuuguauuuuuaguagagaugggguuuugccguguuggccagccuggucucaaacuccugaccucaggugauccacccgccucagccucugaaagugcugggauuacaggcaugaggcucugcgcccagccuaugaugcaguuaaaaaaaaaaaaaaaaucuauccuccuugcugcuaacuaaacucacuaaaugaaggacuaacguuuacuaaggucuguaagaucauagagaagcuuuuuggggagacauauuuccaaguaucaaaauuuaauuucagaaacuauuccaaaaucacaguaguucaagcuagaaugaaguguacuuuauuugaaagaagacuuaaaaaugaaacaugaacaaaugauugaauagcuaaguugcagugucuauguuuucuaaugaucaguguuuaauauccuaaucagagcuccucauucuguuaacgguuuuguuacaagacuuguguacuugugggguggggaaagccguggucccauaucugugucugcucagaggcgugugucuugauguccuuaugcaugugcugugcaaugaugcauguaugaaucauaaggaccugcccgauugagucuugcauuacaaccccuuuuggguuaaugucacagcauauaauauagaacuucuuuuucaugaucuuugcaauaaauuauguuggccaaaaagucauaugucugcccauuuugaacagugcacuaggguuggggguaugggacagucguuaagcagcaucuaaaguaaucaagcauggauauacgggggaaaaacaaaaauccagaccuauucuccuuuuguguaacucuugucuauauaugaacucucaauguauuuuauaugugacugaugcugcagaugguagugucuccuuaguguuguauuaaaauggaauuucugcaugccuagcaggagcuugaaccaaguccaccccugcggcagcuggaagaccauaaaaggguacguagucuugagucuuggguaucgggagcuaaugaucaaugaccguaacaccuccaucagccacacacugugauugagagacagcuuuuguuguugauauuguuaaagcauuaauugacucaagagcaaucacagccauguauauaaaugaaacuaaauagugguucugcccauugucuaccugaucagagcacuguaaccagcuggccuccaaauaaugaccaaguaaacuuuucauguccuuuuuucuuuucugugguggcuuucuauuuaggugaaauauaaaagaaaaagaaaaacuguaauggcugaugaccauuauaauuuauaauuuuaaaaaaauggaaaaacguucauaauuacauuaccuagccacaagagccacuguuuuuguuuguuauuuggggugguuuuuuagagacagauauuacucuguugcucaggcuggaauguaguggugcaaucucagcucacugcagccucaaccuccugggcucaagagauccuccugccucagcuucccgaguagcugggaccauaggcaccacacccggcuaguuuucuuuuauuuuuuauuuuuguagagacagagucuugcuauguuucccaggcgggucucagacuccugggcucaagcaauccucuugccuuggccucccaaagugcugggauuacaggugugugccaccaugcccagccccacuaauguuuuaauauuuccuucuaccuauuuuuuauacacaugagcacaugugccaacagacacaggcacauuugcauugucauugggauuauucuagguauacaacuuuuguacccuguuuugucauuuaguacuggaucugagcauuuguuuugaaaaucuuugaaaguuaacagcugccugaaguuccucaaauuaacaggugguucaucacuguuuuccuuugaugaagaaaugaaugaaugugugcaucuuugaauaaauuccuagaagaggaauuccuuggccaagggguagaucuguuuuuaaggugcugacugugccuugccaaaccauuucuagaagauuguguauauccaugagcaugcugacagcacugauuuucauguugcccauuuuugggaagauaaccagauguccuggugacacaggcuucauccgcauuucacaaguaggaccuugagacucugggauguucaacaucuugucuaaggucauggaguucaaaaaugaccugucauuaugaagacugucuuggaacuauggucgucggugucuaggagaauuuuucuuuuauuuuuguggguacauaguagguguauguauuuauaggguacaugagauguuuugacacaggcacacaaugugaaauacacacaucauggagaaugggguauccauccccucaagcauuuauccuuugaguugcaaacaauccaauuacacucuuuaaguuacuuuaaaauguacaauuauguuauuguugacuguagucacccuauugugcuaugaaauagcaggucuuguucauuuuuuguaacuauuuuuuugguacccauuaaccauccccaccuguccccugucuuggagaauugaugccugagauaaauggguagccagaugcaccuguacucugcucacacacccaggccccugcccagucccacuacaucccaaaucccuuuuguuuucuugcucugauagagacaucaacuuugugauuucucagacuaggaccagagaauagcuccaggaaguuggcauuucauccgaauucgggacaugaggcuauagcccuucuucuccagcuuccuguaucuccugcacuucauggcccgaggcaccuugcauucuuauauuuuccauccuugccugcccuuuagaauuguccuagguccuaggaguagcugauaaaggcacauagcugucccucauguccugagcucucagaggacuugguauggaaugcugccuaugccugugaacuuuguaauuagaaacagguucaaguuuugggguuuucuuuuugccagauacuagcugugugauuuugagcaaguuaaccucccugugccucaguuucuucugcuguaaaaugggggugacaauggucccuauaccuuaggacagugagcugugcacaugaagcccuuaacacaguggcuggaaugugauaagggauauuaacuuguagauaccuuguggagugaaacauugaggugauuuuguagacaacaagaggagaaggaagguauuuuaaaauccaggcgcuacccucaugccgacuaaggugugagaggcucacagcucacaugagagggugaucuugccugaagcacaugauuuuuaaguggcuggaaccugggaaaccgaaaggucaguucucucucuccuuuguguguggcaauguuaacuccuuagugccuuguucaacacuggcucucuucccacgcaguucauucgcuuauuuaguucaguucauaucaguggaacucauauugguagagugaccagguaggagcuugguuuaauuacuccacaucacuaaucuaccaauuuucauuguuuuaaugugacacuuauuacaaaugacuuuuucuuuucucagucuuagguaauaaugugugggaauuucugacugagaccaacaucugauauuuguuugcauacuguagguguaaacugcuggaaaaaaacugguauuauuuuuaaaaaggguugcacagccaaauguuaaagcugaagaagugacguuauuuuagaagucuuuuuuuuuuuuuuuccuucucugcaaucagauuucucagccugguacauuaugaacagcuuagugcuguugaguaauuuauaucaggaugauuaggaaagcuuuucucugcagauuuuaauuuuucuuaaauuaaaccacuggcucaaacagaauuuuccuugaacccaaguuuucacauuagagauuugcauaacuuuuaauaauucuuauccauuuuccuuuucuauccccucuuaccuauaauucucagucuuuauucuuucaaaaaaggaaugaaucucaucuuuaaaaaaaaaaaaaacaaaaaaaaaccuugcucucugguuuuucuuccuugcaguuuaauuguguguguguguguauguguguauagagaaggugagaugaauaugugccaaaaaccuuauaauuaaaagcaaaaaaaaaaguuuguuggguggaauguguguguguguguguguguguguguguguguguguguguguguguguuucccccagaaugagcacauuucaugauauucucuuaugggggaaaauguaccauuugaugcaucaguugcuaugguaacugcuaggguuuuucuguugaaggagagacaaaaugguaaugugagaucccuuuguaacuugaguuuggcauccagucugcauaaauguggaguuccuguuccuggcguccacgugcuccuuucauuaccuccugcuugcuugauugcagacugaccagggucuugcuguucacccucaaaaacacgaaggggggaagaaaaaagccaccacuagaaacugaaaaucuaagcaagucacucuagcuccaaguggaaucgugguacacaggcuccaguugagacccccuuaagagauguguguuuguugacuggucacaaccauacugccuuucacuugaccacucaacccuaugcucuuucagauucccguugcgauggcuacguuggcugucuucccuggcugcggcuuacgggucucagcccagccaucuagcgcucaaacaauguucucacagugccaaaggggauccagucagagacucaggauggucagcugccaaucacuccuguugcuggaacucaaagucugugucauacugaaagaaaaucaaauagaugcauuaugauauuuaaaaagggaaaucauauuuaaucuaucauauucaacauggagacaaccuuuucuuucucucaauucuuucuucauaggcuuucuugaauguagcuuucaaacuuguacuucucuuaugaagucagccuuuuaaaucacugcguucccagugacuucuucagagagugcugauguguuuauacuggugccugagacuggaauaccaguaaaguuguaucuuguuuccagaaugggguauuccaagucauuaaagcaucuugcaccgaaacuuucuuccccaccugugagcaguuuauuuaaaaaguacuuaaaauaucaccaguaacuuacccauuugaagcacucuuggaauuuugaauuuacagucaguccagugggaaaugaguuucaugagcugauagaaguuacccuccuuugcugaacuaugaagagaggcauauuuguggguggaauggagagaggaaauuugggauuuuuuuguuuucugcacauucauuuaaaaaucaguccccucccgucuccccuguuuaucccaucccaaucugucccuggaaucuuuaauuagcagcaugaauuaacagaguagauaaacccuuucugggacuuuccaugguuuugaugauugacaggagccaagaguuuccugccuaucuccuuuccuccuuggucccccacuucucccagggugccucacguuucccagggucccugcuucagucugcucccucccaucuuguuuugcaaaugccucacuugaaaucuccagaccuauucucagagcuuauuaacaaaucauuuuaaauucuucugacucaugguucaguugcaggucucuucaaaagaacucuggagucucuguuuuagagaccugcuagauuucaacaccuuuccucucggccagacuucuucucccucaccucucuucaugacguaccagaggaacuccgugacuugcuacuuugauuccggaaaggaguccagggaaaauuuauacagccuuugacuuuuagaaccuucagauuaggagguggucuuggggccccuuaggagugcgggugaaaguguagagcugagaaugcagaacgcaugcugccucugguuacuggcuugccaguaucccccaguauuacugaacaauggagguuuuuuugguuagaguaauaacaaagaguuacuauaucccuguucaggacucuuugauauuuauauuuuuaaaaaauuuuauuacagaaagguugaaauguauauaaaaggagucagaaagguuuugaaaccccucauucauaacucugcuucaacagcaacugucagcucaugcccacucuugucucacuuauaucccucgcugcuuccccuucucuccuguauuguuuuaaagaagauuccagacaaaaugccauuuuaccuauguuggguuuuuuuuuauauauuugauaucugccacucaugccacuaauuuauuuccuauagcauuaugagguuuuuguuguuguuuugguuugucuuuuguuuuuuuaaccauuuggcccaucgacuauuuuuguaagaaaggcuuacucuuggcuuauuguaucaucuuauucuauuacccugauaucuuaauauuuuuucggaccuugggaauaaaccuugugguugaaauaacauuuuuauauugcuauguggaagcugaccuguaagccuuuucaauuugucuuaauuuuaucaacuuaccccaaagagauuuuuguuuguuauuguuaguuguccuucaaaauuacuguucugucuuaucauugugugagagggaacuucagucaauauuuuagauugcuaccguuuuuuaaaaaacaucugguuuucugagaaaauauugaaguuaacuucagaguuucuaaaugcuuccaugaauaauuuauucuuucgccaagugaaacugggccaauuauaacugaguaccccuguguguuuugaauauucgucccucggugaugcauuaaaugcagaagcugauuuuauuauccuguuugaauuaagggugaggcgcucaggcaaguucuggucaaccguuacuauggaaacgucagaccuucgggacgaagagagagccuuaccagcuuuggcaauggcccacugucagcaggaggacccggcaagcccgggggaggagguacgcuuugugguguaauuaccuucgugugugaaucaaguguguucugugauagcugcauguuuccuccuaacagguugaaaugcucacaacagaugaauuuguguugcagguguauuuuuuagcaacuuguuuugucuuuggucuaccaucaaauugaugccuaaacauauuuuccugcaaacuagcauuucccugcaacuagaugguggcuaagccuuuugcuccuccuucccaugcagugaccaucuuggugaugguugaaugauuugagggauuugauuuuauugcacuucgucccgugguuguuaggacucuugucuuuccguaaaauaaugaggauauuggcacccaggauagugaaagcugccauuuauuauacauuuacugaaugccaggggcuuuccuaagugcauugcauucuuugucucauuuucuccucccagcuacucauuauaugauagguacagucuaucccaguuccacagaggaaauggaagcuuguuaguggcuggucuguaauuucagccugguauaucuaauucuaaugcccaugcuguguacauccacaaacuccuaugggaguuuacaaaaaaacaucccuguacagaagugcuuacuuuaaaucaguuuaagcacaauuacagguaaaagauacaaaaacauggaacucaaaggugggucuuaccuaguuuguguuuuuaggcagugcucaaagcacagaugugaguugccugauuuccugucuuauggugaugacuguggggcagcuucagauccuugguggguuccauguauagcacagaaauacucaguguacgcuuaauuuguccuagcacaugcuaaggaggaagccuggacuucucacuaaaugaaaacuggaagcauagcugcccaguucauggagcuaugcuggcuucagugaagaugcaguucucaaggcauccuagagaugagaacuuggccuuucaaauccaaaaaucaaugcagagguucuucacauaaucucucaaaaccauucucuuuacuuucuguagugaggucauuuaacaauuaugugaagcccuuggggaggcaucaugacagggauuuggaaaugcaagacagacucugcucugagaagcuguagcagagagaaugugcaacccaauuucuaccuugugcuauagauauaaggacaagucaaggacaagcagcauaaaggaggugacauuggaauugaguucugcacgaaaggacagauagacaauuuucugccuuuugaagcugaucagcccauuucuccaugugcguucaugguuuaguuauugccaauaguaauacaaggcaaguccuuaaauauguaccucccaaacacagucagaauccauucuaaauggcauagguccucucuucuuaaguauauucaucucccccauccccagcucuuggcuccacgccaagcagugagcaaacauuuguugaaugaauaaacagauaaauuauguaaaagaguaaguuggggguuagaguaggcuuguuaaaaggagagcuaaagugaucauuauaggcugagcuuccuugagaguguucuaagaaguguuugacuuugguuuguuucugaaaccaguucugaacucugccacaaguaauuguguuuuaauguaagggagagucuuugcuggcuggcuuuaggucccuugcuggaaauguaucauucuuuuuucaucuuaccugucugaauucaaacaccaucucugcugcugacaagcuggguguccuuagggaaagcaccuucaucgcucuguguuaauaaucaguauuuuccuugugggauuaaaaggguuaaaagagaugaacauggguaaagcauuuagugcauaaaguguuggugcguaguaaguaugcagcaaacauuagcuguucugauugugcuuaguaaaaacaauauuccaucuucuuagggggagguuccggauccagcucuaugagcaggggugagaugagucuggccgagguucagugucaccuugacaaggagggggcuuccaaucuaguuaucgaccucaucaugaacgcauccagugaccgaguguuccaugaaagcauucuccuggccauugcccuucuggaaggaggcaacaccaccauccagguaggaaggcagcuuggcuacugguauggcaucccugcugagcaggaggagagucuguucugggagccagaugucugggugguaccaagccuuguuugagagacagcucauucugagggcacaaaauucuguuuugaaaaaugaguucugcuaguauccugcugugaucauuuggucauaaaucagacuugguuccagaacaugaguuacauuugaaaacugauaaaacacugagaauacgcaaaggaaacuggccuaagaucuggcacauagugggcacuccauaaauguuuguugaauaaguaaaugauugcaugaaguuuauuuacaguuuuuauccaagauuguaggggaucucaucacaagaugaccaaagaguuugaacugugugugcuauuuagaagauuuaacuuuuauguaucuauagauaccacagcuguugcuucugauaaauuuaccuaccuuuuaacugaaaguuuaauaaagccaaaucaauuugaaauacuagagauaccaggcuauguuagucagaaaugaauagaugacuuuuugaaagguagguaugauauauauuuaaaacuaauaauaaaaacucaaauucuauuucuaguucacuuuuuauagauguccuuaaaaaacaauuuucaugauuuuuucuuccacaacagucaucuuagaacaugaauuuuaauaauacauaaauaacauaacuuuuauauaugaucccuuuaaauauuuuuaauaccuccuuuaugcacucuuccuucuuuguuagcucucugaauaagaguuuuuuuuuuggacguguaucuauguacagacucguguacacauacacacacacauauguuuugauaaaagcuuuauugagauauaauccacauacuguaaaauucacccugauguauauauuugaccugacauauucuuggccuugaacugaaauucggagucucgguuaaugaagucuugguucuuugugcaacuuuguaaagggcguuucuuccugugagucagugugcccccggccagggugccuggcuuggcaggugcagcacaggugagauuucagucccugccugcuccuccagccagcacccuugugccuuggcacaaccugugcagccaacugcgguggcccuuuucuuucgccuuccaauccccgcuucccccaacguacacuuuugaaguucauugucacguguugcaccagguugggauuugggacaaugagugaggcaccugggccaguggcaaggcccacugcuugucuaaguugucacgugggcacgagucguacacguugggauugcuuuuuauuuugucauguguguguggguggguccugcaguccuucucaucaauggaauguugcccagccacugcuguguucugggcuccuguguugggaggaagcagagcugaaaugcuccuugucuuagaaccacaugauuuccugugauuagagcaguugaacugaauagucauugagcccuuucugcguaugugcugcuauaccaggggcgaugauggggcagugguuuccagacaugggagccaguucgucugugaggauuuucuccaggcauagucaaguguggaaaaugaggacaauguggugaacuuuucauaaaccaauggauucagguugaagaccuggccauuuuuuucugagauuauaucucuccaaucuuuauccuuagccacagugucuucuuuaaugaaaugguguugauuauggaugauagauuuuuuuuuucuguuggccaaauuagaaguuggaaacccuagguuguuauuccuucccuuccccaaauuucaaagcuuuaccaguuugagaaaucccagaaucucaguccucaagaaauugaaccucuaacaaggauacguggaugugcacauacgaugcuaugucucaaggaugacauuuagugcccuccaagaaguagaagugaugccggggaaccaccaaggaagaaggaccagcaucucucuggggagccugcagacggucuguggaugaaaugggcuuucaaggauggacaugggacugaaagggggaaauugggcauggaccuggggcauaaggaaucuuugucauauuccaugguagagagggcccagaggugugagagcagcaguuggguuuccagaacagcgguugggucuuucagaccgaggagugcuauguagaagugaagggccuuggauggggguugggguucauauauaggagcagugcagcccuccaaggggcuuuggagcuguaacggaggacuauacaccuggcaguagaggacagguaaacugaggaaagcagggucccaaggaggcagucuaagaauuaaaaaguuaaugggcaguaauuuguggaagagcugaugagaaccugaacuuaaaucucugauaaaagaguucauaucuugggagaggauauuuucucauaauggcacaagagagcucucugggugcuggaaacauauucgaccucuuuguuuggguggugguuacaugacugugcacauguuuaaaacuccgugaucguauccuuugcugggacacggauggagcuggagaccauuauccuuagcaaaauaacacaggaacagaaaaucaaauaccgcauguucucaguuauaagugggagcuaagugacaggaacacauggacacuuauagggggaacgacgcccacuggggcuuuucggaagguggaggucggaaggagggagaggauggaaaaauaacuaauggguacuagguuuaauaccagaguggugaagcaaucuaugugauaaaccccagugacacaagcuuaccuauguaaccugcaauugcaacccugaauuuaaaauaaaaguuuaaaaaagaaaaaaaacaacaacucaguaagccauaugcuuaaaauuagugugcuuuacuguaccuauguuauaugucaaucaacaaauaaaagaaaugagggcagggaaugagacucugaaccuugcugggacuaaaggggugggggugagggacaggaugucacaaacagagacccugucacuccuugcaccaggcccaggccuggaccugcugauacuugguaaauguuggcugaaauggcgucugauuagacguggaagagaagucagaggccccauucgguucugggcuuggcaucgggaugaccaggugcacaaaggcaccauuaauuaaggacuaacaaugaaguauaguggcugguggggcugagggccgccagcacugaggcuccuggggagacgaugucuguggcucuggugagaugccauguuuuucacggagcacccugauggugacggccaggcacacagaagcuguuuuuccuucaaguucuuuaucuuguaaggucauuaugaauauuaguuucaugguuucacacauuuauuacucauacacccaggcuguagaugaaaugccaugauggaguuaccgcaguucagccacguguggagcagggauguuuucucuugggggaacgcagggguggugugggggccuguggauccaugccaggauggaagggugcggguguggccgcacgcacaugcuguuuucuccuccccgcuucugugaccccuggggggcccagucuaacccagugucucacaggaggccgaugguuccaggaaaaugccuucuagccuagacuugacuugucagagccccuuggccccaagcuucucuuucucuggagaaaaugauguggaacuaggguugugucuggggccaguuaaggacaggaaccuugaagccccagggggagugauucagaguuucgucuugcuguugagaaguugguucagaguaguaaguggccagcugggaagugagccugacuugggcuaagaccacaguguggcaauuaaugauugcugagaugcuuugcuccacugaagacaugguggguucuugccggagcugguggagcacggucacuuccuguucggugcaccauggagggucucaggaagggaaaugggucuguggucagcuggccuucuugagauccauguuuccugaugacaggugguagaaaggggaguugcagggaagcaggcaggccuacacaguuccagaaauguauacagucugcccucuguguuugucgguucugcaucuguggauucaaccaacugcagauuuaaaauauuuagggaacgcugggcacaguggcucaaggaaacagaaacucaaggagguuaugacuuacucagaguuccagagcuggacaaaacccaugauaaaauauccuguaccucuuguccgucccaccuccaccuguaguuaucugucacugaauaaccaccuaaaaauuuaauagccuaaagcaauggccauuuuggugccuagcaugauucugugagcuugggcucagcugggugguucuuuugcucugugugaucuuggcugggucugcaaccaucaggggguugacuggucuuagaacagcuuacguggucacucauaugacuguggccauuggugcugguccuuugcugagagcucagcuggggguacugccuggagugccuugguucucugugugguuugggcuucuuagaacauggugacuggguucugagaaacaguguuucaagaagcaggaaguggaagcuacuagccuuuucaaagccuggguuuagaauuccuagaauaucacuucuaucacauucuauuggucaaagccagacaugaggccagccccauuucaaaggcggggagaaaaacuccaccucuuauugugaggaggguacauguauaaaaagagagaauuguuggggaccaccuuuggggacuggcuuccucaccaccacccccauuauaaucgauugagcaccuaccaugggucagccaggcccccaagcuggaugcuacagcugcaggaaagggagacaccauugucucugcaguugaggaguuuggaucucccuggauacuaaaucccuucuuugcaaaaguguugacucuugucuuucuccuuuuggauguuguaagaaaauucaguccugccuuaggauaagcucacugggaaucacagcacuccagaaauucuagauuucauuguccagacccuagaggauucaauuuaugggaauccacaaauaaugacauacagugcuugcuaggcacucucauggaggguuugcucccuuauuaugaaacccugucauccaucacaucaucaccuaaagcccugaaaugccuggaagccaaauacagguuacuucccagucuggcauaauggacucccaggggugguguccccaggucucccagcaucuuuucuuccugccccggcuccugcaauggugauaacaucugaggguagaucgugacucccagacuucuccuaccuggcugccaucagagcaggcuucacauugaacccuccgcuuaugggaacaaggagacaguaccacagcccguggauuuuccagaaacgggugacacguugucaggugauaggaucacgcuugucuugaagagaacuuccggcuuucuuucuccccacucuggugccacccgcuuccugucagcccccagaagaaauauuuccuuguggcuugauguuuuguagcaagugggaaacuauaaaauaagcauuugcuuaugaauuaauuuuuggcacacauggggcucagcagggcucacggcacuuucauauccguccuucgaguccuugccaauuucuauguuccuuccuccuaagauguucccaccagcgccugggggaaguucccuucgcuuccucuuccuuacagaaggacaggggcuguccuuaccuggaaugaagaggaggacaggcuaucuuuggacauaccucguuuuuuauuuuuguuuuuuuuaagccaauacagauguuuugggauauauaugcugacaugaccauagagaaccuccuagcacauuauggggauagauaguuaaacauuuuuuuggacuaauugcuucugguuucagaagcacugggaauuucauguaucaaauggcugcccacgucuauuccuaugccaaagucuagucuacagacacacccgaaaaggguuuucuuuucugcacguaagcagcuagagauggaaaaugugagaagugcuccgucaggaaacuggccugcaaauucagcagagagagugaucccugguucaugaggccuuuccuacaccacacucuuuuuuuuuuuuugagguuggcuuaagaaaucagcccaagaacaaguguuagauaggaaaucucacaucccuuccggaagucaccaacacagugugggagggacacguugguugggcuaucucugaccccaguuagcaaagagaugagggcggaaagggcaauuugauuugccucugcuggaaauggaaggccaguuugugaggaagaucagccuugguuugacagggcagucacccugaggaggaggaaaagauuggugugugagcaaguuacguaaauggguguuguuuuuggcagggaagucaggaaugagucacuucugagcgguguuuucuaaccucagguuuuauccaugugggaaaggagugaagccagcaguggagucagggcagcucuccuccugcacguggggguucgagagcuguuggcauuaaagaaagagggaggcagugacuuguccccagcaggcguccccagagacacugcccuucugcggaagcugugaggggucagcaaagccaccccagguuggcucaaggaccagcuuggcuccuuugagaaaugguggcguaaagguuagggacucagggaggacccccuggaaggagagagccuaucaacugcgggccuccagaccacaauauuugugcuggaauuccagcucugccccugccagccuucagugaccuugggguuugucagggccacuuugaaacucaguuuccucaucugcaaaaugaggguuggaaaagccuagucccuuccuuauggaguuacgaagaacaugaggguaaagugugugguccgguagacaaguggagcugcugccagggcugcugauucugugguguggguacagccugggcucaagcccugccuccuauaugcccaccucaggacuccuggcgaaguccaccucacucaucccacugguuccugacuuggagaauaggauggugacgguucccaccucagagaacuccugagauguuuucacagacuauuuauagaaagcaccucacguggcaucuggccaauacaaagaucucaagaugaugugguucuuauuuuuauuuguucauauauauuuuuaagagauagggucuugcuauguugcugaggcuagacuugaacuccugggcucaagcauuccuccucccucagccuccugaguagcugggacuauaggugcggaccaccaugcucgguucuaauuaauaauauuuuuauuuauuuuaaauacaugcuguauuuugugaaauguguuuucugucuaaaauccuacuucugauauuuucuauuuuugcauagugguuuaucauccagcaggccugggggacgcucugucuuauguuauuuucacacucaauugacccaaguccuucugacuguauauuaaaaaugauuuuagaacuccaggacauugggaaauuucauugccuugaguacagguuauuuagguuggugcaaaaguaauugcgguuuuugccacuaauaguaaugagagacauucugggaugaagcagaaagaaaaacagcaaucuagucacuucuuugugguuugaagugcucccuggcccaggccauugucuugucuguccuuuuuuccuuuccuuucuuucccuccuucucuuccuuuccuccuacuuuaucugccuuugaccugaacaccucacacccuucuucaccauucccaggaaacuggacuguuauugaacaggaguccuugaggauuauuggucuaaauccaggucuuaaggaggaagcucaaaauucaaaagucguuacauucuuaggcauaucagacuugagugagcccuccugcagaagaagauggcaguucccacaacucugcccuggucauccuuagcgcagcucucugagugacggcagacaguagguaaugcaugcaccuacuggcauucaguuucccaguucggggcaagaaauuacugcaagacuugucagcaucauucaucugugagucccuccagguuggugauaagaggcacaaucccuuugagguggucccaggggagaaugugcauccugguucaugcuuccagaggagcuggagacccagcgugauuuuucuuauuuccugaguagcagagccaacaauaugggcagaaguggacaguuacauacaucugcuugucuggccuuccaugagaggacuacaguuguugagggggaagggggaggggaagaacuuuggaagcagaauguuaaucuccuuccuuucugcgaaaccuagaagcaggaauuuguuucuuguucguuugucuguuuguuuguuuguuugagacggagucucacuaugucacccaagcuggagugcaguggcgcgaucucagcucacugcaaccuccgccucauggguucaagcaauucuccugucucagccuccugaguagcugggacuacaggugcccacccccacgcccagcuaauuuuuuguauuuuuaguagagacgggguuucuacauguuggccaggcuggucuugagcuccagacgucaagugauccgcccgccucagccucccaaagugcugggauuacaggcgugagccaccacgcuggcuaggaauuuguuucuaagaggagaugucuucagagagaaccucagguuuuccacagucuccaaaauuuuacuaaaagugcagagaaaaaugacagagaagaccuggaaauuuuuguaaagugaggcaucaauucauuuuaucccacugaauccucaacagguccagauauuccuuauuucuuucucuuccuucuggucuagcaagaggucugugcucuuccuaacuuucuuuagugacuuccgagugugagaugccucuugggaacugccaggcagaggauuggucagucuuccucuggagguucagggauuaguaaaugguagcccacgggaaaaauccagacagcugccuguguuuguagauaaaguuuuauuggugcauagcugcaguuuuuccuuugggauuguccuaacugcuuuccugcuucaggggcagaguugaguaguugugacagauagcugcaaugacccucagcgugugaaauguuuaccauuuggcccuuuggaaaaauguuugcugacccuaggguuuguuuaaucuuuacuauguagauguuaaacugccuaagggaaagaaccacaguauuuccccuuuguucugugcuccucauccccugguauggcaauuuuuaaguaaauauucaccagaugagcaauauccuaagucccaagauauguuggccacuuacucagcuaauaaaugggaauucagggaaacaggcuggggccucccucccucccuuccucccucucugucucccucccuccuuccuuccuuccuuccuuccuuccuuccuuccuuccuuccuuccuucccucccucccuccuuccuuccuucguuccccucuuucccuccuucucuccuucucuuuccuuccuuccuccuucccuuucuuuucuucuuuaucucuuucuuuuccuuucucuuucuguguuuucuuucuuucucucucuuucucacugucuuuuuuuuuucuuucccuccuucccucccucccucucuuccucccucccuucuuuccuucccuuccuuuccccuuuuccuucauuuuuuucuuucuuuucuuucuuccuuuuggugggagcagacaggguuguuuuuuaaaagacguuuucuucccuagagucaucucugcucuccccacauagccucugccaggauguacuccaucaccccaguuuacuaucuuucaacacagauucgggacgcagacaaagcaggacauuccuuaggaaauuguauauguagccugagaguccagacaccugcgauuacagacuuuggaucugugagcccccucugaccguccuaccccaaagcaucaugguuucagguuagucacucccuuauggcuuaaugcugugcuauuucugugccuccuacaaacguuuuccuagugguaaacacagggacuucucagggcauauacgguugaccuuaaaacaucugaaauguuuugaggccccaucuccagccuguuugccuucuuuuucuaccgauccccuuggguaaucucaucuacugcccaggccuccagcagccauuuaugccaacaccucccaaagauacagcucucggucccaccucucugccgauuucuagauuucugcucaaaucccugaugggcaucuccacuuguguuagcuauaaguuagcaggaccccaugacacugucaucucccuuccuccauucuauuugcccucucguguuccauagcuuucucaguggacucaccaccagccaaggauacccaagcuagaagcuuugcagucaucagacuucuuuuucucuugcuuuucuccaggaacuaaucugugcccacucuaccuccugggaguuuaaccauuguuaggacuuauaaugagccagauaguuggcacugugaauucagaguggcccagcugggaauggaggagcagcgguuugaaacuaggcacuguuacuucaggauucauauucuugaccaccaggcucgaccgccugccagcauagggcugcugagaucugcaccugucagccuuuuugccuggauaacugagauagccuuuuaguggccuccugccucugggcauuucucucuuccacgcgguugucagugaugccccccaaauggaacccucacuaccugcuuccccaucugaacagccuucuguggaguauggagcccauggccacccugauggaacccaucagugccucacguggucuggccccaccuggguuucuccacucacuccccuacgcuuauuguccugcagcugcaacucaugccugccaauccccagcggggccaugaacucagaugccuuugcuucaugugggacgugcccucauucccuuuggcaggcuccccaagcccugauugaaaugucuccuacucuagaaacuuccucuugauccccugaggcagagauaauggguugugcuucauuuacuguaguaaugaccacacuucaacuggagcuugacuguaagacccgagggggcagagaccaagucugucuucacuccgaguccccucgaggagccuccacacgugcuggaugaaagguccucaguguguacaugaugaaucaguguggauacuccuacuguauaaacuauucugggaauucacugagauaauauguggaaggcacucagcucagcauggagcuuuuaacacaucguaacagcucauccaaagcaacucugcuuacuuuuugguuguuuaucuucccucacccacuaacucgcccaagggugcacuuucuuccggggucaagucuccaucugacuccccagcacucagacuguaaauguagagauagaaguucugacccaguguggccaccguguuacuuuagccuucuuaccauuuuugaauagaaacaugaggaugugaaaugugaacuuguguuguugaugauuauugccauuuuaaaggggaccuucuuuaggugugggagggaauugaucugagcccaugggaaauacaugucaacuuggagaaauagccuuaugauggcagcaguccucuuuucuucuucuuuguaauaaugauggacaguagugguaacaagugcucauguaccacgggcuagccaggcgcccucacugcauggucucauccaucuuccuggggcgccuauguaguagguacuguuuugaucccuuucugcuaaugaggaaauagaggauccgagaggucagguuauaugcucagagucacagagccagcugguaguuguuccaggguuuguuuucugccagaacgugaguuuguaaccucucuaccaugccgccuccuuacuccaccaauuuuccaggcacagacauggccgcuucaaggacuuugcgucuguuugccaggcagauuggaaguugugccuccacauuuuguuuucuuugguaguggagucuuugugggagacacugugcccuccugauaaucagaaggcagcucgaguggucaguguauuugcuuuguuuauaaggucugcccaugaauucuggaggaggaaaucaugaaagacuuuuccuuucagacugggcaucucauuugccaaaugacaauuaugugugcuacauacauguacuuccagcaaguuccagguucccaggucuuaggaaaguuaaugacaggaagacuguccuacagaacuuccucacuguggaagagauugacagcagcucaucuaauuagggccguuaugaaaaguuggauuaauagcgauuuuuguuuuucgcuugcgucuaaagaagcauauguucuuuggcaucaugugaugguuauuagaucucagcuuuugcccguuuugcucagagaagcuaaaugcaccagauacuccccacaucugagucuuuacugguugaagaauauucauguuugggcgaagggaaagggaggaaggucuucucauuuuauaaagugcccagcacugugcguggagccaguagguacucuaucugggcuacauggaauagucccaauugcagaugaggaaacugagucugaaaaaagccaugugucuuacccaaagucacccaguuggcagagcugggauuugaacacaaggcccucagaagucucucagcuuucucccaugcuagccagccuuuaaguuacaugaguacaaugugagggagcuauucagugcccuguacccacuuuggagcucugccuacuagagagcagugucuaucuuguuuucguuuggggugggaacaggcugcacugguuauuugaucugagaagcaaguagucacugcuugguuagccaaugaguuuuaaagguagaccuuuaaaauggaguggaauggaagcacauuuuuuuuuaauaacaaugcaugagcuuuuccuuaauuucugcuggugucuuucuuguggguagcuuccucacaauuguuagaggagagcuuguccccgacagaagaaaggcucuuccucaguuaucguuucuguagguuuucuggaauucaucuugaggguaagagugaaggcugggaugcacugcagauagcuauugcaaaccccucuacuauuuccgauuaguggauacgugugugaguuguaugccugucuuauauuuacaagaggaaguaucccguuuaauuuuacuuucacaccaaaaacccaaguguuaagagaacgcgguguuuuaacacucccucgguuaucagcugcagagcggagguuguauauugucacauacaguuuuuggaguauguuucuacauuuguuaccuggcaacauugcugcacugggacgcgaaguuguauugguucccagcagacccucgcuguucguacuguagaaggcagaaguuguuuuccuccgcggggauuuagaagagaaggcacaaggcuagugggguuuggcugacagaugggcugaugcgcuucggugacaugacccagaaccaggcacugggcaggggauguggacucuuguccugucccaacaacagcucccuguaaugcaaggucacgugguagacaaggguuaguauuagguaaccuugaauacuaauucgugauucuuuaucuucucaaaguaaaaacaaaagaacaaacuuuuguucuggucauuuuaugagucaucugagcacuugcagaaccauaauggcaaauagcuaauacauggcaccuuuucaguugcucacauuggauacccaauucccugccuucauuuaugcauuauugugguuuugaccaccuacugguucugaugagagaggaaaucccguaguaggagugauagccagagcaucucuugcugaggugacccccugagcugauuauagcccuaugggguauuuuguuuugcugauacauaauacauugaaaacacuguauauagaauuuuuugaaugcuuaaguggggccuccauauacacugagaucauuuuaucccccuaccuuccacugcacuucacugacacuuaaccccgaagacauuugcauuggaaacuucgcauuaucuguuugaaaguccucucaguucaagccacacauucuaagacucagcaaaagcuuauugacaccaagggcauugaauucaccagcaccuguaacguuucuugaagaaugcuugcuagggaaaaguucccaugguaacuguuuuuaaaagaguuuuguagcaucaacagguuagacaggaagucaaaaucauggagcucagcagcauccccuauaagcacgugcuccuuuuuaaccaccccuaacaaagacacugaagcacccuguucauaagcccugaugggcacuggagggucuggccagguugggcuggauuucaggggaccugauuuguguuucccugugcagugcucguuuccaucaccaucuuuaaggaggaggccuuuuccauccacuggacucuuaccaucgugccuguuaaggaacaaaaagacaacugcuuaggccuggaggguauguggaaaccaccaguuaccuuugaauauaccuguggugcucgaaccuccuuuagaaaacccaagaugccauuuuaaugaugcuuugcucuuggguaucaaauuuacuccuuaauuuaccucaggagauguucuaagaggaagccacaagauuccauaccugcuguuguuguuuuagagcugguggauuuuuuuuuuuuuaauccgcggaggaggacuugacccuguggguuccuaacuuggauggccaugcagagcacccuuaacuuggaaaucuauauccugcuguuuaaacuucaagaugauuccuaucuggauuaaaguccucaaccagcaggccgaggcaaacucuaaagaaaaacaaggucaugcugcauuuuuuuuugguaagcacaggaaucaacaaagagauguuauauaacuucuauuuauauccuccuugcucacuaucugcaggcagacaagagucgcugagaagggauuuaaugagcucucuggguuugcucaccuuccugagcugguaggaaccagcuuguucucaaaugcgucaguaaagaaucuggcugugggugggcggccaggguagguggacugcguuguugcuaugguguuuuuuaauuccccugucucucaaagaucucacuccccccuucccugacuccuuccuuuugcccccuuccuuucuuucuuucuuuuuuuuuuuaaaucuguaagcuuccuuguuucucacaccuacucaugauucuuggagcugucuccggaaacagaauauuuucccucuccuuccuaagugcucagcucccccauuguguagccccgggacaucagaaguuguuuucuaagguguguuuuuuccacccucccuuauuucuuuucccaugauuuuuuuauuaccaaucccuccaugagagagaccuauccuaggagucuuccaucuugccugauagaaguuuucucuggcauauuccaaauucagauugcuccaaaaccaggugaagucuguugcuaguuggacagucgguauggccuggaggagaagggcuguuuguauuuccaugcauccuccuuuguccucuugcccugggugaagcaaugacgucucugucuccucuagugcguuauaaaauagaaccgcaagaaaacaagagaauggguuuaccccacaaucauaauuccuggagcuuggguaacuccuguuaccugaagguugcagguugaaaugacucagcuugcauuuaauuaaaaaaaaaaaugcugccccaucagauucucagcagggacgacgaaugcaccuugcugagaacccuauggcugcccagggaguggcccccugcacccuggccggccuggugguggccacagaggcuucugagauggcucuguguuguccaucacauucccaccagagcagagacacuuagaagaugugaguagggagguuaggaugaaaaguucuuagaaaagaauauguaguuccaugaggacaggcugaaaaaauuuuuaaaaagccaaacccaccucugccuugcccagaaguugugcaauccuuaauagcaguagccuguuugaauaaucagaggcaagcugacuucccuuuauuaacuucuguuagagacaucugcauaaaauauccccggauuccagaccaaguagguaauuuuuuuuuccccucugaguaacgggagggacuuucccuuuggaaaucuuccagcagaguuaacuucaugguugagacuguuuucucauuauaaggugccaacagcuagauuccugaugcagggacagugaaggcgccucauguacacacuuggauccccugcuucccugagaacugacuugauguucacaguugccucugguucuucugccuugacccuccuuuucacggagaaaucuaugcccgcucacauuuccugagguccucugaguuccucuuugaaacugucagaggcucucucaaaguuucuaccaauuuccuauuccuggguuuuagacuuuugaucaagauggcucugacacugaaggggauaguccuguaaacccucugaagucuucaagccucguuuuuccccuggaauucaggacuuuaaaaauauauauauuuuauugcucuucgaggaggauguguugcaguugcccucaccauaugguauuugagaaauauguuuuuauuagccuccuugcaacacaaacccacaaacuguugagcccagagcuuguagcuaucaagucuggggagggagccagguuuggagacggaaggugcacaaaugaucaucccucccgggcuguaguuaaucaugcaagcugcugugucacuggggccgggguaguuaacaguuaacucgauggauuaaggauccucagccaggcugagcccaucacagaguuacgugcaaaaaccggauaagcccguagaggugacaacaccacaucagcugccuuuggcuggucugcggugugcugcauauucccacuuagcaggacuuugagcuuucacaugcaggcuucuucuggccauaaaguuauacuucagcugccauggaugcaaagcuuggcuugaguguuucggaauugcaccuccuucaggauuauuguucauucauuaauauaguaaauuuuuuaaaaagagagaagaggccuuacuguguugaccaagcuggccuugaacuccugggcugaagagaucuuucugucucagccuccggaguagcuagaacuacuggcuugugucaccacagccggcuuaauauagcagauguuuacuuacugagcacucccugggugucaggugcuauacacauuggcgucaauacagucagggaugagaccaacauagccccugcccuccaggagcuuacagucuugugggagacagagcuaggaaaucagcucaucaucagcuaaaucagagcuucagagaagugugauggggaagcaaacaggcgccacgaagcguggccagggagggcuucucuggggagauaccguucaagcugagacccaacagaugcgaagagaaggagcugugugaagaguagcagagggcaagaguauuucagaagaggguuggcuugugcuugggauguuggaggagcugagugaaggaagcuaacgcggucuaccccaugguggucggucaggggcagagcugcggaaaguaucugcuccaccagggugaugggcuugucaucaagucggggcuggaugaggugaucucugugguucccgccgaucccuagucggugcuucuaaagggcaccaaguuggcuugggccuguccccugcuuggauaugcgcugccgccgccaaagcccuaauauacaaagcagcuuuacccagaugagugcugugugauuucacccugcccugcucuaaccgcuuggccaucuguacaucuuacugucagcugccagggaugcucucuguggccguguggaaguuaccuggugggccagcacacagcaagauggggaugcaggguggggagacaugaagagucccagagcauucugcuggggaccagacucggcuguacccgagagucaguugaguugggaaggacuaggguugacugggggugacugcagucuucaucaaggaggcacuugcuuugcuugaugcuuugccaccuaagccaguguccuugccuccauccggccugaguggauuuauuuuuuucggcuucuauggccaaguguccuugucacaguuuguguggagagcagcgaagggaacguggcugguguagacacccugccgguacugugcgggcucucaccuguuuucucuccugcacuccuugcaauagaaucucaagugguucuccuccucuuucuccauugcagaugagggaacugaggauggaaguuaauaaaugagcuguccaaacccacccaguuccuaagucaccccuaugcguauguuucuaccuugcuaaagaugcaggauagagaucgcuuucacugagccgugugacugcacaaacacagaaaaugggggggggguggcaaggauuauucuuggcaucuguauaaauuucaaguugaauucccugggaaccucggagcauugaggacaggaaauguugguugguguugauucauugucccucagguacacagaauggaaauaagaccuggggaguuguuuccagagaucgacuccccugacccugcaacuccugcuucagcccucgcucuccacgaugcagauugccacccccauggaggaacagcacccaagucacugccagguccucagcacuggacccuccucccgggaagaggacuugaugauagaauuuuccaagcaccucuugcaucugucuuuucaggguucaugagacaagguggaggucugaugagaaagucuucauguccuccuggccacaguucccacagugaucaugugggugagcugagacaggaccugagaguuucacaagagccaccagaggauacuugucauugaaucauagaaccagcccuggaagccacccucagaggcuagcaugugucuccugcagcccagacaugcaguucacauuguucauuccuucuuuauggacugagauuuuaaagcccucugauuccuuggacaaaaguccuuccugagaucuaaccaaacucuccuuugcuuuagaguaccuuuuuaauaagccucauauuggcuugaagagccaccagaacaccuucuugcccucuuggaggauuaccaaggagcuuccuaccacaguccccuuccacuucaggcaaauuuugauguugcaucuauuuuacaucuguuuucaaggguaucguugauuugacacuccacuggucaucuuuguuuugucuggaggcuuuccaaucuucaugacuuggcuggaagagacagacggcugugccguguauccccacaaaagauacuggccuuuggcaucuguuugacuauugaacccagagaaaauuuggagucuccuuaacuucuuguuccugggucagagccacaggguccuccagggugguggcugaccugcuucucugaaaucugguuuuacuguugaaaauugcuggaaacagugguugccaguagccugccuacaccaucaggggcuuccuacgauaauaccuuuaauuuuuuuuuuuuuuuuuuuuuaggaauuacuguuuguugguugaguuguuguugaauaugugugaaacuguuagcguucugauccacacaggguggagggggaccacgcugcuuaccagauagggcagagcuuucccaguaagucccaguucccgugggcacugggagacaggaaaggagagcuguugagcuuucugucucagaagaaagguguuuuuucccccaauuaaaaacauuuuuuuuuuuuuuuuuagacauggggucuugcuauguugcccaggcuggucuugaaauccugggcucaagcaguccuuccaccuuggccuccggaagugcugugauuacagcuguaagccaccauacuggacccugaaaaguguuuuuaauagaacagguuggacuuugcugcuugaagaagacugaauucaccuugaaaaucaucaugaagauccccugccuuggccuugacccuggagcuuaggccguuccccagagcccagugaccagauuaauaagagugaaggaaggguucuuuguccuccaccuuuucucucaggugucaggcauagcgaagggcgucugccccacccuugccuggcaggguaguugaaacugguuugucucucacuuguuaaaaggugacuguacaguguggaugagggaggaccuuauuucagacaaaugaaauugaaauguugacaccucuccaauacagacuugcuucacuucaucgcuuccuuucuacuuggaagucuauguuauuucugaacucauuaaagcuggaaacauccugagagaggcugguaaacugagagcugcagauguuggcugguugaaagccaucagaccuugcaaaaaaguuucuuguuagggugagugauaauuuaugccaagggaggguccaauucugaaugcccauuguacucacuauuaggcccuuuucauaggucagacuuuugcugaagucgagacugguuuaaaauguugggaaaugcuuuauguggaaaggcuggggauuacuugagaggagggucugacacaagcuuguauucugccuuuggguguauuaaacuuugacaagcggaagcaacgauguuuaucucugcacgugcagaaauuugaauggcuuuuauagcuagugaaauuucagccaaauuuuuuuuuaacuuuuacuuuagguuugaggguacaugugaagguguguuauacagguaaacucaugucacugggguuuguuguacagauuauuucaucacccagguacuaagcccaguacccaauaguuauuuuuucugcuccucucccuccucccacccuccacccucaaguagaccucagugucuauuguuuccuucuuuguguucaugaguucucaucaucuagcucccacuuauacgccagaacgugcaguauuugguuuccuguuccugcauucguuugcugaggauaauagccuccagcuccauccacguucccacaaaagauaugaucucguucuuuuucaugccguccaaacuuaaaaaaaaaaauucuacauugugacacuuaaugggaauugccauucauuguguuuuugcugucaauuuagaggccauucaaccuaccagaaccaacuagaauuaucacuggaugcaaguuggacacuagucuuuggccauuuauguaacacccagcucuuuucuggauccaccuaucuuacaccuucccuggaaagggguauuauuguuagacaacuguagcaccuuccaucugaguaguucuugguaguaaucaaaguguuuuucacaccuacuguuucauaacaaccuugcugggugggccccagcuuccaugugaugcugacauggcaggugguaagacccucauuuuuuagcuaaagaacccagggcacaaaugaaguuaaguaaauugcccacaaucacauggcuggauagcaaggagccaaggccaaaauguagguuucccgaguuccaguucuccaggcacucucugccuacccagguguguuuuauuaccuaguucaugguuccuggucuuugaguuuugauuguaaucauugguuucuaaaaaaggacuccagacccacagcagucauugugugacaaugguuuuguuaauaauuuauuaccccagcccuggcagcccuucagcuugcagaaggggauuguuugggaacccauauuaacaaauguauuaaacgucaugggaaaguugaggcauucgaaugcauguguaccuucugccacuauucuuuacugugagaggagccuguuuaugccucugaaagaccugguggguagggguaggggugggguggauuauaaaaugccaaaagguguucagaacaggacagacucuugcucaggggagagguguuuaacagagcaugugguugggaacagggcugaggcgucggacagguggggcuugggugccagggcacuuauuagguggaugacucagcggguuacuucuuggggccucaguuucuucaucuguaaacuggggaugauaauggcaccuaccccauggggugcuucugaggaugaaaugagauaaugcauauaaagcgcuuagcgcccggcaaaucggaaacguucaguugccguucacuauaauaaaacuugcagagagaggguccccagggaguggggaguucucaguucaccacagguguaggaagacagccaagguaagccccaccucuugguagccacuggcguugcucugucacccacagaguaucuguucaagcugggcaggaguggguuagucuggugggagauguccucugaagucccugagacucccagaguugaugugaaaagagaaaaaucaaagaugcccacagagaauuuuccucagccuguggaaacucaagcuuuggcucacuguuuggcagccacauuuuucaaauucuuggccuuaaccugagaacuuaaaucauucugcagcagguaagugagcagccguggugagugucaugggcuagaugggucagggccaugucuuaugaggcagugagguggaaaaucccauucucuggauucucucaaggcccagagcgagggcuucugaaagguggaccaacuuuuagaagcugauggaaaugcuuuucuuugaggaaggaucugaguccugcagccgucacucugugcuggacugcucccccgcaagccaugcccgcucccaccaggcuccacccugggacacauacaucuaugcuccccgccacugcccugucuugcagcuaagaugccacaaaggggcuccuccccuagaauggucugguggcccagaaacggacagguaggcuggcucacauuccagggagcaccaugauccuuggacugcaaggccugucuuuuccccugaacuuccugaauucugggaaagauggcuucauggguauaugucuaggucauggagaagauuugucucuccuauucuccuccccaggaccacuuguuuacacaguuugauuaggacugugaccucuugcaccuaaagaaaggagugucccccuuugaacuagguaauaaaacacaccuggcuaggcagagcgugccuggagaacuggaagucgggaaaccuaaauuauggccuuggcuccuugcuauccagccaugugaucgugggcaauuuacuuaaccucauuugugcccuggguucguuagcugaaaaaugagggucuuaccaucugccaugucagcaucacauggaagcugggguccagcaagguuguuaugaaacguuaggugucaaaaacacuuugauuacuaccaagagcuacucagaugcaaagugcuacaguugucuaacaauaauaccccuuuccagggaaggguaagauagguggauccagaaaggagguggguguuauguaaauggccaaagacugguguccaacuugcauccagugauaauuccaggcccucugucucccugcugucaccgagguggccgucacuguccacuagccccuaaccucgggguggcucuuguuccugaagcaaggcaggcucgucauaaccacgcuccauggcuuugcaaggacuugcagggcugggggaggaugggggagccaggcuaauuaagcaauauuauauuauuuucaaggcugaucugaaaagguaguuuuguuauucuuuuaaucuaagacccggauucauuggccccucuacagcucagucaacccaaggagggaaaacugucuacuugacaauuaucagaagguaagaauguaaacucggguuguaguuucaaccagccacaccccaguguggucaaaaguaacugucuugggcagucaggggagggagguucuguguggcccuggcaagucucuuucccuuucugggcuucaguuuccucaucugugaaauguggaaggauggacgacaugggugguuuucaagugcugcucuccugaaguuccaaggaguuucaauggcaagagggaggggacccucuuugcucugcuucauauggagcuguuuugccuuuugucuuuuaucuagcggcgucuuuauccuaagaugguguuuugggaccggagaggagcacguuacccugcugaaaaaggcauuuggaaacugcuggauuccagugcuuccagcugcagaguucugugaucuguguucucuugcucuuuuguugugguugaagguuggcugacagcagccaugcccacuucccuuucccccuguccaguggauucaggauggaaacagccacugccggggucacugccucacccugccccugccccugcccuggccuuuuccuuaaagcguaucugaucagaucugucaucagggaugucugggacuggugcugaggaucugcccgcagaccagcuuugugucuucugcuuucccagccuuugacuccggccucacugcuggggcugguugucugugucgguucaacgugcagaugggaggagaguugguuguggcucugccacaagucacugaccucuccuaaccccagcucucucaucuauaaugugacagauuuaugaaugaugauaucugccuuggcaaucuccuaagacucuggugagacagcuuauauggaaagggcucuggaaucaaaugugauuuggagacgacuggagggugaggagaggucggccuggcgggggcagaugccguucccucugguggagaggcagccucagaagguggccccucuacagaguuccccagcuuucugggaacaaagcagacuuucuguuaucuuuuuuuaauuauuauuauugugauauaauugacauauaaucauaggcacagauuuuaaauguagacuuugauucgauaugacaaauguuucuauacccauuguaccaguuuucuguggcugcuguaacaaauuccuacaaacugaguggcuuaaaggaaccaaauguauuguuuuauaaguucaacaugagucuuacuagacuagacuaaagcaaguguuggcaggccagcgcuccuuucuggaggcucuaggggagaaggcuuccuugccuuuuccaguuuccagaggccacccacaucccuuggcuuguggcuccuuccuccaucuucagguuuagcaauggugaauggaguccuucucacauugccucucgccacccuccucuccugccuccugccuccacagcgaaggcuccuuguaauuauguugggcccacccggguaauccaagcucaucugucuacuuuaaggucggugauuagcagcuuuuguuccaucugcaccuuuaauuccccuucgccacauaagacagcauuuucacagguuccaggaacuagaacauggacaugucugcggggaccauucugucuaccacaccugugaaacugccaaccuaaucaagacauuuauuuucuucuagaaaguugucucauucccauuuauaguccuuuucuacucacaaccccccacccuccagaggcaaccaccauuuugguguuuuuuucaacuuuuauuuuagauucaggagguaaaugugcagguuuguuaccuggguauauugugcgaugcugagguuuggggggguucacccagguggugaacauuguacccaagaguuuugcagcccuugcccccgcccaggcacuccccacugucuguuguuccccucuuuauguccaugaguacccaauguuuaucucucacugacaagugagaaaauguaguauuugguuuucugcuccugcaucaauuugcuuaggaaaaugacccccagcugcauccauuuugcugcagaggaccugaucucagucucuuuuauggcuguguaguauuccauguuuuauauguaccacguuuucuuuacgcagcccacuguugauggguaccuagcaaccaccauuuugauuucucucaccaucaccugauguuucccagucugggccagguuuauguugaagggcuaccucacaccugccaggugggguggagugaaaaguuuggaaaaguaaaaucucugaugauuugcucuuggucugggugaagagugaugaauugaaagagguuccgggagggagagagggaggcaguguagcggguagaggggccgugcuucaggagccuggggcggggaggcugugcacccaccuucucugcucucagcucccaccagccauagggagacaguccugaggagaacauuccauuccccacccaagcccugcaaacgcaucauuacagaaagaggcuuaaugaacaggucugugacuguguggagggcucuugucucucuaagucuaggucacaccagguagcagagggggcaggugaaugccuccagcagccacagccagcaauuccagaaggcccucccugagggcccucugccucccuucgcuccaagggcacgccccuucuaagaagaaguauguuaguucuuuacccacacuaccaucauguuucacuucuacucuugcaauagauaccacugcuucuguucuagaaaccccacuucuuucuucggggguaccuuuuuaauuuuuuuuauuucauugagacagaagucucacuauguugcccagguaggccuuguaacuagcuccauggguuuuugggugagauaacaugugaagguuugccugagcuccugguagcuugaaagcagucagugaguguuagcuaucguguuacuguagugaucucauugaaccuucacaaccauccaugaaguacgauuauugcccauuuugcagaugagaagauucgaguuucagagacauugucacuuucuaaggugacacucgcuaguaagcgguggagcugagauccaggccuuucugacucuggaaacagagcucucacuuugcucuccuguccuagcugcucacaggaucaccuucaccuuggaguuuucacauucuacuaauguaaugguaguagaaaaacaaaauuaacaccaucaguuugcacuguacuaagcacuuggcaugcaucauggcagcccuucuauguggauucagagaggcugggcagugugcccaaguccacagagccagugggucaaggaccugggacucacacccaggcagucugacugcaaaaccugcccugcuaauuccucuguuaagaaacaccuucccaguguggcaauuccucaaagauuuagaaccagaaauaccauuugacccagcaaucccauugcuggguacauacccaaaggaacauaaaucauucuauuauaaaguuacaugcaugcauauguuuauugcagcacucuucauaauagcaaagacauggaaucaacccaaacgcccaucaaugauagacuggauaaagaaauuauaguacauaaacuaugcagccauaaaauguggaauacuaugcagccauaaaaaggaaugagaucguguccuuugcagggacauggaugaagccagaagccauuauccucagcaaacuaaugcaagaauagaaaaccaaacaccacauguucucauuuacaaguaugagcugaacaaugagaacacauggacacagggaggggaacaacacacacuggguccuguugggggaggcaggaguugggggagagcauuaggaaaaagagcuaaugcaugcugggcuuaauauguaugugauggguggguugacaggugcagcaaaccaccauauauuuaccuuugugacaaaccugcacguccugcauagguaccccagaacuuaacaaauuuaaaaaguuucuaaaaauuacuugaacagaauaaaaaaaaaagaaaugucuuccuuccguugaggcacugguuguauaucuccuuuugauaccaagaguaguguaacugagcacaccucucauuucaucuugaccucagagcccagccugggacuccucugaauccucauuccccauucuccaguucccaaccuauucucuuuuugauuuucugugcuuacuugugucuucuagaccuuauuauccauuuuauuauuuuauugagcacauucuaucaauaaagcugcuucgaacccuugagcgacugaggacuggaaucaguaaugcgaaacaaaccuagugaccguggcggaaacacacacagcaauguggcguucucagcgccuggcccugucucaucucauaagagcuucccuuacccugacccuagcgguugacagccauugggucacccgauuggccgucagacagcgcgguccguggcaggcuaucugugugugucgcguggcgcugcugucagauaacagauggcgggcuuuauuuauucauuuacuuacuuacuugaagggcuuuuguuuccuugaaugaccagauugucccaaaaugcuuuuaaagcugcuuccaugccaugagaacacagcugggauagcagcugaagcgaauggcccugcacggccaccuucuggugcaccccagcuuuagcgggcaguccucuguaagcccgcaugggugagauguuggauggucugucuuggugagaaauucagucaccauaauuagguggcuucagguugcauucuuugcccccaugauuuuuuugucuccuuuauugaccugaggguucaagagcucucaaagaagugaacaacugaaaguugcuuucucauauuugagcaauuuucuagaauucauuuauuuuggagauuuauuucugucauguccaccaaauauaaaaaggaucugaccauggggaggggggcauccaguuauggggagccauaaaguguuggguuauauucauucuuuuaucaaauaaucauggagugccuucuauuugcugggccucuucuaggugcucugggggcagcuggaaaccacucaggcgaggcaucugccuucacagagcuugcacucugcauaaggcagacaguaaggaggugaacggucagugcaacagugcaauucagaggccuugauugcugugaagaagaugaaacaaggcauggagaauaagcaauaggcuugggagcugcuguaggggcagccucacugagcagguggcauugguggugggcccaaaagaugaggggcccuagcugugggaagagcuaggaauauaagaauagggcaguggcauugagcgucugccacagcuuuguuuaccagcagccuccugggucacuuuuguagggguaaaaggcuauuuaguaaguagucauuauggugauuguugaauuacuauguguuuuccuccugaggcugucaauuucaugggggaaaggucuaggcuccuuuuuguucacuucucuuauaacugacauagugcccaccuugugacaaaugcaaaaauaaguaguggguggcuggauggauggauggauggauggauggauggauggauggaugggugaauggguggguggguggauggaugaguagguagauggaugaauggauggauggaugaaauagcaggaaaccuaaaagaaaagaaaagaaaagaaacgaggcaguaaaaggcaaugaaggacacuacagacuuaccuugguuccagagugggagucgugaaggccucaaugacauggaggaugacaaggcuaagcauaggggagguggugacuuguguccuggcauuuggcaguggcuggagggaaaacgaaccagggagcacaggcaggauggauggauccugagcuguaaaaagcaaccagagguaaagaagaacaguuggaaggaagagaaagggcaugaccaagaagugcauugugggcagacaggacagauguuuguccacaaagugugugagucaauggcuggaggagucagaguagcugaaguugcaugucgacgauggaaaucuggugguucccuagggcucugcugaaucaggcauugggguguguguaugggugagaguuuuaagaguaagguggcuucaagaaggugauaagauuuaaguucuuucugggauuggaagccuaggacugccuucuguagggaagugccaucuuuccaaauggaaagauuugaaauuggcagaagauacacuggaagaagcaaauauauuguugggagcuuuguuuuuuuuuucucuggaaaugaccguauuguauuuuuauguaaauaauuuacaacagcgugguguuugcaaaggggugaaaagcgaauacucauaaaugaaguugagacaccauauuguguuuuuccaucaacaguguauacuauugcuugcagaggguccaaaaacaaauguguauccaagaggagagcuaccuguucauucugagcuucuucauuuaaccacucuuaccuguccuuugaagccugauuugaagaugaccuuuuucuugaagauuuuggagucacuauagcauagugucauccucaccagcucugagcauuuauaauauaauuguguagcuaccugaguacuuuuuacuuaacauaauuuagucugauuuauggacaugucauccuaaccuguuaaugagcaaaggcagcauaucuuauucauguguauauuuuucauagggcucugcccaggggaagagugcauagaagcccuuaaacaaaugauuggcccugcaguaauccccccagaaaagcucaguuuucauuauuaacaguguuguuuugcgugugugcaaggguggaagggaauuguucuuaguuggcaacagucugcccaccacacucgagcaugcucccaaagccuaugugucuguugcagccacagcaauuuguuucaaaggcucuguguugaaaaccccaggccuuagaacccagagaacuacaguguguggagugguccuuaauguugaucuaaacuuagaucaugcgugagguuuugcaacuggcucugaucuucauuagguuuuggugucaugaguggggugcaguuucuggucaguuacaguguucacaaucuauggauuuuccuuugcagcacuccuuuuucugucgcuugacagaagauaagaagucagagaaauucuuuaagguguuuuaugaccggaugaagguggcccagcaagaaaucaaagcaacagugacagugaacaccagugacuugggaaauaaaaagaaagacgaugagguagacagggaugccccaucacggaaaaaagguaaauguuccucagucuucagucagcuggaucaugaacaccagaagaguccuuguuauccuucauuguuuucauuacuucugugcucuaaaaugcauuaugaugggagcuuucagaagaaaugccagccugguuaugauguaauucuuccucagugaccugagcugaagcccugcugcucagaaggaucuuccuguuuaauaaagaacauuccucuuggucgagcuuaggguuuuauuggcaagggauccaugaauaaucuuuuccugugauuccuauucaauguuagagaaaguugagggaaauacguauuuuaaaacuggguguuaguccuuugucagauaauguucuuuuguuuuccgagguauuggaaagcuuauaaagcuuuuuauccaguaucucaccagaagagaagucguacugggcaguggguagacccacaaguguuggagucagauggucuugagaaaguuaagcaugcugagccucacguuucaaguuuagaacuggguuucucaaccacaguacaagugacauuuggagaauucuuuguuacaggacugucuggcuguccugugcacuguaagauacuuagcagcauacacauucucuacccaguagaugccagcagcauaccccuacucccagaauaucuccagacauugccaguuguccccugggcgggguugggggcaaaaucaccccuggcugagaacagcuggucuagacaggagcuaaagagaagaaaaagaagaauggcuaccauuuacuaagugcuuacuaggaaucaggcacuguucaacguucuuuuuuaaaaaacgaaaucuuggcucugucucacucuguugcccagguuagagugcaguggcacgaucauugcucacugcaacguccaacuccugggcccagaugauccucccaccucagccuccugaguagcugggacugcaaguaugcaccacuacaucuggcugauguuuaaaacaauuuuuuguuuuguagagauggaaucucacuauguugcccaaguuggucuaaaacuucuggccucaagugauccucuugaguagcugggauuauaguccagccacugcgcuggacuguucaaaguucuuuacaguuccccucauuucagacucaugucaccaccgcaagauagauacaauugagguaccuccauuuuacagaugaggggacuggggcacagagaugguaauuaagucauuacggacaugcagcuaggaggcaguggagccagcauucgaacccagcgugucuggccgcagagucaguacugcuaacuguaaugccauaacuaccucacaggguuauucugaggaugagauaaaauaacacacacaaaguucuucaucacagugcuuugauaguuacagaagggucaggcauuacgacaacaauaauugugauuagcauuauguugagcuucuuaagaacuuucuugagauguuauucacggaugcucucccauuuuaaagaucaggaagcugaggcccagaaccuuagaugugugaggcugacagaaccugugcugaggcuuuuccucugaaacacacuguacacguaggugaaaugguagauccacaaguaagguggcagggccuggcucgguuuuaauccugucugaggacugagagcagauugugacuucuuugaguguuuugccaacuuugaacgucucuaggagauaaaggaauguagguuucugagugucaccuuuggaguggugaauagggcccaugaggacucugcagccuuucaugccuuaugcuugcuuucuagcuaaagagcccacaacacagauaacagaagagguccgggaucagcuccuggaggccuccgcugccaccaggaaagccuucaccacuuucaggagggaggcugaucccgacgaccacuaccagccuggagagggcacccaggccacugccgacaaggccaaggacgaccuggagaugagcgcggucaucaccaucaugcagcccauccuccgcuuccuucagcuccugugugaaaaccacaaccgagaccugcaggugagggccugggggugggggcguggagggagcucgggaaaggcugccaaggccugccuuccucugaugguucagcaccucucacuugggccagauugcuugagccaaggauccagcaagguucuuuuuuuuccuuuuucuuuuuucuuuuuucuuuuuuuuugagauggagucucgcucugucacccaggcuggaguacaguggcgugaucuuggcuuacuccaaccuccagcucuuggguucaagcgauucuccuuccucagcuucccaaguagcuagaauuagaggagugccuggcuaauuuuuguauuuuuaguagagauggguuuucaucauguuggccaggcuggucucgaacuccugaccucaagugauccccccaccuuggccucccaaaguucuaggauuacaggcaugagccaccgagccaccgagccuggccagaucagcaaaguucugugaugcaaaagccugggcaaguaaugcccuugucugucuucccugcugucuccagagaccacaucuugugcaccaacauaggugccugccccauauauauuuguuaagugucuguaugugccuauugaugugugugucuuguagccugucacuguuagacaucuaggcacucagguaaaaaugggauggauggauggcuagauaauuaaauauauuagauuucuaaaauuggauacauagaaaguucugaauaaauauuuguugguugaaugaaggaaauggcugccuuucagugauuuacagaaagaggugcucaaaaauauuugcugaacugauuauuccagaaauccuuuguucauuuuguuguuuuugucugauaacaaugggcaagguuuguuaggcacuuaugauauccuggauccuaaguguugcuuauaugauuauauuauauagaugaggaaacugaggugcagaggacacagggagugcagaaguaggacuugaacccagguagucuuacacuagagcucauguuguuaaccaaaugcugagagacagagggcacaugaugucccuugcaaaguuucccagcagcaggagcuguuuaggaagggccgaggauggaucguagagauccgcuucuuucuuccgaaugggucuggaucugcggagggcccucacugcccaggagaagugugcuggagcacugggucccuggcuuuugccuggguuuguugccaacuccuggaccuagggaaaccacccccuuuuugccugaauggugugaggaugaacaaggaaagggcaucugaaccucuaucuccuuugugguggaauguuuccuccuaagacacuccagucagccgugguaguucuguguacuuggguuaugaggguauggaaaggaaauaaugcuaguccagaucuggccagggaaggcacagccuuuaaauauuuaccuggcugaccuuaucccccaggugacuugaugccugucacaccucgauuguggcuagacaguugguacugccgcagugaauugcucucacuuaaaacuugccacagagucuaugccuggauuagcuaagaaauuauauuguuaauuaguaaggcaaacagugaaauggaacugagagaagccugcaacguuaauaccuucuauaguuguuugaauuuucaaucagauugaagaaccucaacuuugaaaaagcaucugagaucugagguccucaccuggccagaucugacucauguuggaaagugaaggaauuucacacaaaccccacugucggccaggcuggacccacaguaccauguggcuugcaugcuagugggggccccuccagaugagguggguucuuucuuuucuuuggugccuggcccauuucagccuguggugcucccugcuugaucccugucgccaucugagugugggaucucagccaucgguuuccuuaguuuucuugucaguugcucagacuuuccucuuuggggcguuagaacaccucagcccuagauuuucuugccaggacuguguaguccaguuggguggagcaaagcacuuaugccucaaaugcucagggccugguuaccaucucacuggcugauaaccucuaucugaaggccacuguuucccugacauuguccacccuccaccuuccauaacccuaccacuagucacgggauucaggcaaagggggagugagugacccacagaggacuagaugcugagcggcugagcuuggcaucucuguggcugggagugggggaauccugaugcuggggacuguuucugagcagagcauggugaucagugccccuguacuauuccccuaugcaggugucacuggucucugccagccuuggaguccacaggggaaguagguugagaugaugcccaggcaugugugugucauuuaaucaauaucagugaaucccugcucugugcccagcacccauggugacaggaccucaccccuuccuucacagagcugagucuaggguagcagccacuugaacugaauggaagcagccacuccuuagaagagaggaaccaacccauugcagguccaggaaggccucucagaggagguggcaucugcugaguucugagcuuaugaaacucaagacugccuggaguagaaucccuccaugagugucagaggugcagugccaaugugcuuguucccgagcuuagcucuggugguaugggccugcuccgccuucccucucucccugaccuucccucccucgcccacacacccacuuccuuccacugugaaagcggaguaaggcuuuaauugcacagguucaucauuucuuguuuggaagucuucagauuuuuaguuuuauaccuuagcuuucugcagaauucuccguugaaucaaugcccugggaaccccauggacagaagcaccuuuuaaugaaguccuuccaaaacucguuccucagugcauugcucuguuggaaacagugcugugggguguugggguguauaguauauuuuaacauauuuuaacuuaaaaaaaaaagaccuagcaacauaauguuugaagguaucauaaagauuauccaguucagugcuuuaaaacuuuuuggcuugggggagcgcacgggauccuuuguugaaauauacuaaguacagcagaggagagcaaagcugcucuguucggaguggaaacuagagugcucccucaccuacgagaccccugggaugguagggaggaauuguagggagcccccaggguucugcagggcccaguuagaagcccgugaucuggaccagugguucacaaggauggagguuggaaucauccuuaaaaacuccugcaaaaucagauucucucagguggugacuugccuccaauaaaauuaugguguguagaaauccacuucuccaaagaauaguuuuaagcaggacucagccacucugagugccauucuguggcaauaucccagaacagggggugggucacugggucagggauuccucuuggaucggagggaaggagaaggcauucucauaaggagagaguguucagcuuccugguguaaagcagcucagagucagcacagagggagaaggaaucuggccuuuugcagcagcacccuuugggcucgugcccggaguugcuugucauauuuauaaccuuaacuuuccuguugguaaauguucagaagagauaaagucaccaagucucacuuugccaaacaggcaguugcugccuuaagcaagccuuguuuacaguggucagaaaugugaugggaaaaaccucucuucagccaguuggcauguguuuggggacccuccccugagaagcuggcuuugcuuuuccccugggguaaugaaugcagguccugaucucuuuccaccaaagucugucuaagcacagacuugaagucuuccauuuccuuaacccacccaucucaacuuggucccaggcucuucaaggaagacugcaaaaagggcaggauuucucuagcuuggacaaggcagggugguacaugcugaaggggaguucucuucucuaagaaggaguucccugugccucguagugaguggugugccucuguuuauggagagggccagaggaaauggaucugagucugggacagauucuguccagacacucugaaagccaugagagaugggagaggcuuucaggaaugggcagccauugucuucauggggaguuugaaacacgugggcccagcuagccuugaggacuucccaguccucuucccuccauucauuucauuuaguucagauuauuucauccaguguuuacaaugcagcugguaggugccagucccugugccagcugcugggcacccagcgcugucaacgugguccuuggugaguugaucggucccucuguacgcacaucacaggagugaggaaggcuggaagaggcgacuugcgaugcucccaucucacuggaguagggcucaggggucggaggagcuuccuagaagugacuuuagaccacauccugaaggaagaggagucauucaggguggaggccucgagagcaacaggcagagggcauugccuggugggagccuggaggccaggcagagaaugaggagugcuugaaguguguuguaaacacugguugaaauaaucucaauuaaaugaaaugaauucauugggagugguaacagaaguuugagagacagguguuauaagaguugccucucagauguuauaagaguugccucucuuucauccauagagacuugguuguugguuuagacuguaucuucaaguccuuuuucuauauauucgaaugggaacauuuguuacauauuaaucuauaugccuuuuuaaauucacugggagcaguaacagaaguuugacagacagaugggccaggagagccuugcugugaauuucagccauggacagccaggaccucuccagaguugucccaaacacuccuccagcgccccugcacagagcagggcugagccaaccccucaaacagguaguaucuucccugaggagcuggagcaaggcagaaauggcugugaaauccuccucugguuucccuuagagaaacaaucgagcccacacagucccaaaucaucuguucucccuccaccucccaccuggaccugaacuuguuauggagcaaaagggauuuggguuaaguuguaguggggagaaaggaggugguuaguuuggugaugagucaagcacugaacuugguuaccagcucuuaaccugugcauuuacaaauguuuuaauuauacaaggaauguguggauauguucuuuuuauaaagaccaaaugaaaauaaguauuuaguuacaagaguugccucucuuucauccauagagaauugguuguugauuuacacuguauccucaaguccuuuuucuauauauuggaacgggaacauuuguuacauauuaaucuauaugccuuuuugaaaaaacuugacagugugucauagagaucuuuccauauuggcacauagggaucuacucgguguuucuaauuuauaauauuaaaugauguagauauacuguaauuuauuuacuccucaauuggugcgcaauuagguuguuuccaguucuucacugucacaagcaguacuauaguggacauccaauacauacuuugugaguagaagugaauacuucauagaaguggaaauuacugggucaaagaucauguccauuuaaucuuuuccuauugcccauuuuuuuuacaguaagcaugucgcuuugguaacugaggaaaagaacauacauaauuaauuuuugcuucuuuuuaagaacagaugacuggagccucugacaaaaaucuccucauuaaaauacucuauuucucaaguugggugaauguggcuuuuuaaauuuuguugaggaagugucuugcuccuaucugugccucuuguuuacauuuagaacucaccuggagaacaccugcucaggcacaugcacacaagcacacacacauuuacucacugucacuccuuccuuuaaucguggaaauggccaaacaaguaauccaggcuccugccacauggcacugggaguaagccagcugaucacacccccauuuuauggugaacugucccuagugcugggcuccgggcauucagcacucagaucaaaccaucaucuuuaaacaaaaccaccgcccuuggaaaugucagaugccucugaacucaacaccugauggaagcuggggugggcaggagagaggaaggguuaagaagugaauggagaaaugaggacucaaaaagauuauaggagucaacugcacugcauuccauauacuuacaccuuggagagcagguugcauuguugagggccauugccauacaccaaguccauggguuuaucaucauggugguggggggcauacugacucuuccaugcucucccacguggcaucucucuguauaauuaccaaccuauuagaggcuaucagaauggcaggaugaauaacguuucccucuucccucugccuuugcucaccgaaccuggggacuacccaauugcagaacuuccuccguugccaaaauaacaagaccaacuacaauuugguaugugagacccugcaguuucuggacuguauuuguggaagcacaacuggaggccuuggucuucugggcuuguauauaaaugaaaagaauguagcgcuuaucaaccaaacccuggaaagucugaccgaauacugucaaggaccuugccaugagaaccagguaauuaaauuucuguuuugggauggggaaaaaaagugucccauuuuggaaauguugauagagacuaguucagaaaucacgaagccugugccuguuggccuagggagucaguaggacaggaggcugucuuccagcaguugagaaauagccaugguguuucaugauacuucagaaccuuccuaaugaaggacauuggagggacaguccauggucucuuuccuuggcuagguuuggcuucauuugauuugguuugaauguccaacuauuuaacuugauuucuaggaguaggcaauaaggcaggagugaaaugagaaccaaaagacagugaccuauuuuaaauacuaggggauuucaaagagugacuacuggaaggggguuuaagccuagcuagagagaagaaaauuacuacacgugagacagcuugaaaguaauauaaggacauuuuuauaguugagauuuaaacaucauggacauucaggggaaagaaagaugagauagucuugacuuuggucucucaaagaagaauauuuugggaguacaacccaauaacuucuugucuugaguagagucauugcuuauacauggcaucuuaaggauuuugugaguuuuugcauugugcuagguugaguaugauguuuuguuuguuuguuuuuggagacggagucucacucuguugcccaggcuggagugcaguggugcaaucucggcucacugccuccuggauucaagcgauucuucugccucagccucccuaguagcugggacuacaggugcaugccaucaugccuggcuaauuuuuguauuuuuuuaguagagaugggguuucaccauauuggccaggcuggucuugaacuucugaccucgugauccacccaccucggcuugccaaagugcugggauuacaggcuugagccaccgcgcccagccaaguauguuuuuuaauaccaaauuauagcuucauccuaacuggagagagacgaccaaggcuucaaauggucagugcuaaacccagcagccagggaagguuacuugugugacuuggggagccaggcccuucauucagaggagaacgguuuaugagagacaacucauugucuauuaaaaaccuggucucaguugucugugaaugugagaauagcauuuugugagaugcacuuucuucucccgguucccucaugaagcagaugguguaguccuaguuaaaaugaaaaggaacaaaaaaaauacaacaggcuuggggaaaggcuuuauuugacaucuaagugaauuuccuuauuaccucaaguuugcuucucugccaaauaggggccuguugaaaggaacagaucagaguggauugugcugcaaacggagauguuaccugggggcagaugauuaauuuugauauugugugccuuaaacaggaaacuugcuuuccaagcuuaagccuuaagcuaaaguacaaaauacaaaaagagugcuuuagagagaauggaacacaccuugaaaggggaaaaaggguucagaacccagaaucagucauacaccauauuuucccuuaagaacaaaagccaacugugcugcaugauuuggauuagacacaaccaauuuaucaguuacagugcauggggacuuuccuacuguuuacuguuaauucugaaacuagagauuuucaucugucuuuuauucuuaccacuuucucacggaaaauuugcagcucuccccuagagacauuacugggagugguaagcauuguguugaaauagcaguucagccuguuggccuuugacgucugauuuaugaccagcguuugugugaaugucugugugugucuuugcucagaacugcauagccacccaugaauccaauggcauugacaucaucacagcccugauccucaaugauaucaauccuuugggaaagaagaggauggaccuuguguuagaacugaaggcaaguaggaauuaaaagcagaagacagucauuuggaaacagucacuuuuguguuuugccuuggcacaugcacaugggcaauuagucaugagaguaaauauuaaagauaguucuuuaaaugaaugacccagguugcuagugcugacuacgaugcagaacuccaaccuuucucuuccacguaagguaucucaugaggggauaggagcuucugaacuguuaggucacacagaaugaagauuccuugcuccaagcuaagaagugaaucccaacagcaucgaguacuaaauaccuugguucugaaagucacaaagagagaaacaguggaaacgccauucccucucugguuucugauuuuuccccauuugagggaaaagggccgguugaagaauaguacaacuaagccuaucuaggaccaaaaaaaaaaaacccaaaaaaacaaacauguauuuuuacuuaaucaaggaaauaccuuuuucucuuuugucacugauuuagcagaagggugguuaauaauguugguuuaaaauaaggaaaauuacacaaaccaaaaaugugccugcgggccucugcugaguuucucuguauuguguacaaaugcgggacugcaggugacugauguggaagccccacugacauuuggacucucuauuacucaaacagcuuaacggaaugaaaaucgugacuucuaggugcuaaaccugcagcauuuccaagcuggccuuuuuuggauauuugagaaauugauauaccauuccugauguugacuucuaaaguauacccagaaaacccucccuucuauguagggguuccauagguucucugagaaucccaugauucaguuuuaacaauugagcuugcaggcaucagguuucuaaaguauauuucaaaacauguuagccuuucuggacacauuuccuuuuuaacuguucccaugucagggcauguugagauuuguccucuaucugcccauccgcagcagcgagcacuucaucauuaucaugaaagagccuagaacuacaggguuuuggcugaaagguugagcuguauuuauugcaugaaggaugucauaggaaaggucauuaggaaagaugggaacacagaaaccugugggaauggcaguuauuuuuucuuuacuauuuagaacugagaguccacacuaacagucgauuugggugugugguuuaaauggacuuuuuuucugcuauuuuuaauuccuuuugacaaauuguguuuuagagugaauuuuaacagauucaaccuuguguaccuggccaccauuuaucagaaaguccgaaauaaacagaaguucaugugcuccuggucagcauuugagugacuuuuucaacuaauccagugaucuauggaugaugauagaaauuugugcccugcgauagcaugauacccugacucaacugcugugaccuaaacuaggggaagaaauaagaccacucucacuguccaaaaaaagaaaaaaaacccaacagcuuucaaguccuguacauaaagaagcauacaaaguaucauagacccagggccuaaaaugaagucaagccaggaaguacaggauguggggugugaacauggguguuuuuaauguaaugggaaauuagggcuuggccugcauacauuguuccuuugggucacauuuguuaacuagugucagauguacucauuauauuagggguuaugagagcuaauagaaauauuuuaagacagggaagaauuaccuuuauuaccugucuucucuggccugcaaggccaaauaacaguuuguaaccacaccugcccggaaggcagcacagaucuguguaguagcagcuucuucccaaccacugucaccaugagggugacaguguauccguaagcacccacguguaaauucccaauuucuucuaggacuuguaccagcuaacauuagggcauaacacacaugcccugacaaauaugugccucuuuguccgaaaucagauucugcacacguaucuggggucugaagggggaugcucucugccuggugcagauggauuuugauguccuuaacccagagcuuccucauggggugaaauguucgucuguuuagccgggaugccucccaugugccaguuggcaccugcauucaggccgggcccccaagcagccccucuacauuuccucucccuuuguuucuccaacuagaacaaugccucgaaguugcuccuggccaucauggaaagcaggcacgacagugaaaacgcagagaggauacuuuauaacaugaggcccaaggaacuggugagucgggugacggaucugaugguagcaccaaggagcauugcgacgauauuugggacagagcagaggaucugcuuccuggagcuuucuugaagguucccaaagucagaaguauaaagggaacauugaauucaggccucugacugaguagagaagugaaauauuuugguuggugcaaaaguaaucgcgguuuuugcuauuacuuucaauggcaaaaccacuauuacuuuugccguugaaaguaauggcaaaaaccgcgauuacuuuugcaccaaccuauaugacauugaauacgugcuguuuuacccucucccuuuggcauaaaccacauggagaagccuccgucucuguuuuucccucaugggggacagugugguuacggaaccuagcagaccugaguucaaguccauagcucugccuguuuugcuguguuaccuuagacuucucugagcugcacuuuccugauccauaaaaggacaauaauaauaauauucccuaguccagaggguugcuuugaagacuagaugagaagauucaugucaagcccuagcaccaugcucagcaccugauacacccuuaaugaacggaaguuccuuuuccuuuuucuuuccucguuugcugcugguauuugagccauaucuuuguccagugcugaagaauucaugucucaucuuggugccaagagucugagcuacagaaauguuuuuugguugcugacguuuggauuuuuuguuuguuucauuuaaagaaaacacgaucugguuuauuuuugaggggugauagucacaauuggcugugacuugcagguugggagaguguugcaggcugugagacgagcagcuuucagagacggugacaugaguugagggcagagcucucuauuuggacucuuuuuccacgcuaauaaacuguaacugacagacuuaaaugagggcaccaaaacauuucugccuccuggugaccugaaugugcacuugggggccaggcaaaagucccuuuauguaugcuuuuaaauaaaguuaagagcagcccaguucuuugaucucugaggucagggaguaaguucucagcccgagauggaaggccucucugaguuuacauaacaagcuuauguaacuggggaucacuggggaggcgagguuugucauucuugagcagggauggaaugacuaugcagggaccccauucggcuucccaggaaucaagaacaugccccagcucucugaccuaucucagguggggaaaaugucaacacccagugagguggcuggcaccggcucuugggcagccccccggugguuggagaacaucauucuggcucauaggaggagucaggcuuccuggaacaaacacuguucuaagaauccaaauagaacacguguguacaugcaugugugcguacauacguguguaugcuccuggccucaaaucgcauguaacauguugucugcucgauuuaguauuugagagaauuggcagggaaacaagcucagacagugaggcucucuugucuccaccguuacuuccagggccugacuuggugucagugcugacauacguggccuuugguauuagauaaugacaaauaauucaugggaauggccucguggcaaugggggaggcagaaaugcccacugaaucuucaaagaagauuauaauuuuuaguacaaauuagagguugaagguauuuucuucuucuugaaaugauucaaucaugaaugauguguucauuugauaaguguuggccacacccuacauuguccugggcauugcggagggucuuaggggaaggauucagauaugagcagacccaguccccgcucucaagaaacugagacagaaacuugagggaacaaucagacaggcacagaaaugcucugagaaaugugcucaaaccaugagacaagccaagugugugguccuccgggagccgagucgugcggcugugaaggguaauagggccaaguucacaucccagcucaccaccugugacuuuaggaauguucuuuuaucuccuugacucuacuuccucauccacuaacaaaauaaauaaggaaacaggugcaguggcucacaccuguaauugcagcacuuugggaggcugaggugggaggaacacuggaguccaggaguucaagaccagccugggcaacauagugagaccuuguguuuacaaaaaaauaaagcauuagccaggcauggugguggacaccuguaguuccagcuacuugggaggauaaggcaggaggaucacuugagccugggaggucagggcuauagugagccaugauuguaccacugcacuccagccugggugacagagcaagacccugucucaaaaaaaggaggggaaucucugauaccuuauaaauguuugugagcauuaaauuuuuuugaaagaauguuaaacaccuagacacaguccuuggcacauaguaaguacucaguagguaauacuaguucgugcuguuauuuucauuuggaguaggcuguuggggacugggaaaauuuuaaaaaugaagaaauaguuucaccagcuauuccuaaaugugaauagacuucuuaucagguuuuccugaaaugguaaagggcugggagugggaaauguuggugggaggaaauguugagauaggaaaagucuggcuucuagccuacauucauaucauauuuauuguuucaaggugcuugaaagccauugcugccuucuaaagaaggacauuaaccagccacagcaugucucuuggucuaaguagagugaaugaguuucauuucucacgacaggagagguggauugguauugauggccugugccagugucaugaaggauucugaggcuguguccaagcccgauaggagagagugcggaacagccuuuucccugggaggggagacagccagugugcaugcuguccauccaguccugugugggucuuccuugaaacaggauuuuuguucccuuggcucuucuugcagguggaagugaucaagaaagccuacaugcaaggugaaguggaauuugaggauggagaaaacggugaggauggggcggcgucccccaggaacguggggcacaacaucuacauauuagcccaucagguaugaucucuccugugccuccucuggaugcugccucccuacagguccaaaauuccgagcuggagggugcccccagucuugcuuuuccuuuaugacuuuaaccuaggacugucuguacucaugagccugcggcucacaggugcucguggcaaccugacccagugugcagaguuccaggacguuuccauuuuuccacagugauagggucauguaguuggaaauccccguguuucuuaaaagcauucacccccaagcagugauacuuggaugguuuaugacucugucuggagacaguugaaaggagucuuaggcuuuuauaaauauugaugagccucucuuaacaauccaaagaaauaaacuucagcuuccuugcauauugcacuuggaaaucugugggaacuuguccuuaugacuuccuuuuguuucccuuuuuggggauacggcaauacuuuaugcccuggcaccaaaaugccauguuucauaauucuccuuccaagcggcuggguuuuugaagagccuuucucuuuuuggaugccgacgugccuugagcuuucgguggguaggggcaggcuguaacccugcuggagccuuguguuuccugucccguccaccucuuuuaaacucagguacgggaaccagauacacaacaaugaugauauugggcccgagguuggugggccccuguuaccacccacugguuaaagaauuucaaacagucuccugccucuuuucccuuccaugaccacaucugccaccgagaagguuucugaacauuccgaauggaggcucccuaggcuacacagaaagccccaucucccuccugccuggcuaaugacaucgggggaaaguggaaccaugugugggcacgagcuuuccaugcuuuucuaccaagcucccaaaauagcgccugugcacagcacgccgugaugggauggagcaagccucguggcaccuuugcccuuuggcuugcugcugguuauuaugcauuuuuaaauacccaacaugagaaaggaguuucuguguuccuguugugaagagacaccaaccuccuguaucucugucccuguauucuaguuggcucggcauaacaaagaacuucagagcaugcugaaaccugguggccaaguggacggagaugaagcccuggaguuuuaugccaagcacacggcgcagauagagguaaaagcugaguaaacucagggcaugggguuguguugaggccauuagugugcaaugcccugcucuggggcuggcgugcauucauucaucugagcaauggaaaugugaguguguacugugugcuagguccugggcugggugcuggacaucccauggccaagacagucauuauugcugcuugugguccgguggggaagaggacacugagcaaccucucauuccucacgaauucacgaggacaggugggaggcaucauaagaaaguccagcagagggaccugcuguagaucgugguggucacagaggccuagucugaagaaauuucaucugaacccagaccguaaagaacagagggaugaaacagguagagacuagcaagaggaacuuuucagacauggggaauaacagcaagcgaaagcccagacgugggaagauucuaggugauccggaggggcuaagcaaggcuucaaggcucagggcauagaguucagugcagagggagauccgaagggaaaggcaggcagcccugaucucacaggguccuaucaaccauccuuaugagaagucugggcugcauccccagagcaauggggaaccacuggagaguuuuccccaagagggcauuacaaucagaucuguguuuuuuguuuuuuuuuuuuuuuuaaaaaaggugucauguggcugggcacaguggcucaugccuguaaucccaacacuuugggaggccgaggcagguagaucacuugaggucaggaguucaagaccagccuggccaacauggugaaaccccuucuccacuaaaaauacaaaaaaaaaaaaaaaaaaaaauuagccaggcgugguggcacacgccuguaauuccagcuacuugggaggcugaggcacaagaauggcuugagccuaggaggcggggauugcagugggccaagaucgcaccacugcacuucagccagggcgacagagcaagcugucucaaaaaaaaaagaaaaagugucaugaugcauugugaguguggagauggccauaaugugaaaggggagacuccaccuaaucuagggaaugcucaaauuacagaagcaggugcugggcagccauaaguuaaaaagaagacaagcugaagccacacauguugguguuauauugaaaaugugacuuaaauucuuucaauaaagcuuuacaaucuucucugggggaaagaaacaaacaaaaaaacaaagccucugcaaagucauugguguaucuccauuuugcaaauggggagcugugaaauaaggcucagagagacugugucacuuuuccagccaccaguggcagagcuggaauuuucauccugaucugucuggucccugagccuguggguccguuuguaccugcacugucuuucagaauccaagagaacacagacuucucucuacaggcuuugagcaguaaggaaugauguguuuugcuaaugaggaaaugcacaaguucaauaucaguguugaaacaaagauuuuaaagaauggacagacuccuuugggcaauaugaaauguucaugauggagacuuuucaagaauguguucugaccugaugucucaggucucugggcuauccuaauaaaacacaucauuucacugauuagccaaccaugccaguguaugugagcaaauaucugauuuaucauuaaugccuaggagcuugacugaagggccagcucuguccucuagagcccuuaaaaggcgagcuuuagaugucugugauacagaauuucagaggagaaaaggaccuuggagauuaucucauugagcuccuugacucacuggggagaagacugaaacuugaucagguuuaagaggugugaacaaggucaccuagcuuuuuagggauguuagaaggacugaaauauguucuccugacuccagauucuaaaacuacugaggaagaguuacaaauagaucuuaaaugguaaagagaagugaccaggcaugaccuagcucucaaauccugcccuuggccagccacccagcucuucagguuucccuagggagugaucgaugcaaagccagggacacuuuguuacuaccaagggcuuuccaugcagacccaaugucuucacucuggugaacuaggcuggguagcccuggagucuagaacucaguucuugccaggaggccuccuugucuacuccuccuuucccuccuggacccagaugcacaccucagaucaucuuccuucagugggaagaagcacuuguccauaguccacuugacuauaugaagcaggcaggcucuugauagcaggagacggcagaggugaucccugacccuugcauacaccaagaucaugggggaacugcuugugugcagguucuggucacugaccccacaccacaauuccaguuaaaugggguugaguuauggacaagaaucaguaugguaacuaaccugaucuccacauggauuugggaaccacuggucuaaagaccacaccccccagaacuuauggaggcagggcugugggaaccugucucaccucuaagagaguuucccacuacagcuugaccugagucaccucucuugcuguaucagggaacaaagguuuugggagagcuagaaccagcucuucuuguagagcacguugcauccugggccucaccugacuucuccaaccucugaggaggaagaagagagacuugugccucuacuauacuguaacccauagcccuuucgaaaucacuaccucccaggacuaugacacaaucaagugcgcuagaauuugaacaauccagccagaguaccuccucucuggggacugagccagucuaggaagugcauggaggaaacuugcaagguguccaccccuggggcccaaacauacccagcauaaagaacagugagugcugccccagaguuaaauaggcauguugguucauguauuguauguuuuagauccuuugacaagguaggaggucacugcaacuggauauaaccaaagaucucuuuuuaaaguucccaucuaggaaaaauaacccaauguuacuaucugagaaagugccuuaagugagauuuauaccacugccuagcaguguacucuccaacaugauagucacuagcuauguauggcuauuuaaauacaauuaaauaaaauuaaauauucugccucucaguugcacuagccacagguguuagugauuggggccacacgugacuagcggcuguccucguggauaggacagacacagaaccauuccaucauuacagaaaguucuagggauagcaccagccucaugugaauaugcacacaaaacacagagugaauugauccagauaaaaguuggucaccuuagaaauuaauggguucacagggagguggagguugcagugagcugagaucgcaccaccauacuccagccuggacaacaaaacgagacuccaucucaaaaaaaaaaaaaaaaaaaaaaaaagaauucauggguucaucauugucuuggauuauauaaaaaaauuaaaauuaggucaggcacaguggcucacgccuguaaucccagcauuuugggaggcugaggugggcagaccaccugggcucaggaguuugagaccagccuggccaacauaguaaaacccugucaauacuggaggaaaaaaaaaaaaaagccaggcgugaaggugcgugccuguaaucccagcuacucuggaggcugaggcaggagaaucacuuaaacccaggaggcagagguugcagugagccaagaucgcaccacugcacucuguccugggugacagagcaagacuccugacucugucucaaaaaaauaaaaauuaaaaauaaauaaauaaaguuaauggaucugaaguuaggaaaauacucuuccagaguuacccaagcuauuuuuuauauaaaucugagacacacagcccaguuugggguuauaaaaucagagaucauauuauacucaaucuugaccaccgagucuaccaccaguagcaaauagucuuaguaaaagguuucaaagaugaauauuuaaucucauccacuuuuucauccuagauugucagauuagaccgaacaauggaacagauagucuuucccgugcccagcauaugugaauuccuaaccaaggagucaaaacuacgaauuuacuauacuacagagagagacgaacaaggcagcaaaaucaaugauuucuuucugcggucugaagaccucuucaaugaaaugaauuggcagaagaaacugagagguggguuccaacgcaucagcaacaacacagagagacacaguucugggauuucacaaacuugggcuugauggugcguucauuuccaagcaggagcaaagcuaguaucauuuaugauacuuugcaccucugaccaccaggaagucauaaccaguuuugcagcugaucagugggcucaagccaaaguaugauaacuccccugaaaaggcuuccuucaucagaauuugacuugauuugauuggaaagcuccauggaagacuuuuugaaugccucuuuugauaucucuaucuagaaaauaaaaagaaaagggaaaagcccaggcccuugagcucacagggugguucacuugagcaggaaauucacacugcuugcuggcucauuuacuagcacaccugcuccagagacucugguauuuucccuuuuaugggguagcuuggauuuuagacuaaaucguuuuacaggcaauggaaucauuugccacauaaggugcaucauugcucaccagcgagucccauugaguaucccagccagucagguggaaauuacuugucugaaacacauucguagggcuuccccagggggcuucuguguuccugguuuucacugggguuuuaaugugauccuucaguaccagccuugugcuuggcacuggcuguugagaccaacuuaaaaaggaucgugcuugauuucuaucuguucaucaggagccagacuuuuuuauuugaaacacuggauuccagcuauaguugugacguguugagcucuuucugagggguagaccugggguggagaacagccguguuggaggucaguuucccagagcuuucgucuucuccgugaugcugccaaucugagcaggcacggaccagugcugucuguuuuuucuucccuuuucucccuaccugccugcaucccuagaucaggcuaauggcagauaagguggugcaagaagguucgcccaaaggucccauucccaccucacuuccagccccgcuguacucuugcucgucucuaaggggcaccucccugugcagcaccuucaaacauuacaaaaagucuggccaggccaaauccaucccucagccagcuccaugucuagugucugaccgaggggccaggggaccauuagcagaccagccucuguggccuccacgguauggaccucaggagacacaggugcaauucuaccugguaucagaguguccucauagccuacuguagauuccucaaagacucuugcagcuccaggauccucaugaacauggaaacuuuugcagagcaccaugcuugggcaauaagagggaaaaagauacccuguacuccaaaagggagacauagaccccacccauuucauccucauuuuucuagcuauuauguuacauaggagaaaacuuaucuguugcuuuuguccuucacugggauauuccaucauuccagcuuuagggaauaauccugagguguuuuguuuuuguuuuuguuuuuguuuuuguuuuuguuuuuugagacagagucuuggucugucgcccaggcuggagugcaguggcgcgaucucgggucacugcaaccuccaccucccggguucaagcgauuccccugccuuagccuccugaguagcugagauuacaggcacaugccaccauggcuggcuaauuuuuguauuuguaauagagauggggcuucaccauguuggccaggagggucucaaacuccugaccuugugauccauccgccucagcuucccaaagugcugggauuacaggcaugagccacugcgcccagccaauccugaguucuuguauccaaaccuccaugauaguuaauaggcuguaauuuuagccuuaucagaauaugugucuaugaaauuggucagacacauacacugauacauucauucucuauaaauuguuuuaugaaauguuuauguauaauguauguauuuuauagguucuccaaaaggcuuauuuuggagaugacaaaaagguuuucaccuuuucuggugagaugagauaucuccuuaucccuuuuuuugagauaaugucuccagccuggaauaguaggaggacccucaggcccaaagagugaggaaucaguucuaguccauuucugcccccaacaggcuccauggcccugggacaaauggcuuaacugcucccagacccucaccugugaagugagggauuaagaugaccuaauugauggacuguagcauggucauuaugccaagacuuauauuauauuguagcuaauaccuuccuuauuucagucauucuuuuuuugaaaaacaguuuucauuucagugaaacuuaagcacaacugcaguugucagcugaaagauuuuaauuggcuucaaaacuaucugcugguaagagagaaauugaaaauaauaacugaauuaaccaugauuugcacacuuggggagggagaaauguacucaucggaaauacaauuaaaaugaaaugcauuuuccccucuaaguagcuuauaucucuucuaauaagucugcagaaucaauuuuucaggcucauucauuucgcuguuuuaccuuuuccugaauguauugcagaggaucaucuguucuucaguaaaucugcagcuaggacucagacacguagugagauccgucugagacugauggggcuuaguauuuucuucugcaagauuaaaauaugcaauugcucugagcuucauaaacucucuucucugcuuuauuuacucuagaacacacacauagucuucugugcacucacauccucucucucaccaucccucccugauauccuuuccugaagauccuauccccagugaagugaaaacucugggcuaggaaaaugagaagagagagaaagaaagaggaaaucgaggcagaguugaaugugcugacacuuucuugcaugagguuuucccaugugauuaucccacucguaaguguauauggaguccaagccuuccaguaaagucccguuccucucaaacaaacacaaacaaaaaacuaggaaagaauguuaccaagagaugcccuaggcugugguuauuuaaauugccuugccaauccaggaucacagcacuccuucuuuuugcuauaauguagcagguauauugauccaaccaacuuuuagccccugauaaguagaaaacgugcuguaaggcagcgguccccaaccuuuagggcagcagagacugguuucauggaagacaauuuuccacagaucggagggaugauuuggggaugaaacugucccaccucagaucaucaagcauuagauuuucuuacggagugugcagccuccuagaucccucacaugcacaguucacaauaggguucacacuccugugagcaucugaugcccuugcugaugugacagaggcagagcuuaggugguaaugcucgcuugcugcucaccuucugcugugcugcccaguucauaacaggcuaugggccagaacuggucugcggccccaggguuggggaccccugcuauaagguacagugaggaauucaacaguguguaagcuaugacuccuccugugggcacuuacuaucugaagugggcagacaacaacggcauauuuuuaaguggcugcaauaccaagcuguuugugacuagagcuguaaucaagcauugacgcauggaaguacaagaaaggaaggcuucagagaaaagguaggauuugaguagcaucuagaaaggucuguaggacuugaauagacacagccugagagauugggggauggggagauguauuuguugcccauugcugcuauaacaaauuaccacaaagcuugaagcuuacaacaacauacguugauuaucuuacaguucuggaggucagaagucugaaaagauucucgcugggcuaauaccaacguguugauagggcuguguuccuucugaaggccauauccuuuuccagcugcuagaggcuaccuguggcccccggccccucccuccaccuucaaagcagcauuguucaguagagcauuucucaugcugugcuacugacccuccuguucccucucucacucucucaccuacacggauacuugugaccacauuggaccuaccuagauaauccaagacaaccuccccaccucacauccuuaaccuaaucauaccugcaaagccccuuuugcuagguuagguagcacauucacaaguucuaaugauucacaugucaacauguuggaggggggcacguuauuuggcugccacagaaaguagguuaguugcuuuuuauugcuguauaacaaauugccccaacaugucgugacuuaaaacaauaaauguuuauuuccucacaguuucuuggggucaggaacuugggaguggcuccucuggaugguucuggcucaggucucucaugggguuguagccaggaugucagccagggcugccaucauuugaaggcuuaaguggaccuacaggguccgcuccuuggugcucuuacguggcugucggcaggaggccucagguccccuccacacggaccucuccauaggucugcuucagcauccucaugacauggcagaugauuuccucagagcaaauuauugaugagacagagggagagggagagagaggggaggagaaggaagccacaguguuuuuauuaauaucaccuagucucagaaggcaugaaccagcaguuucacucuacucuuauuuauuaguaacagguuguuaaguccagcccauacucaaguggaagggaaauuaagauguaccacuugaagggaggaggaucaaauaauucaugaacauauuuuuaaauugacacaaagcgagugugcagaggcuggagagugcgggguguguucgggaaccaccacuagauugggauacaaaggcagaguauauggggaaggggagugggagaagugucuggaaagguagauagggacauaguuccaugugccacaggaaauaaaagacauugcaugucaagauuggucucuaaguaucuucuugcaccuggauaaauaccuaguugauuugaaggacugaauguuuguccagauugaaaacaacauuacaacuuaaguagaauguuagccuuauaaaaauaagauucauuucaugaacuauaugccauaguugaagaccauuuauuacaaucauauuagcguauccugcaguacacgcacucacauuugauacggagcacucccucugaaacgaaugcuggcuuacacagaccaucacugagcuuugccagauccuuuucuuccccccaacuuuguuuuaugagcuuuuuauacacacacuaguguggagaggauauuucagauucccacauauccaucacucagcuucagcgguuaucaacucuuugccauucaucucuucuguccucuucuggaguuuacauauccagaucggaaaugggcuucagucccagaagaaacacaauagcuguuguuucuagagcagauaaaugucucagcuuaaauuugcuucagcaaucaacuuaccaaagaaaguacauugcuacguagugguugacuggguccuggcuggccccccauucaauugucacaugggucauuuauuuuuaucccugccgcugaccccagaggaucacuaaccuggauaacaagaucuccacugcuucugcccugugcugggccucaguuucccucauuuauacaaugagggauuuuaaacuagaugauugcucauggcucuaaaacucuacaguuuggaaacauugccuguuaccaagugcaaacaugauaugggcgauuaauaaauuacccagggcucuauuuaauuguaccauaauuuuauuuugguuggaagcucccaaaggcuuggcugcugcuacaagcauuauuauaaggccguuggauuugucauuggcugcugucgcaaaguuacaugaugacuucauugggaaaaagaaauauacgaucgagauccauucucacguacuccaugcuuuucucuggagggggaugauguggaaugagacugucuuuuggaaacuuugccugugacauggacacugaaauuaugccuaccaugucuauuuuggagcaucacccuaaguguaaagcaccacugaaaaagaguucagggaaaaaggcaccccuguaaccaaguguuuguuguucuaagacugagaaugcccggccagcgugggauaaccugugggcagcgguggauuaagguggcagcaauguccaaagcgucucugucucuugccccuuugugauggcuuugcugccacauccucucucugccacagcccuggagaugggaacucugcugcugaccacgaggucagcaacuuguaccccucgcuucccuguccucaagaaugaucauccaacuucagggaaauggcagaugacucaaugccgggaaaggaaucauugucuugcuuuuaggcacuggcguguuaguggagcauguugagccagagaggaauguggaaaugauaccagcccuagucuggggcccagcggggcugacucugaaugcuguaucucccccaccccuccccagugccccacacuucuaaaaagcuaauugaauuuuugggucucuccgggcaucucaucuggucccagagcccuagggggaaccgaggacucaaugugugaacucuggauaacccccagauuccgcaacugauggcugcggcugggguaugcaggguuuauagaugcuccaacuuuucucuuuuugcucucuccuuacuccacccccaauacaucuucuguuccaguaaguacuccacacagaaauaaaccaaucugaugucauuauguaccaaguuccaaacaaaugaucauuuuuacucuugugguaaaaaccgggaacaaaaguggacuuguggggcagagcuggcggaagggccacauugcauuccuggcguuccggcuuggggucuccagccucacgcggcuuugccuuugucucugcagcccagcccguguuguacuggugugcccgcaacaugucuuucuggagcagcauuucguuuaaccuggccguccugaugaaccugcugguggcguuuuucuacccguuuaagggaguccgaggagguacccauaucuuuaacuucaaaaauccuauuagaagcagcaggaaggcuaggacuugcaucucaguugugguuccuggauguauuggugcaguacuggggaucccaguuauccacauucagacaagaggagauuguagcuguuaccauagauuuaguuuuaaaucuaacuuaaaauaauuuaacuuuuuuauccauuuuuuuuaaccaggaaagaaagagaagcagcuagauacuauuaaaccugugagaaagucucuuaaucagccccuucuuuuauauaugaggaaacuaugucucagagcaguuaagaaaucaggccaaagucacauagcuaacuaauggcagagcuaacccuaaaacguagacgucuugaugcucaguccaguauauguguuuccacaccgcacuucuggaauugauuucagacuaaagaauuuguaagaaaucucuggaauauuuuuuuugccaggggucagaggggaggcaggacuugaaugacugcagacuguacaauguuuagucuauuaagagguaccugccauuauucacauaacaaaacaugaugauuauggucuuucuggguuccccccagccuaccuccuuccaggcuacacauuuugcugagaaaaggcagacaauuuggaggugggcauuuugcuauuuggggccccucgacaagcauucaaagcuccucuucugugauacauucauggccccuuuucugacauccacagcagccaccugggagguccaccucccggcuaaauuuuucaucagagcuuuuuggcagaucaccucacauacgcauagaacaaccugccaggaaccaccuuaugugacagagaaugggauaaagagcccaaaaaccacacaggaguaaguuucaggcuccacucuuuagcuuaaucaugcagacaucaacggaagcagacauguauggguaaugagucaguuuaaggaccaacuugaaagcgauguuauguaaugcuuauaugccuaaguuacccuuuugaggaguuagcuuuucuguuugaccuuaaguuacguggaaggcaccaucugaaugcccccgcuccgaaaaguacaaucuaaacacaaguccaggggggauuuuuuuuuuaaugucaugucaggaaacaugaaugcccgugucuaugucuaaaaagauuugacuagaacccagagcugcaagguuuucucuuuggggauguccaccuuaacccugcugccagacagcagaggagugcguggcagagggcuagugaggagcucagcuggcggcggcggaggaggcccaggucuccuuucgccucagggaaguugucauguuccucacggcagauuauucaacccuuaccuugucuguguuuucauuuacucuccauugccuuaaaaauauuucaaacagauuuuauuauucgccacgucuguuuucuucaccggucauuuguggcagcauucaggccaguucuggggacagggaguuaacagccccccacccuucauugacaagccuccugcagugccuuucuuagacuuaggaaguccagagacuuaaggucucugccuggcuccugccgcccauuugccaagccacucugggcaagccacuucagcaaguccuugucauccuuuaugugaagagauguuuacauuaagcccaugguuagaaaacuuugauauggcuucagaaaauccuguagaacccggggaagaacaguuggcaaacuagucaagaucuccagagcauguguuucuugcccauccaagcuugagauccccuggaugguaugacuaucgaggguccuuccaacucuaaaauggugcauucugaaugagccaccaacucaggcuggucugcaggaggcaaggaugcaugguuuggaaucaugggcuuuagaacuucaugcugagggacuaaacugagagcauaauucagagcuccgaggagauuugaccugaggcugauaugacccaaggaagccuuuuccauuaucuaguagcugauacugccuuaagugcaucaguucacucucagagggauucuuuuuuccuuuuguaagaugcauugagggcauuuccuauacucacugcuaaccauccucaguagaagaguuguauuaacccugccuagaaacaagaucugguuuguugaccugaaaguauuucuuugagcuaauauguguuaggauuuguugcauccuaaaggcaagauuucauaaugucccucuugaauguguauaauggccguauuaugugugcugauuuugugugguucuguggcuuacaagguuugcaacugccaagaaccaguggccuuaaaagcuccuuuucaaaaguaucaccgccccuccaccuuuguuuuagaacugacaaguuacagucuuucaaaagcgugcaacucaggcagcuucagauugcuuacugaauuugugagcaugccgugauggcuaaagcaaauguaguacuacuuuuuaaauguuuuuauuauugaaauugucaaauauacacacaaguagaaagaacaguauaaugagcuaccauauaucuaucagccagcuuuaacaauuuugccuaucuuguuucaucuauccccauacuauauuuucugaaacauuuuaaagaagucuagacaucuuggauuuuuuguccauaaauauuucaguguauaacuuaugaggacauuuuaaaauauguauaaucaccaugccauuaucauaucuaacaaaacuaacagcaaauccuguaauagccugcccaaauucagauuucuccaacugucucaaagaugucuuucuagaguugauuuuuuggaaucuagcacuauguuuuuuaacacugccguuauagugaggagacagcauuuuuacauuggccucuucaggauuugggacauacauuguacuggucacauugaugauacugagaucaucuuaagaguccauuuaaaauggcauuaagcauuucagaaaaugauaagccacagacugggagaaaauaguugcaaaauauauaucugauaaaaagcuuauguccagaauauguaaagaacucuuacaacucaacaauaaaaaaacuauucaauuaaaacagugggcaaagcauuugaucagacacuucacagaagaagauguaugaauggccaguaagcacaugaaacgauguugagcaucacuaguuaucagggaaauguaaauuaaaaucaccacaccauaccacugcaaaccuacuagaaugacuaaaugaaaaagaugggcacugccaaguauuggugaugcuguggaucagauggaacugucauacacggcuggugggaaggcagugugauacauucaccuuggaaaacaguuugguauugucuuuuaaaguuaaacauaucuguaggauccaacauucuacuucucuauguuuguccaagugaaaugaaaauauguccacuccaagaauugaacaugaauguuucuaguagcauuauuuguaaucacuccaaacuggaaacucauugauuguuaacuggacaaauaaauuguaauauauccauacuauaauauagucagcaauaaaaaguacaaaguaucaauacauacaugguaaccuggaugcaucuuaaaaacuugcucagugaaagaagucaagcacaaaggacuaccugauaggauuauuuucccauuuuuaugaaauucuagaaagugcaaagcuauagggacugacacuauuagaucagugguagcuggggguagggauggggcaaggcaucaccugcaaagaggcacaaggagacuuuuagagugauaaaaauguucuguaucuugacuguggugacaauuacaugcgguggucacaugacuauauaaacugccaagauucaccaaauuuuacacuuaaaaugcauggauuuuuuaaaauauugauuaaggaccaucgacuucagaggcaaauggucugcagccauuugcugcaucacuuugggcaagaaauguaaccugagacucaguuuccuuuagaguagaccggggacaguaggaugaauaaaugaucaucaacaucaagggcuugacacgaugucuaacaauuguuaaaugcguagaaagcggcacaugugccucaaugugcacuucuugaauuucugagaaaccucugccucuuuguccccauucccaaucagcuuugccuuuugaaggauuucaaaagggaagagguaaguggcugggcuggggggaacaguuguuaaagugaggcugaaucuccgcaggcguggacucaaugaacuagggcagccagcagcugguggaagagcugugcccugcaaaggugucuccuccccaguggugccacaauccaagcaucucugaagaagugaagcuccuuuauauaaguggccuuaaucauguagugcugcuuguuuacaucugaaggagacucaaaaugugacagcauuugaaauagggguguuuuuuuuuuaaugaguguuuuacagaacuauauuuuuagccguguuggcucauguuauauaaccaagccgucucgugggacacucuaaauagaacuugcaguagcaagagaugacaaaaauugguauaagcucuuugacugcagggauaaucuaauuguagcaugaugcucaugacacggaaguugccuuucuccuucccuuggagaaaucugauucaggcaggggaccugcaguuuuccuuugcauacuuuuaauagaaauuaaguuuaggcuuccacgucgccuucuuugagugaagugugacacaugcaugaguuuuauuucucgaacgagcuuuucgugaguaccugccaggcaccagguacuuccccuggggaaugugcaaucuggugagagagagacaaguaaacugaccauuaggaaauaguguccuguagggaugacuggaagcagggaguacggaggaggagggaacuccugacauguuuuuguggggaggaaggggauugggggaggcuuccuggaagaaguaaugucaaagcuaagaccugagaugaaugagaagggaagaacuucccagcagaaggagcauguguggaggcuuggaggucaaaaaaugcugaugggacugguuauggauggggcagagaauuugaggugagaguugggacugguaagccaaaaaaguuauugaggaaucuguaacagugcauguuuuaggucuguccccuguacucagugaaggcacagauuugugagagaacccuguuuuguccuugcaggaacccuggagccccacuggucgggacuccuguggacagccaugcucaucucucuggccaucgucauugcccuccccaagccccauggcauccgggccuuaauugccuccacaauucuacgacugauauuuucagucggguuacaacccacguuguuucuucugggcgcuuucaauguaagugugaauaccuuccuugccacuguuuuguuugcagauuaauaggaaugccuugcacucugguuucuagaauccuggccugugcuuucaguccagaaaauuauuguuuggggcaacuguuuaaauagccagaagcaggggauggcugcagguggacgucucccucuugaccuccgcguggugcagugagccuuguaauggaucccuugggcaucagcacuuucacuuuuagggacuaucccugucaggagauaggcagaaaaagugguagugcuuugagauuuaaguuaguuuugccaaucuggucaaagguuuguugggacagaagauuuuagacaauaagugaaaugaucaaauauuaacaccguacccacuucuggaaagggccacauagaaaagaggggauagguaagagggccuggccaaauacagagacagggcagguggagagggaagaggagaagcagagacaauucuuuaaaagucaguggugacauuuagaaaugcuguuucacuaccauugaaagauagaagccaauuucaucucugggagaauucuuaggacaaacugauauaaaaccauacauuggagagguuuccuugugaagggaaggagaaaauuuggacaugugaggcacuggaggaucuaaaaaugccuuccagggguuucugcccugaguauauaaggaagcugaggucccaugcaaaacuggaagugauaucgcaaaauaauauaguaauucagugcaacagcaaaagccccaaagggaguauucaaauggcacaggcagcaaggacuuuagagaacaggucaugucaagcugaaaagcuuacagcggggaggaggcaggauggaaguuagggcuuaaggaauggagggccaggcucgguggcucacaucuauaaucccagcacuuugggaggccagggugagcagaucacuugagaucaggaauuugagaccagccuggcuaacauggcagaacccuaucucuacuaaaaauacaaaaauuagcuggguuugguagcaugcgccuauaauccuagcuacucgggagacugaggcaggagaaucacuugaaccugagagguggagguuguagugagcuaagauggcaccacugcacuccagccugggugacaaagggagacuccaucucaaaaauaaauaaaugaacaaauaaauaaauaauuuuuaaaaaaaagggaauggagaggaucuggccaugaagcggggauugagaagaguucuuugguuucgugggccccauaggccagagcagaacagugggaaagcucgggauguuaucaacagacaauaaauaaagaguuucaccucauucgugguucaguagugaucaguaggaacugauccuguguaagucacuugcagcacugaauuuuaggauaaagcaacuggacuucaucccccaggucagcauucccagagcauauuccacguugauaaauaugaggugaaaaaaggguuccgugauugaauccgcaugaaaaaugcugagguaaacacaaugaaagguuucauuacugcaggcuuccucacagacuuuaauguacuaauauggauuaggaaccuccaaggaaaacagugucuuucuguuucccaaacuuauuuuccugcaguuuuuuguaaguaucacuugagauuaguguuguauagaauguauguuggaaacucuguucccaguaguggaaagugccugugguguuuuugagccaagaaaugguccauacaaagaaguauucuugagaaaaugcauucaguauggcuuguuauguggauucaucaggagggacuagaggcaaggaggcuuuuuaggggcuguagcgacgcuuugauuagguuugagaagccugagucuuggacauaguguagaagaaagaaggaagguauggacgucagaaaugggaaggaaacaggcugggcaccguggcucaagccuguaaucccagcacuuugggaggccaaggcgggaaaauugcuugaggccaggaguucaagaccagccuggccaguaugcaugugaaaccccucucuacuaaaaaaaaauacaaaaauuagccuggcauaguaaugcaugcuuguaaucccagcuacuugggaggcugaggcacgagaaucucuugaaccugggaggcagagguugcagugggcugagauggugccacuucacuccagccugggugacagaaugagacugauuaaaaaaaaaaagaaagaaagaaagagaaagaaagaaagagagaaagagagaugaggaaauaguaacacauggugggcacagagucagagccuuaccccacccagaaagcaaugugcuucuauuaguucguucucacauugcuauaaaaugccugagacucgguaauuuauaagaaaagagguuuaauuggcuugagguuuugcagcuguacaggaagcauggcagcaucugcuucuggggaggccucagggagcuuucacucauggcggaguaaaagcagcaaaguuggagcuggaacaggaggaagcggauggggaggcgcuacacgcuuuuaaacaaccagcucucuaucacuauacuguauccgggacagguggcgcuaaacuauuuaugauccagucaccuccccccaggccccaccucugacacuggagauuacaaguuaacagauuugggggggacacagaaccaaaccauacugccacucugggucccuuuuucagacaaagaggguaucacugucuugauuggguaaugaaggaggcaaauaugacuccaaauuuucagucacaaaugauugggagaagaauaauguggccaucuaaaaugaagucaugcaaagauuuaguuuuucagggugaaaaugcauuuacaucguugaccuacugggcuucagguggaaagacacgcuguuaacgugagcugcggcauuuggaaauacaugaccagaacuacagagagagaucaguguggggaggggaauguagggauugccugcagugagaggaaaccauuuaagaaagaaauacaaaagaauuacauaaacaacuagguagaaaaaauguucaguauuucagaggcugucuucuaugggcugucuaguucuuuucuucucuggccuucucugauaaucauuccacaguuaucacuucuuuaacacaaaucaguugggggaaagacucaacugagauaauuaauuaccauuuacaacaacauaagcugguagggggcaaacagcuauaauaaauaauuauuuagaguaaauuuuauuuuacauuuuuuuugagacagagucucgaucugucacccaggcuggaguacagugguacaaucucggcucacugcaaccuccgccuccuggguucaagcaauucuccucccucagccucccagguagcugggacuacaggugugugccgccaugccuggcuaauuuuuuguauuuuaguagagacgagguuucaccguguugcccaggcuggucgcgaacuccugagcucaggcaauccacccgccucggccucccaaagugcugggauuauaggcgugagccaccaugccccgccuagagugaauuuuaaaagagagaaacacccacauggaauguaugggagagggaaaguaccuguggacggagacagagagagaauauuggaguucugagagcuggaggaggagaaggugggguccuaaagcccagcugggagaguggugagcagggugcgcugggagacuugucacgccgcagggagcugggaaagaugcuaagagcagacgggaagacugcugggugcgcagaauccuuggagacuucacaugagcugucucuguugagagguggggauggaagccagaucuaagacuaacaagcagaguccagccgcaggcugagaccacaaauagcagcuauuuccuggggaagcaauggagaaaacuagggcagaaguuagaggggagaauggacucaggugaaguggaucacccuguuguuaaguuggcaggaucugggguguguuugaggugcuguaaugugugaugucacccagggcaccaucugccucucccugaaaccacaucaucauggaucauccagaaucagugauacuuucccacccucugaaauccccuccacuagcaaaggugagaauuuuggaaaaaauuggcagauugaaugcuuagccugucugagaaagccagcagcgaucugugggugucggcuuccucgcuuaucugauugccgagaagcucacuuacaccgaccuaccagauuaacuggcaguauuucccccgcaccuguggccaagggagcuagaguagcagaagaugguuuuaccaagugcauccagagaggucccucucuggccuccuccugagccaaguuuuucugucaacauauugcuagagauggacuuccaggcauugggguuucuaucaaaggugagacuauauugcacaguaguucaguuaggacuccuucaguugcagaugucagaaaaccuaauccaugcuagccucagcaaaggagaauauguauugguucauuuugaccaagaaaccaacagccucgcuucaggcacagcugauacaggggcucacacaguguccucagggcccaguuccuccuugccaucuuuuggcucuguguccccagugcugguggugccuucaguguugguaauguggcagcuccagaguucacagcugcucagguucaaggucagugggaaagaacaaaauuaucuuuggcugcaaucccaagaaagagcucaguggacaucauuggcuccauuugguccugugucuaucucuaaaccagucauuguacccaggggaauacaauauugugauggccagguuggagccccacccagaccucaaagacugcuacucagagaggaaugguccccaaaggaaaauuagaaguuauucccagaagagagggcaggggaauagaacucauccugaagucccuuauauuuuuuuucccccaagaaaauuguuguuuucccugugaacuuaggagcauugaaaggcaagaacugaucacugcucauuaaauugccaccuuacagugccuagaauguaacaaauucagaaaaugcuuuugaucaugcugaucacaggguucguggauugaggugacuucuguguuugacuaacucauacaagaauguuagaaaugauucauaucucauuuugaaaaucauaaucucaguauguguuaauuuuguuuuugccauagagaaaugcuacuugauuacuguugcgcaugaaguuauuugacuaccauguaauuuguaauaugccugaaaagcaaaguaaugaaaugacuuagaucugcaaaugggucuuggcggguuuggugggcaccggguggaaaaggaagcguuuguuugggcacggugacugaaauacauuugugugagaugcucucguugcucucaugaagaguuuggcacaguccgugccaucugacuguuccugucauuguucucagguaugcaauaaaaucaucuuucuaaugagcuuugugggcaacugugggacauucacaagaggcuaccgagccaugguucuggauguugaguuccucuaucauuuguuguaucuggugaucugugccauggggcucuuuguccaugaauucuucuacagucugcuggugaguaccugguguggaaauauuuuauguguggggaaacuaggagaguguccuauguccucucucucaucacagacccuuccuuuuaauggugauuggugugccugguccaccaagauugaagcuccacaguuggcagccuuugggggaucugagaggaaagcuccacaggaauugggucagcccaggaauucaagagucacacaaccgcacuguguacugggcacucccgaucuguuacuucucaguaauggaacaugccuguaguagguucaggagauguuuccuuuccaugcaccuuuguuuuucuuuacuucuuagacucagccgcacuuacaccaagaggaguguuuuugaggcugucauccaacagcucucagggaguccauuucuugugaacacguguagcgaccauaagaguaggagcuaguuuugaagccccgggauucaugaucaugagcucaguagauuuauuggucuaggagacccuuucaguagcucauuuuccuccgauaugagccaagugcuuaaugucuugacagucuguaagacaagcugguuccaucaccuuccuccugagcagguuuuuaaaugacaaaucaaggaacuacuuacuuuccuguaguuggagggaaucuagaccuguggcguuguagauaagaaaccauuuucuugugccuacauaaaaugacaggaagcauaaaacugaccuaucugcaagcaacaccauaaacagccuaggaauauuaaaauauuugugaggacaaaaaugaucaaggccuaaggguuggcuuacaaagagggggacuuacaaagagaggggggcuuacaaagagaggggggcuuacaaagagaggggggcuuacaaagagaggggggacuuacaaagagaggggggcuuacaaagagaggggggcuuacaaaaggcagagcaagggaagcucuucagggagaugcuuagaaaacccccccgaagcgcguaugagaggcauccagccacgaucuaguuugauccuauugcguuuucuuaaagugaacugaggagcaguucagcaucagaagcugggaguuacucuuaucuuucugcaauagguuagagauuugaaaguacaaaaugcaacugugugagaugcucccuucgcuuaacguacuugacugccuugugccacaguuuccucaucuacaaaaugagaacaguguaucucccucacagggccgucacagggauuacaugcagcuguucaggucagggucuuagaauagcacugccgaaugauugccagcuauuuuauugucuuugucauucuauauuccuucccccguccaaaacaccauaaggaauucaccguucagaucacuaggauuagcucauaccauuagggguggauuuuggcaggcuaaagggaauggauucuuuucccucaucuuaaaauaggucuggcuauauuuugagguuuuaggcaaagaggucucaggauauccuugugauucccauuaugucgccuauuuuggucacuuuguaucagaaaccuuuagagacuuacgucuguuucuggaacuuuuugucucaugccaucaugucccuggacaacaaauuccuguccucccuugggagggcggcagaguucaguugguggucucucucaucccugccaagggcucucucccaagagacaggagaugccccuuuggucaacgccaccuugccccaguagacacuucgaccuuuccuccaaucugccuccaguuggcuuggcuucuuuucuguucauuugaguccucuucucuucaucacuugcaaugcaggccagugccagugccugacgcagggcacauaauggugagaggaacacagucccuacccucauaggccucacagucaggagcacauuacagggacagccguuuugugaguggucacccugcacucuucucuacacacucucacuaccaccuuugagguagaugguaucuuccaauuacaccugaggaaacugaggcuuggugagguuagguaacuugcucagagucacacugucaguaacugguggaggcaggagagccucacaacucuguugauucccaaguugacacugccuuuuauucaagcaugugaaaaaguccuugcaucagugaaacuggcauuucacguuccaguuugcaucugugcuuucaagucuccaaccuaucacagaaagauaagaguaacucucagcuucugaucaugcuaccucaguucacuuuuaggaaacgcaauaggaucaaaccagauuaugguuggcugccucuccugugcuuugcggggggauuuucuaagcuguguggaccuugacuuguuugugucuucaagugaugugcuccuuuugguaucaaagcaguacucaaugugucugguaagaaccagaaaacacugacacuucaaauuauucuacuaauaaggaaagccugcaaccaaaagaaaucgggcugccuguaaaaggagagagaccugagcagggaacacccauguguuccagaguugggagagcucccuccaugccagcaggccggaagguagggagggugaucugguggccuaauuaaacugcugcccccccucccccacaaagacuggccggaccuggucgugagccugcauuaaagcuguguccuuagaaaaauauuaacaccuggagaugaaaaugugcaaaguucauaagcaggcaguuaacaaaagcagaaauccagauggucaguaaacauggaaaaauguucauccuuggugcuaaacaaagacaugcuaauuaaaacagcgcaauccuguguuuuaccugugacauuaguaaagguuaaaaagccugauggugcccaguacuagugagagugggguaaaaugggcaugauucuuuacuaguggugaauguaaacugauccugccuuucugaaagcagcaggcaaaauguuucucuuauaccauuugacucaaauacuccauuuccaaaaauucgccgaaaaggaauaacuagacgagcacguauggaggcauguauagaaguguuccucacagcauuauuuguuaugacauauaauuggaaacaucuugacuguuuuuaaaaaacauauugguuauguuaaucauguuuuucccauauagugaaauaccaggugaucauuuuugacaggaaaauguuccugauggcuuggugaaaggcugguuaugugccaguauuauggucuaauauuuuuguaaacaauauauaucuauaaauugcauuuuuuaaggccagaaggaauuaagcuauugagcgaaugucucuagauggugaauuauuagugacuuuuuuuccuuugugcuuuuuuuuguuuuccaaguuuucuccauugaacauguauaauuuuccaauuagaagaaagcuuuucuuuuauauaaauaauacuuauugauuguuuuaaaaucagaaacuauagaugagugaaaaggaaaaaaucgcuugucauuucuaugauuuggagccuguguaaucucugcgguccuuaaccacagaaaacaagugccauuuguuuguugucugaaguugcgcuuacuugccacuuuauauugagcugcuggaaaacauuuaaccaacauuaacagcaacacuuugccuucugucauauuguauugacuaaaaucccucuuccuugcuucccuuuaaguauccuacucuacccaaugcccuucacagaacuagucucagaacacagauuggugucaaggaggcagaaaagccaaucgaccggaaaaugaccucagaugaaaaauucuaaauuggaagggacucagagaucagcugucucaguccacuuauuuuacagaugaggaaacagauccagagagcuuagauggcuuggccgacaucuugcaacaaauuaaaagcagucaggauucaacccuguccccugacucacuucauggugcagucacaccccaaagccacaguggagaccaaaccuucuguacaggauuagacagcagccagaggccaugcuaaaaacuagccucaggucuaagaguaacuucagagagcucucuccccacacuccccaccauucucccagucaaguaucugugacuguagcucuuggaaaacuagccaucauccucccauaccuauauguaccuacaaggauccuccauuccucaggaagccaacuucuugcaaagagcagguuccuuagcagagggcaagccuggauugugaaggcacugugaccugcaggggucuuacccucgcaauguuaacgucacuaaugucccugcgauacaccagcuaugugacccugccccagucucuugaucaggaaauugaugauaauuacuauuuacuguacuuacugagcauauggaugccagugugcuaagcacugugcguacgugguuuacuuauucuucauaacaacucuacauccuccagucugcaaaugaggaaauggagacucagaggggaugaggaaagugccuagcccgagaucauacgguggacaguagcugagcugagauuugaauuuacaucuaaguccagaguucuugccacugacgcuggcuuguaguacgucugccuucccaccagacacugggcugcaggagggcagggaccaggguggcuggcucuucauaaacucaauucaguaccuucuaaaugaauggaugccaagacccucaucacuuuccucucccuuugucucugaaacucauuggcacaagcauguauuuucucuauuuccagucccucuaaauggcucuggauacuacuugaaguugcuauuguuuccugcuuccucuucuguguuuauuuuuccucauuuuuaccaucuccguuucacugugaagccagggaagauguucaguguuaagaucauauguagugcuuuugagugucuaagagggcaaacucucuauaaaccaaguuugcauuaugggauagugauguacaucuaacaucaaggcuucuuaaaauucuuuuuguuuguuuucaaagcuuuuugauuuaguguacagagaagagacuuugcuuaaugucauuaaaagugucacucgcaauggacgguccaucauccugacagcaguucuggcucugauccucguuuaccuguucucaauagugggcuaucuuuucuucaaggaugacuuuaucuuggaaguagauaggcugcccaaugaaacagcuguuccagguggguuugggaucuucugaucuuuuuaaugcuaaaagauuauuuccugauuauaacugaacuaaagaaaauaacgacuuuaguaaugcagauaucuccccauuguaucucccuaacacgcagagugugaauuucaaauacaggucuucauucucacaaugaauguggcaauguggcauaucaaaugcuaagagugggugaccagaucugacauuuauuuauucacuaacaucaucuuuuaaacuagugcaacuuuuuuguaaagcagugaccauacauauugagagcguuggaguaugcaucccuuuaacugaguaaaucuacuucuaggaucaauacuuaaagaaaaaaaggcugccgacugugcacguagaaacagacauauaugggagaacguucgcugcaguguacaguuggaagcaguguaaauguucggggguguuucaucagaucaugguacauccaugagguggggugccuugcacauagguacaucuuuagaaaccuccauggaaaaauacccacaagauguaguuggaaauggcagaaggauaacuauaguaggaucacauguaugucuuuuuuuuuuuuuuuuucgagacaggaucucacucugucucccaggcugaugugcagugguaugauuucaccucacugcaaccuccaaccucccgagcucaagcaauccucccaccucagccuccccaguagcugaaacugcaggcgccugccacugcauguggcuaauuguauuuuuuguagagauagguucuugccauguugcccaggcuggucucgaacuccugggcucaggcgaucccccagcuuuagcuucccaaagugcugggauuacaggugugggccacuaugccuggucuuauguuuucuuaaaaauuaaaaagcccauauacauauauuaaaacauggaugacuguaccuccagacugcuagcaguagcucucucuggggcuuuuuuacuauaugcagguuuuacagugagcucauguuauuuuuacacauagcaagaacagaagagauuuccaauucugagagugaaaaaaaaugaccauaauacuugaaugguacccaagugcccucuucucucaguuacaauaguuggcccgacuuagugaaauacuacugguuuuucaucccgagucuaagaaacagacuagaaucguuguggcugacugagccagccagccuuugugcucucccucccaaaugcuguguucuuggcauguaucuccagccucccaaguugacacuaagugacauuuacugccagccaucuuagaguuguggacuaaacuggccuggaccuuggauuucuauuaaugccugcuaaugcuucucgugcagacuugguauaaaucuugccagagucuguacguucaguaguaucugucuaagaguuucagcuguuugucuuuaaaguuggagaggugcuauuuaagugcgauauuucuaguaagccuacaggaauugacauuuuuggcuuuuuucccauccagaucaccaaaugaaaguguaaauugcauuucugcuuugaauuuauaugcaagauucuaggguguuauuuauguaaagaauuguuuaaucagccgugaauuggggacuucaaacauuuuaaccauaugcugccagauuguucaucauaaaauuuccuucucucucccagaaaccggcgagaguuuggcaagcgaguuccuguucuccgauguguguaggguggagaguggggagaacugcuccucuccugcacccagagaagguaggaccuccuaacuguaagccccauguuaauaucggacuccuccagaggcuuagcugaugcaggugauguuggaagaagauuaaauuuacugcucaggaguaaggcuauagcaaaggggaaaggcugagaaagaggagggagaugaagggaaaagaagguuacaccugaagaaaagaucugaugugauucagccgauuuauacugagugcccgccauuugccagggacugugguguacucuaagagacaguaauguaguggagggugcgggcaggccaaauggugauugcuagagaguugcccaaugcugggaauaaggauggaauacagaaguuaggcacccggccuacuacugggcuaagcguaucaucaagaaagugauauccaaacuauaaaaggagacucuugauauuccaaggagagggaauaguacaucuaaaggcuuuaaagguaaaaagaaaaaaacagcaaguuuggggagauaaugauuauaaggaaggagaguggcaagaaaugaagccacagauacaaacaaagggcuagaucaugaaggaucuucuaugucaggcguaggagguuaaacuucguccagaggauggucagggguuguuggaagaugagugaugaaaucuguguuuuagcaagacccucugcagcuggagaaaggaaugaggcacacagcaaggcauggcucuuacugcauaaaccagugagaaugaacagccuccaauguaaagcaguugauccagaggcccugccgugaaauaucccuggauauaguccucacaccauucccagugaggaaccuguguccuguggcauaacccucaucugagagacaagaggccugugacucagaguugcgaagcaacucaucugacaugaaaagacuguuugcggcugggucugggguuuaaaaccugaaaaggacagggcauguuuuagaucccacagagggagagcaauacuaccauagcuggagaaauuagcggggguuagcgaugaaaacaguugccccagacgacuuuagcuuuugaaagaaaauaagaaaauucuuggcucuugauuccuuaauuuuauucuuucgugugccuggugagauggcauucaggaaacaggauuucaaaaucccggucucucuuuucuccucacguuuucucucuguuguuacuugccguguucacagagcuggucccugcagaagagacggaacaggauaaagagcacacaugugagacgcugcugaugugcauugucacugugcugagucacgggcugcggagcggggguggaguaggagauguacucaggaagccguccaaagagguaaauuaaucccgaggggaaggaagggcaaagggggcggguggggugguuggugggagcaccaugcagcgguguugaguguaaacugaagacgcagaggaagagcugggaguagggcugaguagcugcggaacuagcucaucaggcuccuuuccucucuaucacgugagguggugccgcaaagucagcugcguggaaaggguuggcuuuggcucucuguucaguagacuuagggacuguuuccaucaggguuaggccugauccaccugaacgcacagugaauaucccuccuggcugugucacaccacacuuggagaagucgcaauugagacaggggacaugaaaagagaugcaguuuucaguuuaaaaguugaaugcccaauuuaauuucuacccaaguagaugaggucucacuugagcugugccccaggcuccgcagaccaaagggucgcaagggacccagacugauccagacaccucucuuuuccaggaaccccuguuugcugcuagaguuauuuaugaccucuuguucuucuucauggucaucaucauuguucuuaaccugauuuuugggguuaucauugacacuuuugcugaccugaggagugagaagcagaagaaggaagagaucuugaagaccacgugcuuuaucuguggugagugucgcuggccagcuccagcaagggcgugaaggcccagcguggcagaggcauguggauacugcgagggugugaugggcggggugccugcccaguuaugcgggagggggcaccggcugcugcuucgucuugacucuucuacccucugccgugagugaggcucuccuuggccuuuauucugcugggaaguauuuacagaccuggguucugacugagcuucuaccacuuaacuaacuguguaacaucauuuagucauuuaacaucuuuaauccuucuuucuucaucuguaaaauggguacaauaacauguccuucucugcauuauugugagaauuaugagagacagcguauguaacacuccuagcuagaaccuggcacacuauaggcacgggaggagaaguagugaacggcuacguaaaagaggugcauggacaccaaacaaaucauuuucaguauaacuacaggaaaauauuuguaaauguaaacuaaucauggaggaaucuggggagcugaguaaucauuucaggauuauucauaauauagcuacuaaauauauaaauuuccuagugguauguaugcuaaaaaaaaagaucaguuuccaauuaaagacuuaaauucuuugcuuuuugcccccuuaaaaccuuuuuaagcuuuuugcuuuggcauaauuucagaguuauagaaaagacaugacuauccaaagaauuucuauauauucuucacccagaauccccaaauauuaauauuuuaucucauuugcuuuauacacacacacacacacacacacacacacacauuuucuaaugugaguggcugacagugaugcuuucuuaucccuaaauauuuuaguacacauuuccuaaaaacaagaacauucucuuguguaucuacaguauaauuaucaaaauugggaaauuaaaacagauccaauacuguuaucucaucuacagaccuuauucaaauuucacccuucauuccaauaauguccuuugcaaaucccaccuccugcggggcuucagucaccaugccucgugagccuccgcugacacuguugaagaauguaggucaauuauuuuguagaaugucccuugauuugaguuugucugauguuugcucaugguaagauugaggguauguauuuuccacaggaauaucaaagacaugcuguuguguucuucucauugcaucguaucaggaggcauguaaugccaguucaucuuguaacuaguaucucggcucacuguaaccuccaccucccaggguucaagcaauucucgugcuucagccaccugaguagcuaggauuacaggugccucucaccacaacuggcugauuuuuuguauuugaguagagaugggauuucacuauguugcugagaggcuggucuugaacuacugagcucaggcaaucugcccguuuuagcuucccaaaguguuaggauuacaggcaugagccacugcgcccagccgugauacuaacguugaucauuugguuaaggugcuaauugccagguuuuuccaguaacuccauaaaguuacuuuuuuggagagacacucuguaaauaucgugcuauuccuuaaacuuucaccccucagcuuuagcauucauugaugaugcuuggcuaacucuauuaugaugaugguugcccaaugaugauuuuuauguuauuauuauuucuacauuucuuuauuggcuuuuuauuguaagaaagaauuuuuucuucuccccacauauguguuuauauuucuguguuuguauuuguaacuacauggacuuguggauuuuuauuuuauucaaugggcuauuuauuuugauguucaaauugcuucagauguggccagugagagcccuuuccagcugacuccuggguuuagucaugucaucaucguuuucuauguacuuucuuacuuuuuuggcaucauaauauauuccaggcuuaggcucaccuuguacauuuccugagccaucccuggaaucagccauuucuccaaagagccccgguucuuuuuacuggagaaagguauuuagaagccaagaucuggggacugagugugcucauuccuguuggugugcugcugcucucagggcuuauuagggugcagaucuagaggagagguguaugcaucugcauauguguguauguguacacagcacauguaucugcacacaucuguguauauauguaugaaaaaggaugaauucauacugauaccuuuaauuccguuucagcauuacaggguuuauucuuucucccuuucucuauuuguguucuuuucucaggcagugaggaauccagcucccauuauccgugauauauuuauuugaucaauccuagaauacguacagacuagaauugcucaccccggccucuucaaauuauaaaccuaccagcuagaguucaaaauuuguuuaaaguucuuguuguccuuacuuauucugucuccucaaaaaaccuuaacaugucugcauuuuggcauuuaccugggcgaagggacuucacauucccugguugcaugcaauaugugagagugucacacacauucucauuuuaccccuaaacacuccuggaaccuagacggcggucuccccauucacuaacaaggccacuaaggcauguggagaugaagcagcaacugccaaguggcagaggugggauucaaacccaagucugucugacucacagccuguguuuuccugccauaauguaaacaugaauguacuuauaaggccgacagaauccaacucuuuauaaagacaggagugaaaccacagcccccuuucuacugacaguucuguuauugauuuuuuuucuuuaccaaggcugcucagcuggggcugggggcuuuuugucucauuuuuaggcuuggaaagagacaaguuugacaacaagacugucaccuuugaagagcacaucaaggaagaacacaacauguggcacuaucugugcuucaucguccuggugaaaguaaaggacuccaccgaauauacugggccugagaguuacguggcagaaaugaucaaggugaguggaaaggccuccugggagcaagguggacuuggggccuacucagcucugagcaaggccccagcagcccaucggggagcugcacaacagaagaauaacauccgauguugccugagcccuucucacggauggggcgcugugcucugugaacuucguguguucucuggagugauccucagaaccacuagauaggugguauuggccuguguuagugggggaaauguugagccucggugagauuagcacgugaccacggaacuggggcugggauuuuaaucuggaucaaacuccauagcccgauuuccugucgcuaugugaaucugccucuuuucuugauagugcuuuuuuccccuuucuuuuuaauuaacaccuacucucuaagaggugucuuagaggcaaagugacugcucacugcaguccagcaugguuuguguuugcccucagccucgccuuucugggagacacucuacuaaucguuaagaagugaucauaugauggaggaauuugaguuccaaauuaaucuuuucgcugaugggaaguguggauacugugucccaggaagcggggaagcugcuucaggcuguuagagaacacuucucgggcagaguuugcugagacaccaaacgugcgcugugggugucccgggccagcuguccuuucagaccugugcuuuccgaacaucauuaaaauguucagggguggauaguggcgugaggagcaugaacugugaaaucgagggagucucugugauucacgcuggcugccucugaggagaaggggccaacucuccuuccaguuaccaaggacuugagugcucggccugauaaugacuuacccuaaaggagccugcuuuuuaccuagauguaauuuucaggcuuuuuauguaaagauacuggaagucaggucuguucagauaaguaucaucauugacaggccuagaggcagccaggcuuucaguuuuauugccagcagggcagcgauuacgugguuguguuugcugaauaccccgauuacagaggcacagaggccucuccuagguucuggagggcuuucuggagauucugugccgucuguacccuugagguccuuagaguugaauuccaugcuucucaaauuuuauuguacauaugaaucaccuguggagcauguuaaaauucacauuuugacucagcagucacuuccaggacuugagauauucugcauuuccaacaaccuuccaggagaugccgaagcugcuggcccgggaaucacccuuuaaguaguaagagccucacagaggagacaaagcagaugcuuacuuaagauuacucucagagggguugugcgaaugaugaggagaaauauuccuaauccuuuacauacauuuggcccucuucgguuuguaaaauccucucaccucuaguauuguauuugguuguuaaaguuacgcuccauggggaacccggaggaagggacuucugggauggggagagauggauggagguucacggcagagguaacuuuugaaaaagguuuugaaagagaggaugaagucacuagggucauagauuagcagaaagaaaggagaaaaaaaaaucagcacagacuggggagaaaaagacacaaguugcagaaugcugaugauggcuuaucccuuuuacagauaaaagccaggcuggggguuaagugacuuccuaggaacaguucagaaggagcugagccagaauucaaaccaggcuuggcugacuguagaaaucgcacuccauaaucaugucguugauaggaaaccgggagggugcuggugauucugggagcagacuccuauuuuuaagcagcuuagggauucugaugggugccaguguggauuuccacaggugagguuuccagggucaggacacauuaacugaaaaguccucaguucccuucuuuuccuccaauuguugaaacuggcaaauuaaacccuacucgaucagcauuuauacugacacagaccuguccacaugcacagauaaugaccuucauuugcauucgaugucuuaaugucuagaggaggccuguacuguucacccuugacuuauguuccuucucaccccugacuuuguucucuugucucugaaguguuugaguggguccuaucuuuacaucuuccaggggccaguuuugaaguuuucucuuaaucaccuuacuuuccggucacagaaaacucuggcacacuuuuggguuucugucucaaucguggagacuuaaaggcgucuugugagcagucacuugauaaggauuaagagccagagugaccuguagcccgccacccacccaacccggucagagccugcugcguggcaacacucugagggccuggguguuuggugugcuuucuccauccacaucauucuuugauuauaugagacaucuugucagaaaaccuaaaaaucuuacagcaucaaggaauucuucucugaauguuaaaguuguugcagaaccagauguucugugcgcuaagugguggcucagagaagcgucagaucuaccgcuaaacgguggugccuucucgccugcgcugucugcuguuguguuuaggcuugaaaccacaugaaucccugcugcggacuccuaagggagcauuagccccaucaggguagcggcuggggugcccagcugagucauuuggugggggugggggcuggggccccaugggaccucagagcugcggugcagaggcuacaagaccaccugugggccccacuuagucacacccuguggaggcagccacaguugggaugaggcccccaccagccuccccacugagcgggggcauccuacccacugcugcugggagggaaaaucaggugaucucuugaaugagccaaccccaggaggcuguagcuacuccagcguggaggacagagaagggacagcugaugggcaguggcagagauggaaggaaaagcaggcuggagggcucacugcccucuugccuuugauacaggcucuuuuaggguaugugguccucaggaaaaauaccucuugccuaacugcagaaggcuggggauguuggauuacucugcagcucuccuuuagcccaugguugaagaucccagagacuccuggagacuuguggaaugacagcugccaaaaggcaacccaagagaaccaauggaaaagcccucagaugccacucgggcagggaggagcccagcugcccugagagcagcuccuugcagacagcagcaucagggauggcaaauggguuuucaucucaccccacacugggucauagaauuuaucuggggcacuguauugagaaggguucuuggaaacccaggcugacuuggaaagaaugacauuugacgagucaugaaugaaagaggugucugugugcagagccauggcccucccugccuagucccaugucccaagggcacauucccugcauugguggcugcucagccauguaaaaacacaacagccugucuagaucagauacuucaccuuuccuaauuccugcuggaacugccuacagacaaggugacaggaccucuucucccuguagauagaaacaguguguuucuugucaucucuggagggagggaaagagggaccacguaaagaagcucugucuuaaguugagaacucugcaacuagcuguucacccacaaguuaaucuuguuuaaacauaauagaucauauauuucccucuccccuuuuggucuuccccuuucuccuuucacuggagaugggaguaucccccucaaagcuggggccaggcugaugccuacuaugaaguccucacuacccaagaaguggagguagaagauccaaggugagaguuuccgcucugugccuucccucgccgugugacccugggcaagucacgggacuuugcugaccuggguuuccugucuguacaucgcgguuccuaccgccucacacauccguugggugguagacaugagcuaaaugagaccuggcaggugggaggcaugcacagagggagggagcaggcgaaagagcaacaggcccagagcacagccagccaggaagcaggggcugcggggcugacagcagagcugacagaagcaucauuuccuaugguuccaaaacucugcaagacaccuuggcugugggcacguugucacuaagaaaagucagagugggcaucuugacucuaagagccuccuccucuggaaaaucccugugucuuucucucucuugaacuuuaaaucuuuaaguguccuucaaaguugaggcagggcaugguugacguuagcguucuuuucucuguugaauuggucacagauacuugugaguucuauccaugucuuuagugguuuccuccacuugcuuuuacugcccagaaguagagcuuucauugauuuggggaguggacccugaguucuguguauucaaggcaaaccucagauuaaucaugaaaucauucaugguucacugguagauuuguccuucaacucaagcaccugauggaaggcgaugcugucgaguacucaaaugaccaggggaagugagcccuccuccacuguaacucacagcgccgcucauuccccgagaugcaaucucauauucacugacuugggcccuggacaagccugggcuuucagagaaaugugacuguggggugaccugacauagcccuuggcagaucaagggaagagggaaaaaaaauuuccuuucccugcgggaacuugaauuuuggugccauccuaguuuuggugauagccuuuuuuaauaagcaaauuuuuauuaaccuugaucuacauuuaaguuuucacaguaauuuauaugcugcauacccuuuuuugaauaauuuuagcacuguuugccuuugcucuagugccaacuaaacugagaaucuguguuagucuauagaugaugauuugaaaggccaugcuauuggagcuauuuaaucugaauaaguggugaauucauuaugagcacuuugccugagagaaucuagaugcugcacccugggcauguugcaguuaaaagaccaaauauuugauucccagcaaagaaacagcagcccauuuuucuaguauagucaaaugcaggagacuaaauucuucuugaaaauuagaaauuugagcagcauuaagaaggaagguugguaaagaagaccaaacaguaacuuaaguacacaacaguaacaauaugaaacuaacauaagugcccaucaacaaaugaauggauaaagaaaaugugguauauagacacaguggaauacuauuuggccauaaaaaaggaaugaaauccugucauuugcagcaacauggauggaucuggaggccauuaucugaagugaaauaagccaagcacaaaaagacaaauauugcauguucucauuuauaugugggggcuaaaaaaaacaaaaaacaaaauugaucacguggcaaguggaaagauagauaacagagacugggaagagugaguuaggggaaaaaggaaaggaggaagagaaauggguucaagggcacaaacauccaguuagguagaaggaauauguuugauagcagaguagaaugacuauaauuaacaaaaauguguggugcuugggugauggacgcccuagauaccuugacuggaucacuaggcacuauauacauguaacacaauuucauauauaccccauacauuuguacaaaugaaaaaaauauaagacaugucuucugcuaauuauagauuucacuucuauauguuggaauucugcccgguuaacauaacucuuauauuuucggagguguguuuuugagugaauugcauauaaagacggccugaucagauagaacacuguccaucuacauuucagaaggucccgauaccuuggucuacucuggcuacuucuguaggacagcauauucgucgacuaacguggacagugaaauaucgggggagaaccugcccccccaugguagcuagaguguucuggaaugcaccagcgcugccguuucuggaggagcagucugugcugggcucugcuuuaccucgggaagggcagauuggauaguaaggaauagcucguguguaaucagugugcggaaaauaaacacuguaugugcaugaucucacucaauccucaucacagcaugguaggugguacuauuaacacuuuauagaugggaaccuaaagcucaggaaggucgagcaacuuuugcagggucgcggcgcugggaagugcuagagccaagacugaaauccagagcugcugaaccagaacccacccucagguuguccugacccacauauccgcaugugguuaccugugugcacaugcacacagcccuccugucagucugcagccauuggcuggcuggcggcaucugguuuggacuggcgcaucuuagacuuggacuggcucaucucccagccccgaccccgagugauacugaauuagccuccuuuaaaagaggcaagaugcaggaaaggccccucugcggguagagaggagagugggaaagaggaucucccggggauacugaccggcucaugcauaaaucaguaagacaggaguuagauggggugugacuuuccgagcugcugccgccagcaaccacugcucagacaaccacuucacaacccuagggguuguugagacgguaggaguucaggaagggguaucaagugcagcccuugcaaaggauguaucugaaauauauguuaauuuugaccugcugaaauaugagaaacuucacuacccucaccuuagcuugaaacagggaaugacauguccuuugguggccagauuugagaggugucaaaguaaaaggagaaggacgauucacuacaaccacagccagacuggagcuuccacacccaggugacucaucugaacgacuuuaacucccuaauaauuacacaugagaaugucugcuccaucauccuuuaagccuggugcugaguuuuucucacaguggggguagacaccucccuacuuucucucuuugccucuccugcucccucuuccuugcccucaacauuccauuggagauuuuccaguuuguuccauuacggguuaguucacuugaccucuucagaaacuagcuauacaggauccagaagcaaaggagcaauuuuccagaucaaaaguaggcucaauguggcagcaagugggaugcucucaggaggugguggggugcuuuugcuuaggaggggagagcccaggagcccgcauuccugaaaaaugcuuuccugagagcugcggguaauuugcuucaaaaaaaguaacaugcaaaagagccuuuuugccugacaagcaccuccuggguaacauuuccaagcaaauaaguucuauuagcuaauucagugcuacuaaacaucuaugaggaaacauuaugagaagauucaaaagcaguaggacaucuggcccuugugcuuaucuguauuugauaagaugacacaggaagcaaauacagaaagcaacguguuaacaagggcaaaagaucaaaauggaaacuuaauaccugcgugucacuaccuucuguuuaaaaggggaacuggcugaagucuuaccuugacccaagagagagccugugaaaucugcagacacuuucugaaguuggggacaacagcuuccagccagaggcaacgcaaggaaccaagugcaggggcuggugggaggagaguuuccugcagaucaugauuagauaagaguaaggaccuagguuugggggaaaagaugguggcagcagugaccggagccacgaaaugagccugaaaauucacacagccaucauggggcgucucacuuuaaggaacucagaaguuggagucccugccagacagcacuuaggugcaggagagaggaagggcgaguccaacagggcgugcacuuaacccuggucugaccuuucugcccgccugugcaccuccucugugcaugaagcaggcagcuccuggcuguugauaaagugccguggacaccuucugcuucgugcagaugcacgaugauggguuugggcuuuuauucugaauuccagugaggaugcuggcaggaagggagugccuagguauguuccuagaauauugauauuucaacauugguagugcugagcagcagcuuuccuuguggccuaaccugggaggccacgagcauugguuaaaaugucaccugggcucugacaagcccuuaaccaugggugaggauacagccugugcugccugccaaauacgauucccagaaugcccccugaaguuagcuggcaccacggcagagucaagaauaucggagcagggaggagugaagagggauuuggcacuggcuucccgguggcuggaaacagugugucagcgucacuggacucgccgcccagccagccagccaggccucucucaccccacccugugcacuugggcuuggguucgugucaguggcagcugcacaaagcaguugcugagcuuaaguuuccccacccagccuuagaacacauucugcccuuuagucuagggaggaugaaaucaccccuuguuccgugcagcacuucacuggcacuuuccuuucauugugaggcacuuggcguuugggccccgguucugcacugaccucccagugcucuccuccgaauuuccuacauucugaccuucguggagggugugccaggugccguuuguaacaaugaguugagcagagccaugauccucccugaaggagcuugugugcuaagggagagcauggggcgugagucagguauacccaggagucuagucugugagacugugcaggacaugaggguuaugcacagacauuguuccgucagccacugaagacucgcuucacugugcaugaaaccacuucuccccauuggcuacuucguccaacgauguaugaguuuguacaugcuuauuauacacaugaaauaccugcauacaugcacguuuuccucaacuuggcagaucugauaagcuccaaaaguacauuuucuccccaccgcccauacccugacccacccuccugcuccugccccgacagcaccaccaccgugcugcccggcuugcccuuuacuuccagacguccuaacuacauuuguaacuccccugcuucaacuccuucauuuccuguguauucuaaauauugacugugucugguagagcuggacuauaguauaugauacugagaagugugucaccauaaaaaugcacuuauaaaacugcucucaccuggaaaauguucugaauaugacugucuacaucagguauauauauucagaguucuuuaaaaccugcgucuuuacaaugaagccuacugucaugucucuagggaaugugagaaugaggaaaagagguuaguauuuagggauagucauuuguaugagaaagcuauacaaggugaacuagacugaguuuccaccuuuuacaaauccucucucuucagggccucaguuuuaccaccuauaaaaugaggaaguugaaucaaagggucucuugugcccuuuguagggucuaagauuccaauaagcaacauucagagugcggauaggaguucgugaaauaugaaacaggaaggugugauccuuagggucugagucagggaucagaguacaaggggcugguuagaaaaggggaggguuuggaaaggguuaaggaauuuggagaccauccacauggccgaugaucucuuucccccuaaagagaucuagcuguguggaaccuuucuuccaaaccacucuuaagucaauaacagugcugguacccuucucaguucuucaugaaguccuguagauggcgagacggauaacaucuuccaucacuucuuucucggugugucuaggcgggacugaccuugaguaaaaccauuucagcucagagcuuuccaguauaaaagcccaucagaugauaaagcugagauggaacgugguugcguugaagcagcuuauuggugaggauguguguguguguuuucaaagauaaauguaucuuuccccgaaacaacagcauagaacuuuggaaagauguuucccuaggcuuaaaacaaacacaaugcauuguuguauaaaaguaguaauggaucaaaguugaauacuacuggaauccagaaaagaauagaagaaaaccacgaaaauugcuaaaauccucauacauagccacugggaauguucuggcauauuucuuagcuaauugaaagugcaggggaaguugccuaagcgagaugucauaagccagcuuggaugcugauguggggagaagggugagugagccugauuguucucuauucagagucucaaaugggcucgcccugcccuuguccagcacggguggccggccccaccuuuuucuccuccuguccucugguuuccucagccuggcagccuaggugcccaggacccagcaagugugcacccuguguaccauggucccugugcaccauggcacccugugggugcccaggaaauccuccaccgguggccccagaaugacuugaaaggauuauucugaggcuggcucuuccuagggauuucaucagaaacgggugugguucucucugcugggaugagcccaucuuuguugcgcuguaucauccaagaacaacuauggagucugggaagggugauuggucauuccaguccagcugaagauuauauaauguggccuguuuugguaaugucauucagagcucaaaaacagaaccagacugacaccuugauuuaugccguuuggauacccuucauguggcuuagcugguaaaaagagaaaucaguaucccuaaaauuuuuaucccaaagaaagaaaggaacuaucuuuacccaggagcugagcacugaaauuagagucaauacguggauugcagugcugacucuaucccagcucuaggcagaugacauacugauuuauaauacuuuugcauaaugcuuuccaguuugugggacauuuuuauagccaucugauccuuacaguaacccagugagguagcuggugaggugaucucuuucaaaaaagaaagaaagaaaauagaccagguuggugagcuagcugacuuauacacucauucaccguccuguauacacacaacugaaacucuucuuauuacaggccauugcuuuuucuacugacacacuaaugucacaaggcuguggcagaaauguacagaaccugugaaauacagggauauuaauaugcauguggucugaagucacuguacuuuugggacaaagagaacugaauuccuugaauuuggggcuggccaacaaauuccggguauggaaucccauuuuuaaaaaauuaauagacucacaggauagaagaagaaaaaaaauuaaaaagaauaaaaggaugauaauuuuuuaauaagaaaaaauuacuagacuuuauuuuuuagagcaguuugaaguuuacagaaaaauggggcagaaaguacagaguucucauacaugcccuucuccuccugacuuccugccaguuuccucuguuaguaacguuuuguauuauuguggccuguuuguuuguuaagauuugauaugccaauauuggauacauugauauuaaugucccuccaucauuugcugcuuacuuuucauguugugcauucuguggguuuucaccaauucaaaugacacguauccaccuuuagaauaucacacagaauaguuucugcucuaaaaauccucugcacaccuccuauuuaucacucccucccucccucccccugagccucaggcugucucugaucuuacuguguccaaagaugggauccauuuuuuaggguuuuuuuuaaaacauguauaacaguuuuuuuuuuuuuuuuuuuuuuuuugugugugugugugaaacggaguccugcucuguugcccaggcuggagugcauuggcaccaucucggcucacugcaaccucugccuccuggguucaagcgauucuccugccucagccuccuggguagcugggauuacaggcacaugccaccaugcccagcuaauuuuuuuguauuuuuaguagagacaggguuucacuauguuggccggguuggucucgaacuccugaccucaggugauccguccaccucagccucccaaagcgcugggauuacaggcgugagccaccaugccuggccuauaauagauauuauuaaguggcauuucagagcuacugaacauaaagaugacuauuuuuucaccaaaaccaacagauucuguguuuuuguuuuuggaggguuuagguuucauuuuguuuugcugugaucuuagaaaaauuagcucuaaagacuaauuuuuuuuucuuccucuucaaugaaaauaaucacccuagcucauaaaagggacaaaugauuuaaaguccguuaagugucccauauuccugcuuuugaagacauaaauauuaucuucaagccuccuccuccugacauuuucugaggguuuaaauacauggggaggccaaaucucuguuuccaggccuaccccguacccccuucuagucguuuccaucaccugagcaucccuaggcauucugagaacauccaguuugucuuccugccuagugagagcaguagacaugaagcugccauuugaguuggaaagaccaucuucgccuccuugcgucuucccagaggggauucucaagggcagagaaagcaacaagaccauuuuucuaggacccaucuucucccccaugacccuuucuuuugcccucaagccccccucacccucaacgccucauucucugauuuggcuauaaaagauuccacaaaaauguuccaucguuuaggugguaaacguaaaacucuaccugagcagacuuucucugaggaggugauugauuacucgguagucuuucuuagaacagccucuucuuuugaaccugggaagaaaaaaaaauaccccacuucucagaaugauucgcauuugcaucauacaauccaacuuccuccuccgucugucugucuuugucucucucucucucucucucucucucacacacacacacacacacacacucacucccucucucugucucucucccucuuuccagucaaggacauuucaagagguuggucaguaccacccccauaucuaaaacuucaguguuugccuucgcagggacuuuuccaacuuuaccuagaaaagaacuaaccagaaccuuagcacuuguggucagccugcuuccggcuguggcuucaguuaguuugucugcuccgagagaggaagcacuugcugugacgggaacuguacuggcuggauuguaggaggaccggggcagacagugccuaaugacaucgguaugugagaugccagcagcaaggagugagugaagcaaagcagacugaagccagagucagacccaguggcagaugcggccgacagaugcucagugaccccguaauccucuccccaccuuccccucccaaccgcauauacacacacacaccccaagauaauucacaacagacaaagcgucuuagcugaagaugacuuuuccaaaaauccauuagaagccaagacacugagacacguuuuugaucuugaauagaugauacaggcaagauucugcaaacauuucuaggccuucagacgcuggcuggcuggagaggcgugggugacaggcuucacuggagucauucagcacucaaacaagcucagaguuuuguaugaaagucuuagcuagagagaaaguaauuggauucagguguucucucugugccuauuccaguaacuggguuauagucuaaacauuugcacuuugagauuuagauucucugugcagagggggacccuguugguggggaaccuuauaccacacuagagccuguccuacugcacaggaugcaaagccaacgggaaauugagagaacagcuuggcuaaaauugcuaauuaauuuuaacuaccagguacuucuugguaauuugagauuuaauuucacagcccaggaugauuauuuaauuaaaacacugguaacaccuaaauuuggggcucucccccacuucagugcagaaaagauaagaaugcuugccagugggaucccucguagcccagcuuuucauuauuagauauuaagggaggcacugggggagacucugugugguggugauugauaaauuucuggaccagaaaauccuuuugcuaucuuugcauugaaggccuccugugaaauggagaaugaggcuuuaucccuaggaugggagcacauggcccauguggccugcacaaaguaugaccuucuuugaaacgccguguuuuaacauuugauugagcacuuugggagguggugguuggaucaccugaggucaggaguucaagaccagucucuacuaaaaauacaaaaauuagccaggcauuguggugcaugcguguagucccagcuacuuaggaagcugaggcaugagaauagcuugaacccgguagauaggcagagguugcaaugagcugagauggcgccacugcacuccagccugggugacacaccaagacuccgucucaaaaaaauaaauugaccuuucuaucuggucuacguaacuuuuugaauuuaauauaaaaauauuucaaucauuuaccauugauuaaaauggauauuguacauucuaaaaagaugcauuauuucuuuuuauggcuuuauguaccccuuggguggggccaucaagucccaggauuacagguacgccauguagcagcacaagacgcagggcaucagugccucuccaccaccacugaggcgaggggcagagaugccaggagcggcccuuggcaugcugaugggccccauucgugucuucagcacacacucuuuagacacucacccuuggagguagggccuccgugcagcuccacagaggcgaagaacuaugcauugagaccuggccggugaccacaguucuuggacuaaagcagcuugagaauagagaccuugucuuucucaucuuuagauccucagcgcucaaccccaugcaggacacagauauuguaaaaguucaguaaaaagcuguugaauggagaaagucugugcauuuugcauuuauuuguucaaagacccuucugaaaucauugccuagagggccaggagguacauauggcaugaaagaaggugaggaaaauucucauuuuaaucuguagucauuuggucacuugcuauuaggaaugagggagagaaacuguuccuuaaacuuucggcuaugugcagacucuugcauugguuuucuggagucuuucgaaggccucauuaauguggacucuguuuggaaauguguguuuucuauuuuuauagaagguuugcuaagcaaaugaacauaugaaggauuugaaagccagauuuuagauggauucgcuaacauuuuaggcaguuuagauucauuugcaugucaguaauaagugagcuacaggugaguuccgacugcuagcagugaggacugugaauguccauccucucuccucuccccuggucugguaaggcacggcggccuuucacagaguuccugcuuccuucuguuucccucuagucuucaacaguccaagcugcuccugccugucugcccucauccccagcuccagccacacuggagccucacugugccaguggccucugugaaaugcccucaugcuugcccaagggcuaaccuucuuuagggccaagccuugcuugaagaggauuuuagccaaucaaucagucacugguuguugggucuuacuuggacacuacucucucuaccgcuccuagauacaacauagccugcauuauuccuuaguuaguuuuuuauuuguuuucagagagucuuucugucacccaggcuguagugcgguggcacaauuaugacucacugcagcuucgaccuccugggcucaaacgauccuccugccccagcuucccgaguggcuaggacuacaggugcccaccaccacaccgagcuaauuauuuuuauuuuuuauagagauggagucucacucuauugcccaggccagucucaaacuucuggccucaugcuauccacccaccucggccucccaaagcacugggauuacaggcaccagccaccaggacuggccuguuaaaaagaaaaucuagauggucacucuccuugacuaaauuguaagcacuuugauggcaggaauucuaucacauacuuagguaucaaaacuguuucuccuuugaggggguccaggaugcagugaccaugucucuguugcucacuguaguauccucaacauuguuguauccaaagugggacuuuguaucuuuuuucuucaauuuguuuuccucaauugaggucagucugcaaaaauagguagcagccaccgugaguauccagggccucgugcuaagugaucucucugcagcugugcuuugguuuguggcuucagcagcccagcccacgucaucccuccuccccucgcccuagugggagugagugaucaccagugaccugucgccuaugugugcccucuucugaaaaaugagguuuccuccucagaguugcauaguccuugaacaugggcuacuuccuuggugggaagauguggcugugucugaaggauugacacaggagagaugaguacagucaacgauaggccacugcagcugcacgggagaaaacugguuacagguggggaagcacuuuggguuucucagcuagucaucucugaaauggaauauuuuuuaacgaucuuuugcccauugcucuguggugggaaauugaugaauauaagcuaauguuaagacacaugaaugaaguguuuauucaggguauaggaagguagagauugccauuuuucuccuccagcagucacgauaagcagcucaggcuuacuacuuaagcauuuguuauuagggugcaugcagaagaagaguugcauaucauucuguccuuccacaagcuuuuauuaauauugaaugucuacuaugcucuagucaguauacuaaggugguuccugccuucauaaagcucacaaacuagugacugugacccugcccgcccacccaccaguaucuuaagcaaacacucuaugacaccuuguuguccaugugguaugacugcuugugauauuuuucaucuagcucucuuauagggcuucuauauugcuagauggcccuaggucaagauacagcucaaugaucucacuugaguuguaauauuuagacaugucucauggaguuucauuauuuuaaauauauugaugccuucuauuguauacagcagaggugagcaaacccagccugcugcccgcauuuguaaauaaaguuuuauuggaacauggacauacccauuuauuuauuuacugguuguuugggggguauaacggaguagcugaguaguugugacagagaccagguggcccacaaagcugaaaauauugacacacaaaaugucgccgacccccacgguguacacaaagcaacaauuauccagcauuccgagugagugugugugugugugggagggggcuugauuuguuuuagaaagaccauuaaauguauccuuacaagauaaaacugguccaggugagaaugacaccagacauguggaaugagucaguuuucuucccccugucucaugcuaagcuuuucuuacuguucauuccugccucucuguacagaacuuauguaugcggcaugcucuuugggagaaaggcauaugugggcagaaggaagugaggugggaggaggaguugucccauucuguuaaccaguagugagaaauacuguuuacaggcauaagcuauagacaucaaaaggauggggauggacgggggaggaaacugaaugggccuuucuuaggcuaguugccagcacccaucaaccacuucaggcuggaaggaaaaggaaacaagaggagugguuucuauaagcucauaaacggggacauugacagaagagccuauuccccauuuucagccucuuaaugaucuccucacccacgcaaacgcauacaugcacacguaucuguuaagugacagaacaccugggaccuuaaaauucacuucacuucaaguguuugcaaaagguuuucccaguauaaugcauuuuaaaauacacagcauaauaugaggccccuggagcagucaaauucauggagacagaaaauagaauggugguugcccggggccggcgggaaugggguuaguguuugauggggauggaauuucacuuggggaagauaaaaaaauaguucuggaaacagaugauggggaugguugcacagcagugugaauguacuuaaugccacuaaacuguaugcuuaaaaugguuacaaugguaaauuuuauguuaugcauauuuuaccacaauuuuuuaaaaaaaccaaacucaucagccauguaauuugcaaagaucagagcagcaguggcaguauucagauuuggagauuaggacucuuguuuagaaccuauauuuccccuauauuuaaauuuaaaguggcuuccucuaagaauucagaguuccauuguaugcaauuaaaaagauagcuacugagcaauuaaaaaaauacacagcacauaaguucugccauagaaggagauaaccuaaugagaguuaggaaacauggcacgguaagcuggccuuucuuguuuuuaccucuagaagugacucagucuuuuuuuuuuuuuuuuuuuuuuuuaauguggauucuaggaaagaaaccuugacugguuccccaggaugagagccaugucauuggucagcagugauucugaaggagaacagaaugagcugagaaaccugcaggagaagcuggaguccaccaugaaacuugucacgaaccuuucuggccagcugucggaauuaaaggaucagguaaagaaagaaaaucccagcgccuacccucccaucacuauccccacccacacccacuaucaccacaccaaaucugaugaggaaaaucaguagugcuucaucuagauggaaaagggagccaggcaacaggggacaaacccacucacuccuccagucuccucaccccaauccccuucacugcccuuuuccaggauaaagccauggugcuacuuucagugcugcucaggacaugguuuuaauaugaaaaacaaaaccaaaaaaaaggagggaaaugcagacuacuucagugaaguacuguccaaaaaccacuaugcauaaagccauacccuuuuuacuuuauguacuguggaagauuaaaagcuguuucuuguuuugcuuccuagcccucagacuugucaaauccucaccccauauauuuaaauucagcauccuaggcuaaaccauagucauggaaaagcccuuuugguuucauucuuuucucaguggcuuacugaguggcuaucauaguacaggaauuaugccagguguuggggauaaaacagugaacaauauagacauacucccugaucucacaggccucaaccauccacagaaauacugccugcacccugcuuccuauccguaagauaaaugcuucgcccuuaucuuauggauaggaagcaggaugcgggcaguacugugggcagaauuuaaauuggaaacaggcaguuuccaauuuaaaguaaguuguaggggacauguuuauacaaaaccgugcguacucuguuucugcccuuuugacuccauuaaaaugaacaugccacagucaccaggugguuaucuagugauaggaugcagcuguguauuaaggacuuguacccuggguggugagaagacccugauugguuuuauuagugcauuucuguaagugacugggauaaucauguucaguucagcauuuuaugugaguuucugaaagcucuuuaaucaacuccauagacaagauuauaguguugcacagcaauaggcaugggccaugucugcacuggagguaaguugcaagguacacccacgggugauuuaucacucuuacaaagaugauaacuaaugaagaccgcaucuagaaugcucuuacuggagaugguuuacagagcauuuuuaaucaucauacuuagauuuauauuaauauuucuuuucaaacuaaauuauuccaaacugugcccugagauaccauuuggccucaaguucuuuucuuucgucuguauuaaggugcaaauaaaaaagacuaguaggaaaagaaggccuuauuuaugaagguugucuauagcucugagcuugguagcuacauaaaaugaguaauaaccuaaauaaguaaaacuaaugaagaucuaacuagauuacuuugcuuaauauuaacauuuuacccgccccccgccgugaaacauuuggcagauguucugcaggacucaugaggacauugguggcuacagcugcuucuggcacugcccccccaaccccccagugaggugaacuucuuuacacauccagcaagcuuuaguuaucuucuucucccauuugagauaacuguggcuacaagaaucucaguuaaaucagauguuuaaauuaggugccaaaaaaucuuacagacacugaacuaauacuuaaauaaaggaacacuucaguucuccauaaaaucuggugucauuuuccaaagaaacagaggaucuuuguuucacacccgugguacuggaauugcaacagugaggcauucuagcucucacaugccaaugcgaguggcauucauucuugcucacucauuucugcuucucauugucacacuuggaggcucuuuggggguauguuucaguugaucugagaaacuggguguuaccaauuuacuagagaguuucuuaaaauguaucugaaacaaacuauuaaugggcauucuguggugguaaaaccaggcaacgccucccuacacuaucuguccuuucagagcuaagaaucuguuauuuugaauuguucacgaagagugauucugacucugcuucagugcacacuuuacaaaccauugagccucaucaaaggagugaguugagcugaggaauuagaguaaagaauacagguauagugccgggcgugguggcucacgccuguaaucccaacauuuugggaggacaaggaggguggaucaccugaggucaggaguucgagaccagccugaccaacauggagaaacccugucuuuacuaaaaauacaaaauuagcuggacgugguggcacaugccugugaucacagcuacucaggaggcugaggcaggagaaucgcuugaacccaggaggcggagguuguggugagccgagaucacgucacugcacuccagccugggcaacaagagugaaauuccaucucaaaaaaaaaaaaagaauagagguauaggacaguauccgagacuucagaugccaucucaccucauucccuuauuuucuugaugaggauaccaaaggagcccagaagguucuuaggcauugccagggcaggagcuccugaucauccagucagggguguguguguguguuuuuauuugcuuuguuaugucacuguacuguuugccuuucaugguugacuguuuaaguucuuacucuuuuuuuaaaaaaaagcuugaaguuucagaagucaagucgcaucauauacuuaaaugguauggaggauacauucauugucauuuuauacaagugagcauaguagagacuuggcauuucuaaaauccaagauaagauuauucuggauaagccaaaguuuuaguuuaaacaaaauauguaaaauuugauuacauauggacuaagguucauuaagugacauuaaaaccaguaugguuuaaacugcuugauuccagccuuuuaugcauuuuuuauuuugaaguuggcaguuggaaccacucuucagaaagcccuuccccugugaaugaauuugaacuguuuuuuuucuuggaagauauuauaaguuaaaaagaagcaugagaauccaguaguacauucucaagugcuuuuaccaggauugaucuacuuaaguuuuaagguacucagaauuacaggaaaaauucagcauagcugcuuuuuuuuuuuuuuuuuuuuuuuuuuuuugagggggcagggggauuugcaucuuuuaaaaggaaguagucaguguuuucuuuugauuauguaacguccuacaaaccuuuaaugcauuugagaaucaacuuguugaauagauuugaauuucauuaaguuugguuauagcaaucauaaagguuuaaaaacccuuuaugugcaaaagauauuaaaaaaugcagauauguuacagagcugcucuuucuuaaauaguaauugugagaauucuugcccuuugugggaaaaaauuuugaauuaaaaaauaaaagcuccaugaaugauuaaugaccaagaaaucuugugauauuuuuuaaaacagcuaugaaagaauaccauucacuaguaaaagugcuagaaaacacaaaaauugcuccauuacuuagagguuuuuuuuguuuuguuguuguuguuguuuguuuuagauuuucugauucaaaaaccagcagacucgagcaacgauagcuuaaauguggaugacuuuggucuaaaucuuuacuguuauuuaccucuuugauuguuucguuauguaucaaucugagggaaaaaaguucuuguuaggauauuaguaaaauuaugguuaguggugucacuuuuucuauuauugccaagaaugguugguuaggauugcuauucuaaguauuauuuaacgaugccucucaucuugaaguuuccccucccaagagauucugaacacuaaaugugauucucuuacauucuuauuccaaggaggagaacuaauguaagaacuuaaaaaucuuuugcauguuuucuucauaaugcaaaagagcaaauacuaagaagggcuaacuuucuugaaaauaugacuggcuuccuauaggacagcgaccauuauuugcuguugcuaggaauacaagaagugcuugaaaauucagaucacauuagcauguuacagcauuuggcauuuuucauacaagaggguuaucuugcuaacauuaacugcuuaaggacagaaggcauaacacaagauuagaauaacugcccaaaguuggaaaauggaauauuaaacgacccguacugcaucuauguuccuuauacugugcugggaccacaaaagaagacuaagucaacaucugcccucuagauccaggaucuagcaagaaagacaaagaaguagaccucuagcaaucugauacaguaugaaugacuugaggcaugaauaguuucauggagcacaaagaaguagguagguagugguccugugugaaguuugcagugcagaaggaguuuagcuuuuauaaucuuacaagcaggugacuucugagcuggcagagaaaugcaguagggggcuucccaggaaaggaaucagcaugagcaacggcaugaaaaugcauggcaugcucaaggaauggcaguauggucugguuaauuccguuccuucuuucagccaacacauaugaaacaccuguuugccaggugcggcauuagguacuggggcuacaaagaugaauagauccucuucucugccuucaagaacuaaaagucuagagugggaaacaaguaaacagaucaauuauaauuaaacuuggugaguguguaaccgagcugugaacacauugcucugggaauggagaaaagggagugauuuguucaaucugaucuucgggagaggauuagaguaauuaccacagaagucuucucagaggugguaauucaggagcuugguuucaaagccugaguaagaguuggccaggugaaauagagagaaacagagcauuugagaucaacucuaagaaucugaauuguaucuauacauugauaguaaaucaacauauuuguauucaagggaugguuugguuucauuucucaguauuugaggcucaucauucugaacaugacugauuuuauagggcuguagaaaauaacugugauuacuagaauuugcuagcuguuuagaaucugaguaaccaagaccuuccuguaacaugaaagcagcuuuucaaagacuauuaagauguguuauaaaccagaaauguggcauuugugugcugucaaugaacuuuccuuccagugccagccuuuaaucauuuagaggcaauacugguagauuaaaauuugcccauuucuacuguaugccucguguuuucaugaacagucuuucagaugucuggcuguaucugacuuguaaagcuacacuauucuuugcuucuuguuuagaugagucaaaaggaggaaugcugaaauucaagcuaguuucuacauuuguauagaugugaagaacagcauuacuacaacuguuuauccuuagcuacaugggaauuuugagguuugguuuggguuuuuugcuuuguuuuguuuuugagacggagucucccuguguugcccaggcuggagugcaguggcacgaucucagcucacugcagccuccaccucccagguuuaagugauucuccugcuucaggcccccaaguagcuaggauuacaggcauguaccaccaugccuggcuaauuuuuguauuuuuaguagagaugggguuuuaccauguuggccaggccggucucgaacuccuggccucaagugaucugccucccaaagugcugguauuacggagugagccaccaugcccagccguuuugaggauuuuuaaauguacuauaaaugagacaucucacacuacucaaaauagauguuucaauauuagaauuuugaauacaguuaccauagauuuuuuuuacucaagagucaauuuuguuucagauguccagagagacuauuaucugacaaaaaugcuaaggauagacuuuggucauuauauuuguuuugauguagguaagaguaacagacaauaaugaugccuuauaacaagauauauagauaguacgugugaauguauguaggugggguagguaaguagauaagaagaauugaacuaauaaaaccagaaauuaugugagaauaugcacuaagaggcuggagaaaccuaagcguccagaauuguuggccucaguuucuuauaggucagauuuaguccuucaggguuuugagggguuuuuuuuuuuuuuuuuuuuugguucucuuguaauuggaugaugacugcuacuaaaaggccaaacacuuuagcaguugcccaauuccuucuccuuuagcagucacuuaaauggcagugauguugacuuaaaugacagccauucugucuaaaaggccaugguuaaucaaaagaguaucagucaaaugugugugccuacuauaugcucaguugcagacaaucuucuccaagagcuucccucauuugagaaaaauaauauauguacacaaauuacuuuuuuuaaaaaaaguguucaaguauauacucaaaaugaucuuguccgauuuuggagauuaucagugaaaaaccucuucuagagcagugguucucaaaguguaguccccagaccggcaacgucuacaucaucugggaaaucguuagaaaagcagauucaugggaccuaccccagaccuacugagucagaaacucuguuucugaucuguguuuuaacaaauguucugggugauucuggcgcaugcugaaguuugagaaccauucuucuagagaaacagaaaagaacauuagauguguaguugguacuuaaaauuaucaggaauaugacuaccugagcaaagaauuggccaauaacccacaucaguggggagccuuaaggauagggacggagggagggugggcgaugggaucacuuaugaagacagaugaauagggcugcuaacugaggaggcaucaggccgcggcuguggaagugaaaaggaagccaggccaccaacugaagacuccuuuguuguaaaguuucagagguuucuucaaguugaagagaaagacuaacugacaaauugaaaagucaaggagagcugauguaacaaacagggaugaaaauacgcauacuaaaaggucaucucaaauacaaguaguuauuuaaagcaaaauuacaggggaaaaaagucuuaauggccaacuuugacauucaacuuugaguugaaagauuucagcagcuuuaaauauaagcuuugaguaaaguauccuucaauaaggguugagcagaccaagauuuuuuuuuuuuuuuuuccaagacaagaucucaguugcccaggcuggagugcaguggcaucaucacuguucacugcaaccuccaccugccaggaucaagugauccucccacucuuagcuucucaaguagcugggacuacaggugcacgcuaccaugccuagcuaauuuuuuuuccccuuugguagagaugggguuuugcuacguugcccaggcuggucucgaacuccugggcucaagcagucugcccaccucagccuccccaaguggugggauuacaggcgugagcccgcugcaccuggcugagcacaccaagauuucuaaaucaauuugaacacuugagauuauccaaauuuagcuaaguuguauuggauucccucucaagguuaccugccaagggaaggguugugggagaaaaaucugagcuaaacaucugaacuaucagguaguaagaugaaugaauuacuggcauuuuaaccuaauugugaauuuauuucaugugucauauuagguucuccuuccugagccgaaucuguggauacaguguaguguguaacacuuccuuuaaagaugucacucaccuaaggaaacuucaggggcuagcuggaauuuccuaauccaauucuuaauuaaaagcuuuauuaaaagcuaccuuuuggaaauacuaaguccuuguaagucuucucaucuaaauuauaacagagaaagcaucuccacaggagccuaaaaauaguauuuugauuugagaggauaaugcuaguuuugaagaagaaaaaauaaccacauugaaauugaaccuagguaaauuagucuuguuuuauguucucuccagauauuuuguaccaaaaaugaguucaugugaaaagugagauuaagugucacaucuacuaugugacagaugcuaugcuaauaaauuugcguauaaccucgcaauucuccaccaaucagcuaggaauuaucauccugauuguauggaugagaaaacagacuuugauaaguuaaaugacaaaaccauaagaaacuagaucugauuccaaagccuuuauucuuuuuacccuaauuccucuacaauuuuaggaagcuaaaaacauaggaguaggaccuuaacccacuugcagacaacaauuuucuugaauauauauuccguauagccuuuuuaucucaguugacuugaaugcucacccuaaaauccaaaacuaagacuaacuggguuaaggaaaaucuuaauacagagacagaaguaaguaugcccuaaaauaccuagaacaggucuagagacccaucaacaugagaauauauuuaguucagcaaccaaaugaauagaaucggcuucuuguuugggauuuugaaaguacuuuuucauuugaacuagucuuaggcaauggucucgccugaccuucagcgagccucagugucuacuggguggcaagaaauagauaccgugaauggucacagcauuauuuacagcauuuaaucauucuggaccucaaagagauuugagaacauuucucauuuuccuaguuaugguagguaauuuuuuuuuucucuaaccaacuacucaagagucauugaagagaaaaaucaggacccacugaaaguguggacacgaacccucccucucaaaccuaggauucuaaacacugcuuuucuuguuaguauggcguguuguuacuaucguacaaagccaccauuuuccaaugagucuucaaaucauuuggaagugcauuugggaaacaagaaagaauccugugcuuuuauuguuuuuuguuucuuuaugaaacaaguggcaagcaauacuucugaauguuacauugcaugacuaggucacagaauuucccauucugccuaagaagaugccuuuuuugaagugcuguguguuugauauagcgaugguacacuauuuguagaaaguggguuucaguauaaaccauaaccacagagguaaaucuaugguucaguaugcgauuugacguacaggaaguaucugggucuaaugaugaaacuuuuuaacuuuccagaugacagaacaaaggaagcagaaacaaagaauuggucuucuaggacauccuccucacaugaaugucaacccacaacaaccagcauaagcaaaugaaagaaaggaauuguauuuaccuuuuauaauuauuauuaguguggguauggcuaaugaguucugauucacccacgaagguuacauuuaugcugaauacauuuguaaauacucaguuuuauacuguauguauaugauugcuacucuaaagguuuggauauauguauuguaauuagaauuguuggcaugaugacauuucauuugugccaaaaauauuaaaaaugccuuuuuuggaaggacuaacagaaagcaccugauuugcacuugaaccagauuauagauuuaaaaguauaugacauguauuuuguauuuaaaacuagaauagccaguauuuauguuuuuuauaaaacugugcaauacgaauuaugcaaucacaauacauuuguagcucccgaguguccuaaagggagugcacuucuuugaagcugguguguuaauacuauguaauaaaugguuaacuuucaaaugaugcugcugccaaaauuauauuaauagugaguuucaggccccugggcauuuuguaccauguaauuauccucuggugaugcuguuucucguuaguggcaguagugccuccgucuccuagugauaaugcuccaagucuaugaacuguuaaaucagcauucauuuuaagaaaagcaacuuuaguuucaaagauacuuuuaagcuucuaaauugaucauuuaaacuauuucuuuaaauaagagagccaaauuagaggcucauacuuuagcuugugaagaagauaaugaauuuuuuaaagggaacuuucuaugcaauguucaggauaaaugcauacugcuggccaaucagugucaucuccuggguaaauuuugaugucgcauuauaaagacaugcauaauugaugguuucuagauuaucuaguccaaacaauagaguuuauuuuuucuucaucugaaccaacaugcuacaguagcuaagaaguauuaaaacuauauacauccauauaaagaugaaauaugaacuaucucauuagaagucauaguugaccacagacauguuauucuucugaaagagccacauuuugguuuuauuucuugucacaugauuucuuuucuugauggaugaaaaauaugaaaggaaacuuuuauaucuguugccuaguuuuguacauggaucucauuuuacaagagaaucucucugcaaaaaaaaaaaaaacaguuuaaaaaugcauugaaagcagaguucugaaaugaguaaaguuuguaaaugcauauauaaaaauauuuaauaaaugaugcagaauauacagug

SEQ ID NO: 14829 - RNA, 1834 nt, Homo sapiens
aaaaagaacguugaacagugccugauuccuaguaagcacuuaguaaaugguagccauucuucuuuuucuucucuuuagcuccugucuagaccagcuguucucagccaggggugauuuugcccccaaccccgcccaggggacaacuggcaaugucuggagauauucugggaguagggguaugcugcuggcaucuacuggguagagaauguguaugcugcuaaguaucuuacagugcacaggacagccagacaguccuguaacaaagaauucuccaaaugucacuuguacugugguugagaaacccaguucuaaacuugaaacgugaggcucagcaugcuuaacuuucucaagaccaucugacuccaacacuugugggucuacccacugcccaguacgacuucucuucuggugagauacuggauaaaaagcuuuauaagcuuuccaauaccucggaaaacaaaagaacauuaucugacaaaggacuaacacccaguuuuaaaauacguauuucccucaacuuucucuaacauugaauaggaaucacaggaaaagauuauucauggaucccuugccaauaaaacccuaagcucgaccaagaggaauguucuuuauuaaacaggaagauccuucugagcagcagggcuucagcucaggucacugaggaagaauuacaucauaaccaggcuggcauuucuucugaaagcucccaucauaaugcauuuuagagcacagaaguaaugaaaacaaugaaggauaacaaggacucuucugguguucaugauccagcugacugaagacugaggaacauuuaccuuuuuuccgugauggggcaucccugucuaccucaucgucuuucuuuuuauuucccaagucacugguguucacugucacuguugcuuugauuucuugcugggccaccuucauccggucauaaaacaccuuaaagaauuucucugacuucuuaucuucugucaagcgacagaaaaaggagugcugcaaaggaaaauccauagauugugaacacuguaacugaccagaaacugcaccccacucaugacaccaaaaccuaaugaagaucagagccaguugcaaaaccucacgcaugaucuaaguuuagaucaacauuaaggaccacuccacacacuguaguucucuggguucuaaggccugggguuuucaacacagagccuuugaaacaaauugcuguggcugcaacagacacauaggcuuugggagcaugcucgaguguggugggcagacuguugccaacuaagaacaauucccuuccacccuugcacacacgcaaaacaacacuguuaauaaugaaaacugagcuuuucuggggggauuacugcagggccaaucauuuguuuaagggcuucuaugcacucuuccccugggcagagcccuaugaaaaauauacacaugaauaagauaugcugccuuugcucauuaacagguuaggaugacauguccauaaaucagacuaaauuauguuaaguaaaaaguacucagguagcuacacaauuauauuauaaaugcucagagcuggugaggaugacacuaugcuauagugacuccaaaaucuucaagaaaaaggucaucuucaaaucaggcuucaaaggacagguaagagugguuaaaugaagaagcucagaaugaacagguagcucuccucuuggauacacauuuguuuuuggacccucugcaagcaauaguauacacuguugauggaaaaacacaauauggugucucaacuucauuuaugaguauucgcuuuucaccccuuugcaaacaccacgcuguuguaaauuauuuacauaaaaauacaaua

SEQ ID NO: 14830 - RNA, 4808 nt, Homo sapiens
cguggaaaggguuggcuuuggcucucuguucaguagacuuagggacuguuuccaucaggguuaggccugauccaccugaacgcacagugaauaucccuccuggcugugucacaccacacuuggagaagucgcaauugagacaggggacaugaaaagagaugcaguuuucaguuuaaaaguugaaugcccaauuuaauuucuacccaaguagaugaggucucacuugagcugugccccaggcuccgcagaccaaagggucgcaagggacccagacugauccagacaccucucuuuuccaggaaccccuguuugcugcuagaguuauuuaugaccucuuguucuucuucauggucaucaucauuguucuuaaccugauuuuugggguuaucauugacacuuuugcugaccugaggagugagaagcagaagaaggaagagaucuugaagaccacgugcuuuaucuguggugagugucgcuggccagcuccagcaagggcgugaaggcccagcguggcagaggcauguggauacugcgagggugugaugggcggggugccugcccaguuaugcgggagggggcaccggcugcugcuucgucuugacucuucuacccucugccgugagugaggcucuccuuggccuuuauucugcugggaaguauuuacagaccuggguucugacugagcuucuaccacuuaacuaacuguguaacaucauuuagucauuuaacaucuuuaauccuucuuucuucaucuguaaaauggguacaauaacauguccuucucugcauuauugugagaauuaugagagacagcguauguaacacuccuagcuagaaccuggcacacuauaggcacgggaggagaaguagugaacggcuacguaaaagaggugcauggacaccaaacaaaucauuuucaguauaacuacaggaaaauauuuguaaauguaaacuaaucauggaggaaucuggggagcugaguaaucauuucaggauuauucauaauauagcuacuaaauauauaaauuuccuagugguauguaugcuaaaaaaaaagaucaguuuccaauuaaagacuuaaauucuuugcuuuuugcccccuuaaaaccuuuuuaagcuuuuugcuuuggcauaauuucagaguuauagaaaagacaugacuauccaaagaauuucuauauauucuucacccagaauccccaaauauuaauauuuuaucucauuugcuuuauacacacacacacacacacacacacacacacauuuucuaaugugaguggcugacagugaugcuuucuuaucccuaaauauuuuaguacacauuuccuaaaaacaagaacauucucuuguguaucuacaguauaauuaucaaaauugggaaauuaaaacagauccaauacuguuaucucaucuacagaccuuauucaaauuucacccuucauuccaauaauguccuuugcaaaucccaccuccugcggggcuucagucaccaugccucgugagccuccgcugacacuguugaagaauguaggucaauuauuuuguagaaugucccuugauuugaguuugucugauguuugcucaugguaagauugaggguauguauuuuccacaggaauaucaaagacaugcuguuguguucuucucauugcaucguaucaggaggcauguaaugccaguucaucuuguaacuaguaucucggcucacuguaaccuccaccucccaggguucaagcaauucucgugcuucagccaccugaguagcuaggauuacaggugccucucaccacaacuggcugauuuuuuguauuugaguagagaugggauuucacuauguugcugagaggcuggucuugaacuacugagcucaggcaaucugcccguuuuagcuucccaaaguguuaggauuacaggcaugagccacugcgcccagccgugauacuaacguugaucauuugguuaaggugcuaauugccagguuuuuccaguaacuccauaaaguuacuuuuuuggagagacacucuguaaauaucgugcuauuccuuaaacuuucaccccucagcuuuagcauucauugaugaugcuuggcuaacucuauuaugaugaugguugcccaaugaugauuuuuauguuauuauuauuucuacauuucuuuauuggcuuuuuauuguaagaaagaauuuuuucuucuccccacauauguguuuauauuucuguguuuguauuuguaacuacauggacuuguggauuuuuauuuuauucaaugggcuauuuauuuugauguucaaauugcuucagauguggccagugagagcccuuuccagcugacuccuggguuuagucaugucaucaucguuuucuauguacuuucuuacuuuuuuggcaucauaauauauuccaggcuuaggcucaccuuguacauuuccugagccaucccuggaaucagccauuucuccaaagagccccgguucuuuuuacuggagaaagguauuuagaagccaagaucuggggacugagugugcucauuccuguuggugugcugcugcucucagggcuuauuagggugcagaucuagaggagagguguaugcaucugcauauguguguauguguacacagcacauguaucugcacacaucuguguauauauguaugaaaaaggaugaauucauacugauaccuuuaauuccguuucagcauuacaggguuuauucuuucucccuuucucuauuuguguucuuuucucaggcagugaggaauccagcucccauuauccgugauauauuuauuugaucaauccuagaauacguacagacuagaauugcucaccccggccucuucaaauuauaaaccuaccagcuagaguucaaaauuuguuuaaaguucuuguuguccuuacuuauucugucuccucaaaaaaccuuaacaugucugcauuuuggcauuuaccugggcgaagggacuucacauucccugguugcaugcaauaugugagagugucacacacauucucauuuuaccccuaaacacuccuggaaccuagacggcggucuccccauucacuaacaaggccacuaaggcauguggagaugaagcagcaacugccaaguggcagaggugggauucaaacccaagucugucugacucacagccuguguuuuccugccauaauguaaacaugaauguacuuauaaggccgacagaauccaacucuuuauaaagacaggagugaaaccacagcccccuuucuacugacaguucuguuauugauuuuuuuucuuuaccaaggcugcucagcuggggcugggggcuuuuugucucauuuuuaggcuuggaaagagacaaguuugacaacaagacugucaccuuugaagagcacaucaaggaagaacacaacauguggcacuaucugugcuucaucguccuggugaaaguaaaggacuccaccgaauauacugggccugagaguuacguggcagaaaugaucaaggugaguggaaaggccuccugggagcaagguggacuuggggccuacucagcucugagcaaggccccagcagcccaucggggagcugcacaacagaagaauaacauccgauguugccugagcccuucucacggauggggcgcugugcucugugaacuucguguguucucuggagugauccucagaaccacuagauaggugguauuggccuguguuagugggggaaauguugagccucggugagauuagcacgugaccacggaacuggggcugggauuuuaaucuggaucaaacuccauagcccgauuuccugucgcuaugugaaucugccucuuuucuugauagugcuuuuuuccccuuucuuuuuaauuaacaccuacucucuaagaggugucuuagaggcaaagugacugcucacugcaguccagcaugguuuguguuugcccucagccucgccuuucugggagacacucuacuaaucguuaagaagugaucauaugauggaggaauuugaguuccaaauuaaucuuuucgcugaugggaaguguggauacugugucccaggaagcggggaagcugcuucaggcuguuagagaacacuucucgggcagaguuugcugagacaccaaacgugcgcugugggugucccgggccagcuguccuuucagaccugugcuuuccgaacaucauuaaaauguucagggguggauaguggcgugaggagcaugaacugugaaaucgagggagucucugugauucacgcuggcugccucugaggagaaggggccaacucuccuuccaguuaccaaggacuugagugcucggccugauaaugacuuacccuaaaggagccugcuuuuuaccuagauguaauuuucaggcuuuuuauguaaagauacuggaagucaggucuguucagauaaguaucaucauugacaggccuagaggcagccaggcuuucaguuuuauugccagcagggcagcgauuacgugguuguguuugcugaauaccccgauuacagaggcacagaggccucuccuagguucuggagggcuuucuggagauucugugccgucuguacccuugagguccuuagaguugaauuccaugcuucucaaauuuuauuguacauaugaaucaccuguggagcauguuaaaauucacauuuugacucagcagucacuuccaggacuugagauauucugcauuuccaacaaccuuccaggagaugccgaagcugcuggcccgggaaucacccuuuaaguaguaagagccucacagaggagacaaagcagaugcuuacuuaagauuacucucagag

SEQ ID NO: 14831 - RNA, 2090 nt, Homo sapiens
aaauucuaaaggcuacaaaaauccuguuaaaucaagggaggaaaagaaucauuuuaggacaaaguuauucaagaugaaagaaaggcaugucuucagugagagaacugccugcgguuggauguuugcuugcuaauauguuuaaagauuuuggacuucucaacuuucuugguuuucugguagccaaauccaccacugccuacucgcuuuuucugcuugccuucauugcuguugacguucagaucaacaaagggaggcaccuugaaaccaaugacagcaacuugaggcaaauuuaaguuauuaaacauuaaagaucuguuucagagaaugggaaucguagguuuguauguaugauuuauaugcuuccugagcugacuuaugaaaaaaguaguucuuuugaaucaauuucucaagcugagacugaaugucagaaauuuuagaccaggaaaagucaaauucacuuaauggaaccuuggaucauuucagguagugaagaaaacccaauucuucugggugcaaaaugagcaaggcaugccuucucccauuuaggucucuggcuguucuacccacacgaugaauauuauuccuuagggucauccggagggucauacugaacaauccaguugacuucaguaauguccaguucucuugcugccacaucuguacacaauaguguuccugaaucugcauugcagaacuggaagaauguggucguaugcuuauuuugcuuuugcuuuccaugaauggccaagaugggcaaaucaauguaguucagcaacucauagugguauuucacggacauacaagaugaaaagaaggccauaagcuucuuuuuuugguucuucuuaaggaauguaaagaguagaaggaaucucuuuucagaaggacaaacaacauaucccugcucaagaccauccacuguugcauuagcuuuaucgucaucaacaccaacauacaauggcuccuuuuucagagaaauccuugccgggccuucaacuuuucaaguuuggguggcagaaaagagcaucgucugucuacguguuggcaaaaguuuaauaauuuguuuuaauuccucuucaaacucaacauccaagauacgaucagcuucaucgauaaccagacacugcagauuuuuauacauaaacccugggauauucugcauaugguccagcagacagccuggugugaccacagugauguugaucccauuagcaaguuucugugcuucagcagaucuauuacugccacccauuaucaacccauagguaugcacguggugacucauuagcuccuuaagaacaccaaaaguuugcauggcuaguucucuaguaggugagagaauaaggaccccuguuccauuccugggcaugaaauuuaacuuaacaaugaguucagcugcaggaugagaaaagcugggguuuuaccacugacgguuuuuguagcugcaagaagaucccugccuuccagagguggucugauacuuuuaugcugaauuucagucacguuuguaaaacccauuucuuuuauugccuucagaguguuuucauugacaagauuacauaagaagcaaaugaaguauccucaaaagcuccugucagucccaggggcaggcugggcaucucacugucaucuucaucaucuggcuucucaacauuauuuucuguuucuuuaggagacuuggcacuuucuucuucagauuccccuuuguuuucaguuuuugcuuuuuuuguaucagacucagcaucauucaccauuuuucucuucuuuuuugauucugaauuaggagacugcauugcugcuucuccauugguuaauacgguggauuucuggggagauuuuuuaacuuuuauauuuuccacugcuucuugagacacaucuccauuuugagcaucugauaagcccacauucauagaauguuuugauuuuuuaaccuuuccaccucccguuguuucuucagacacaucuguauuuugaguuucggacagggucagauuugaggcccccugcaacuuuagguuccacugccgcaguuugagguuccacuucuugaucuucuugcguaggaguuucaucagcaggugagacauccuguc

SEQ ID NO: 14832 - RNA, 2090 nt, Homo sapiens
gacaggaugucucaccugcugaugaaacuccuacgcaagaagaucaagaaguggaaccucaaacugcggcaguggaaccuaaaguugcagggggccucaaaucugacccuguccgaaacucaaaauacagaugugucugaagaaacaacgggagguggaaagguuaaaaaaucaaaacauucuaugaaugugggcuuaucagaugcucaaaauggagaugugucucaagaagcaguggaaaauauaaaaguuaaaaaaucuccccagaaauccaccguauuaaccaauggagaagcagcaaugcagucuccuaauucagaaucaaaaaagaagagaaaaauggugaaugaugcugagucugauacaaaaaaagcaaaaacugaaaacaaaggggaaucugaagaagaaagugccaagucuccuaaagaaacagaaaauaauguugagaagccagaugaugaagaugacagugagaugcccagccugccccugggacugacaggagcuuuugaggauacuucauuugcuucuuauguaaucuugucaaugaaaacacucugaaggcaauaaaagaaauggguuuuacaaacgugacugaaauucagcauaaaaguaucagaccaccucuggaaggcagggaucuucuugcagcuacaaaaaccgucagugguaaaaccccagcuuuucucauccugcagcugaacucauuguuaaguuaaauuucaugcccaggaauggaacagggguccuuauucucucaccuacuagagaacuagccaugcaaacuuuugguguucuuaaggagcuaaugagucaccacgugcauaccuauggguugauaauggguggcaguaauagaucugcugaagcacagaaacuugcuaaugggaucaacaucacuguggucacaccaggcugucugcuggaccauaugcagaauaucccaggguuuauguauaaaaaucugcagugucugguuaucgaugaagcugaucguaucuuggauguugaguuugaagaggaauuaaaacaaauuauuaaacuuuugccaacacguagacagacgaugcucuuuucugccacccaaacuugaaaaguugaaggcccggcaaggauuucucugaaaaaggagccauuguauguugguguugaugacgauaaagcuaaugcaacaguggauggucuugagcagggauauguuguuuguccuucugaaaagagauuccuucuacucuuuacauuccuuaagaagaaccaaaaaaagaagcuuauggccuucuuuucaucuuguauguccgugaaauaccacuaugaguugcugaacuacauugauuugcccaucuuggccauucauggaaagcaaaagcaaaauaagcauacgaccacauucuuccaguucugcaaugcagauucaggaacacuauuguguacagauguggcagcaagagaacuggacauuacugaagucaacuggauuguucaguaugacccuccggaugacccuaaggaauaauauucaucguguggguagaacagccagagaccuaaaugggagaaggcaugccuugcucauuuugcacccagaagaauuggguuuucuucacuaccugaaaugauccaagguuccauuaagugaauuugacuuuuccuggucuaaaauuucugacauucagucucagcuugagaaauugauucaaaagaacuacuuuuuucauaagucagcucaggaagcauauaaaucauacauacaaaccuacgauucccauucucugaaacagaucuuuaauguuuaauaacuuaaauuugccucaaguugcugucauugguuucaaggugccucccuuuguugaucugaacgucaacagcaaugaaggcaagcagaaaaagcgaguaggcagugguggauuuggcuaccagaaaaccaagaaaguugagaaguccaaaaucuuuaaacauauuagcaagcaaacauccaaccgcaggcaguucucucacugaagacaugccuuucuuucaucuugaauaacuuuguccuaaaaugauucuuuuccucccuugauuuaacaggauuuuuguagccuuuagaauuu

SEQ ID NO: 14833 - RNA, 5910 nt, Homo sapiens
cucauucacuuggcucgcacggcgcagacagaccgcgcagggagcacacaccgccagucugugcgcugagucggagccagaggccgcggggacaccgggccaugcacgcccccaacugaagcugcaucucaaagccgaagauuccagcagcccaggggauuucaaagagcucagacucagaggaacaucugcggagagacccccgaagcccucuccagggcaguccucauccagacgcuccgcuagugcagacaggagcgcgcaguggccccggcucgccgcgccauggagcggauccccagcgcgcaaccaccccccgccugccugcccaaagcaccgggacuggagcacggagaccuaccaggguaaguuggcacuccuuggcccuucaagccucaacugcagccccauguuaugcgccacucucaacuuggagcagcuccgggcgcaccgggagguucuugcccggcagaacgccugcagccgugcgcaagcagucacgacccuuccuggucucucuuccugcaggauguacccugcccacauguaccaaguguacaagucaagacggggaauaaagcggagcgaggacagcaagguaagcaagugcaccccuagggacccugcgcucagccccucgcgcgcgcugaguuuccaagaaaaguuuucucgcuuugagguuggcgaggggaugcagggugugggcucggugccucuucugagugacuuggaaaagaaagggcagacgaugguucugggugcuacucugcuacucugcuccucugccggacuguugcugcggggcugggaggauaggcuucucaucuccuuccccaagcgcccaccgccuccccgugcgucuugcaggagaccuacaaauugccgcaccggcucaucgagaaaaagagacgugaccggauuaacgagugcaucgcccagcugaaggaucuccuacccgaacaucucaaacuuacaguaagugagaagcuggccccuuuccaacccaguccuuugcccagagggcgggcgggucacucgccgccugcagguuccgcggggaacugcagaccagacuggcggaucagagcuggcggguggcucugcggugggguccuccuccacaguccuggcguuuucuggcugacucaugcaaaugaggcgagaaccacuuggaccucuccaaguuggcuccaacaccaacuggccuuccuuuucaggaguuuaacuucuggugauuuucaggauucccuaguuuuucucacuuaaaggaacacgccaagaaacacacacauuuuauuuaccccuuccccucuaccacuccccccaccuuuuuuguuguuguugucaaauaaggggacuugcuuuggugugugauuuuuacggccuguccuuucuugacaguagcccucggcuacuucgcagccuuugguuggggaaauggaaaaaaaaaaaauaguauuucgggaggaacaaaaaagccuggaugagcuggaaguucugaaaggguguaaggaaagaaguagggaaagccucuuggcugccagacguaauagaggucccucucugaguugacaccacugcaggaaaauguuaucucuggauuccccugaguuaaggucggcagaggcugcuggagaaauuuaucugucaaaggauuuuccugagguaguugcagcuuccaaaaugccuccaaagacagguggcacccguuuuuuuaaauuauuuaauuauauauauauauuauauauauauacacacacacacacacacacacacacacacacauauaugaguguaucugucuaucuuuuuaaaagcaugaccuacagacuuaaaacagccaaccaggaaacacuauuccacuuuuuuuuuucuuuucucauuucucauugcuaauaaaugucccaaaggugggacuucucugaccucaccgcugacuaaggcucuuuuccuuccagacuuugggucacuuggaaaaagcagugguucuugaacuuaccuugaagcaugugaaagcacuaacaaaccuaauugaucagcagcagcagaaaaucauugcccugcagagugguuuacaagcuggugagugcugauucuggcuaugcucucuuuaagaguuugagugcaaauagagagcccgugggcucaacaucugauguaauaaacauuacugcaacaaauugcuuaugcacguucauugggggagaugcaguuuuaucuuuccuaaaaggucagacuuuucauuugaaaugcauugugccaccuggcaugaauacguauuagugaaaugauaagauauuccuguggcauuuuagcuugagagucucuggguucugggagauuucccuacucccuuuuaaaaugccaaggcaccuauaauuugcauuguggguguuuuacaguuggucuucuuagcccucuuucauuggagaagaaaucauggguaugccccagcguuuuccuguuucuuugcuuccuugucacuugguguguggugugauccuggcaggauacagcaggaguuuuuccugcauuucaugugguucccugaauagccacuagguaucuuggugaauugcacaaucuagcgaaaccacugaaguuucaucauucguuucuacugacuuccagauaaucggagucaaccuucuaaccuucuagucucacuucuuccaaauaauacuguacagacuggggagaauuauucuacccacucccucauuucaugcuugucugccuuccucucgaaggcucguaugaugaaaauugcaaaaacccagcuagugcuucugccuguuuccucauucaaaauaggaagauggucauaccuaaugucuugaggaucauggauagaauauguggagaagacauagaaauagccuaauuaaaggucacagcaugacugcaacuuuuacaaaucauugaaaauaaguuuacuuuaggugauuguuguuucuucauucuuuuccucauuuuauaacuauccagccucugcccauuuugccacggugcaauguuguaugcauugacucuuagguuuauaaauacaucagaauguucuuugcugccucgcuuacauggaaaacucacaaaccaccuauacaauccaaaagaggggaaacagcucaucucauauuaauuaugguccauuuccaugauaggauauuaugcaaccauuaaaaaucauauuuuaucugaguguuaguauauggauuauuuuaauuauuuauacuuuucaguguaauucuucucugagcauacuacuuuuggaguuaggaacacaaaucaguaaaugcauuuuuuuuuuuaacaaaaacuaaagcaccugguuuuuuggaguauaguuuccaggugcgccacaggccuucugaaacguuuuccuucggauuuuucuuuccccaggugagcugucagggagaaaugucgaaacaggucaagagauguucugcucagguuuccagacaugugcccgggaggugcuucaguaucuggccaagcacgagaacacucgggaccugaagucuucgcagcuugucacccaccuccaccggguggucucggagcugcugcagggugguaccuccaggaagccaucagacccagcucccaaagugauggacuucaaggaaaaacccagcucuccggccaaagguucggaagguccugggaaaaacugcgugccagucauccagcggacuuucgcucacucgaguggggagcagagcggcagcgacacggacacagacaguggcuauggaggagaaucggagaagggcgacuugcgcagugagcagccgugcuucaaaagugaccacggacgcagguucacgaugggagaaaggaucggcgcaauuaagcaagaguccgaagaaccccccacaaaaaagaaccggaugcagcuuucggaugaugaaggccauuucacuagcagugaccugaucagcuccccguuccugggcccacacccacaccagccuccuuucugccugcccuucuaccugaucccaccuucagcgacugccuaccugcccaugcuggagaagugcugguaucccaccucagugccagugcuauacccaggccucaacgccucugccgcagcccucucuagcuucaugaacccagacaagaucucggcucccuugcucaugccccagagacucccuucucccuugccagcucauccguccgucgacucuucugucuugcuccaagcucugaagccaauccccccuuuaaacuuagaaaccaaagacuaaacucucuaggggauccugcugcuuugcuuuccuuccucgcuacuuccuaaaaagcaacaaaaaaguuuuugugaaugcugcaagauuguugcauuguguauacugagauaaucugaggcauggagagcagauucaggguguguguguguguguguguguguguaugugcgugugcgugcacaugugugccugcguguugguauaggacuuuaaagcuccuuuuggcauagggaagucacgaaggauugcuugacaucaggagacuugggggggauuguagcagacgucugggcuuuuccccacccagagaauagcccccuucgauacacaucagcuggauuuucaaaagcuucaaagucuuggucugugagucacucuucaguuugggagcugggucuguggcuuugaucagaagguacuuucaaaagagggcuuuccagggcucagcucccaaccagcuguuaggaccccacccuuuugccuuuauugucgacgugacucaccagacgucggggagagagagcagucagaccgagcuuucugcuaacauggggagguagcaggcacuggcauagcacgguagugguuuggggagguuuccgcaggucugcuccccaccccugccucggaagaauaaagagaauguaguucccuacucaggcuuucguagugauuagcuuacuaaggaacugaaaaugggccccuuguacaagcugagcugccccggagggagggaggaguucccugggcuucuggcaccuguuucuaggccuaaccauuaguacuuacugugcagggaaccaaaccaaggucugagaaaugcggacaccccgagcgagcaccccaaagugcacaaagcugaguaaaaagcugcccccuucaaacagaacuagacucaguuuucaauuccauccuaaaacuccuuuuaaccaagcuuagcuucucaaaggccuaaccaagccuuggcaccgccagauccuuucuguaggcuaauuccucuugcccaacggcauauggaguguccuuauugcuaaaaaggauuccgucuccuucaaagaaguuuuauuuuugguccagaguacuuguuuucccgauguguccagccagcuccgcagcagcuuuucaaaaugcacuaugccugauugcugaucguguuuuaacuuuuucuuuuccuguuuuuauuuugguauuaagucguugccuuuauuuguaaagcuguuauaaauauauauuauauaaauauauuaaaaaggaaaauguuucagauguuuauuuguauaauuacuugauucacacagugagaaaaaaugaauguauuccuguuuuugaagagaagaauaauuuuuuuuuucucuagggagagguacaguguuuauauuuuggagccuuccugaagguguaaaauuguaaauauuuuuaucuaugaguaaauguuaaguaguuguuuuaaaauacuuaauaaaauaauucuuuuccuguggaagagaaagauggucuccugaguuuuuuaaaauagcucacuuggugugauauggcugacucccauguccuucuuucuuggcugaagcaaaccaguuaaucucaguguaauuucauucagcuuuucaugugcuuuguauucaaucagaauaagcuuagucaaccuggcagg

SEQ ID NO: 14834 - RNA, 569 nt, Homo sapiens
gauagaugagaaaccuacgacaugauauagcuguguguagcaguggaguucuccaaacacagucacugucaagacugugguucuuugcaugucuaaauuaguuucugcuccaaaugaagucucaaccauccuuguaaaaauguaagaauguggucauggcaauucaacaugaaugcaaugcugacuucuuggcauugugucaaaaaugguaaauuaaacauauuaaaaacaaggcaggcaguguugucucagugauuagccaugguaacuguuaggaauuagacugaaaucuggaugcaggagaggaaaaguguuuauguauuucaaugagagggaaaguggaacacacuguguauaggcugaauugaaagaauacuaaugggagugacaguaaugagauuauauguauuauaagcacugacaauuauacucucauuacuaaaauacacaaagggaaugaacacaauuauguagcagauaccaugggacaaugaacuuauuauacccauuugcaguguagucuauaaaaguuugcugcuauaguuuaugcuuuaugggagcaaaaucaa

SEQ ID NO: 14835 - RNA, 13116 nt, Homo sapiens
aggggcacccgggacacgcccccucccgccgcgccauuggccucuccgcccaccgccccgcacccauuggcccacucgccgccaaucagcggaagccgccggggccgccuagagaagaggcugugcuucggcgcuccggcuccucagagagccucggcuagguaggggagcggaacucuggugggaggggaggugcgguacacuggggggauggguggcuaggggggccgucugguggcuugcggggguugccuuucccgugggaagucgggaacauaauguuuguuacguugggagggaaagggguggcuggaugcaggcgggagggaggcccgcccugcggcaaccggagggggagggagaagggagcggaaaaugcucgaaaccggacggagccauugcucucgcagagggaggagcgcuuccggcuagccucuugucgccgauuggccguuucuccucccgccgugugugaaaacacaaauggcguauucugguuggaguaaagcuccugucaguuacgccgucgggaguacgcagccgcuuagcgacucucgcguugcccccuggguggggcggguagguaggugggguguagagaugcugggugugcgggcgcggccggccuccugcggcgggaggggagggucagugaaaucggcucuggcgcgggcguccucccacccuccccuuccuucgggggagucgguuuacccgccgccugcuugucuucgacaccugauuggcugucgaagcugugggaccgggcccuugcuacuggcucgagucucacaugagcgaaaccacugcgcggggcgcggggguggcggggaggcgggcguugguacgguccuccccgaggccgagcgccgcagugucuggccccgcgccccugcgcaacguggcaggaagcgcgcgcuggaggcgggggcgggcugccggccgagacuucuggauggcggcggccgcggcuccgccccggguucccaccgccugaagggcgagacaagcccgaccugcuacaggcacucgugggggugggggaggagcgggggucgguccggcugguuugugggugggaggcgcuuguucuccaaaaaccggcgcgagcugcaauccugagggagcugcgguggaggagguggagagaaggccgcacccuucugggcagggggaggggagugccgcaauaccuuuaugggaguucucugcugccucccgucuuguaaggaccgcccugggccuggaagaagcccucccuccuuuccuccucgcgugaucucgucaucgccuccaugucgagucgcuucucgauuaugggcgggauucuuuugccuaggcuuaaggggcuaacuuggucccugggcguugcccugcaggggagugagcagcuguaagauuugaggggcgacuccgauuaguuuaucuucccacggacuagaguuggugucgagguuauuguaauaagggugggguagggaaauggagcuuagucauucaccuggggcugauuuuaugcaacgagacugcggauuaucacuacuuaucauuuuuggagcauuuuucuagagacagacauaaagcaugaucaccugaguuuuauaccauuugagacccuugcugcaccaccaaaguguagcaucagguuaaaucuuaauagaaaaauuuuagcuuuugcuugagaaaccagugcuucccucccucacccucucuccccaggcucucuaccccuuugcaucccuaccaggcaucuuagcaacucucacucauacuugaucccauuuuccauuuguuguacuugcuccucuaguauucagacauagcacuagcuuucucccucucuugaucuuggguagccuggugucucgcgaaaccagacagauugguuccaccacaaauuaaggcuugagcuggggcuugacucuuacccagcagugcuuuuauuccucccuaguucacguucuuaaauguuuaucuugauuuucauuuuauccuuuuuccuuagcugggauucugucccugaccgucuucacaguccaggugaucuugacuacugcuuuacagagaauuggaucugagguuaggcaacaucucccuuuuucuuccucuaaauaccucucauuucuguucuuaccaguuaguaacugaucucagaugccugugugauagcuuccaaauugcugucucugucuuuaguguuaucuuuugauccaucuuacaucuuguuaggaugauuguccuaaaggaagauagagcaugaaaaugacaggugaaacuccauuacuggcuuguacuguuuacagcaaguugucuaacccgcgggccgcaugggacccaggacagcuuugaaugcgacccaacacaaauucguaaacuuucuuaaaguuuuaggaguuuuuuuugcgggguguuuuuuuuguuguuguugucuguuuuuuuuuuuugcucaucagcuguccuuuauauguggcccaagacaguucuugcaguguggcccagggaagccgaaagauuggacaccccugguuuacaggaugaauucuguucucgugaaugugaugcauaaggucccuggauagacuuuccucaauuuaacagcuuuuucauuuuucacuauuuuccacauacuacacacacaaauaugaccucucuccugaagucacauggaaugaauugcaguuacccaaaucauagagacgucauauaucuuuguggggugguucuuuuuggaaugcuacccuugcugcuuuuaauccugcagauucaaaugucaucuccccuuuggucaugccuuccauggucuguuguucuaugacccaaacugcccuuuuaaaaaagcaguuuucuucugacuccugagcaguuuguacugcgugggucauaguaauucugggguuguugucauugcugauuuaaauuaccuuaacuauucugagcuuuuugaaggaauagugucuuguacuccugagcuccuaguauacucugaugucuagccaacuuuaaguaaauggagugagcgacauguaaaugucuuuaugguuugacauuuuauuaaucuugagcauuggaaaaguggcugguaugacuaaagaacugaauuuuuauuuuuuaucuaauuugaauugcaacuguggacaguauagcuguagccccggacuuguucuguggauuacagaauacguggacauugaugguuuucucuuuuuacugagcaguaaggaaauaaaagcugaagcucucuggcccauuacauuucauuuaacugcuuguuuuguuuuauuuauuauauauuuagcugaaagcuaaguccaacaaaccauuuuuaaagaugugccugccuuggacaacagugaaagcaagcguuaaugaguuuggauuucaaaaaaaaaugcauaaugaauuuuagggaggugagauuccauuaaacuguuacaggagcuacauaguuaaauauaucagaacuugaaugaagaauaggucugugugauacaaaugaacccagccuaaauuucuguccuacaaguuuucacuuccuggaaacacuugauuggaggagcucuaagcaucauaucuugaguuauagaaaacaaucacaaaguaaguuuuauccugaggaauuauaauaccaacauuuuaacaccaaaugcuuuuuauauugcuaauacaguaucuuacacauuuuaauuaucuuuuuuuuuuuuuugagacggagucuuagugucacauacuggauugcaauggcaugaucauggcucacgcagccuugacuuccugggcucaagugauccuccugccucagccuccugaguagcuggaacuacaggcacacgcuuccaugcccagcuaauuuuuuuguguuuuuuuuuuuguagagauggguuuuugcugugcugcacagguuagaacuccugggcucaagugaucuuccugcccuaagcuucccaaaguccugggauuacaggugugagccaccgcccuaggccauuaaauauacuuuuuaaaaagacccuuaugucagcgaucuucaggccuccuguguguggagacaguugucuuaauguagauucucagaucacccaaaaauucugaauucuuuuggggaagguggaaccccacagggcaggcaguauaacucaguaucuucaaguucauuugcugacucggauaugccuauuuaccugccaaaaaugauuacaguuucagagaaacucuucucaauuguauaguaugugacccucaauuuuuccucaaaugaacuguuuuuuccuccuccuaaaaaauaacagaaugggaauuuugagaggcaaagaggaauaguaauuaauauuuuuggaaacuugcaggucagguuuuccuuuuaaaaggaauguugaaauauauucuuucgaacaagagaaguucaccuuauuuguguuucuccugcuuaauugcaauccuuaaggaaagugauuuuucagugccuaagcacagagcuggaagcucaauaaauguuaguuuuguugguuuauacgugaaauugauucucaaguaauaguuaagcucagaaaacauauaaacaaggcuuuuugggagagacuucagggucccauuuaaccuacaucuccuaauauucuauucauagaggaaacugaugccucauggucucugaguacaucuaucccaccauucaguucuucuuuggguuuccuguacuaaucauugcaguuauccuuuuccugcaccuuacuuccuugggcuuuuuguuuaaauuaaccagcuaccuaucuccuuuucaaguaguuacauacuauuucuuacccuuauaagacaaauuuauuaaguauauuacacgcuuguacuuggaugagaaagcuggugaaacuuuugucagggcuagugugugugugagauuugcaaaauguaaacuuagguuacuuccauauauuuuuugugaguggagguuuggcauaauuacauaauucucuuuuacaacacucugguuugacuguuagguuaauuguagagcaccuuguuaggucacaaauccagaagucugguacuggacuuugcagguugcuuucuuaguggcauauuaguuuauauuagagcacauacuucucaagaagccuuuuuuuucuuaucugugacucucucuucuugagaugggauaauguauuggauuauuagagaagugugaguauugaaucagauaguuuuauuuuaucuagagcaggguuaaaccugaugaauuguuucugcucucucauggaguauaucuucuuggugacaaagacuuuucugucucugauuuuuaucuuagucgugguuacauuuaauaauccugcuuuccagcuuuuccuagagaucagucaucagugaccuuuugucuugauacuuugucaccuuuuguuuucugguuuuggguuuuuuuuuucuuuuuuaaacauauguaacauuggcuuuuccugcugacaacaguaacagaguuucagaucauguuuauagaaugguuauuucaucaccuaacuaaucucaccucuaguguauggauucugguaaagucagucaacagucuucacagccuuuucuauuuuuacugaccuugauuuaaaaucuaaucuuagaccuugagguauugcuuacgaauaguguaauaaugagguacuacuuauaacaaauaaugguaacauacucuagugcguacuauaggcaaaagcuaauggaaacauagguagaagaaaugaaguaauaguuauugaaugcuuuuuguguacugcagguguggaaacaggaagagaacuagaacuggaaguaaagcauugaagaugugacugaauugcugcaaucucaugaucaaauuugaauggaugaggaguugcuuuuuagggaugagcaaagaaagugguuucucgagauggaaucuacuggugaaguugcugugaacauuguuaaaaugccaauaaaggauuuaggaauuacagaaaccugguugauaaagcagugccagggugugagagaguugacuucaauuuugaaauaaguuccacuggcugggugugguggcucacaccugcaaucccaguacuuuaggaggccgagacugguagaucauuugaggucaggaguucaagaccagccuugccaacauggugaaaccccaccucuaccaaauuagccagguguggugcacaccuguagucccagcuacuugggaagcugaggcaggagaaucucuugaaccagggaggaggagguugcaguaagccgagauggcgccccugcacuccagccugggugacagagugagaccuugcguuuaaaaaaaaaaaaaaaggaaaaggaaaaaaaaguucuacuguggguaaaaugcuaucaugcuaucaaacagcaucacaugcuacagagaagucuugugaaaggaugucaguguggcaaacuucauugucuuuuaagaaauugccacagcuaucguaaucuucaaccaccaccacccugaugagucaguagccaucguuaacguuggcguaagacccuccaccagcaaaaagauuguuagcauuuuuuuagcagugauguauuuaucaauuauacauaaugcuauuguacacuucuuaauagacuaugguauaguguaaccauaauuuaugcacugggaaaccaacaaauucaugagauucgcuuuauuguagugcucuggaauugagccugccguguuucugagguauaccuguguauuuaguauguuccuuguauauaaaaccccauuuuauaggguaggaaacuaaggcuuagaguuugagcaauuuucccauagauaacaccaauaaauugagggcugcagagaccacuuaagugguucucuuaacaguagucuagacaugacguaaugagauuuggcuuaggagugacaaugguaaggaaguuaaaggauucaggaaccaaauaccaguuauugagaagaaagaauggccucaaaacaucacuucucaaggaagccuugauacccucacccuuacuacacuguauccuccauuugaauguugucaagagcucuucucacaauuguaaauaauaauuguguaauuuuguuuuuuuuuuccuacuuuagguugcuccuugagggcaggacaguucuuauggcuuuauccguugcguaagcacagagaggucugcgaggucaaaacuauugucaugauagcaagaugccugucuuuuucauuuauucucacggugugcagaggcuacaugaugugugaugacauccucauugauguuaaugaauggugcuauacuugaauuuucuaaggugucauuagguagguuuagguaugcauacuuguuuuuagaaauuauuuuuuuccuuuuucccauuuuuagaaaucaacucauuuuuuagguuaugccuucaguaaucuuugcaaccucaauauuguguaaugguuacuuuaaaauacuguaguuuucuuugugccuaaguauaaacauaaguacauuuuguuguuuuguuugcaauagugguuuaaauauuuucccaaaauauccaaauuuaaaaauucuacaacuuuagaauuuaauaaauuuauucuaaaauauuuauauauuuuuucauuuaagaauggaucggcuuaaaaagacugcuucucauuuacuuacuggcuauaccaucuguauacuaauaaaaaacaagauuugauuuggaaggacugacucaaacuaacgaaaauaugaaaccugucuuucugcuuuggagauauuuaccuaaucauguucugcaguagaauaauuuaguucuuuugucuuuuuuuggagaugaggucuugcuguguugcccaggcuauucacagcugccaucauagugaacuacagccugaaacuccuggguucaagagauccuucugccucagccuccugaguagcuggaacuauaggcaugcgccaccaagccugggcuuuuaaaaaaauuuuaaaaagaauuuugagacaggaucuugccauguugcucaggcuagucuucaacuccuagcccugagugaucuugcuuugggccucucaaaauguugaguuaauaggcgugagccaccauacccagccaaaaauuuuuuuagagaugggaauggaaugaucuugaauaguguuggugccaccuauguuguggcaucauuuugaaaccaaucauucagagugcuuuuuuugguaaggcauuauuuuuuaaugcagguaugccacuacugggaaaaaaaaaaaaacagguuuuaaagcuagaaaugaaaagcuacuuaaguaucuuaaaggauaaguuacuuuauuauacacuagaaacauacacaauagcugaaaaacuuaaaaaaucucacacugcugaaugucucugcuggcugaaguguaaguaaaagaucauaguagugccgcuguugagugauaaagcaacuugucauuaaagaugugugugcagacauggauucugaguuaauaucucaucuguagaaguauauauuugucccuugcuuugggauugguuucuggacagcacucccccacccuugcuggccauuugccaaggacaccaaaacccaaggauguugaauucccuuuuauaaaauggcgcuguaucugcauacaacuuacacacauccucccauauacuuuaaaucauuuccagauuucuuauacuucauacaaugugaaugcuauauaaauaguuguuacauuguguacuuauauuuguacuauuguauuaaauauucucaaauauuuucaagcacauuugguugaaucugcagaugcagaaccugaggauauggagggcugacugugcuaauacguuaucaauggaugcgugcauaaacauggcuggacuuguuacuuggcuuguauuugccaggcaucagcaccaacuaguuaaagauacucuuacgugaaagcuuggcaacaaacacauguccugaaauaaugcaaguguagaauaacuuuuuaaaaucucaugguuuaugcuaaacuauauguugacauaagaguggugauaaggcaacaguagguaaaaguaaaauuucaggcaccuuggcacaaacuguggcaguggcaucaaacucuaaguuauuuuucacugccaugcauuuguggugugaacccccacaaaagaaaaaaaccaguuucacucaagaauguccuugugaaagcagugacauuuuguuaaaucuuaaacccuacaguacauaacuuuuugaaaugguugucucaagaaaaagcacucauguaagcugaauuaucugcuauuuccuuggagccuaacaacugacagcaauuguuuucaaugauaaaauccaaacguugagucaaaaucagaauuucgggaaaacuugugucuaauaucaggaacuugacagcuucccaauacuucaugagauagugauauugaaaauaauuuuuuuuuuuuuuugggacaucuggcugacugcaaccucugucuccuggguucaagcaauucuccugccucagccuccugcauaacugggacuacagguguguaccacuguacccggcuaauuuuuguauuuuuaguagagaugggguuucaccauguuggccaggguggucuugaacuccugaccucaggugauccaccuuggccucccaaagugcuaggauuacagguuuaagccacugugcccggccaaugauauuuuagguaguauacaguaaaaugggccaacauuugggagauugacauaacucagugaagcuauauuuuccuaaugacuaauacgugagauuauagaaaacugcuaguaacauuguaaccaauugaaugcaaaagaaacaauucaguugucuucuauuuaagucagacauuuagggaaacaauugccaaaauguaaaacaaugcaccuauuuuuuuaaaaauaugcauuuguugcuauaauauuuaaauauuuuacuuucuaauaugguaagauacuaguaaagugauuuggggcccucaaucuuuaagaaugugaagggauucucugaggccacaaaguuuaagaaauggcuacucuagcacaaacgcacauaguaaauacucaaguaccuguugaaugacuucauggaguuaaagugacuccugguauuaaaucuguauggcugggauaaugggcaugcuaggacaggaagcagauuuccuuaacuucaccacuguaacucauuaacaaacauguuagccugagacagaaguauuaaggggcgacaggaaagccuuucauaagcaaugugaugcuuuuuuucacauuauucaacaugguuuaaaauuugguauacaggccuaugguguuuguccugaacuuuugccagaguagaaugguucauguuuuuccucauagauuuucacuccucacuaaacuucaugacaucuaacaugaacuuauuagaaaaggcuaugcuugagaauaaggauaucuuuuuucuaugccuauguuguuaaugaguaugaagcacuuacaggcuuuuauguacuugagguuccaaagacauuuccaaauuuucccauuuucagucuucaacuuaacauuuugguccuugcaguggagaccugaguccuaucugacauugggacuacaguuagggcagaauuuccuaaacugccauuuuuuaaagaaauaaggguaaccaaauguuccccuuaaaagcacucugguacccucuaguauugggagauaacuaucuuccccuaauuagauuuguaaaaucuuucucaauauuuauuuacauuuuuuuccccucaaauauauugacuuuuucauucccaguaacaauaugucuggucuguaacuaagucauuccauguucagauuacagauuuauuuccccaucuuuucacauucuuuuaguccaggagacccacuuugaagguuaaaaccaaggucacacaaugaauagguggcagugucacauauaacucagcuccaggccuuaugaauccugcuuauagcccacugccuauucuagucaccagauugaaaaacaccauacuagggaagaagacggcaaacuauugcccacuacauauuuguaucagucuugucaaauuuuuauuguaguauguaauagaauuaaagcuaugaugaaucaaguaaaaaaugauuuccuuaaaaacuaagcuaauaggcgaaaauacucgcuuguucaacaaauacccagucuggcagauacaauacccugcccuuagugggggguggagugggggguggggggguggggaaagacaucguggugaaaacagacaugguccuugaacuuccugguucuguggguugcuuaauuugagguuuaaaugguuucucccaucaggugaaaaguuuuguguucggcccauaaacaaagcagcugugaauucugauagugguaaaaaggccagucuaggauauaaaaccuucauaaacaucuuauuucccauucauuaugaagugugggguaggagaucagagaaaccagaugaggauugcuggcugugcugcuaaugugaacucuucuuucaaaaguauuguguccuuuuauucucaauggagacaucagaaaguauuaagaggaguacuauuauaauacuaauaggauacugaaaaucuauacugauugcagccagaggcuccaaaauaaacaauacuaugaugaguuccacaaaaaaaccucaacuacucuuuguuccagggaagcaccauuuuccacaaaacucucaagaaggacuuguugcaacuggaaaagcaauuaaaugugaaucgugauccaggagaaaguaacaacucacauaacucccaaauuaaaaguuuuccaaagauauaucauuuuuuuucucuuggccuuuuaagaaacuagccaacaaauacucuugacagguuuguguuugguuuugaaaacacacaccuuaguguacugaaagaaaaacaauuucuuuuaauuugguuuguuggucccacaccccaucuaucaauguaugugcuauuuacaaauaaguucuauacaguauuuuugcaguaccuuugauaauuccuagaccucuauuuucauucuguguauuaaugugaauaacagauggauauuuuaauauuuaaggcagaugguaaacuuuccuauaggucuugugagacuucgucuuauaggcugaacaccauucacaaaauguaauaaugcuucauuccuucagguugagguaaagaacuugagcaacuggauuagcaaagcugcaaagaaugaaauguggccuaagauguaauuauguucucugcccuuccuuugggccaggguaguuuugcacuugacacaauggaaaauaggccauaaagccugaaaauaaaauguucuaaaccccaaucucacagcacuuuaguaggcuuuucacuaggcaucuuuaaaguauuuucaacaaaauacuaauuaagcuaccacuucaaaagagcuucaaggaaaagcucugcuuucuuauaaaaucuuuuugagacagaguuucgcucuugucgcacaggcuggagugcaauggcgugaucucgacucaccgcaaccuccgccugcuggguucaagugauucucuagccucagccuccugaguaguugggauuacaggcgcccgccaccacaccuggcuaauuuuuguauuucuaguagagacaggguuucaccauguuggccaggcuggucuccggaccucaggugaucugcacacuucggcuuccuaaacugcuggaauuacagucgugagccacugugccuggucucauaaaacuuuuaaauuccaucacauuacauucacaccuuuugcuaaccaggaugaagagccuuaaacagguuuaaagagugcagacugcaguuuuguuaauacuuuuuuccucuccaaguucuuuuaugcuaacauuuccaguggugggaaguacaaguacuauuagucaucuucauucuuugcauugccaaagaguuccucuuucuccgucuuguucugaaggaugaacaaaagcuugagguguacguaucagaacguaaacugcagcacgaagaccaccaacguucacccagacuguauccaccuuucgccauacgugucgcauuccagauaacgccuguguacacacaaaaaaaauaacaauuagguugacaaucuacuuuuacaucaac

SEQ ID NO: 14836 - RNA, 91822 nt, Homo sapiens
gaaguucaaggaccaugucuguuuucaccacgaugucuuuccccacccccccaccccccacuccaccccccacuaagggcaggguauuguaucugccagacuggguauuuguugaacaagcgaguauuuucgccuauuagcuuaguuuuuaaggaaaucauuuuuuacuugauucaucauagcuuuaauucuauuacauacuacaauaaaaauuugacaagacugauacaaauauguagugggcaauaguuugccgucuucuucccuaguaugguguuuuucaaucuggugacuagaauaggcagugggcuauaagcaggauucauaaggccuggagcugaguuauaugugacacugccaccuauucauugugugaccuugguuuuaaccuucaaagugggucuccuggacuaaaagaaugugaaaagauggggaaauaaaucuguaaucugaacauggaaugacuuaguuacagaccagacauauuguuacugggaaugaaaaagucaauauauuugaggggaaaaaaauguaaauaaauauugagaaagauuuuacaaaucuaauuaggggaagauaguuaucucccaauacuagaggguaccagagugcuuuuaaggggaacauuugguuacccuuauuucuuuaaaaaauggcaguuuaggaaauucugcccuaacuguagucccaaugucagauaggacucaggucuccacugcaaggaccaaaauguuaaguugaagacugaaaaugggaaaauuuggaaaugucuuuggaaccucaaguacauaaaagccuguaagugcuucauacucauuaacaacauaggcauagaaaaaagauauccuuauucucaagcauagccuuuucuaauaaguucauguuagaugucaugaaguuuagugaggagugaaaaucuaugaggaaaaacaugaaccauucuacucuggcaaaaguucaggacaaacaccauaggccuguauaccaaauuuuaaaccauguugaauaaugugaaaaaaagcaucacauugcuuaugaaaggcuuuccugucgccccuuaauacuucugucucaggcuaacauguuuguuaaugaguuacaguggugaaguuaaggaaaucugcuuccuguccuagcaugcccauuaucccagccauacagauuuaauaccaggagucacuuuaacuccaugaagucauucaacagguacuugaguauuuacuaugugcguuugugcuagaguagccauuucuuaaacuuuguggccucagagaaucccuucacauucuuaaagauugagggccccaaaucacuuuacuaguaucuuaccauauuagaaaguaaaauauuuaaauauuauagcaacaaaugcauauuuuuaaaaaaauaggugcauuguuuuacauuuuggcaauuguuucccuaaaugucugacuuaaauagaagacaacugaauuguuucuuuugcauucaauugguuacaauguuacuagcaguuuucuauaaucucacguauuagucauuaggaaaauauagcuucacugaguuaugucaaucucccaaauguuggcccauuuuacuguauacuaccuaaaauaucauuggccgggcacaguggcuuaaaccuguaauccuagcacuuugggaggccaagguggaucaccugaggucaggaguucaagaccacccuggccaacauggugaaaccccaucucuacuaaaaauacaaaaauuagccggguacagugguacacaccuguagucccaguuaugcaggaggcugaggcaggagaauugcuugaacccaggagacagagguugcagucagccagaugucccaaaaaaaaaaaaaaauuauuuucaauaucacuaucucaugaaguauugggaagcugucaaguuccugauauuagacacaaguuuucccgaaauucugauuuugacucaacguuuggauuuuaucauugaaaacaauugcugucaguuguuaggcuccaaggaaauagcagauaauucagcuuacaugagugcuuuuucuugagacaaccauuucaaaaaguuauguacuguaggguuuaagauuuaacaaaaugucacugcuuucacaaggacauucuugagugaaacugguuuuuuucuuuuguggggguucacaccacaaaugcauggcagugaaaaauaacuuagaguuugaugccacugccacaguuugugccaaggugccugaaauuuuacuuuuaccuacuguugccuuaucaccacucuuaugucaacauauaguuuagcauaaaccaugagauuuuaaaaaguuauucuacacuugcauuauuucaggacauguguuuguugccaagcuuucacguaagaguaucuuuaacuaguuggugcugaugccuggcaaauacaagccaaguaacaaguccagccauguuuaugcacgcauccauugauaacguauuagcacagucagcccuccauauccucagguucugcaucugcagauucaaccaaaugugcuugaaaauauuugagaauauuuaauacaauaguacaaauauaaguacacaauguaacaacuauuuauauagcauucacauuguaugaaguauaagaaaucuggaaaugauuuaaaguauaugggaggauguguguaaguuguaugcagauacagcgccauuuuauaaaagggaauucaacauccuuggguuuugguguccuuggcaaauggccagcaagggugggggagugcuguccagaaaccaaucccaaagcaagggacaaauauauacuucuacagaugagauauuaacucagaauccaugucugcacacacaucuuuaaugacaaguugcuuuaucacucaacagcggcacuacuaugaucuuuuacuuacacuucagccagcagagacauucagcagugugagauuuuuuaaguuuuucagcuauuguguauguuucuaguguauaauaaaguaacuuauccuuuaagauacuuaaguagcuuuucauuucuagcuuuaaaaccuguuuuuuuuuuuuucccaguaguggcauaccugcauuaaaaaauaaugccuuaccaaaaaaagcacucugaaugauugguuucaaaaugaugccacaacauagguggcaccaacacuauucaagaucauuccauucccaucucuaaaaaaauuuuuggcuggguaugguggcucacgccuauuaacucaacauuuugagaggcccaaagcaagaucacucagggcuaggaguugaagacuagccugagcaacauggcaagauccugucucaaaauucuuuuuaaaauuuuuuuaaaagcccaggcuugguggcgcaugccuauaguuccagcuacucaggaggcugaggcagaaggaucucuugaacccaggaguuucaggcuguaguucacuaugauggcagcugugaauagccugggcaacacagcaagaccucaucuccaaaaaaagacaaaagaacuaaauuauucuacugcagaacaugauuagguaaauaucuccaaagcagaaagacagguuucauauuuucguuaguuugagucaguccuuccaaaucaaaucuuguuuuuuauuaguauacagaugguauagccaguaaguaaaugagaagcagucuuuuuaagccgauccauucuuaaaugaaaaaauauauaaauauuuuagaauaaauuuauuaaauucuaaaguuguagaauuuuuaaauuuggauauuuugggaaaauauuuaaaccacuauugcaaacaaaacaacaaaauguacuuauguuuauacuuaggcacaaagaaaacuacaguauuuuaaaguaaccauuacacaauauugagguugcaaagauuacugaaggcauaaccuaaaaaaugaguugauuucuaaaaaugggaaaaaggaaaaaaauaauuucuaaaaacaaguaugcauaccuaaaccuaccuaaugacaccuuagaaaauucaaguauagcaccauucauuaacaucaaugaggaugucaucacacaucauguagccucugcacaccgugagaauaaaugaaaaagacaggcaucuugcuaucaugacaauaguuuugaccucgcagaccucucugugcuuacgcaacggauaaagccauaagaacuguccugcccucaaggagcaaccuaaaguaggaaaaaaaaaacaaaauuacacaauuauuauuuacaauugugagaagagcucuugacaacauucaaauggaggauacaguguaguaagggugaggguaucaaggcuuccuugagaagugauguuuugaggccauucuuucuucucaauaacugguauuugguuccugaauccuuuaacuuccuuaccauugucacuccuaagccaaaucucauuacgucaugucuagacuacuguuaagagaaccacuuaaguggucucugcagcccucaauuuauugguguuaucuaugggaaaauugcucaaacucuaagccuuaguuuccuacccuauaaaaugggguuuuauauacaaggaacauacuaaauacacagguauaccucagaaacacggcaggcucaauuccagagcacuacaauaaagcgaaucucaugaauuuguugguuucccagugcauaaauuaugguuacacuauaccauagucuauuaagaaguguacaauagcauuauguauaauugauaaauacaucacugcuaaaaaaaugcuaacaaucuuuuugcugguggagggucuuacgccaacguuaacgauggcuacugacucaucagggugguggugguugaagauuacgauagcuguggcaauuucuuaaaagacaaugaaguuugccacacugacauccuuucacaagacuucucuguagcaugugaugcuguuugauagcaugauagcauuuuacccacaguagaacuuuuuuuuccuuuuccuuuuuuuuuuuuuuuaaacgcaaggucucacucugucacccaggcuggagugcaggggcgccaucucggcuuacugcaaccuccuccucccugguucaagagauucuccugccucagcuucccaaguagcugggacuacaggugugcaccacaccuggcuaauuugguagaggugggguuucaccauguuggcaaggcuggucuugaacuccugaccucaaaugaucuaccagucucggccuccuaaaguacugggauugcaggugugagccaccacacccagccaguggaacuuauuucaaaauugaagucaacucucucacacccuggcacugcuuuaucaaccagguuucuguaauuccuaaauccuuuauuggcauuuuaacaauguucacagcaacuucaccaguagauuccaucucgagaaaccacuuucuuugcucaucccuaaaaagcaacuccucauccauucaaauuugaucaugagauugcagcaauucagucacaucuucaaugcuuuacuuccaguucuaguucucuuccuguuuccacaccugcaguacacaaaaagcauucaauaacuauuacuucauuucuucuaccuauguuuccauuagcuuuugccuauaguacgcacuagaguauguuaccauuauuuguuauaaguaguaccucauuauuacacuauucguaagcaauaccucaaggucuaagauuagauuuuaaaucaaggucaguaaaaauagaaaaggcugugaagacuguugacugacuuuaccagaauccauacacuagaggugagauuaguuaggugaugaaauaaccauucuauaaacaugaucugaaacucuguuacuguugucagcaggaaaagccaauguuacauauguuuaaaaaagaaaaaaaaaacccaaaaccagaaaacaaaaggugacaaaguaucaagacaaaaggucacugaugacugaucucuaggaaaagcuggaaagcaggauuauuaaauguaaccacgacuaagauaaaaaucagagacagaaaagucuuugucaccaagaagauauacuccaugagagagcagaaacaauucaucagguuuaacccugcucuagauaaaauaaaacuaucugauucaauacucacacuucucuaauaauccaauacauuaucccaucucaagaagagagagucacagauaagaaaaaaaaggcuucuugagaaguaugugcucuaauauaaacuaauaugccacuaagaaagcaaccugcaaaguccaguaccagacuucuggauuugugaccuaacaaggugcucuacaauuaaccuaacagucaaaccagaguguuguaaaagagaauuauguaauuaugccaaaccuccacucacaaaaaauauauggaaguaaccuaaguuuacauuuugcaaaucucacacacacacuagcccugacaaaaguuucaccagcuuucucauccaaguacaagcguguaauauacuuaauaaauuugucuuauaaggguaagaaauaguauguaacuacuugaaaaggagauagguagcugguuaauuuaaacaaaaagcccaaggaaguaaggugcaggaaaaggauaacugcaaugauuaguacaggaaacccaaagaagaacugaauggugggauagauguacucagagaccaugaggcaucaguuuccucuaugaauagaauauuaggagauguagguuaaaugggacccugaagucucucccaaaaagccuuguuuauauguuuucugagcuuaacuauuacuugagaaucaauuucacguauaaaccaacaaaacuaacauuuauugagcuuccagcucugugcuuaggcacugaaaaaucacuuuccuuaaggauugcaauuaagcaggagaaacacaaauaaggugaacuucucuuguucgaaagaauauauuucaacauuccuuuuaaaaggaaaaccugaccugcaaguuuccaaaaauauuaauuacuauuccucuuugccucucaaaauucccauucuguuauuuuuuaggaggaggaaaaaacaguucauuugaggaaaaauugagggucacauacuauacaauugagaagaguuucucugaaacuguaaucauuuuuggcagguaaauaggcauauccgagucagcaaaugaacuugaagauacugaguuauacugccugcccugugggguuccaccuuccccaaaagaauucagaauuuuugggugaucugagaaucuacauuaagacaacugucuccacacacaggaggccugaagaucgcugacauaagggucuuuuuaaaaaguauauuuaauggccuagggcgguggcucacaccuguaaucccaggacuuugggaagcuuagggcaggaagaucacuugagcccaggaguucuaaccugugcagcacagcaaaaacccaucucuacaaaaaaaaaaacacaaaaaaauuagcugggcauggaagcgugugccuguaguuccagcuacucaggaggcugaggcaggaggaucacuugagcccaggaagucaaggcugcgugagccaugaucaugccauugcaauccaguaugugacacuaagacuccgucucaaaaaaaaaaaaaagauaauuaaaauguguaagauacuguauuagcaauauaaaaagcauuugguguuaaaauguugguauuauaauuccucaggauaaaacuuacuuugugauuguuuucuauaacucaagauaugaugcuuagagcuccuccaaucaaguguuuccaggaagugaaaacuuguaggacagaaauuuaggcuggguucauuuguaucacacagaccuauucuucauucaaguucugauauauuuaacuauguagcuccuguaacaguuuaauggaaucucaccucccuaaaauucauuaugcauuuuuuuuugaaauccaaacucauuaacgcuugcuuucacuguuguccaaggcaggcacaucuuuaaaaaugguuuguuggacuuagcuuucagcuaaauauauaauaaauaaaacaaaacaagcaguuaaaugaaauguaaugggccagagagcuucagcuuuuauuuccuuacugcucaguaaaaagagaaaaccaucaauguccacguauucuguaauccacagaacaaguccggggcuacagcuauacuguccacaguugcaauucaaauuagauaaaaaauaaaaauucaguucuuuagucauaccagccacuuuuccaaugcucaagauuaauaaaaugucaaaccauaaagacauuuacaugucgcucacuccauuuacuuaaaguuggcuagacaucagaguauacuaggagcucaggaguacaagacacuauuccuucaaaaagcucagaauaguuaagguaauuuaaaucagcaaugacaacaaccccagaauuacuaugacccacgcaguacaaacugcucaggagucagaagaaaacugcuuuuuuaaaagggcaguuugggucauagaacaacagaccauggaaggcaugaccaaaggggagaugacauuugaaucugcaggauuaaaagcagcaaggguagcauuccaaaaagaaccaccccacaaagauauaugacgucucuaugauuuggguaacugcaauucauuccaugugacuucaggagagaggucauauuuguguguguaguauguggaaaauagugaaaaaugaaaaagcuguuaaauugaggaaagucuauccagggaccuuaugcaucacauucacgagaacagaauucauccuguaaaccagggguguccaaucuuucggcuucccugggccacacugcaagaacugucuugggccacauauaaaggacagcugaugagcaaaaaaaaaaaacagacaacaacaacaaaaaaaacaccccgcaaaaaaaacuccuaaaacuuuaagaaaguuuacgaauuuguguugggucgcauucaaagcuguccugggucccaugcggcccgcggguuagacaacuugcuguaaacaguacaagccaguaauggaguuucaccugucauuuucaugcucuaucuuccuuuaggacaaucauccuaacaagauguaagauggaucaaaagauaacacuaaagacagagacagcaauuuggaagcuaucacacaggcaucugagaucaguuacuaacugguaagaacagaaaugagagguauuuagaggaagaaaaagggagauguugccuaaccucagauccaauucucuguaaagcaguagucaagaucaccuggacugugaagacggucagggacagaaucccagcuaaggaaaaaggauaaaaugaaaaucaagauaaacauuuaagaacgugaacuagggaggaauaaaagcacugcuggguaagagucaagccccagcucaagccuuaauuugugguggaaccaaucugucugguuucgcgagacaccaggcuacccaagaucaagagagggagaaagcuagugcuaugucugaauacuagaggagcaaguacaacaaauggaaaaugggaucaaguaugagugagaguugcuaagaugccugguagggaugcaaagggguagagagccuggggagagagggugagggagggaagcacugguuucucaagcaaaagcuaaaauuuuucuauuaagauuuaaccugaugcuacacuuugguggugcagcaagggucucaaaugguauaaaacucaggugaucaugcuuuaugucugucucuagaaaaaugcuccaaaaaugauaaguagugauaauccgcagucucguugcauaaaaucagccccaggugaaugacuaagcuccauuucccuaccccacccuuauuacaauaaccucgacaccaacucuaguccgugggaagauaaacuaaucggagucgccccucaaaucuuacagcugcucacuccccugcagggcaacgcccagggaccaaguuagccccuuaagccuaggcaaaagaaucccgcccauaaucgagaagcgacucgacauggaggcgaugacgagaucacgcgaggaggaaaggagggagggcuucuuccaggcccagggcgguccuuacaagacgggaggcagcagagaacucccauaaagguauugcggcacuccccucccccugcccagaagggugcggccuucucuccaccuccuccaccgcagcucccucaggauugcagcucgcgccgguuuuuggagaacaagcgccucccacccacaaaccagccggaccgacccccgcuccucccccacccccacgagugccuguagcaggucgggcuugucucgcccuucaggcggugggaacccggggcggagccgcggccgccgccauccagaagucucggccggcagcccgcccccgccuccagcgcgcgcuuccugccacguugcgcaggggcgcggggccagacacugcggcgcucggccucggggaggaccguaccaacgcccgccuccccgccacccccgcgccccgcgcagugguuucgcucaugugagacucgagccaguagcaagggcccggucccacagcuucgacagccaaucaggugucgaagacaagcaggcggcggguaaaccgacucccccgaaggaaggggagggugggaggacgcccgcgccagagccgauuucacugacccuccccucccgccgcaggaggccggccgcgcccgcacacccagcaucucuacaccccaccuaccuacccgccccacccagggggcaacgcgagagucgcuaagcggcugcguacucccgacggcguaacugacaggagcuuuacuccaaccagaauacgccauuuguguuuucacacacggcgggaggagaaacggccaaucggcgacaagaggcuagccggaagcgcuccucccucugcgagagcaauggcuccguccgguuucgagcauuuuccgcucccuucucccucccccuccgguugccgcagggcgggccucccucccgccugcauccagccaccccuuucccucccaacguaacaaacauuauguucccgacuucccacgggaaaggcaacccccgcaagccaccagacggccccccuagccacccauccccccaguguaccgcaccuccccucccaccagaguuccgcuccccuaccuagccgaggcucucugaggagccggagcgccgaagcacagccucuucucuaggcggccccggcggcuuccgcugauuggcggcgagugggccaaugggugcggggcggugggcggagaggccaauggcgcggcgggagggggcgugucccgggugccccuggcgccggcgcugggaauccccgugcggucaguggcguuuccgcucgggcagcgggcugagugagcugccgccgccgccgccgccgccgccgccgccgccgcugccgggggaggggcggccgccgcccgccugcgcucagagacucacgcagccccagucccgccaguccgccaacacaguagugccggccccccucuuucccuggcccugcccccccuccccgccuuuggcucgcuccgccuuucugccccccacccccaccucacggguacgggccauucccggccaggaaacgccguggcgccgcguugggccuaacucgaguccugccgccucccgggagugccgugcgccgcagcccgggcccaggccccggcagcgccugggacaagguaaggguccgacagaaaagagaccgaaccucacgaucgggccccaggggagggaagggucaccuccuccgucuccccgcgcucgcucuccuugggucgugggccuggcccuccccaagcucuuaggaggaugcugccacuucucaccccccucgccgccuugcacacaccguugcaacaccccauuuucccagggagagagaucccccucuaaucuaggcgacccaacucccccuuucauguuuuuccugggucaggacgcuuccccucccccaacgccucuucacccccuuuccugggaacugccuacuccacguuuaccuuucccuugaggagaggccucuugcugcccuccgcucgaaauacacaggcauacuuuuuuucucuccccgaucccccacucccuacccccguucucgcggccuugugacagacaacucugaucgcucugggggccgcgaucuccccuccguaaucuuccuggacgccuucccucucguuuucuggcuucccaccucagauggcugcuucccaaaggcauuaccuucgccacccccaccacacguucucuggcuccccguggcgugugccacagcgugucugagauagccucguugaauguguaggguucgagccuggaguugagccagauugugucguuuuacuugccuugggcguggagaacgaucuugugagaauaucuucaaaggcagaaaaauauucccuuuaugaauucucuuucccucugcguguaagucgggaaugugaagaggaguguaggaaagagcccugguucaaguagguaaaucgcaugagagggaaaguuaaacuguugggaaagccccuucuaugcuaauugauucuauagaguccuugcuugucucacuucuugggcgucaguggucuuucucuuggauauggaugcugcagucagcucugcuggucugggucaggggugcguguaugaccugcauuuucugcuuucucauguuacuugugcaauguauucaccgguaacucauuucuuucccagaccucuggguuccacugggcuuugucuauauuuaaguucauuucuccaguuuccuuccugcacauagguacugaacgaauccccaaguucugugcuaauuaccuucaucaguugacuaaacaaguuuuuagaugacauauuugugaccaaggucauauuuacauuucuuuguuggacagauguuacauagcuauacuugugauuggggaggauccagcugaguggagugugcugagcuuuuuaggagaguguguacucccuauuugaaauuauuuuuugguuguuaauuuuauauuauuaauguuuuuaggucacagaaaguucuaagugguaauuuuagaugugugggaucugagcuaggacuaaagcagagaauacccacguaaucagagguuucugggcuccauagaggacguagggcuuuuuuuuuucuauuggauuucuuccaguuuucucaggaucauuaguucucuucuguagccaaaaauucuggccuguuaugggauuagagucuuuaagguuuacucagacugucauuauguguagaaaaaugaauuaugcccuuugguaggacaugacacaaggcucuguuucuagcugcaaauuuaaauuagauuguagagugcuugggaaauuggcuuucaaaagaccaaagcuuaaucuucacuccuaaacugcuggcuuaauuaaaauggauauuuagaauuugguaaauguugauuuuucuaauaaaaggccuugguuuaaaagggugaccuuaggauuguuucuuucuuaaaagcauaauuccagcccuucuggcauggagcacugguccaaaaaaaaaaaaaaaaaguguguguaaggagugggggugggguaaagagaagguuguuccuuuggguuggaucacaggggugaguauacaaggcagcagcagcugcuggcucuggagcucugguugcuacgugagaagcuugaguagugcuggcugcugucuccagggaaggacagcagugcagcguccauuaaugcugcuggcugcagggagcagcacuuaggcgauggcugcuucaggacuaagaagaaaccuugcuuuucugggaauuuucacugcugagcugguuugcuuuuuauugguggggagaugggaauuaguaauucauaaucuccuacccauuuauggauauuggcaucuggaaacuggaucaugguuaaagccuuucuuuuuuuguuuguuugauuugauuuuuguuuuuuggcagauuuuuguuuuuuaucuagacauuugugcuuggauaggacuaaaaguuccauuagaguuuuaauuuuucaaucaguuuaaaaacccaaguaauaauuuuaagaaucuuucugauaaccacaauaggaagaaaauaacaggaauuuuuuccugcagcucacauaucaugccuuccuccaucucuuuaaucauagaaucaauucuuauuauuuuguuaugugucuccauccuuucgauuagaccacauuuaccuuauagacgauuugcuaaacauuuuacuaagcuugaacucuuaaacucuaaaaaggugccauuuuggagugguuucuaaauaaauauuuuuaauuuguauauuaguaauaaacuucuccagauuagauauuuucuuuggaguuugacuuauaagauugauucauuauauacauguuggauauagccuucugacaucacaaauauaugucuuuggccauaauccaucugaaauguaggacagaccagaagaaauaugcagaaaucgaauaagucuaguucaggauacugagaagauggccucugagccccuuaggugaucuccccucccccacaacuccugaacauuaggaugaucucugauuaagcaaaacagucugagcguggaaaaacuugaaggagaaccaccaccaccaauuauaugcaauacuggacauauuccugugugcuguuuuucuuccccaagacucguguauccuauacuuuuuucucucagaauuuugauuuguucauuuucguguaaauguacuuaaaucucacaaacaucuauaauuuguaguaucacucuggcauuuguggcagagaaccaaaaagaauggaaaugaguuuugucauucacaaauguggcucacauuguuuucccaguaauaaaagcagaccaaugaaacagaaccuuuaauggauacuauuuuaggagguuccaauucuuauuacuaucacauagauaagaugcaauagcagauaaauaugauuucauguauacuggcuguuugacauacuuaggguuuaagauaaaaauguuuguaguuuuuuacucuguggcuuaaguugcuauauaaaauaauugcuuuuacacucgaauuuccuguuguuuggaaccuuuugugcucuugauauuaucauuuuuuagaggaucauacaggcccuuuucauagaaggauuuacuuaaguuauacccuugaaaacuuuuuuauaucuuuugauacuguuuuguguccaggaacugacuuucugaaauuauucuggcuuuucuggggagaaugacuauuucauuuuuaccuuugaauggggaaauaauaaagugcaaaguacagauuugcagauaauuacuuuugcuuuauccucuccauguugaaauaacuuaugaaaaauuaggccauaguuaacagcagucaaugacuauuggauacauuuuaucagaggggaacuggaucaugaauaaaauaaaauuuuaaaaauaauuuuuggcugaacucuggugauucaucaguuuaauuugaagucagaaggucuagcagugaauuuuauuuauaaaaauuguauuucaaguguugaaaacugaaacuucuugaccaguauauuuuguuugaggcaucaaacuuugcaaaaugugcaucguauauuuagugauauaacugguagucauuuguaauuuaaaguauucuuucaaaggcacucuuuagaaaguaauguaguguacccgugaugggcagggauugguaccauuccuuacugccaaaaauuccaaaauauguggcaaaaugauugauuuaucuugugggugggauucugggaaguucaugaaagguggagagaauauaguuuccuucacuugucuauauacauuuuguuaaauaagucuuaggaaaacuguuuuauuguaucuuuaauuaugaauugcguaaaagauacccaguaacuuuggggggaggugcuguuagaaagcauuacauuggagagaauuccccuacccugggacaaaaugcauucugucuuuaauacuuagcgaagggaacuaugggauaaaauaaacaaugaagguaagcucagucugcuuuauaugugcccucacugagcaaggaauuuguaaucgcaucgugccucauucguuuauaccaucauauugauuuuguuugcugaguaccugagggaauaccuuacuuaauguaaggucacauuaaguauguuugauaugaagacagggaaaggaauuuucugcuucuuggaguaaugucuuaguauuuuuaaaacacuuaaguuuuuacaucaggccaguuuugccugaugcucaugucuguugcuuugguugggcugcugcuuucucuucuguguucuuauggguucguugugguauaaggauucccacagcuuucauggcaguaugaaguaaugagaagcauugccuuagccauguuaguuacauguauacuuuuggccuauguuaugaaucacaaaaagcgguagcuauaggaauguauacaaaauagauuucugucuggggaaucaaguuuuugauuugugcuaccuaauggaggggaaaaugcugaauuucuugcugcucuguuugagaaauagauggaagcaugggaggagccagagaccucugcagcaggauuuggucuaaguagaaaaggaagauuuuuguuucaaauugccagcugcuuaugucagacugacucccuuauuaugccuccaguaggccugucaauauggccaaacagcuagauaagugcggggcaggacaaagggcucuuugcacagcagggaggcaauguuggugggggaggggcaggagguaggaaaggcaagaggaggagguucuuuucccugggagauuauucaguuuggcauacaauuaaagaaaucauuuuuaguucccacucaagcauugaauuuuugccaaccacauacuauuaaccccaaauuugauacauuucagaauaucuuguagggauccauucucgccaaggaaaaauaaaaaaauaaauaaagcucuguauagguuaaaauaaaauaaaucccacacucugcacccuccuaggugcaagucaccucccgaggagacccguucuagagcugaauucucauuaagaaauggaaaagaauacucuaucugaauaaaaacacauuguaauacaauguguuuauuuggguugggauuggaccugaacauguagaauaauuuguuucccuuuaugaaauaguugcucguaguugucuacaauuuuauuucauuaagauagguagcacauuacagcuuucauguguuggguugccauauguaaaaugcuaacugaagaaaggcuacuuuuuaauuucagccucauccuuaguuccuggagaaccugauauuuccuggagauuacucccucccccaccuuuuaguuuaggcaaccucuuuugauacauuuguguucagcucgcauacaagugggauaguugcauccaguuuauuaagacuuaguaugaaucauagaguuggaaaagaucuguugguuaucugguccuuuaaaccaaaaucauaaugaaauauuuugaaauuugggucccuauugaaguuuucauuaaaauguuaaaggaucgguguucugaacaacauuuuuaguuacuuuuaaaauaaauguuuugcgucaguucuuuuuuuaaaaauaaagaauuucauuuauaggcaaauuagcuggcaauuauuugaauugugauaggauuucucuuuuaugaaggaauauaugacaagguuuuucaaaaugcuuaauauauuuuaaaagacuuuaauuuuuagaaauaauugguuugaacaguuuuccaagagcacauuuguugcuuggguugagguaccaccuauauugcaauguuacuaaacuagccuuaaaguuuucccuucugucuauacugcaugcaacaauaaagggaacuggaauguuaauuuccauuuauggauuagcagaggagauguuuuaaccgauuaauaaccaaaaaacugccuuucguacacguaauauuaagcaagccugaccaaguuuuguguuauuucucucuguuaaagaaaacuggauguguuacuacuuaacauuauauuguuauuuaauggucuuggcaguaaugauauaauauuucgaccaaaagaaauuuugaguaauuaauuauuauuguaauuaguuggaaguuucucaucaguaaaauagcaacagcauuaacacaaaaucuagugagcuauauuuuauauuacuacagaaauuuaggguagucauuucuuucuuuauaauuuauucacauggauuauuuccauaaauuugugggacuaaaauagaagccaucuagucaagcaccagucuccauaccagacaguuuucucugcaugugcuaugacccacauugccaguauuaaacauccuuuacacccucccccuucccagauaauuagaaaucucuucaggguagcuuccauugcuccuauuaccuggaucuugcuagaggcucuaagaaguuccugguaaaagugagacaguaagggaccacauuuugauuccaaagguuuugauaacuguuagggcuccccaaacagcuaaucucauuuucaccaagacuuagccagcagagggcuggaauggaggugaaacacaagcacuguaccucaucuugccugugcagcugcuccaccuuauuuccugcuauuauuaucucacaacgccuccucccaucaaaaagaaacuaggacaaagggggaaaauuggaugggcuaaugugauuuuuauuaugcuagguugugggcuuguuuauauguacuuaaauacaaagcuaauuugccccauucuuaaaagucuuuagugauagagauuuuguaacuucuguaucuucuacuuucuuucuugauaaaccauuucagauucucagccuuacagaaagaaagguuuuaagcauacuuaauuuucguuggccguucacagucauuauuaccaccagaugccacuguauuauuagcuugaagaaaggugggcucucuucuguacauaauaucugcaauuuguuuuggaaaauacuaauuuguauaaaucugauuuaugacuaaaauaagguuaaaaauuagaccucuauguauguuuacccuauuaccuuagugggggugaaauuaauuagcucuuugaacauaaauuuuucaugucuuagaguucuuuuuucaagcugcauaauuuauguucuucaagccauuuuuaucccauaccacccccacaaagggggaaauuuuauuuuuuaucauuuuuauugucuuucaauggugagauuuucgccaccccacuccugaaaugugaagacucaaauaaaacugaguaaucuaauaagguauaugcguugcugaauguaguaagaugauuguuucaucauucuuagauauuaugaucuaguuugaaucugguuuccaguaucauguuagcauauuuaauacuguugauauguuaauuuuaauacaugcccagguggaucuccuugcuuucuauuugugccccuuguuugucguuuuguaugaaggggguuuuuguuguuggauuuucuuccccaucucuguguccuguuauguucuuuggcuuauguuucaaaaauucuguuuccuaccaccaaccucuguacaugccacaacacauacaauuuguacuuucacaguuucugugaaguaggaugaucugcaguuaauaaucaacuguuugggcauucuugguauccaaggaagguuuuacuuagaaggaagaaccuggaaggaccuguuggcaauuagacuacuucugcguuuauuuuacauuuucccuuauuaacguaggcuguugagaguugacuuguuuuauaagagaaaccagauugacagagaagacccccaaucagauagaguuauuuuaaaaauaaauguguuuauuaugguaacauuugggguagaaucuaaagggcauauuuuuaaaaaaacuuuuaguucuaaagacaaaagaguuuaaccuaaaacagaacaaagagaagggccuuugaagcaguaugauugauuauaugcugaauguagcauuagaauguuguaugaaagcauaaauuuuuauuuucucaauuucuaugguacaaacuacuaugcccauggaaguauguguuuaugcccacagccugaaauauauucgguggaaugccuuaaaaaagaauaaaucuggccgggcgcgguggcucacgccuguaaucccagcuacuugggaggcugaggcaggagaauggcgugaacccgggaggcggagccugcagugagccgagaucccgccacugcacuccagccugggcgacagagcgagacucugucucaaaaaaaaaaaaaagaauagaucugaggaaaauguaagagcaagucuaaaauuuugaaguccuuuuugaaaugcuauuuuuuccuagacaaauuuaguguuauuuguggcaaauagaacuuuaaugucguaauuuaguaauagaacaaaauaaggguggguuuacaugucccugcacauuuuaggauggagcuaaaaauuauaaugucugcauaccaaauuguuacacauuuuaauauuggggcuuuuauugaaaaaguuuacccaauauuuagaaaccuuuaaaaacaaagugacauaaaauauucacagauaaaucagguagucaccuuauugguggcauauuauguaaguguacuaaagccagauauuuaguguuaauccaaaaauaugaaaauuaugcuaacaucauauacagaucucagaaguugcuguagccagccaggcguggcggcucacacuuguaaucccagcacuuugugaggccaaggcggguggaucaccuuaggucagguguuugagaccagccugaccaacauggugaaaugccauuucuacuaaaaauacaaaaauuacccgggcaugguggugcgagcuuguaaucccagcuacuugggaggcugaggcauaagaauugcuugacccugggaggcagagguugcagugagccaagaucgugccacugcauuccagccugggagacagagcaagacugugucucaaauaaauaaaaaauaaagaaguuacuguagaugccacucuuacuuaaacccuaggccauguguggagucccaggggaagacauguauuuuuagagaaggaaggcucuagguagguguaaccuuccucuuacaguuuaucaugaacaguuaguaugaaaaggaauggcuggaaguuugcaguaguacaccgagcaacaagagaaauaaacauaucccacuucaugaaaugacuaugccagccaagggagaugaaaaacaauuuuuuuuauaguacaccucauuuuuuuaaaaacacuuuaauacuaggaauauguuucuguggcaaauaguuacccccaaaggauuaugucaaauaucucuugugaaaauuaauuuuaaaauuaaucuuuuggcugggugcgguggcucaugccuguaaacccaacacuuugggaugccaaggugggcagaucaccugaggucuggaguucgagagcagccugaccaacauggagaaaccccaucucuacugaaaauagaaaauuagcugggcgugguggcgcaugccuauaaucccagcuacucgggaggcugaggcaggagaaucgcucgaacccagguggcagaaauugcagugagcugagauugcgccauuguauuccagccugggcaacaagagcaaaacuaugucucaaaaaaaaaaaauuaaucuuguguagauagugaccacguuuuacuuuccuugggacaguccugguuuauaccugcuauccuagcguaauuaguaauagcacccguuucacucucaaaaaugucucaauuuggaucauaaauuauacgcuuaccauaauuguagaggauugugagacuuuuagucgcuaccuagcaaccuaguuuuucuugauagagcucuucuuauucuggagucuccugugcugcgauuuaucuguugaccucucugaacccccauuuccaaaugagcaguuuuucgaaugucuuuuuucuuuucccauuaggugguaguaagggaaggaguagguauagauuugauuaauuuuuuaauuuuuuauuauuaaaaacuccaauuacuacaaaauagaaaaauacuuuggaguuuauuaaacuguuaguuuaaaagguuccauuugaucaggauaagguccauaccuugauugguaaguuugagucuuuauagauucuguuuuuuccauguaggauucuuguuaaagaaauucauuauuuuguggaguucguacucuggauuuugaagguuggauaaucauuuaacacauuccucuauuaaacaaccuccccccaccuguauuucauguaaauuacugcuuagauagauuguaagcauauuuuauaauaguacuguguauuuccauuaagaguuacauaauuucugcuugucuguguaauguuaagcagcuguuguuauucauugccuagaucaaacuuuguggucuuaaaaauugaagaccuggaagagcuuuuguuugugugaauuaugucaagauuuaccauauuagaaacuaaaacugagaaaaauuuuaaguuauuuauuaauauuaaaauaacaguaauaaagccugcuaauacaaguaaugugauuuuuuaauaaaaauaacauuuuuaauuuuauaagugucguuugacauuuuugcaaaucucuuuaaugucugacuuaauagaagacagcugcuuucucauaacuccuucugcauuuaauuucuugugauaaguuguuuugguugaagacugaagaaaaucuggccuuguacagauaauugguuggaaaauggaagaccucauauaacccucugacagaaucuagaggacuucaggcauucucacaccacccuuuuugagaaucacuggccuauauucaugauuuacuucauauuagaugauauuuucuuacuucuucauuuauuguccggaauacucacccuuauuuuuauuuggcuauacuaagauaguuuauauacagaagguaagauaagcacuuggguuuuuuacccccuuauuuacuaguuuucaaaauaauggguugguaacuuagcaacaucuaaagacgugaaugaaguauuauuauuguguacucaugguuuuaaacauguuugauauguuacagucucuggcaguuacuauuuuugacauucagguuguccuaccuuugucuguuggcuacuaaauucuuuugauucauucuuaauacuuuccucacuuguuuccuugcuuccuacuauuacuagauguucuaggauaauuuuguacauuuuuugccccaaaccuggaaucagccauuucugcagaaaccucuucauucuuuuaaugaaaaaugguacuuagaaaccacaguauggaugguaggaguguucauugcucuugguuugggccuuguuucuagauuuuucaaugaacaaaguuuaaaaguauuuuauuucuuuuuaaaaauaucacuugguauuuuaaaagcugcauuucaaacucagugcuacaugauguuuacguaaaccuaaucuuucucccuuuccccaugcccaaaaucucaguuuucacuaacaccaauguaauuucucuuuguuuugugccacaauacacacacuacaguuuuagugugacagaacaauaugauuacuggaaaguggcuuuuuguuuuguuuucucaugucuuuuugcccuuaggguauaucccuuuagagauagagauagucaugccucacuugaugaggauauuuucugagaaauguguugucaggugauuucgucauugugugaacaucuagaauguacuaacauaaaccuagaugguacaccuaagcuauaugguauagcccauugcucuuaggcuacaaaucugugcagcaugugaccacuggauacuauacgcaguuguaacacagugguaagcauuuguguaucugaaaauggaaaagauaaaguaaacauacgguauaaaagauaaaaaaugguacaccuuuguagggcagcuccauuacagucuuaugggaucauuaucauaugugguccauccuugacugaaaugucguuauguggcacaugaccauauauagucagauuacaguauuuugaaaucccccuuagaauaguucucuaugguugugccaccaguuugauacacagugagguuaauuuguuacauuuuacuuucagauuuuucagggauuagguuuuguuuuaugauuauguaaaauacuuaaaugguuaauaagugaaauuuacgaagcuggguauaaucagaaaaauugagcuucuauccuagugucuuccagcugguucucucccugucccuguauguuagacucaacagagucaucaugaauuuucagagugauguuuugucgauacuuccccuuuuagcagaagaagcauuuagguuaguucauuuacuaaaacuauuuccuucuagauuuuucacuaacuaauauuuuuacacuguagaagaggaauguggaaauuucuguucuuucuuuuuuggaaccagaauuucuuggcuuaauacaagcaguuugagauaagaaacuuucuccaguaaaaauucucuuuuuuuuuuucuuuuuuuucuuuuuuuugagauggagucucgcucuguuucgcaggcuggagugcaguggcaugaucucagcucacugcaaccuaggcgucccagguugaagcaauucuccugucucagccucccaaguagcugggacuacaggugccugccaccacgcccagcuaauuuuuauauuuuuaguagagacaggguuucaccuuguuguucaggcuggucuugaacuccuaacuucaggugagccaccgcaccuggccaaaauucucucucuugaaaugccagaccauguuugucucugggaauuucagguacacuugggacacuggugcuacuugaaguguagagagcucaucaguuaacauuucuugaaugguuugcccuuagaccugaaauguauguuauuuagaaaggaugucauauauuuuuuaacuuugucauuuaaaauccaaguuauuugauuuuauguguuuuaaauaaaauauuaaaacuuuaaaagucuuguaccuguuaaauguuuuauccuuccuaauuacaguaucuuaaaguuaucacauuucagcaauacgucacuuucuaaugacuaauauagucuuuaaaaauacuaaaucaagauauaccaaaggugaagaaauagugauuaagaaugugaggauucuagcugugguuuucuugcuuuggcuuuggccaagaugaguuuaauucuuuggucuaauaggaauaauacuuuucuccuaaacauuaugagcauuauuugaguuaaugcaugaaaagugguuaaaggaacaguggcuggugcaacauaagcauccaguaaaugcugccuuuauuuuggaagugguuauuguuacgaguauuugaucaguucucuaaacucugucugaacuuuacuuagaauuaguaauguucauaugcuguaaauaacaccugauuuucaauacuucauugguuauaugaaaagaaccaacuguuaacaaaggaauaauugguaucuaguuaaaauuugaggccucugacuucacaaguauaccagugcuuacuauauaaauauaaucacauuuaaaaauuuaauaaagaaaguuuuaaggaaguaagucuccuuuucaggauccaggguccuuuacaaacacuggauccugaaauuguauuauuuguuguggcuuuaggguauuguguaugcugaccagagucacaggugguuuuuuuguuuguuuaacacuagaauuuugagauacauuugucuuuacaugcccucaaaguaaguuauauaacaccagauuguucauuaguucagguuugauuuuuuuguuguuguuuuuuguuuuucuuuuuaauacucugggguuggagugagguuguagagugcuauaaggaauuccuauuagaagauaguauuuuagauaugggcauucuaggaaaggacaaaaugguacacuaaaguuaucuucccuuuucccccaccaccaaaaaaauaaggagcaaacuacagugcacaguuuuggguuuuuuuuuuuuuuuuuuuuuuuuuuuuuuaaagagacaagguccuacucugucgcccaggcuagagugcaguagcacaaucauuguucauuguaaccuugaaccacugggcucaagcaguccucccaccucaaccuccaguguagcuaggacuacagguaugugcuaccacacccagcuaauuuuuuaaaaaauaucuuguacaggugggggucucacuguguugcccaggcuggucuugauugaacuccuggccucaaguggucucauaccucagccucccaaagcucuggguuuacaggcauaagccaucaggcccagcccacauuuuguuuuuuaaacaagucuuuaucuuuuggagauacaugcugaaauauuuauggaugaaaugaaauguuaucugggguuugcuuuagauagagaggagauaauagaugaaacaaucaacuuauuaguuggucauugucgauacuagauaaugaauaaauggacuucuuuauaccauuuuacuuucauacuuuauuugaaacaaggucuugcuauguugcccagcuggccuugaacuccuggccucaagagauucucaugccucagccucccagagcuuugggauuacaggcaugaaccaccaugcccagcccauaauagaaaguuuuaaauuuuaaaauaaaaguauucauagacuuggcuaucauggauccugguaaaguagacuagugaacauaaucagauguuucagucuuucccuguugauacugcuugcccucugagcccauuuccucuccugaucaucgccugcuauuuccaaucaacagaaaaaauagaguagccuacauauauaaugaguuuauacuaagagggaaauuuuaauauuauaaagaagucuauacagauucuggagagcauuccugaagagaagauugaggaagcaaauggauuaauuaauguaauaguguguucagugugcaauagguaacauuuuaugauaugguugaauuucugaaaagguaucuuauaaauaucagaccauauuuaaggagacuuccaccucuacugauaaaaucugcccuucucucucccccugacuuuauugcugcccaucuguaguuuugaucuuuuuucucuaggauucuuugccuagaauugccaugggccuucuggaucuggaacacggaugaaggaagaggaugaauguuuuucagauguuaucccuuaugggaguaauuuguaaauucuagcuucuucggguggggggaggcgggguguguguguguguguguguguguguguguguguguauuauuuauuuauuuuuuuaaguuaauuggccucuuccagcaaagaguauacagcagagaccuagaaguuucauuuuuuguuuguuuuuguuuuguuuuguuuuguuuuugagacggagucuggcucugucacccaggcuggagugcaauggugugaucucuucucacugcaaccucugccucccggguucaagcaauuuuccuaccucagccucccaaguagcugggacugcaggcgcgcgccaccacgcccagcuaauuuuuguauuuuuaguagagaugggguuucaccauuuuggccaggaugguuuccaacucuugaccucgugaucugccaccuuggccucccaaagugcuggaauuacaggugugagccacggcuccuggccaagaccuagaaguuuuacgucaaauuuugucucugcaguuuucugaggaaugaguauaugugcucaaauaauagcuaaguauuaagucugaaauauucuagaaaaacagucacaaaguaguuaugccuaggauguuuuugaauauugguacuagaacaaauggauuccuacuagauuuccuuuuuacuuucauauucagauguaggaagaguuggaauucaaaaugugaaaagcagucuugaaucucaguaaauucuuaagaaauucuuaauucauugaagagccauuggucguguguguuuuuuggggaguguguguguguguuguuguuguuaagaauucggggaugaguaugaggcuaucauugcuucuacaaggcaacuuaaugauaguuugcugcuuggcacaacaggugaaagggccuuucuagagcagggaucuugguuucccuuuuucccaccuaguaguaucauuccauguauuuaccaggauauacauuguuuaguccugucuuggcuaaauagguaaugguccuuaaggacauaaaauggaaggauauugugcagaagaauuacuaguucuccguaguguauuuuuuuacuguauucuccucaucaacagauggaaaauuuuuaaacuuagaagaaaaaacaaguguuuuucuccaaaagauugagaaccacugcuuuuaaguuauuaauggaggucuucaauggauuuguuaaaaaucuggagcauggauuuuuuuuuuuuaauuuuuuuguuauugguuacugaguauuggaaaaggaaauacaguauucaaaaacaguaauguucaggauuuggaacuauuuuacucaggaaaaaauaaguuuauaaauagacauuuuaaugaaaaggaaaauagcaaauuuauggaaaucugagauagucuguguuuugcuucacucuguuuagugcuagaauucuggacuuuguuuggggucaaacucugauaugacaggaaaacuaacagaugauuaaaagagacaguaacauaaaugggaaaguuuaaauaugguauaugguuuuaauuauauuuuguauaagaaagcaguuuauaccaguuguauuccuaacuaaaaaguacuauuuuaucaguuuccugggacuaauuuauuauaaguuaauuaaugacaugagcauuuuggcccaaauacaguugaaauguucauugaaacuggaucaaagaugagcauaugugucaaggcuuuaaaaucauuuuucauauuaagauuuccagagaaaguuuuuguaauauauaaguuaaauauuuuuaaugcuuuagaugacaggaacuguugaagguccuggaucucauaacaagccacuagcuagcugauccaaagacauuuggccccaugggcuucuaggaagacaaaugugcuuaccauuucaaagauuuuauuuugcucaguaaccuacuagacauauauuaguguuuguuugaguuggucguugucuuccauugcuguuauuuuauuauuauuauuuuuuuaauuuuagagacaggaucuccuugucacccaggcuggagugcaguggcacagucauagcucacugcagucucaacucuuaauuaggcucaagggaucgggauccucccaccucagccucuuaaauagcuuggacuacagguaugcaccaccacuccuggcugucuuauuguguugcccaggguggccucaaaacuccuggccucaagugauucuccuaagucagccucccaaagcgcuaggauacaggugugagccacccugcccagccccauugcuguugaacuuuuuuuuuuuuuuaaagacaggcucugguucuguugcccaggcuggagugcagcagcgcaaucucaguucacugcaagccacccaccgagcucaagccauccucccaccucagccuccugaguagcugggacuauaggugugcaccaccaugccuggcuacuuucuuuguaauuuuuuugugguucaaauaggaaucuuccacgugcauccaaaauauuuuugguuugugacacucaguguuauuauugacucauuuuuccauuggaaggugugccucagagugggugagccuuuuugcccucagucuucugucagcacucuaagacuccaaguacucuaagagauugcucacuaaaaauaagaacagcuggccaucuaccucaaaugugagccgucacuuuugugauauaaucaguccuuaucuuuaguacacagauuuauggaauaucacacucacugucugccugcuuugggguguuucuccugugucauucauuuuuguauauuggcauauagcaaauauaggaaugcugugucgcagcugugggucauguauguacuugcaguuagcucuugcucccaagaaugcaagaaauuuaucaacaaacucgugucauaaaaauaguuuacagugauuuuuuucuuaaaauauuucaaugauuaagacuuuuuuuaauaaccacaaguguauaauuguaaaaccuaagcauuacucagcaaaucuagcaauuguugaauugcauaagcuucuuguucauuggaacuuuugcuaaagaauuaugaccuuugauuucuuaucaccaugaccuaucauuaugauaaacaugccccucuuauguauccuuauacccauuauaaggauaaacaagggauagcuccacccaccagaugucauagacacaacugguauuuuggggauuuugcuguagacuaauccuggaaggaagagagguuauagauaaaauaagauuggccaugaauugauuguugauuaaagcuggguagggaacauuggguuuucucugguuuuauauuuauuugaaguuuuucaccauaaaguuuuuuuuuuuuaagauaaaaaauaaaagcaugaauaguguaaacaaaguuuugaaggagaaggaaacagguuaguagcuaauuaacaaaaauguucuuguuccauucaggcacaggaguuuggacuagcccaauaagcauuaaggaaaccauuauuuguagauuucagauaaugcaaugauaguaaccaaaguuaugcucuagaagggauaacaucauggaagaauauagaguagauuggaggguucacaccccagagguagugagaccaguucacugcuauuauauaaugcuaccuugaaaucauagggaggcgacugaugugguuugcuaaaagucuccaaaaauuucaaaggagaauagcucuucagucaggugcuagugccagcacaacaaaaaagaggguuuuuucccucauuuggccagggcauggauuuggaccaugugggugucauaauggaguauaccaagugauuuuguuccuaugaugaaagugaaguccauauuuugucuccugucuuuuaguaaaucaguauagauaagucuuuuuuuuuuuuuuccccccgagacggagucucgcucuaucgcccaggcuggagugcaguggcgugaucuccacucacugcgagcuccgccucccggguucacgccauucuccugccucagccucccaaguagcugagacuacaggcgcccaccaccaugcccagcuaauuuuucguauuuuuaguagagacgggguuucaccauguuagccaggauggucucgaucuccugaccucgugauccgcccgccucggccucccaaagugcugggauuauaggcgggauccacugcgccuggccaagucuuuuuuuuuuuuuaauuauuuuauucuuuauuuuuuuccccacauauucuaaaauaagucucuuacagugucuagguuucuuuccaaaggugauuaaaaaugaagcaucauauuuuaaacuucugaggcagaacugcuagaacaagaguuuuguuuuuuuuuuuuuuuugagacggagucuugcucugucgcacaggcuggagugcaguggcgcgaucucggcucacugcaggcuccgccucccggguucacgccauucuccugccucagccucccgaauagcugggacuacaggcgccugccaccgcucccggcuaauuuuuuuuuuuuuuguauuuuuaguagagacggaguuucaccguguuagccacgauggucucgaucuccugaccuugugauccucccgccucggcuucccaaagugcuagaacagaguuuugauaauuuguuugaaacgaagcacucaaaucuucuaguuuauuugcauuugcagucagaccucuacagaugccagcuagauuacagauggcuagcauaaguuuuuuucauuacagaaagaagaaauuuagagcuuagugcggucuauuaaaagaauuaaagguuaugucaaaggacaacuauaagaaaguacuuugguucugaauauugcuucagcuaggguuuauuuugaagcuccuagcccaaauuuguagaaaugcaacuaagaucuaauauuuaguguguaagaacuuuacaggacauccagucaguaguagucuuaaaagugaaucacauaggcugaagcaggcagaucaccugagcccaggaguucaagaccacccuggccaacauggugaaaccccgucucuacuaaaaauacaauaaucagcugggugugguggugggcaccuauaaucccagcuacucaggaggcugagacaagagaauugcuugaacccgggagguggagguugcagugagcugagauccugccauugcacuccagccugagcaacaagagcgaaacuccgucucaaaaaaaaaaaaaugugaaucacauacauaaacauugggaauuugcagauaacuuucauuuuaggguuucuagagcgcagugguguaaucuuggcucacugcaaccuccaccuccuggauucaagcgauucuccugccucagccucccaaguagcugggauuacagguguccaccacuaugccuggcugauuuuuguauuuuuaguagagacgggguuucaucaucuuggccaggcuggucucaaacuccugaccucaggugauccacccgccuuggccucccaaagugcugggauugcaggcaugagccaccacacccggcccacuuacaggauuuuucucccccuucaugguuguauaaaugcaguacuuggcacauaggcaaaccugaacaguuugcaaguugccuacccuuuucuacuuuggauaaaauaaaccucuuaaaauagcacuuaacauaguaauauauguauauuaauaguaguuacuucauguuuguugaaugaaugaaugaaaaaaguagcaaaucuacauaauauaaaucccaagacagccaggaauuuuaucuggaccuaauugucuuacauagcaccaauugguacuuaauaaaaacaaggcugggcauggcaguaugcgucuguggucccagcuacuugggaggcuaaggugagaggaucgcuugagcccaggagguugagguugcggugagcugugauugcaccaaagcacuccaaccugagugacagacccugucucaaaaauaaaaauaaaaacaauuaguuauaacucagauguugcuaucuaagguaaguaguaauuacuauaauaaacaagcuauauauuaacaucuuaauuuucuuuccucugaacuuuacuacuguagguguguagugaacuucauacaaguuaaucuuuuuguagcucuauuucuucauuucuguuuguucaucgguuggagaaauuuugcuuaaauuaaugaaaguaaaaauacagauauuaauggcucauaaaugugcacaacccacuucaucuauaguaaguaaaaguggcucccauuuugggguuugaaaaugaagaagaucugaauucacagagaggaggcacguguagagauaugagaaguucuuuuccuacucuacuuugguacauuggucucuaacacauguucugagccucagaacacaguagaacagaaccuucagaaaguguugagaguauaacucuuuaaagagguuuagucagucuaaauuauuugagggcaucaucuuuauuugguacuuagaagucuaaaaucuuccugauuguuguuaagguuacaaagagucuguguauuguugguuaguugagcaguaaauaccuuuuuaucauuguuaaauggguuguaaauaaaauauuuuucuucaguguuaaaauaauuuaugaucacaauauuuagauaauaauaauaauaauucuguuauuuaugauauguagucuuauccuacugccacuccccucuucugcuccacauacuacuaaguaugacuuggucucuauaauacgcacuaauuaugaaguuuuuuacggagaaggaaauucuuaauauagacuaggauuuuuuuucaguugucuuuuaauggccuuuuauucuaguaaacuuagauuucuuauagacaucgguuuauugugccgagcucaguagcuccuagagggaguauaaauuuaggcaaaggaaucaaggaauaaacugguauuguagaagagaugggagaaaaggaaauuuuuauuuuugcuuuaaauuacuaaaucaugauguuuccugucucucagugcuuaccccaaucaguguuucucucuuuucuuuuuuccuuucagucccgaaccccuaaaauucuuugcuugcauuaacuugcuucagauuauaagccuaauuuuacuguuccaaauacaugaacuuuucacuguaucuccaagugcucuuuuagaguucaucucuuuguuuuccaguaacucauauuuguuucuucuuaugcuuaacacuucucucucauuuuuuuuuuucauguuucucacauuuuuucuuuccacauuaucugcuguagcaaacuugaaauauaugcuuuuggagaagaguaaaaacaguguuuagccauauucagguuauuagcagcagcuccucuuucuucacauauacuuaaagggaccagaaaguuauuuaagcucuuacuugcuacaaaugcuguuccaugugcuccuaugagucagcacaacagguauuuuuuuuuuuuuuauuguacagaugagaaaacugagacuuugagacauucuaugaauugccugagcuaguuggcagcagugccaggauucauagaaauuuggagcaggaagacaacacaaugaagauuuuacuuugaggaauuuaggguucaucuauguaaagugauuuuucugaggucacuaauuauguuguaggcuagaacucaagucuccuaacuccuaauauagugccuuuuuuuucuuuucuuuuuuuauuuuuuuaggagaugggucucacuauguugcccaggcuggucuuaaacuccugggcucaagcaauccuccugccucagccucccaaagugcuaggauuacaggugcaagccaccgcaccuggccucuaagagugcuuuuuccuagcauacuuuucuucuccuaagguaaaaggcuguuugucaugguacagcuacggugauuuuacuugagauauuugacuuugagauggagaugaagauaaguauauaaugcagcugccacauucauucucauacaagguaaagucauucaaaagauaaaucgaagaacuauagauguauuuaagaagaaauucagccuauauguaacaacaaaauuuugaauaaucaaguucagaaauuggauuuuuaaaaacuuauuagcuacuuuaacccuuuugaaauauucccaaaaaguguuuucucuuccugaguuaaauuuauucauuuauugaccuauuaaagauuuuuuuagugcuucagagcuauucuguauaucuguucauuuucguuauuuaguaguauauagaaguaauagauugggcugaauagauuuauuucaggauauaucuuagauauuuguguuuuuucaugaaucccaguuuaaggguuauugcuuucaaaaggaagaaauuugguuagucaugacuuuuggcuaguugaaguuuagagaagugcuuuauacaggaucuuuuauuuagugagaaaaaaauaacuuuuuauaauuuuauaauacugugugaaaaaccugauaccaaaacuucugaaaaagaaaccaggccuaggagaugaggauucuagggaagauuauuaaauugaggauauuuuuaaguuagauucuaaauuaguaaaucguggcuaauaagaugaaaauaaucugauccuuuaguaagaucugaaguaauauuguugcccugcaaaaaagugguuguuaucagcauaccuuauaugucagccuaagcaagauuagauuuucucuuuucucugauagaugccaauauuuaacauugacuuuuaucuacuuucaaaaauaucuaugaaauauacuuucugucucugaauuagaguguauguauauuuguguuuacuugaaauguuauagcuggaugauagauuucagagcaguuuuuaugcuuagggaagccacugccucccaaaaagguuuucuuaugagaaugaggaaaauaaguauaaauuuucauauuuauguuauuacuauugaugugcuuggauaauuguauuuauaaaaguaaaaaauguucaguauuuuaucugaaauuuaauaauggauauuguacagccuaaggaauuaaaagaaaaaggacccuuugagaaaauggcuuguucuuauguaucuuaauauauacuguguucacuuuauguuuugucagacacugaaauugaggaagagagauuuuggcguucuguugguuuauggagagaguugaucagagauugcuccuuggcugaguugcugucugcauaggcuguuaacaauuguuucucuggcagcagaucuuguucaucaggauugcaucauuucugggagaauggccaagguccacagccucaauacaaagacugucugaagcauaugaggccuguucucuuucugaagcggcacuccucuuccugccaguccucuucacaggauuacugaagcagacuuguucugaauuucuuucguuggauugguuguuuauuggacuuuugucugccagcugcuuccgccucaccugucugaugcaauuucuucuucugaaaucuguuggaauuguucauaaaacacuuuuuguuugucuucucugugagugaccagggagaucauacaggucuugugcuuucagcaagucauauagagaagagacugucagaaugaugauacagagacuguuggccauuucugaaaccaauuaaaaagaugggguaauuaagaaacauuucuggcauguucuauuuaacauccuuuucccuagaaacuguauguaaauggcaccuccuaaagagaguacucgguacuacuggaagauacaggcugugucuguuucugaauccaagaacuuacuaguguuccuguggauucugauggauuguucuggaaauaguuaaauuaauaauaaauugaaacugugaugcauucauuuacccccuacuguacacucacaucuauuucgcuguuuuccuccuuuccuuuuuuucuuucuuauuugcuauugcuucuuccuugauuuacuuuauuucuuccuuccuuuuacuguuacuuugauacuuuuauuucucuaauucuggguguacuauuuuaaaucguuucuaaaaaauaguuuauuuuccaguuuuuuaaaauuagaaaucauaaaacaucaacauaaaugaaaugcaugcguucuaaugcuugguaacuggaauccuaugaauagcucuuuucauguuuaugauauguuaaucuuuaagguguuaauaacucuggcuagcguuaaauuugacuuuuaggaaaaaacaccagagacuuaaaggauacugaucauuuucccuuccuuuuuggaagguagaaaauuaauuuaagcgccauuuuuuaagcauguuuccauuugaccgcaaauagaacugacuccuuuuuaucacucuuuuuuauaguaggacaagaaacuagaugguguggaaugaagggaaagaaaggaguaauaaauauggacuuguaauuuaaugggugaugauggccccuugucuggcuggacaguugucggacaucggguuaaagaaagaacucugaauuugagaaguguucagugaagaagggaagcaccuuuuaggagagagaaaaagaagggaucccuuggaaaaugagauaauucuaauuugaaggaagaggaaaaauuagccagugacauaaguauuuaccauuuaagucaaauaauuuccuucucuaccaucucguuucuggcuuuauggaaaaauaaaaaauuaaagggcaaaaaauucagugccggauggacguagggugguaaacgagauaguauagauguaggaugauaaacaagacaguauacagaaacauaauauagcuguagaauuccauucuguguguucaucaauguuauuucuuucuguacuaauuuuugucucaacuuuuucuaggucuucagaacuacuagcagauaauuuggggggacuucauauucagaagucuauauaaaggugacugacccaaguaaauccuuuuaauuucuguuuuauuuuuugcauuuuaaugacugcuggaaucauguuguaguaaauugugauuauaauuuacuuagcagauauuucuggaacuucucuacgugucaguuauuguuuuggccauugaaacuacagcaguggauaaaaaucccuguucucauagaguuuauauucugguaggaaaaaacaaacaaauuauaauaagaaaauacugcauuuagaugaucuguuaaauguuccucgguuaacauuuuaauagcuacauuuuacagaguuacuuagggaaggaacuauucuuaggguaauauuugagaaauuugggauuauuaacagaauuugaauuaagaagccucaucauuauuaaagcauuaguuagaaugagauggucaagcuaaccuauuaugguugcuuucaucagaagaaugaaacagucauguuaaacuagacacaaggaaaauggaauaauuuuuaugaaauagaaauuuauaguuaccgacaauguuucuuuuuuuuuuuuuuuuuuuuuuugagacagaguaucauucuuguuguccauguugaagugcaaugguacagucuugacucacugcaaccuccggcucccggguucaagcgauucucuugccucagccucccaaguagcugggauuacaggcguccgccaucgugcccggcuaauuuuuuuguauuuuuaguagagacaggguuucaccguguuagccaggcuggucuuaaacuccugaccucaggugauccgcccaccucagccucccaaaguguuggaauuacaagcgugagccacugcaccgggcugacuuaauguuucuuaaggauucaucaacuauccaaaauagcuggguugguguuucauuagugaauguagcaaucauuuauucacucauuaagauguuaucugaaguaacuuuuccaucuuuuccuuuuaguauaucuuuuaaaaauugcucuaggaaaaauaucaacuaucaucuuggguuuauaacuugucuuuuaucuagaaacuguacuuuuuuuuuuuuuuuuuuuggagaaagaguuucacuuuugcucaggcuggagugcaguggcccugucucagcucacugcagucucugcuucccagauucaaacgauucucgugccucagccucccaaguagcugggaucacaggcauaugccaacaugcccagcuaauuuuuguauuuuuaguagagauaggguuucaccgugaaaccaugcauuuuuuaaauggguguacagucguaauggcuacaacaaaggguuuuuaaugauauuaaguacgguuuuugguuuaagucuuuuacugaaaauauaaaacaauucagauucccuuugcugaucaggggagguacggugauaaucagacuuucauaugauuaucuggucagacagcuuuggggcuuuucuuuuaaucugaauuauacaguaagacuaauagaaagaguagugaccaacagcccccaguauuuaacugucuuuuggguuuacuugaugaguguucuuguuuuaucauuuacagauuuuacuucaauuucccaaaggcuuagaagauguacugccaaggucucuguuuggauauacuguuagggaaaggaaacauacauguguaagacuggccuaaaggcaaaaaaguucaucagucccuuuuuuuuuuuuuuuuuuuuuuuuuuuuuuuuuuuuuuuggcaacagggacucacuuuguugcccaggcugagugcaguggcaugaucucagcucacugcaaccuccaccucccaggcucaagcaauccucccaccucagccucuugaguuagcugggacuacaggugcaugccaccacaccagauuuauuuuuuuuuuuugagauggagucucacucugucgcccaagcuggagugcaguggcgugaucucggcucacugcaaccuccaccuccuggguucaagagauucuccugccucagccuccugaguagcugggauuaccagcgugugccacuacagcuaauuuuuguguuuuuaguagagaagggguuucaccacauuggccaggcuggucucgaauuccugaccucaagugauccacccaccuuggccucccaaaaugcugggauuacaggugugagccaccgcgccuggcgcacaccagguaaauuuuguauuuuuaguagagacaggaucucgccauguuucccaggcuggucucgaacucccaagcucaagcaauccaccugccucagccucccaaagugcugggaugacaggaaugagccacuucaucuggcccagucauuucccagcccagcuauaugucaccuccaauuggguguaggaacaggcguauugucauacccagaggucucacuucaucaucuaggcuggagugcagugcaugauuauggcucaccucagccucuaccuccugugcucaggugauccucccaccucagcucccaaguagcugggaccacaggcacacaucaccauggcuggcugauauuuuuuuacuauuuuuguagaguuggggucucacuauguugucucagcuggucucaaauuccuggacucaagugauccuuccaccuuggccuccuaaaguguugguauuacaguugugaaccacugcacccagcccacaauuuuuuuuauuugcauuaauaucaaaguaagauuggagcaucucagaccaucuaccauuuacaauuuacauuaaccggccaggcacgguggcucacgccuauaguccuagcacuuugagaggcugaggugugaguggaucaccggaggucaggaguucaagaccgccuggccaacauagugaaacuucaucucuacuaaaaguacaaaaauuagccagacaugguggcaggcgccuguaauccuaacuacuugggaagcugaggcaggagaaucucuugaagccaggaggcggagguuguagugagccaagauugcgccauuacacuucagucugggcaacaaaagugaaacugucucaaaaaauaaaaauaaaauuuacauuaacccccuggguugacucagucgguaucauguacuuuucauuccuuuaguuuuuuuaguauuaauaauuguucuaaugucuuauuaugaaucaguguaucagucaugacucucuuuguagucuuuuuugcaaaaguccuuguuaacaugggucuuugacauucacauugacuuuauucccccccaaauaaaaugcuuuuuguuucauccuuucaauguuuuuuacacuacuguaaaacuacuaauguaaagucacacaaagaacacuuguuucccucugcaccauaccuccaaaucucuuaaucuauuuuugcauuuuuuuauacuucaguaauuucugagucuuucuguucccagcuuucacugguuuauggucaccaugucaagcuauccucaccgcuuuuucauacacaguuguuuagucuuuaucaugaaacuguacucuucgugauuucggggguuuuuuuguuguuuuuaaaaaguagucaacuuuuuuagagcaguuuuagguucacaggaaaauucaucaggagauacagagauuucccaugcacccucugcacccacgcaugcauagccuccuccugguuuauauuuuuguucauaucuagcagcguauuauuaccccacaaauaaaguugcuaagaugauugcaucuucucccaaaauuauaguuaagaugauuuaaaagaaggaagagaguguucaaugacaaaagaaggcacuaagaaacagcuguuuccaaucaaguauaaacaacaaauugaucucuuuuaauuuggaagaaauaacauuauugacugcuugugaaacugcauuuauuuguggccuaggaaaaaaacuuaaaugaagaucuugaauuuuuaaagaguuuagguaaacugggauauuuuuaauaaccauccuuuaucuuaaaacuuguuugcuauauccuaggcugccagaaaauuuuguuugggcaguuuuagaauggggagaauguguugguuagugagauaggcagacucuuccuuucccuucaacugaaaagaaaaacaaaaguaaacauaacuuuuugcccccuacuuugugaaacauuaaugaaaugcauaguaaacaugggacacuguggcuguauuuauuuuauaauuaucccuuaaaagccuuauucaagaaugcagaaaaauauucaguaacauuuaagauaaacuugaagaacuaucugauaacuagguauuuauuuuacuagauauuuuccuuuucuguuacaggauuccucauguccauaacauguuggaugaggcucugcagcucacccccacucucagaguggucagucuccauuaauuggaccccgugauuuccaaucucugcuguguuggacgucaugagcauugcaaucccucugggagucaccacaucagauacauccuacucagauauggcugcuggaucagaguaagugcuacuuucuagguaguagguacauuaucagucuguguggagacagccuucuuauggauagcuaauaggauaauauguaguauuuucuuaaccagauccuauuccacuguaauuaacauuagaccuuucccuuuacccccauugaaggugguggaaaaaaggaauuagaaggggaaggaagaguuuucagagggguauuucugggcaaauaauuaauagaaccaaaguugcaaaguaggaauucauuuucauuuguuuuaauggguggagaaaauuggaauaaaguagguguuacuaccugcuucuguagaguuaaugauucugauggagggagauaagaagguguucuuuccaacugauuuuccuugaaguccucuuccuauguacuucccauuguucuagaguaaaggggccgaaacuauaugggcagguugccuagaccuucugacaucugggguagaaaacauggagaacagcgucaucuguuuuuuuauaauauucguugccuagaaagaggaccuucaaaaucagugguaccaaacuuuuuuuucagcuaagagcagcuuuaggaauucagaguuuguccaaaggcccaaucccuaaaauuauacucucaauucuugaagaauguaaaugccaaaugacaaugaagguaggccuucauuauacaacuuuauauauauuauucacaguuuuaaaauuuuuagucuuuuguaucccuucucuuuuaaguuguccgagauucccccugcucacagauucccccucuuguccuuuuaccucccuuguacccaaucuuccuugcuuacagaaaggaaguggaagcccccuaccuuucaagacgaaguggcacuacaccaggaugugaaaguccagcgaaagagacccaaggggccuagggggcagcacacccccagaagccaagucuauuccaggcaguaccagggauuagggucugggcuggaaaaauccugguguuuugaauauguucagguccaguucagacucuugaucccacagccacuucuugagugagguggguguugcucuaauuccccuguuucucuugccauuuucacagucccuggggauucuucccccuucagcaaagcaaagcaacuguaccagauuucuggguugaaugacaucccugauuaauaagugguuuucuuccuuaaaacagaauauuauuaaagagcauguauauuucuucauaaagccaccuaauauaacuuaccuguuuacugaguuccuuaaagaggaagacuuaaagcuacccugagaaauaguauauaauauucugggguagucuaaaaugaaaagcaguguuugggcuuauucccauauaaaaaggagaaaggaggguuggggguggggaaggguugauuuuguuucuucuagagcuuuuuucuucuuuuguuuuuguuuguuuuguuuuguuugcaugcaaaagguauuuaguuaugucaguaacugagacuuacuuaaccauuuuacaacucuuuccccaaauaaaguacuuaaaacucucccugcauuaguagguagccaguuuguauuguguuuauagguuuuuauaaagucagcuacuaaccugguacuauguagauugucuaacuguauagauagauagcauuaacauuugugagaaauuucaacaaagagguuaaaccaauacguuuggaauugcuggauaaaagacccagagcaguuaaucuuacaauugguguuuuccccaaaguauagacaugacugcccguaaauacugcuggggagucuaggacuaauuccagaaauaaaaauacuucuggucuacaaaugugacugcgcugucucuguuaacaccaacauauccuaggauuuccugaaacauuuucauucaugaucuccagacagauuugugauacuguggucauaacuagcuacauaguuaugcauuucugcaaagggaaagaaugucaguaacuagcuacauaccauucuguuaaauuauuaaugauauuuauuaauguuucaucaugccuauuucgcuguucugggcacuuuaagauuaaaccugguauuaagugcagcauacucaacuagauguagacuucacuucauagaauuuuaaaucugauggcaacuauaugcaauacgcauuuauuuuuguguguguuuguaggaaaauuuguagauguaacaagcaaaacaaagauuuuucugaauuuccaacucuaccauaacagaauuucaggcauuuuccaagaaauggcaugauagcagcuggguugcauguuguacuuagaacacuguugauggaguauaucuguugugagccugguuucuguguauguguccaauucagugauaggagaagaaagccuguaauuacauuugcauaaagugguuggcugcuaaagagauguaauuccauuauuccaaacuuuuaauucauauuuuaaaauauaaaaacuaguauauauaucaaggaauauuuuaggaaaucuuguaguuaccuguaagugucuaacuguguauucaaucaguaaccaauauggaaauugcagaguuucuucaucagaagauaugaguuuaaauuuuauauuuggcaugcacagcaauauauuaaaugcugugcuuaacuagaaaguauugugcagugugauggccuuuuaaccuccacaauauacauuuuauuuuuauucccuagacuugcacaugaagugcauauguucauauuuacccguuuggagauggguaagauacaaccagcauagcuccaucuccauggccaucuuugauuucaugcaacuuuccuuuuuccugucccccucccaccaaaaaaaaauccauuccuaauaaacagcuaucauguuucacuccauguguucagugguacaaaaccuauauaaaauauguacagcucuuuggaauacuuguuuaucuaguaauguaccuaguaaauuaacaauguuguauaaauuuauuacuuucuuuuaacuguccaucauagaaacuaaauuauaccuucauuuuauuaaugcuugucugccuuugguuucauuuaggaaaccccaccuguuuccuaauacucagagaugauugccucucagugagccauguucagaucaucuuuuucucaagaauacugaccugcauucuugauguaccccucccccguucccaucuugcagacacuuuuaaguaauaaaaugcaugcaccucacuaacagagaauacuuuccucugucuaaaguucuucacuuagaaauuuccuuugcuguuauuaauaagauccuuucucacaguuuuggagcauauaacugggugaguuggauacauaucucagaauuuucuuugaucccucacuucucaauugacauugcaccacauugaacugcacacuuauuccugcuguacuauauauuguauaucuuuaagcaggaaaaaaugacuuguuauuucaagcgaacaauaugcauuauuugacucccugaaagacccauuaaucucuaaguuagaguuauaccaaucaucggaguuucuaauuugugaaucuguguucuaauuaauauaaauuacaaauuacuauucuauucugcaaagccauacaaacuuuauauuuuugaauuacccuucaguauucccuaaaaccuaaccagguaacaaucagaguugaaguucuuucuucccauaaaccugauuuuuauccuuugccaucaaagccuuuuuauuguaaaggcuuauauuaauuuucuaaguuugaauacauguauaauucuacaauaauacauugcgcuugaauaguuuauuuucuacucacaaaggguacaaaaagauacuaaaccaagcuucucacuaagccugguuaauaaaggucucaaauaauuuucuuuaaaggacugaaugucauucucauuucuguaguggaaagagcauagacuuuggagucagacagacuuuguuucaaaucuuagcugugucaguguguaaccuuggggaagucauguaaucucaccaccacaucuucccacucuguaaaaauggaguauauaccauguuuagugguugcugaaauuaaaugaauuaauauguauuuaaagcaccuaacaaauauugggcaguucacaaugguagccauuacuguuguuauuauuugucaguagacuaacauaacuuuacaguuuaguuuuuauuuugaaguucuaugguauuaucaugcagcugauaaauaauuuuguccuuaauaugcuugcaugucauugguggaugagaaauuauuacucuaauauuugaaagguguuggggguucaucaagaugagagguaugauaaauauaagaugccauuguuuuuaccuguacuuucuucaggguauccugucuugguagugaauggaagagggccuggucccuggggcagugcagaaggcacuuugaucaucucacucacugcaaaugucaugugagguuucauggaaguauuaagagauccaauuaagaagaauaguucugagucuaaaccagcccagaguggcuucucuaggggaaacuccccgcucagcugguacguuuguguuugucauuagggacaccuuguaucucaggugccugccuucagacaucugccuguacuggcuucauguuacacacaaauccacauuuaauaacacuccuacuguuauuuauaggcuuaguuauguuaauaagauuguuucaccgaguucuuucucuuauccuaguggcuagugguuguggaaagaggagggguuagaaugggaaaugaaguguuaguuuaagggaagauuagguguuaugcuaucaugcauugcuuuucgccuuugugcagcccugaaucuguggaggcuaguccagcaguuaaugagaagagcguguauuccacucauaauuaugggaccacucagaggcaugggugucgaggacugccuuaugcugugaguaugcauuuguuucucuccagaacagugaucuuccuggaguguaauccauucuuauacauugugacuuucuugaaauguuuauaugcagcaugacgaaguugccccuuuugcacuucccugacuccagcggacgucuagcccugcaucauuguucuuguuuuuaugucccaguugaccuuggcauuuuguuuuaucacuuuccugguugaagccaaaaaacaaaggguacuacuuucuucuuucuuuccauauguaccauacuuuaggggagagaggggccaguguuuggacacuguugauuuaaaaaaucuuauuuucaggaucauaauuacggagccccuccuccuccgacaccuccugcuucucccccuguccagacgaucaucccucguucugaccugaauggccugccgucgccuguagaggaacgcuguggagacagcccgaacucugaaggagaaacuguaccuaccugguguccuuguggucuuucucaggauggcuuccuucucaacugugacaagugcagguaagauccuguuccaucuaaauuuaagucuggguugcugggauuaggguuucuuacaaguagggaaaagcucaaaguauucuuucuuguguuuguuaauguagaugauuccuuagugcuccuuggcucgaauucucugcacuaggugagaauugcugacaacaaggaaugagagauugauguuaaagcuauugaauuugauaugaaauuuaauguccuggaaacauuugguaggugggagggaggggguagcauaugcagagacacuucgcccaugugugcuaugaugugaugcaugcuguuggaaggacuacuuuaaguuuauuuucccucuuuaggggaaugagcagggggaagguuauuagacuucaucggcggaagcaggacaacauaucaggugagcggaagauggguuagguccacaauuugacauaaaaauauucugugaucugaauguucauuuuaagaaccccucuuggccaggcgcaguggcuuacgccuguaaucucaccacuuagggaggccaaagcgggcggaucaccugaggucgggaguuugagaccagccugaccaacauggagaaaccccaucucuacugaaaauccaaaauagccaggugugguggcgcaugccuguaaucccagcuacuugggaggcugaggcaggagaaucgcuugaacccgggaggcggaaguugccaugagcugagauugcgccagugcacuccagccugggcaacaagagcaaaacucccucucaaaaaaaaaaaaaaaaaaaaaagaaccccucuuacaaguucccauggucccccagccagcucuuuucacagaaagagauagaaguccucucaagaccacuguauaguucucucauuguaaacgaaauguguugagaacaguuuaguccuguagcaaaguauuccuugugaacacaaaaaauauggauuccuguuuuaaaaauuagccagucucaaauuguuauagauugagucagcgaagcuuagggacugaauacaaggggagaaauaaauaccaugaggaacaggguuuauaugcuuaaugccaaugacauagaaucuuguuuucuuaaggaagaugaguauuuaacguugcuuuacagaugauaagaguuaauaguggaaguaauggcuuacugcauguggggcacaccuaaaagaauaagcuacuuuuaauguacuuuugaggcuauuaguaccugaacuaugaaaucaucauuuuucagguggggauagcagugcaacagaaagcugggaugaggagcuuucuccuuccacuguguuguauacagcaacacagcacacaccuacaagcaucaccuuaacuguuagaagaaccaaacccaagaagcggaaaaagaguccagaaaagggucgugcagcaccaaagacgaagaaaaucaagguaugcaggguaaaaauaucuuaaauagaaauugucugaaauagcuuaaauuuuggagcaagaaugcaccaaaauucuuuuaagaaguuugauccagguguuugaagggccacuuuuguucuacuugcaaaaaucagcuaaucuguguuauguacauguagaccaaccucucuucugccacaccauaucaucaccacuggcucaaaguuucuucuacuccaguccccaucccagguaugaaauuccagcccuaccuggcacaaucccguauguguugcagccucaagucuaggcuuccacuauccuuacaguaucuccccaccucucaaccccaaaguacagucugaaauucuuguccugguuacaugccucaugucuuuggguugauuguuuuuccuuguuucaaaaaaaauaaaaaucaggaaacaucucuuguauggucuagguuuccucagugucauggucacuuuccuguauucucagcuaaaaugucuacgggagaaacuucuucugguuuguguucuuucuuccccaucacagcaacuuuguugcuucuaggugacuuguucaucccuuguuaaggggauuggucuuuguuuccuucuuaguuucaaaacugguaaaucugcaacuuuaaaguuuuuuuuuauuuacuuuuucucuuaguaucagaggugcauauaggauuuaagagaugcaugcucuucccuguuaauuaccuagcuucacaguagaaaguauuaaaauuagucucagaguucauuggccuugagcuaccccuauucuugguaauaguuuggggaauuccauuguauuuuuuaccuagagaaagggggacagaauagaacacuaguuugugccuuaguuuuagucucagauagguauaacugucauucuugguaccaaguuuuguuuguucuacuuguuuuccuccuugggauaggcauuucgagagggaucccggaaguccuugcggaugaagguaagggguaaucuucgcugaugcuguguuuuacuucacugugaucuugcauuuuggucagcuucuuuccugacauugauggucugggaaucuuggacucugcuuuucauuaguuuguaguuguugccauucaguuuucauagagcuuuucuccaaaguagauuuucuuggccauuuucugaaauauuuucccuuucuguaaucagccuucauugauugguuuuucauucauugcuuuccuaggggguaagugacauuuuuccaaacaaaaugaggcuaguguguucugucacugugauugaacucaaccuuaggaguggaguuuuucugguaaugauacaggaucucuugugcaucuacccuagcacugugugggcuuuaauugcaggacgcuuguauuauugauaagaauuacuguuuucucuuagcauaucuguuugguggaaaaaacuuagguaaugcuagcauguuucuuaagauaucaaauaaaagaguuuaugaaguaugauuuuguaaagaacuuggagaauagagcaaguauguggaaugguuuaaaagaaguguaaggugcugguugauuaaaaauagcuugccaaaaggagauuugauuaugcugucugguauccuccuuuacguguguguguguguguguguguguguguauaaauauauauauaugaggaaaacaugccucucaaauuauuacugggggcuucaaagcauuuaaauagaauuaaauucaaguuuaugaguauucauauuccuaaaugauacaaaagcaggaucuuuccuauugagaguuauagggcauaaauauuaaaaucuuuaguaaggccaggcgcaguagcucacgccuguaauccuagcacuuuggaagaccaaggcaaguggaucaccugaggucaggaauucaagaccagccuggccaacauggugaaaccccaucucuacuaaaaauaccaaaauuagccaggcgugguggcaggcaccuguagucccagcugcuugggaggcugaggcaggagaaucgcuugaacccaggaggcagugguuguagugagccgagaucacgccacugcacuccagccugggcaacagagcaagacuccaucucaaaaaaaaaaaaaaauucaguaaggauaagcuuuuuaggauugcuuuaugugcagcaccagugugacugguguuagcaaagauuacagguagcacuuuaccuaaaguuugaaggccccacuuaguaucuaucuuuaaacagacuugcacauaccugugaaagaguugggagaggacucagagcuacagagcaucagaggccugggaugugucuuggaagacaaaucaaucaugccuuugcuggauccgucucuugcaaguggccaaguuugcuuuagcuuccccuuuauuuuugucucauuugcuuagagaggggccuuuuaaauagacuuuggaggcagauaauagcccuaauccuggcuacuaaaugcuuuucucuuaucaagcaacuaucauaacuuaucuccagaagcucgaaaccuuucaaaagcuauaaacuggcucuaccagaaaacugcacauaaaccccauauuuugcuuacaguuuugggagguugacagccucacagguguguuaaaauuuagaaaaaaaaauuacuagucauuuugauucuuuuaauucuaaauugaguuauaaauuuuaugcucagaauuacuaguuuaaaacuccuccagugauccaggugggagccauaagaauuagaaaaaauuaucauuuggauuuuuaaucccagugucaagagcagcuucccuacugaagacuuaauuguaaaucaggguuucucagucuugacacuguugacaguuuggaccagauaauucuuuguuguggaagggacuguucugugcuuucaagaugugaacaggaucccuggugucuacccacuagaugccgguaacacucauacacucaguugagauuaucaaaaaugucuucagauauuaccaaaugucaccugggugcaaaauuucccucaauugagaaccacuacucuaaacccaacugagguagagucucuaaugccuugaaggaugggacagcagaguaaacacacagugagauuagcgaacaauggcuaauacugugacagaggcuuccagaauacaguacacuuaucaaguguaaguuuaacaauugccacuuaaagcugggaauauuguuuggacacugccagucccccuagucuguaagcuccauuaagccuaagguuuugcacuauucuuuugcgcaacugcuacugaugucaagcaggcgauacucugauugucaguauguuggcuuuagguguuucuuuagaucccuuuguuuauuguucagucuuuuggacucuaguaagaaauguggagacaauaguguugauuuuuuuucuucuauacuccuguuccuugcagaaaggauaguagacaauaaucagucagcaacagugaugcaaaagugguaaaagaaaguguuaugauaagcaucaguguuuucugugccauucauagaaaguauauuuaauuuuauuguaccuguuugcaaguuuaauguggacauggauuuucaaguagcuuugguacuacagugucuuuuccuucuaaucaucacuagcaugacaucaucacugucaguguuuguuuuguuuucugauggcacuuaagucuugaacaccguggaggagaacauguauugggcuuaugcuuugucucuguagcucaggcacugucugccuaggaagcuguuccugaguuguaguaaucuuuucucaauacugucaccauagagggcaaugguuuuccuagaggaguauagcaaaguaccuccuagacauuuucuauauucucccuaccuacuccucuccccucacuucaccucuucagauuauuuagaaugugguaauuuaaauuguugaaaauagaguguuagaaagauauacucaaauaauaacuuuuuauauggguaguaagauugggauuggauuaaugagauugauugauuaagaucacaucuagguuuagaaugaacauguauuaugaaaauaauaagugauacaaaaacaugcauucuccuggagaauagucaaaaaaccaguuugggcuaacacuuaacacagauauucagugaguaugaaaaauuuaagcagugauaaauuugaggucucuacuguucauuuguaugaagauuuucuuaugaacuugaugucaguccuuugauuagaaaauugauuuuuaugacuuuaaaauggucauaaaaucacagugaugggaugaaacuaugauccagauuaauuucuuacuuuauaaauggagaaacugagcuuccccauuuaaagaaguuauucaaggucucaccucucauugguaacaaaagcaugauagaaaccagauccucugacucccaguccauuacucuuuuaugccacaucaauugccaagugauaaauuuucucuggaaccccagcuugucccacccccauucccaacccucuauuuaugcauggacuuuacuaaccucccugaauuuguuuucuacagaauucucccucugaagcacagaauuuagaugagaauacaacugagggcugggaaaaucggauaagacuauggacugaccaguaugaagaagcuuucacuaaucaguacagugcagauguacagaacgcgcuugaacaacaccuacauucuagcaaggaauuugugggcaaaccuacuauuuuagacacuauuaauaagacugaauuggccuguaauaacacaguuauugguucccaaaugcagguaagcaccaaaggguugaggacucucuaaguagcugaaauuuuaagaacccaggaagaggguaauggauuggaauuacuguuccuuccaaauguacaaggccauggaauaacagauuagccagguguugaucauauguaaccaaaaguagguuauauuaacuggaaacuaccuggauacauauuuuuaaacuaccuuuauuaauaaaaaaauagaugaauugaggcugugugcagugcaguggcucacuccuauaauacaacacuuuggcaagaagccaagguggaaggauugcuugaggccagcaguucaagaccagccuguacaacauagugagacccucucuuuacaaaaaaaaaaaauuaaaagccguugugaugauacacaccuguaagucccagcuacuggggaggcugagguggaaggaucacuugaaugaauuugagguuauaguaagcuaugauugcaccacugcacuccagccugaaugaaagagugagacccuggcucuauuuaaaaaacagagagagagaugacuuaguaugggaaauucuauauacccuagguaggaauuauguaauauuuauagaaaguuaagcauguucuuucucaucuuuauuuuagagauagagucacugaagucuuaaucauguauuuuuuuuuuuuuuuuaauauuuucuugccguuucuggggaggcaauuucacuagauguagcaugucucuuagaaaaauugagcuuucaucacauuuuaaaauuucucaucauugaucuaaauaacauguacagauaaaaccugaaaauauuagcauguuuuccuuaauuaugaaguaauuugagugucuacuaagguguucuugcuguuguuuaauguuauugcucugguuuuauucaguuacagcugggaagagucacucguguucaaaagcaccggaagauccugagggcugcaagagauuuggcuuuggacacucuuauaauagaguaucgugggaaagucauguuacgacagcaauuugaggucaaugggcauuucuucaaaaaguaagaacgucauucauugagcagugagggcuaagguggaccugguugaccaguguuguuguaaaaaucauucuguuugauaagacgcucuugggagaaaaaaaucacaacucagauaagcucacaccugucugcuauuuguagagaagugcaaguaaaucuucaaauuguucaauguauaaaauggugacaccuccuuuccaagccaagcauuccuugcuuugugcuuguucuuuaaucaaaagcagacaaacgugaugcuuucccaaguuuaggcguugcaaaagacugcugcugcuucucucagcauaugcuucauauuuggagucaugggguggccuucuuauuuguguugagaauuacaggaauuuuaauuguaucccuagaccauaccccuuugugcucuucuacucaaaauucaaugguguagagauguguguggaugcccguacuuucgguaaugaugcucgguucaucagaagaucauguacaccaaaugcagagguaagauaucuguagcaacuucccuuugacuggaaccaucaaaugacaagcuuacugaagaagcagugugaaaacuucacucagauaaaggucuguagauaauagucgugauauuucaucgugggaggugaaaaacaaaaguaauggugcuuuuauacgacaaaaugggcgcaaggaaagaguuuucuuuagagaaggcagaaauagaaaagagcaaguuagcauuugcuaaggagaaaaagcuagacuggauaagaaaaucaaguguaguuauauuaaagagauugccauacgguggaaguagauguuguuaggccuaacuaagcuauuugguugcaguuuuuuuagauuuuagugaguaauguuuuaugagaggaucuagacauuucuagaauucauuacucagagcaaccacaucaaauaaagcaagaaaauccacagagcuuuacuuacuggcuaaggaauuuuaauucucugguggagcuggaaacagcuauaagaugugaaagcggcugggcgcaguggcucaugccuguaaucccagcacuucggaaggcugaggugggcagauaacaaggucaggaguucgagaccagccuggccaacauggugaaaccccgucucuacuaaaaaaaaauagaaaacuuagccaggcauuguggcgugugccuguauucccagguacucaggaggcugagacaggagaauugcuugaacccgggaggcagagguugccgugagccgagaucacgccacuccacuccagccugagcgacagagcaagacuguaucucaaaaaaaagaugugaaaguagagauuuuacccugauuucuaacaucucaagguuucuccacauauuuaagaaaguauuauaaauuuucaagccagugcaguauaauaguuucagaugaaaugaagggguuaaauaacagauuaccauaacuccuuaaauaaauaauagauuaccauaacuccaaauggagagaaaguaugguuuuuuucucucuuacggaaaguucauggucuuuaugaaaaauccaaccagaagccuuuucacacaggugcgacacaugauugcagaugggaugauucaccugugcaucuaugcugugucugccaucaccaaggaugcugaggucaccauagcauuugauuaugaguauaguaacugguaagaccucagaaaccuuuccuaacaggaauauccaugucuuacauauuaagcuauucacucuauuuaaagucugcucuuguuucuugccuuuuccuuuguuuacuuaaucuuuucaugacuaaugaauuuucugccuagaaauuguaaaggaaaagacaggcaagauuuuuuuuagagauacggauaccuuguaugauacugcucacaaauuuccugacagaaguguuuucgcuuaugccuuuuuagcaagaauagcaaaauggauauauauguauguaugagacacuccuggaaauuacaauagcauccuguuguuaugcacagaguacuuaugucagggaccauauagaaugagaauuuaggccaggcgcaguggcucacaggccuguaaucucaacacuuuggaaggcugaggcgggcggaucacgaggucaggagaucgagaccauccuggccaaugaugaaacccugucucuacuaaaaacacaaaaauuagcugggcguggcggcacacgccuguagucccagccacuugagaggcugaggcaggagaaucacucgaaccugagaggcugaggcugcaguaagccaagaucacgccacugcacuccagccuggcaacagagggagacucugucuuaaaaaaaaagagagagaauuuaauauguuaccucuacuuuuaauuugucaauuauacccuuauaaagcuaggggugagauuuaaagauccacccuguccacagaaaccauguuaucuagcuguauaugacagugcagaaaaccauaaagggcaauucauagaugaauaugugggauuuuuuaaaguauaugcuuuuuguucuuuggucauuuggggcaaaauagagguuaugugguaaagugauguuuggcccagguauaaggaaaaaagauguucugcuuaauucaucaaggaaaauaaaaaagguuuuaagaagguuauaaaagguuuuaagaaguagggaauuaguagguaaaagugaggacaugguaaucgugggcacaagaugaguauggccacaucagacuuuaucauugauaaacugccugcuaaauagccaauaaaccacuggggggauugaauuuagggagggcuuucuuuuuuuuuucccacugaccauggaguagaauugggguuacacaaagaaagacagaauauugaaaguguuacgucaggcgcggugacugacgccuguaaucccagcacuuugggaggcuaaggcuggaggaucacuugagcccaggaguucaagaccagccuagacaacauggcaaaaccccgucucugccgaaaauaaaaaaauuagcugggcguguagucccagcuacucaggaggcugagguaggaggaucacuugagcccaggaaacagagauuaccgagagcugugaugcaccacugcacuccagccuagaugacagagcgagauuccgucuccaauaaaaagaaaaacaaaaguauuuauaggacucucuaaugucucuguuuaacuuauucagagacaauaucagaggaaguuacuguacugauauuuuaagagggugaauggauaauguaacugaauuucaaggguacugagacaggcauuuugguuguuucuuuggagcaguaauuauaaaguggacugugccugucacaagggaaaccggaauuguccuauacaaaaaaggaauccuaaugcuacagaacugccacuccuaccaccuccuccaagccuacccaccauuggagcagagacuagacguagaaaagcacgacggaaagagcuagagauggagcagcagaaugaggcuucagaggagaauaaugaccagcaaucacaagaaguuccagaaaaaguaacuguauccagugaucaugagguaaucgccccuggucaaaugaugaugcuauggcaucaauccuccaaaggaagaggaacccggguugccgcaugguuuaaguaggggagcuauaguaacacuuagugcccuuuauaucaauguggguuuauuguguucauacauuucuuucuguuuuacaaagucaaaaacauccuuugcugguuuugcaccagagaauagggguuaguuaucaucuguguuuaccauguggccucacaugaguuaacaguuuaaagcacuagagauuguuauagagaguuuuaagcuaccagaauaaaacagauugauuuuuucucagagcuugaguacagcugaauauugccucuaucuuaaaggaaguagacaauccagaagaaaaaccagaagaagagaaagaagagguuauagaugaccaggagaaccuagcucauagcaggagggugaguacugucugacauuacuuugcuccuucucauuccugcuaccuccaucaugugaaccucuucuguucucuugacuuuguaucaucucauugauuugaccugaagguuauaauuugggcuuuuuccguaauaaagauuuuauuauaauuuuuuuauuuauuuuucucuauacacacaguaguuuuguagugauuauuaucuagugaugguuugaagagguuguuuuuuuuuuuuuuuuuuuuuuuacuaacaaucugguuuccgcugggcgcgguggcucacgccuguaaucccagcacuuugggagggcgaggugggcggaucacgaggucaggagaucgagaccauccucgcuaacacggugaaaccuugucucuacuaaaaauacaaaaaauuagccgggcgcgguggcgggugccuguagucccagcuacucgggaggcuaaggcaggagaauggcaugaaccugggaggcagagcuugcagugaguggagauagcgccacugcacuccggccugggcaaaagagcgagacuccaucucaaaaaaaaaaaaaaaaaaaaaaucugguuuccgaaaaacuggcuggucagaaucaaaauguauuauaguugguuugcucugaauuaggaauuuucuagguuuuugugaguucugaaguuuuuuuaaacccuuuuagucauaugaacuaaaauuuucuacuuuuaugcugaaaccaauccuguguguuuaugacccugauuugaugacuuuuuuuuuuuucuuuuugagaccgacucuugcucugucaccaggcuggagugcaguggcgcaaucucaacucaccacaaucucugccucccggguucaagcaauuccccuuccuuagccucccaaguagcuggcauuacaagcaugcgccaccaugccuggguaauuuuuuguauuuuaguagagacggaguuucaccauguuggccacgacggucucaaucucccgaccucaugaucuucccaccucagccucccaaaguacugggauuacaggcgugagccacugcacccauccuguuuuucuuucauauuaaaguuucaaaauaacugacccuuuuugaaaaguuuauguuugaccuugccuuuauuuacaacuauuccccacauuuaaaaugaaauauuuuauuuuuaaucuucuguuuuccaaguuauaugugucaucuuacugguaguuaaaugaauuucuguaaauuuccauuaaaaauacuuuuauaaaagcuauccacucguccucauuugaagcuuccuucuacaccaguacuaucucuuucuagaccagggaagauagaaagguagaagccaucaugcaugcuuuugaaaacuuagagaaaagaaagaagcggcgggaucagcccuuggaacagagcaacucugauguagagauuacuacaaccaccucagagacuccuguuggugaagagacaaaaacugaagccccugaaucugaaguuagcaacucuguuucaaauguuaccaucccaagcaccccacagaguguuggugugaauacccggaggucuucccaagcagggguaagaguugaaaagacuucagcacuuagacauccucaccuuugcuaaugucaauaccuaacuuuuggaauuuuuaaaaucaguguuuucagcuuugcuccauaucacaauaaauaaggccauuaacuguuuaacuggaaccauuucauuggccuauuuuauaaaugcuuauuagaaauaacgcaaacauuugucgcuagccucuuuagcucauuuaaguguauacauuuuuguauuuaaaaauuagauuuuaaauuaguguuucuaauccuuauauuuuucaucaguagacauucugaaugcuuaaagugaauaggaaauuagacuguuugcugauaaaacauuucugguaagcaucugacccuacuauugcuacaggauauugcugcagaaaaacuaguccccaagccaccuccagcaaagccuucuaggccccggccgaagagucgaauuucucgguacaggaccaguucagcccaaagacuaaagcgucagaagcaggccaaugcacagcaggcagaauugucacaagcugccuuggaagagggaggaaguaacaguuuaguaacuccuacugaagcuggaagucuagacaguucaggagaaaacaggccauuaacagggucugacccaacuguggugucaauuacuggaucccaugucaaccgugcugcaucuaaauaccccaaaaccaaaaagguaagucacaaaugcauccuuuauaaguccagucuggcaagggcugucuuagugaaaugagaggaccuauaaucccuagaagaaacuaaucucaauauuacuagauugaaaguucuaaaaugcuuugacacaaaaggcuggagucauccugcuaccuguuuccuuauuuuuagucagcuuaaaucacugauagcugaaauuauuccucucuuagugggcguggagagggugaaggaagauauccuuguguucuaguugcucaauucauucuuacugcagcugcugcaucuccuccuguccuaguuucuagaugacguuugucuuuaugaacuacacugcuaccucuugauuuauaaacuaaugaucucuuuuuuaccuuaguaucuaguuacagaaugguugaaugacaaagcagagaagcaagagugcccuguugagugcccuuuacguaucacaacggauccaacuguacuggcaacgacccuaaacauguuaccaggucuuauccauuccccguuaauuugcaccacccccaaacacuacauucgcuuuggcucacccuuuaucccugagagacgucgaaggccccuucugccugauggcacauucagcuccuguaagaagguaugucuguguuuuuguguguguguuguguuuaugugugugugcuuuauuuuuuuaagccuaagauuccuaucaucaugacauaaauaaaauguucucuagauagccacucugcccaugugaguuuauaaugaguuaguuguucagccauaaauacugauucaucaagagucugugagacugugguggaaugaauguacugcauuuuuagugcucagauuugugacuggucacugaugucucuucugagaacccuugagguuccugagugagagcacacagcaguggaugacuggguagagacggauauguuuugugugugcucuugugauauggguuaacauguccauuuaugauuauugugugagauuaggcccuggguccucuagaacacuguugcauaaaugaaaaaaauuaaauuguuuugaaucaauucaaccguuauuauccacuaucaucacuugaaggaaauuagaggaaaaauccuauuguaauuggcauaauuccuguuccuugaucaaaugacaagucggacuguuuauuccaagagaauacagaaucuacccuaaaagacucucuuucccucucuguuucugccucuuucuccucuuuccaguuacuuacuguuuuuggaucuaguggcaguagcguuuggugguguuuuuggaaugcucuuucuuaauucccagaagcccugcauauuuuccaaaggugucucuuaggaauagaucacucccucagaucuaugaugucguuuuccauguuucuagaaguauaggacacccuuucauuuggucuuccuuugagguagagucuguucccuggaacacccuuuucucuuauccucagaucuggauucaggcugccuuccucagugucugccauugcccuccuccacuggcaucacguacaugaggaugcugcauguagauuauuugaugugaugaagucuccaacuccaggcaggucuucccugacuccuccaaacuuaaaagcuuuucucuuuccccaaagaacagaaguuauuucuccgggggaggggggcaugaaagaugagccaaaguggugugggauauggaggggaggagggcaauaggaaucugcaaaaaggaaggacacuacugcugaaugagcagcacauugcagaaagucuuuuccuaauugcacaucuuaccuaaacauuggaaucacucauugguuuguucggggaaacgcucguagaauuccuaaagagaaauuugaccauuucuaaggauguuaacuguugaagcaucuuaucaagccaggucguacaaucuccuauuuugguccuuuaaggaguguaggcaauuauuuauuacagauaaguaaugaagucugagcugcaaauaauaugaacuaggcucuugaauugaaauuccuucuugauaauucuaaugcuggguugcagucuuucuguuuccaucuuuuccaacuagcagagacuuaacgaaaaccaaaaacgugucuaggacuguaacuucagaucugguagaaaaugcauuucuuuaagcuuuuuuaacuugguucugcuuuuauacuuguaucuauagcacauccuuaaauuucuacgggcaacagauagaaauuccauuuaacacaagucccuguuauauucuccaaguguaucugacuauccuuaaucucauuuauacaggcucuacucaagcacuuuuaucuaugugucaugguuagucuuuaggaagaguuuaggcugcauacacaggauuaucauaacaagacuauuuaaauaggaucuuuaaaaacuguuuaagucauugcuuuauugugugcuguucacauaucaagauucuauuuuuuaaaauacagcuuuuuaugaggcaaaauaaaaugaaauggaauguuuuagcuagaauagaauuuggcuuuauagcagugaagaagaguucuucuucuaauauuggucuucuucuaauaucuccuaauauugguuagaaaggacuuaccuaaugcagaaccuaagaacauuuucauuauucaacaaaauuguaauaaaauucugaaaaucccucagaguauaaguuaaucagauagauaagaaaacccuccaugggauuauuuagaacaauguauauuucuaauaggcucacuguuucauaucucacuaaagagguaagggccuggccuuguaaguuaaaaacuuaccaguauaggacaaauuaaaguuguaucuguauaguuguacucagauucuuaugcuauuuauuuuuauuuuuaucauuauuauucugcaacuucugaaaagaagaggaguucagguauuugacagaacauuuuaugauaucccuagaguuucuaaauugaaucauaguuuuuaagaagcauuuugcauuuuuuaguuccucaguugguauuuuaaaaacauuuauaaguggccaacaaggcucucaguaguguuucaccuuguucucucuaaacuccucuucuaaacacaauguguauagggcauuuggucuccagacuucuuagaaaaaccagucugacugauaaugaaacagugugcuuugcauugauaauuaauauuucauuuuauacacuggagcauuaucuguaaaucuccaaacauagcauugaaauuuaguugaaccgggacucggugaaaaucugcucaguguucaguacuguacuauaagcuuucuucacauacauuaucucacuuaccaugcaugaaauugggaucauuguccuaaauuuauauauccagaagcuuugucucagaaauguuugguaacuuguccaaagugaagcagcuaauaagugacacagccagauuucuucuggugggggauaguagggguucacagggucucacuguuguccaggcuggagugcaguggcaucaucacaggcucacugcagccuugaccuccugggcucaaaugguccuccuaccucaaccucucguguagcugggaccacaggcacaccaccacgccuggcuaauauucauauuuuuuguagcgacaggguuuugcuguguuuccuaggcugaucucaaacuccugagugcaaggagucugcccaccuuggccucacauucugcugggauuacagauacgagcuacugagcccagccucacagccaagugucaagccagggcuucuggacuccaaaaccuguauugcuuccuugcucuuucgccauaauagcgagaccuuuaaaauauuuauccaucuuugagccucccagaaaacuccuuugcaauauauuuuaauagagguucagagaagggagaaauguucuuuugauuuuaacaacuugcugaguaggugcaucuaaaauuaacuuauuauccaugagguuaauuguaucuuguuagauacaaacaaauguccauguuccuuuuuuauaugaguccugaaauauuguaaaauuauacaacagaaccuggaggaguagguuugauuguauuugcuguguuucaccucauagcuaaccaugguagcaucuuucuucuagaauacuccuguucugauuuuauguucccuuuuuguagucaucagauccagaauguaaauuauuuuacaaguacaucuacuagacccuggaaauauuaaaaaauuacucagauaggaaagcuuagugaccccaaaugaguguuuucugcuuugaaaagaaaaacuuaaagguggccauaacaaaagauuuuucacuccugagccuaauuuuuccauuuauaaaaugagugcuuuggacaagaugacuucuaaguucucuucuaagcuuuaaggcuauauguaugguucugacaauucaucuuuacaucauuauucuguaucuaagauaguucauucuucggauuuuuuauuuuguuuuuguguuugcuuuucagagaccugguuguauccuaaaauguuuacgugauucaaauuaccauugagagcucuuuuuuauauccuuguucacucuuccuuccaaguguuuacagguuuacaguuucaguuuugcuuucauuuggccagccacaaugacauuuguaugauguaagauuuuuuuuuuuuuuuuuuuuuuuuugguaaaauuuuuguggauuguuuccuagguuucuaagagggaaaaucuaugagaauugcucucuggugaagagaguauuuacuuaccuguaauacauguucucuaaagguauaaauuauaauaauucaccuuugcucuuccuauugggggagggucuuacucagaaauugauguuuaucaaaauucgaucugucuuaugucagggcaggagagccacagaguggugagcaaccuacaacuguauaucuuaagagaacacaauuacagguaagaaauuuucugucuuccacaggauacauaaucuuauuauccuaaucuuugcagguuuacuaucuggccuaaauuuauuucuugucaguuuauuauucuaaucuuuacuaccaaaaacuugugacugauaggucuucuuuuugacuuuuucccuuuuuuuugauuucuacugaagcucauuucgugauuugcauuacucaugcauaauuuaaccaaacuacuuguuggaggggggagucccauagguuauuucauuugaaauaaaccuuuuggaaacgcuuuugguaccuguagugaagagcuauuaauccucauccaaaaucuuccaaugaaucuuuuuuauuaccucuucacacgucucuagcacggggcagacaacuuuuaagagaucuuuaucuuccuucuaggcgcuuauuuuauauauuaguuuuauucuauacgaucacagucucuccuaaauaaauguuaagauuucuuccucagucuugccauuuuacaccaucccaaaugguaugaaaaguugaauagcagucauuuuuuauugguuuuugucuuuugaugggaucucauuauauguaauccagauuuccucaaguuuuucaguuaaaaggaauugauaggacaauguuccaauaugcugagacacaagacaauaaaaugcuugacuguguaacugaauuaguguguugaauuguaucacucaccaguugauguacauuuaaaacaggugcacuaaauaguuuuagauaauuauugauaauucucugguucuuuucaauuauagcgcuggauaaaacaagccuuagaagaagggaugacucaaacaucaucuguaccccaagagacuagaacucagcaccuauaccaaagcaaugagaauaguagcucuucuaguaucugcaaagacaaugcagguacguaucuaaaaccuuucugauuauaugaccaaugauuguuucaggucugcauaaaaaauuuaaguaugaguauuucugauacaaaaagaaauggcguguuuucuaaauaguuacuuuacaucugucuuuacagaggaagagagagaucucaagucagggaucaguuuucccaggacgacaaagaaggacuagacaguguacagauaacagcagaaaugguuauaaaaaagguuagauacauuuaaaguaguaaguuuaggaaauuuauauucauauuuauaagauggggcaagggcaagaaagugguggaacacuaauauucaggaaagaauuaaaauucugagugauuaaguugggugggacaugguugagggagcaggggaugaaugaaauaagugaaaaauuauuaucaauugauuguuuucaaaggggcuuguauaauuagcauacaauuuuuaaaagaacagccgggcgcuguggcucgcaccuguaaucccagcacuuugggaagccaagguggguggaucaccugaggucaggaguucgagaccaacguggccaacauggugaaacccugucucuaccaaaaaugcaaaaauuagcugggugugguggcaggugccuguaaucccucccuaaacaggaggcugaggcaguggagaaucacuugaacccgggagguggagguuacagugagccaagaucacgccacugcacuccagccugggcgacaagaaugaaacuccgucucaaaaaaaaaaaaaaaaaaaaaaaaaaaacaaauuuuuuaagacagcuuuaaaucuaaagucuuugugcauuuuuaaacuagaugucaaugaaaaaucaucuguuccauugguuuugacagugacuugcaaaggauguaauugaaagcacuugugauaucuuaauguauuuugugacaaucuuuuuaccaguuucuccugcaaauaucagcuuaauugaaaaguucuuugugauuuucauaacuuuucucuaaaucaguuuuuuaaauauuagacaaucaaaauaccaaaguaaauuagaugcuaaagcaaccuuucagguugcaacaaacagaauauuucacauuuucauaaaaaacccacuucauuguuccuguuuaccaacuugcugaauaaauguaaugaacuugaauuuaauuagauaaauuuuuaguagcagauauugcaacuaaaaucagaacuuuucuuaaaguucuuacuucauuuggauuuuacuucuuuuuagauuuuauuucagaaaacgugaauugccuuuuuuucuuuuuuucuuuuuuuuuuuuuuuuuuuuuugaaauggagaaucaagcgauucucccugccucagccucccgaguaacugggauuacaggcgcccgccaccucacccggcaaauuuuuauauuuugaguagagacgggguuucaccauguuggccaggcuagucucgaacuccugaccucaggagauccgcccaccucggcuucccaaagugcugggauuacaggcaugagccaccaugccuggcugugaauugccauuuuuuaaauuauggauuuaguuuauucuuuugucucuagauuagauuauaccucauaaguuaccaccuauauaccucaggauaauaaaauuccaguuaucugaaagauaaauuauacuguuuauuuaaaauauuuucuucuaguauucaccaaaaauuagggauauuuagucaaauaugaauaguauaaagaaaucuugguaccagauuuccauuuguauuauuucuuuuuuaacagcuuuuaagguguuaguaagaauauaacuuagcugaaauagacuaucauguuuguguaucuaucugguguguguguuaaugcauguguauaguuaagguugggaacaggagauugcauagcaguucacauccugacuagcaaaggauuauaggaaaagugucuuuguuaucacaugcccugguuggaaggaaauuaggauuccuagucaccagccuuuuuuguuauuguugagcuucugcccuagucuaacagugagaaacacucacaggacacaccuugcccuuaaaaagcaauguaggaaaauauuugauuuuaaaaaucaagcagcagucaaaugcgcaaguuauauugcuacaaaauuagcauaaauucugaggaauuacuuuuauuuguuggcucucuuuuguuuuuuucaagaauaccaaagagacauuaagaaaggggaaaggauuucuauaauagaaaaaaucaaacagaccuuuacuugaaaaccagcuguccccuuuacuaacuauaugauguuacuagaagucucugaggcuaggcguugguggcucacaccuguaaucccagcacuuugggaggccaaggugggcggaucaucugaggucaggaguucaagaccagccuggccaacauggugaaacccugucucuacuaaaaauacaaaaauuagcugggccuggucacguaccuguaaucccagcuauuugggaggcugaggcaggagaauugcuugaaccuggagguggagguugcagugagacgagauugcgccacuccacuccagccugggugacggagggagauucugucuuuaaaacuuaaaaaaaaaaaaaaaaacaagucucugagccucauuuguaaaaugggaauagcaauaccugcuuuauagagcuaacauuagaaugaauaauguauauaaaguucucaauauaguaucaggcccauaagaguaauuauuauacggucauuauucuacacagaauacucuuucuuguagaguauuuguggauuaauaaauacauuaaagauucuggcugggugugauggcucacgccuguaaucccagcacuuugggaggcugaggcgggcagaucacgaggugaaaagauugagaccauccuggccaacauggugaaaucccaucucuacuaaaaauacaaaaaaaauuagcugggcaugguggcaugcaccuguagucccagcuacucaggaggcugaggcaggaggauugcuugaaccugggaggcagaaguugcagugagccaaggucacgccacugcacuccagccuggcaauagagugagacuccgucucaaaaagaaagaaagaaagaaagagagggagggaagaaagaaaagagaaaagaaaagaagaaagaaauacacuaaauauuuuaaguuccuaaaagcugaaacuuuauagaaauaaaaguuauuaucaaaguagggcaggggcaugauguucauuauuuguaaaugaugugggucuauucuuagaagagccuaaguaaucagcugaaaaacuuagaauuaauaauaagaguuuaggccaggcgugguggcucacgccuguaaucccagcacuuugggaggccgagauggguggaucacaaggucaggagaucgagaccauccuugcuaacacagugaaaccccaucucuacuaaaaauacaaaaaauuagcugugcgugguggugggcacuuguagucccgcuacucggggggcugaggcaggaaaauagcaugaacccaggaggcggagguugcagugagcugagaucgcgccacugcacuccugccugggcaauagagugagacucugucucaaaaaauauauauauauacuaauaauaauaauaagaguuuauuaauaucacuggauagaaggauaaauauauaaaaaguguaaauauauuuuaaaaaaucauuuauauaccaagaaaguaaaugaauaccaauuuuuuuuguucccaaacuuaacaaaacuaagaaacugccuaggaauaaccuuaguuggguauauggaguaaacuguuacugagaaauauuuuuaaagucugaggaaauggaaauuucuuuuucuuuuuuuuuuuuucaugaaucauacgugagccuuugauaaauuucauguucauuauggaaagaauauauauauguguauauauauauuucuuucucuuucucucugucuuuauauaguucccaugaaacugccuuguuuuuggaauuugauuaaaugauucugaagucuaccuuuaaaaaaauaagaaaaaaauugaaaaaauaauaaugaaguacuuucucuugagguguaagacgagcuucuaguaugaagcuaauaguuaaauuuaguauaauauugaugcaagaauggauguauauauggaacaaaauagucagaauaggccuaaauauaaauguaaaaguugguaaauugucauggaauuuuuaguuaggagauugaaaaagaauuagaaucuagcuggacacgguggcacgugccuguaacucucaacuacuugggaggcugagguaggaggaucacucaagcccaggagucaaguucaaccugcgcaacacagcaagaccuugucuucaaaagaacuacuagguccuuugccaaagaaaauucuaggcacauucaaauauauauauuuuuuuaauucaaacuugggccuggcauggugacucucaccugcaauuuccagcucuuugggaugccaaggcagaaggaucacuugaggccaggaauuugagaccagccugggcagcagagagagacccacaucucuacaaaaaauaaaaauuagccaggcaugaugguggguugccuguagccuuaaggaggcugaaguaggaggaugacuugagcccaagaauuugaggcugcagugagcugugauaaugccacugcguuccagccugaaugacagcaagacaucugucucuaaaaauaauaaaauaaauaauucaaacuguauuaaccauguuuuugugucuauacugccucuguauuaauagaggauuaguacauuggggaaaggauuugcaguaaaacugccggggaguaauaucccugcuagcaaucugauaaaauuuaucaugugcauuaaaaauauucauaauccuuaaccuaguagucguucauuuguucugcuugguaucuuuccuacagaaauagacaaagaaaccaaaauuuauauauaagguuggugcaaaaguaauugcguuuuuggaccauuaauuuuaaaucacuguaacuagacucagacacaucuuuauuaaucaaaauaggaaccacugcaaucaacacauuuuugccacugagaaauaaguuuguuuauuccuguagccuaaaaaucuaugcuucaggauucgacaaacucuuggaaaauauuuucugcauccugcugguuguggaagcaccuucccuguaaaaaguugucagaugcuugaagugguaccugguuggcgagaggucaggugaacauggcgggugagacgaaacucuguagucaaauuuguucagcagcuucagaaguugaaugaauuguuuauuagaauaauuaauucuuaguuauuaacaauugcaaaaacuauagguuaaaaauaaucugaauuccaaccccaggaaugguagaauuuguaauuuuaucugcuugugcacauacuuguaauggaguaucauauacuauuuauugaaaaucuuauuuuugauucauuuuaucaaauuaacucccucuacccccaaaaacagcguaguaccacuuuugaauuagauuugugaucuuaccuagcaccuugaauuuguaagaauauuaaaagaauagccaggugugguggcucacgccuguaaucccagcacuuugggaggccgaggcaggcggaucacgaggucaggagauccagaccauccuggcuaacacggcgaaaccccgucucuacuaaaaauacaacaacaacaacaaaaaaaaaaaccgggcauaguggcaggcgccuguaaucccagcuacucgccacugcacuccagccugggcgacagcgagacuccaucaaaaaaaaaaaaaaaaaagaauauuaaaagaagaauauacgaugacuaagguuccuucuaggaauguaaggaugaguuaauauuugaaaauuuaauaaucgucauuuguuagcaggucaaaugggggaggagaagucauaacacagugacuuuuaucaauuuaaugauaaaauaacauacuaugaucuuuuaauaucuagcugaaaaauugccaguugucaugcaucaugaaaacuaguuaaacaucaaaauaggcuaucaaauuaucccacuauuaccauuauuauuuaauauagucuaaguaauuguuagccaaaguaauuacaccaacccccucccccccacaaaaaaaaucaacauaagagauauaaguacugguaaagaggguuaauguguuaucauguacaaauacuauuaucuaccuagagaguuaauugaaaaacugguagagauuaauaggguaacuggauaaaaaauaaguauguaaacuuuuuaaauguuaauaacauuuagauaacaaagggagagauacguuuuauucauaguaguaaaaaaaaaaaacuaaagaacucuggagaguaaacuuaauuagacaugugguauauauagaugaagagggacauaauaugugaauaacaaagauuaugccauguuccuggguaagaaugcuucucaaauuacuccugaauuucaucuaacaccaaucaaaauccuaacuuuuuuuuuuuuuuuuaauaguaugagcauggucauugaaugacuucuauaguucauugcuagaauagcuaaaauauuuuggagaacuagaacagaauaacuggaauuucccuaacaauuuuaauaaaaaguaugcugguguugauucaguauuggacaauaaguggaaagaauaacauucggaaauaaacauucagaagauaagcccaguauauguaagaaucuaauaagauaaauauauuucaaauuaauagggaaauuauaguuauucuacauuuacagaagauuuuggaagaaggugcuggcuauuuguuauggggaaaggauggauuaauugcuaccccauauuuaaguauguucuuuuuuccuuuuuuguaauggcaguuugucagugugaaauaaaauguucuuuuuuaauuaaaaucuaaauuaaaaauuaaacauggagacaaaaggaaaauaggcuggcauuuuuacagugucaggguggguuagcaaagacaugauaucagaagcagaaaauaaagugauccguuugacuaaauagaaacaaaacauauagcagagacuuguaaauaaaauugaaggcaaucaguaaacugggaaaauacauuuguaauuuuauugacaaggggucaacauucuuacuauuuaaagagcccuuacagaugaagaaaaagaccccaacaccucaguagaaugcaggcugaagaacaugagccagcaguucucacaggacuaaauauaaacuacacauauauagauauucuuuugauuuaauaauccuacauguagccauuuguucuaauagcaaaaaaugaaaaaaaaguugguuaaauuuugauaauacuaauguugugcagucauuaaaccugaacuguagauuucuauucauugucauaaaauguugaccauguauuucugagugaaaauaguuacugaguaguuuagguaaggcaagagucagugaagcaaugucucgauaaaaauuuaccaggauauuagcaugcguuuauuuguggauaugauuuucagguuguguaugugcuguauaaccuugguaauuuuuugaguaaaggugaaaaauaauaauaauaaaagauggauagauuugaccacauaaaauuuggaaacuauauaugcaggaaaaagagaaaaaguaggcaaaugacuuggcuuucuuuggccuguaaacuucuuaagggcagacaucaggucucuuguugaauacaguaucauaauaaguacucaguaaauauauguugaaugaaugccuuguacauugauuugcacguggcagauuucaccuguaucuuauaacuccuuucuacaacuaacuucaucacuuaacauaauugacuuugauaguuauaguguuggaccuagcaguacagagaucuguaagauuccauuguuuaagacccuugaaauauuaaauauauaaaaguuauuccgaauauaagccaugaauuacauguuuguuucuguuuuauaccuaggcacuuuuuaaaaggaggaaagaaaauuuaguaucuggaacaaaaggaagaugugaauauacuuccaaucuaggaauauuaaaaauccugagauaucagaaaggaaaaauaugcaucuucaauaauuuuuugcauuuauucuucccucuucaucuaaacaucuccuacccuaguuuagugccucauaauucuuugcuaacuacuguguuaacuccagaugguuucccaguuacuagucucauacugaccauugcuuccagauaaucuuccuggcccaaaaauuuuccuugaaggccuggaauaaaugucacuccuuccauccaccaagccuuggggauauacuuuaaccuauugauuaagaauauagauagauggagccaggcgcgguggcucacgccuguaaucccagcacuuugggaggccgaggcggguggaucacgaggucaagagaucaagaccauccuggccaacauggugaaaccccgucucuacuaaaaauacaaaaaauuagccgggugugguagcgagcaccuguagucccagcuacucgggaggcugaggcaggagaauggugugaaccugggaggcggaccuugcagugagccgagaucgugccgcugcacuccagccuaggugacagagcaagaguccgucucaaaaaaaaaaaaaaagaaaaaaagaauauagauagauggggccaggcgugguggcucauggcuguaaucccaacacuuugggaggcucagguggguggaucacuugaggucaggaauucaaggccaacauggugaaacccugucucuacuaaaaauacaaaaauuaagaauguagauauaugggagcaagaauaccuguuuugucucucuccacacaucaaguuucucaccuuuaauauggggaugauaauaauagugcuugauuuauagaguuguuaaaauuagauauuucacaauaaagcacauggcauagucugugguauauaaucaucauuuagaaaauacagcuuuuuuuuuuuuuuaacuaacacauagcaauaugaucaccuuucuugaucaugcuaauacuaauguguucacuuuuuuuguugugucguuuuguuuuguuuugagacagucuccucccucugucacccaggcuagaguacaguggugcagucucaacucgcugcaaccucugccuccuggguucaagugauucuugugccuccaccuccugaguaacuggaacugcaggcaugcaccaccacuccugcuuaaucuuuuuuguguauuuaguagagacaggguuuugccauauuggccaggcuggucucaaacuccuggcuuaagugaucugccugccucagccucccaaagugcugggauuauaggcaugagccaccacaccuggcccuguuucuauuucuuacaaauuuuaagccucuugaaaauagaauguaugaugaccauuuuucccuucauaccuaguucaguaaucaguagguauuaaauauauauacuuuuaacuguaaaugaauaaaacuguauuuuuauucugagaaucaagugagaaaggugcuuugaccuaaauggucacuaaaauauuuaguguagugacuugcuuuuuaaguggaucuaagaaguacagaaaauaggauuauucuagucaaaaagaaugugaaccuaauuuuuuaaugguugggagaaguuuuuguagaaaucauuucaugcuuuuuagguagaaaaggggcuagacauggaucaaggaaucauauaagaauagaaagagcuucugaaaagggacacacauauauaagagauggugaaaggaauuuggauuuagcaucccaguaccuuuaguuggugauauagcaguuuaguagaggguaacuguaacacaguaacaaagacuuuucagaaacucaauguaaaagaaagaacuguagcaguggcucacgccuguaaucccaacacuuggggcgucuaaggcgggcagaucaccugaagucaggaguugaagaccagccuggcaaacguggugaaaugccaucucuacuaaaaauacaaaaauuagccagguguaguggugcaugccuguaaucccagcuacucgggaggcugaggcaggugaaucacuugaacccgggagacggagguugcagugagcuaaguaaaugccauugcacuccagccuuagcgacagagcaaggcucugucucauaaauaaauaaaugaauaaaugaaagaauuuuauauuuugcacugguagaaauuaaauuagagaucagucacauuugauuuaccuggaguuugggagauagaauguuuucagaguuauuuuaagcaugguaauuaaagaguuucuuugggauuuugguuggauuggaggagauaacuuaaugggaugaggcagaaaacaguuaagagccauuguagauuacagauuaauggcuuuacuguagagccuuaaauuaaucugugguuucaaacucucauccaagcuuuguguuucacagacuuguugagcccauuaaagaaauggaagucucgcuaucugauggagcagaaugucaccaaguuacuucggccucugucuccagucacaccacccccucccaauucaggcucaaagaguccccagcuggccacaccuggcucaucucacccaggagaagaggagugucgaaauggauacagccucauguuuucaccagucacaucucuuacuacugcuagucgcugcaacacuccucuacaguuugaggugauuuggguuugguugcugggagugcuggauaugaaaaucaucauuuguaccuucucauuucaaauauaauaccauuccaaauguuucuuuacuaucuuucuuccccaucucaguaagagaaugggaaaccucagggucauuguggccuguuaccugguagccucucaucuuggcagccccuaugcuucccaaaauaggcauacugcuaccacaaaucccauucauguaucuuuugcaugcaguccaucaaucuccauaaguuuagguaguaagcaugcuagaucuccaucguuaucuuuacuguauacuuuggucaaaauaggccucuagcugccuguaguaucuguuaguaacacuagccugagagcacagaugauauugauugauugugucuucguuucuaggccuuuaaauaagugaagugucuuucccagguuguuugguauuuucauuguggccuuagcagagauuuagaaaacauugggguauggcuuauggcgaauguggguuuuuuccacuccagguuacuuucccucuuuguuauaaugucuuaggaaucagaaguagacaagaggcuagcaacauguauucaugagacaaauuuauuaccuucacuguuggauuaaguuagaaaugucugccucagcuguuucaaaaaguaaucuugaaucacuuuaguguucagguuugggugacagcagguuucaauagaauccauguauacuuuuuuaaaacacuucaucuauugcauguuacuuugauuuguaauuaaaauggacacugucucuuuuuuccuucucagaaaaauuuguucugaccacuaaacacacucugcugcucugcccccuuguuugcacuucuccagauguguuuuuugagaaaggugaacauuuuaaccaaucuuacguuuccuauucagcuuuuccaaguaugaggauucagaauacuuagcuuuuaugaguaacuaagaggcagcuagcaacauugaaagcagaacuguauucuuucuuacccuagaccucuacuuuuggagcagaccucuuucugggugagggaaaaaaccuccugguuacauaucaguuaucuagggaaauuacucuuuaccagauuauuuaugaaauucuuucagccagauaauaaagcagcugauucaggccuuucuaacuugacuuugucuacuugcaauugacuuugcaguuugcaccuagagcuuuauaguaagguaucaugagaggaauucucccuggagggcauaagauuauaggaauagagugucauacuuuaucaauacagguuuuauuauaaauguggaauuaugaaaauuagaaggaggccgggcgcaguggcucacaccuauaaucccaucacuuugggaggcugaggcaggcggaucacgaggucaguagaucaagaccauccuggcuaacguggugaaaccccgucucuacuaaaaauacaaaauauuagccgggcgugguagugggcgccuguagucccagcuacucgggaggcugaggcaggagaauggcgugaacccgggaggcggagcuugcagugagccgagaucgcgccauugcacuccagccugggcaacagagcaagacuccgucucaaaaaaaaaaaaaaaaaaaaaagaaaaucagaagguaagucacuuugcaaaacaagcggguucaguacucaguguguuccuuaucccuuguagcauuugggauaacuauuaaacacugcaaauauaaagugguuuugguuuuguuuuguuuuguuuuuuuuaauuggugaucauuuuaauaauacaguccaugcauaauguuagaauaccaggagggaaggaaaauauuaaauaguaaaagguccaaggcaugguuucacuugcaauuuaaggaaauuuuaccuuucucaucaauaauagaacagauuucaccacccugacccauucuaaucaccauuuuaauggccauacucuuugcuguauucuaguacagagagguggggagccuuuuuuguagcaaaggcugugacacauugugaaauaucaaaaaggugucacguauaaagaccagcuuaggcugggcaugguggcucacaccuguaaucacagugcuuuggaaggcugaggcaggaggauugcuugaggccagggguuugagaccagccuggguaacaucgugagaccacauuucugcaaaaauaaaauacaaaacuuagccagguguaguggcauauaccuguagucccagcuacuugggaggcugaagcaggaagaucacuuaagaccaggaguuuaagacugcagugagccauuauugugccacuacaugccagccugggcaacagugagaucccaucucuaaaaauaauuuaaagaccagcuuaggccagguacaguggcacacaccuguaaucccagcuacucgggaggccaaggcaaaggaauugcuugagccugggagguugcagggagccaagacugcgccacugcauuccacauuccagccugggcaacagagggagacucucucucaaaaaaaaaaaaaaaaaaaaaaaaacaaccuuacuagauuaguuuggggaaggauauuuuugagaaggaaaaaagcauucaggaaaauggugagaagucuuaagugcuaaggggaagaagguaagaagauaaacaguggaagagaacaagaucuucaggaggggaaagcaucuagaaagaagaguggaagcaacauugggaggacaagcuuaguuagccucuccuuucuaccagaauaacccuccccuccuauucuugcccugagagccauacuccacccgccauuucacacauacgugcaccuagauguacaccacccacuguccaugccaaguaaaauucacagccaaaacccugcuuugcugaagcagccucauuuccccuaccucagcaugugccugccaccuaggccacaguuauucagagucuacauuaggcacccucuccuuaccucagcccuagcaccccugagucauugucacacuaccaccuucacucucuucacguguucccauuuacaucuuuccauuaagcacucacugcucagucucuguuaugggacugcugccucaccugaaagucccaagguaaaguccuacccucuguaggauacagggaccuaaguauacacauacaugcuuuuucugcucuguugccaaaaguacaauggauuuuacaaaauaacauuaauagggguggcucaggucuaauuagauuaugccaagaaccaacucuagccugugagcuagggauuccaucaaucacauuuccuguaacugucauucaagaggaacuggccaucucccuaaccaugucagcccccagcacacuaaugucucccccuggauagcacugggagggccugaggcauauaagagaauaaagaaaugugacaagcagaagaggcauuggaugaaggaacaagguccauguaaggaggaauaagggguagggugccccucaauaacaaauacuguagguugcuaaacucucaucuaaaauacaaagacguauaacacuaaaauuucaccagucuaacucuuuccuuguaugugcuugagauguuuacuuacagcaugaaacauuauaaccaauuuauccuuaaaugcuuucagagauaccaggaagcauuuuaacaagucauucuguccauugagaugaguucugcaguuaaauauuuccccuaugcauucuuauucaacuuccccgcccccgaaaaaaguuauggcuaacaucuaugcuugcuuuuauuuuuuguuuuguuuugcuucuugacuucgaguagaugaauaauaacaagaugcuuuucccuccucuagaacauauccuccccugagaguuccccugcgcauaggcccgagucccugucacccgagguaguuaucacaccaucucaaucacacuuggaggcugagagugaguguucaugaauguguuccugaguguguggggagggcuggggaucugagucaguggggugaugggcuggagggcggccacucagucacaguaaguugaaugagucuuccugugugacugugacuacacaggacugucaauguagauggaggaaaaugaagguaggagcguguguguuuguguguguguguguuguguguguguuuggugggguugguuuuugccguuugggggaggggguggcuggaguucuauuaaagaauagaaucuagaagucaagaugcugauaugugguaggagccuuguuaaagaaaggcuaauaaaucaggaaaguugagucaaaaguuguaagagcuguuuuuugaguuggguggugacuuaugccuuguucuaggguuaaucuaacagcucuguaaaccagauguuuugaccuuugguugauagauugagcagcuucuucaggaagggaaagucauucugucuuucagcuuuccuacauuuucucugcagcuccuuacugggugcacaaggaaaccaagugagucccuggcuuucugucacaggccaccauucugcaaugguuaggauaugguugcuauacaaguguuaucucuuuaggauaucaguagagugguuuucucacaaacccuacugcuguggauaugucaaacucagauuuuagugcuagaguuucuauuauaagcuuucagauuuaguaacauuaacucugaaucuauuaauacaugggaccuuuuuucucuugaagagaaaguuagagucucucagaaauagucaacugaacuuuaacccuauccccuuccaauaaaaaauuagggcauaauucagugacagucuacuaaguucugaaucaguaguaguucacagguuaauaugaaacugaaaaagguuuuauuccacuaguauauuagagauuuucuugguguuuugacucuagcuuguuaggaaaguaaagcucucucuccucaguuguuaaagauucuaagauaacguaauuugaagacugauaugguaugguaucugguuuucugguaccauucuuugucgguuagcuguaguugaccuaguguuggaaguuuggagguuaugauaaccaaauaguaggugggguuuauuuuugguacauuucagcauuucagaaucugcagugaugagcauuaguggucuugugguauguugacguacauuagaggauaaagaagaauugaguggccagaaaguuguaugagaaacacagcuucuuuaacagugaaagugagugaagaacugguugguugaugucuuuaaugccauccuccuuuacugaaccaguaacuuaaguacuugccuuuccgucuaccuucuccuuccuccaccuuuuucccuuccccccaccuuccaucaauauuaauuuagaaauugauaaccccggaagccaguuaucuuaagacaccagucucaucuuuguuuugugcauggggcuaagguaaauuccuaauuauaccacuugucccuuaguguaguacaaggugacucagcaaccugaugaaaggcuaagcaggcaaaauagucacauuuagccaauuaccuaauucuaacuuucccaguauuucccauccagaaagacuugaaagcaauuuuggaaaggccaggauucuuuaguacucuggcccauguacacuguugcuacgugggacuuuuacagaauauaauggcuuuaucugcucuacuuccgucccucuuaucuuucccuguucaccugugucccucuccccuccuuucugcccuuugacuuuuuccuuucuccccuaccccaugucuccguugauuuuuauucuuucagcuuugucaccgaaaagaccuggauuuggcaaaaguaggauaccuugacuccaacacuaacagcugugcugauagaccuucccuacucaacucaggucauucugaccuggcuccucaucccucccucggacccacuucugagacugguuucccaagcagaaguggagauggacaucagacccucgugagaaacucagaccaggcauuucggacagaguucaacuugauguaugccuacuccccuuugaaugcuaugccucgagcagauggacuguaucgaggaucuccucuagugggggauaggaagccuuuacauuuggaugggggauauuguuccccugcagaaggauuuuccagcagauaugaacauggcuuaaugaaagaccucucucguggauccuugucaccugguggugaaagggccugugaaggagucccaucugccccccagaacccaccacagaggaaaaaaguaaguguuucauguuauaucggcgaacuuuucaagaauguuaaccaaguaguuuaguagauauucauaaguuucugcuauguguuccgcacuacucucagacaagugagacauagucucugccaaauccagugaaagacaggcuguuuuaguacaacuuggugaauguuguaaauauucagcaaauguaaaugccuguaugugccauauacuugcuaggcaauugagagguuagaacagugaaaaagaaauuuuaccuauuauuuagugugucccaaguucgaggcacuguauuaagcucuuuaaauguguuuuauccucacaguaagccuauaagauaggcaauuuucuauuuugcacaugaggaaacuaaggcaaguugaguaacuuucccguggucacacagcuaguaaauggaaggaccaggauacuacccaguuugagagagaaggcuggagugagaggcagcagguuacugauuuaacugaaucucaaacaauaaguaggagucagccaaccaacaauugagggugagguauguuacaguagagggaguagaacagguaauuagguggcacuccauuggccaggcagcaggcaugcaguauggugcaaacaguuggauguuguuguaucagguggaaggccgggggagccaggaggaaagugcagagagugcugggcugggccaggccauagagagcuugcuaauggguugggacuccacuuccaaguaaugccugaucaagaagucacaaagccaaaaauaugcuuuuguauaagugguucucaacuagggguguuugagaaugaguaggaguguuuugaauugucccagugacuugcauuuauugagcagggccagggaugcugaauguccuguauaggggacagucccauguaauggccaaacaucuguaguauccucauugaaaugaaaccuagugguuuuuuuauauuuucauuauaaugauauuaccagaauuuauuaacuucuuuccaaaauuauuucuagaaaaugcauaugcaaaacugucuauauuuuuguuccauuuggacagaaaaaugagaacccuaaggggauagaaggaggaggaaacauuggcagauaauuuggauuaagauaauaauugauuucgaagauuguugcgugaacagcauugacuaccagaaacaaacaugaaaacaaucuuuggauuucugguuuuauaauauuuacuaugugcaaaagucauagaaauuaugauauuuuauuucagaaacacuucugaaauuuauugggcacauuuaagcauaaauuuaagcauaugccaaauucugugcuggauguuaaagauaaaaagccagauaaacuuggccuuugccuuccuagaacuuauaguuuagucagggagcaaucaaggcaugguaauagguucuacggccuguguaagcaaugugccagaacaacaaagagaagguguacuaggcagggcacggauuauggugggcagggugggaugggaggucugcugucaggaaagaaugagcaagcauuagggagaugaaggggaaguuagggagaaguuaccaaguuguuuucuagagcuagcuugcuaaaauuauaaacuggaaauaauaauuuccucucuuuuuacauuaauuacaucuauguguaagacagaaacaguaauaaauuccuauuuauaucuugaaaauuugaacauauuuaaguauccuggagcauuggguuuuucuucuguuuuguuuuguuuuuccuucucucucucccucucucucuccaccuaccucuccccaccucccucuccuccaucuccuucuccucucccugcuucuuucucucaaacagcuaacucuagggguucccaaggaguacagaacagccaucagucaccugggaggcuuuuuaaacuauacaagcuuccaauucucccuucucuagguacuuccauuguugcaaauaacugugauagcaugcuucuguuacuguguaaugguaaccucacaaguuuuucugaaggcagaaaaaaagaugguggucuaauuggcaaacauucuuuagagacuugccuccuaguuuauuaucuuccucuuaccaauuuccagcugccuuaaauauguagcugugcucagaucucuuucauacuccccaaaaaaaguuaucaggguuggugucugcuuuguuugcguggcuuggcuagugguuuacuaagguaccaucuuuccuucuuucccuguugcuggugauccacuaaugauauccagauagaguaccguuuuuuguuuguuuguuuuuuccuuucuagguaucccugcuggaguaccgaaaacggaaacaagaagcuaaggaaaauucugcuggugggggaggugacucugcacagagcaaaagcaagucugcaggagcugggcaaggcagcaguaacuccguuuccgacacuggugcccauggugugcagggauccucagcccgaacuccaucuuccccucacaaaaaauucuccccaucucauuccucuaugucccauuuggaggcgguaagcccaucagauuccagaggcacuucuucaucucacugcagaccucaagagaauaucagcaguaggugguaaguuuauauuugauguuuuauaguuaaauugggggugggggggaguauauaucuaagaucauucccaguuuuaccuaaaaucuaugggaacacuugaugggaacaucugagacagccagccaacaguaccaucuguccuguucagcugauuuaauaaugucagcugcaaccccccagcuuugcagaauuaagaauuaccaacaugccuguggagcagugcuuuggaugacauguaguuauggaugcagaugagcucuuucauuuggugggcacuaacacugccuuuccuauuucucauuucacaugaaaggugagucaagaauccagccaaguuccacaugaauuaacaacagaugucucucuuccacacagcuagcauauacagagcaaaaagacauucugaaaggauuugucugguuuaggggagaccacaaauuuaaaaaugaauaauacugguggcaaauacugaggaucaaaugugugaaauagagaaugaagcacaggaguucagggaucuugaacugaaaaaaauaagucugggaaagaacaguccuggcucaaauguuucauguucauuaaucuaugaaaccuuuauuaaaccaguacuguguaucaggcacaugauuuccuaaaggagaaauuuuaacauuuuaaauggggguuaagggaaguuaacaucuuuaacccacuuuuuccuugauuucuuuuucuuuaaaagugguuguuguugauguuucucuuuugugccugacauaguuggaggcagaggaaauacguuguuuuaaauugguucugaagaaaguaauguuuaagaggauguuuuaagaaaauacacugugcacugguuagggcuucauuuguuuugguuaaguccuguggcuugaacuugcacccuguugccuuuacaggaugguucccacaucaguagaacgacuccgagaaggagggagcauccccaagguccuccgaagcagcgugaggguggcccaaaagggagagcccucucccacaugggagaguaacaucacagagaaagacucaggugagcccauggccuucugcugccaccacauucagggacacaugagccgaguccuguacaguucaugccuagugcugaguugaggugagucaguuucugaugcaguugggcuccaccgcaugcuagguuccagcccacuuaugcucauuugggcuaccacauuuguaagaucuagcauugcuugcucucugucugcucuuuuuuccccaaggaauaccuuucuguaacucucaucucuccaaaguccuggaaaucuaccucgaugaaggaugaagagaaagaagacgggaaucacaucaggcauuuagaacauagcccauaauuaaccacucauuuugcccuucuggcaugcugcacucacccaauuugucacaaagagagcaguacggguuggugauggcacuggugauuuaaaugaaaaauggcucuuucuuacuuauucuaagaagccaaguugauuuuuuuuuauauauguuaccuuccagacccugcagauggagaaggcccagagacauuaagcucagcacucucuaaaggagcaacaguuuacagcccuuccagauacagcuaccaggugagaugagaaauugcuggucucuagccauaggaguguguucugggucccaaauuguccuggucauccuuugccauugagaugcugucuuugcauauaguuucagcagccuuggaaauaagucaucaucugcuuguccucagguaauaaauuaugccagaagaugaauacggugaucaaagacagacauuuuacugccuuugguuuccuaaaaagaauacaugguuaaaagaugaagaaaaaagaauguaggguauuauaaauguucaccagccauuuaagggacuuguucgcguccuuauucguuuccucccaacuuugucuagcuccugcagugugauaguccucggacagaaucacaaagccuccuucagcagaguuccucccccuucagaggacauccuacacagucuccaggauacaguuaucgaacuacugcacugagaccuggaaacccccccucucacgguucuucagaaucaucccucucuuccacguccuauuccagccccgcccacccuguguccacagacucguuggccccauuuacggggacaccaggguauuuuagcagccagccacauucuggaaacagcacuggcagcaaucuuccaaggaggagcugcccuucuagugcugcuagcccuacccugcagggacccucagacucgccaaccucagauucaguuucucaguccagcacaggaacucugaguuccaccuccuuuccucagaacucuaggucgucauugccaucagacuuacggacuaucagucugcccagugcugggcagucagcugucuaccaggccuccaggguaucugcgguuuccaauucacagcacuacccacaccgugggagugggggugugcaccaguaccgacuccagccacugcaagggucaggagucaagacucagacgggacuuuccuagggcuucuggauuugggcaaacagaacugaaugagcccauagcugcuuccuuccagcugccucuggaaccuaggccgagcauauugcugaggaacgggggguacaaggugccagaggauugggucugguggacaagaaacaagacuuguggucacaauuggccucuggccuuggagaaagcuguaaaucuugucugaagcagagacuauaaagaaguuucucccugcugucaaggguacauuguugacaagcaaaugguguuucgguuaguaacgguucuaagugcaaugaguuguguugaagccuccgucucccauccuugccuguagcccguagucacuugugcagugaggacaucuuuuuaaauuuaaaaaaaaaaaaaaaaaaaguuuucaaaggaaaaaaaguuaaaagagccaaucucaaagccccaagccaucugaguacuguuaggguuuuaugcacuuaagaaaaaagguagguauguaaauguucauccuaagacaaccauuccaaaagcagguaucuggccaauguguguccaccaagaauacuguuuaucuuugucuuaagaucaccaagaaauaggcaaggauaguaaagcuuggaaccugcaccaacuggagggugccuggcucuuugaagaaaagcucauggucagcucuugauuauucgggagcagauuauuugaguagauugucugagccuccaacuguuaccauccuacucccccuucccaagcuauuucacagcucaguaacccaugaaguaaguagacaagaaaaggaggaaugagacaugauauaggccaauugcauugcuacuuaccagcuuuuggcaauaaauuucauuaggaaggauaccgagugguuugggaaugcuucgaauuuuauuuuuucuacucccaauuaaucaggaguugaugaucccaugagcaggaccgccuccaugauuggggagcaugcacuugugacugcaggguaagagugggaagauagguuuguggaguggcaccgacaggacugugauugugugugggccugccccacauuucucugggggaugcuuaugugagagugggcccagugaaagaguuaccaagccacccacaccccuaacacuguucuggaugagagaugagagcagaccggcuucuccccaucagugcauugugccuguuguacaccccuggaggagcccuggagccagcccaggugggguacacaaucuuuuuaaauuccauaugguugccagcuuauuucuuucacuuguuuacuguaauaucuggcguguuuuuauuuaucuaauuuuguauucaguuauaaccaugguagggguagugaauauaugacagguguaaucccuggugcugcaguggaccuucuuuucuuuuggacaagauaauacugugaguuucccuccuuccuucccucuaauuuguuuuccuuuuuuccccagccucuugcauccccuucuuuucuacccuguccuacaacuaucauaugcacagucuucucucuuugugugugacuguuacaaaauuucacuuuucaaaaucgaaaucagguguuugcucaaaugaggggagauuuuuuuuuuuuuuuuuuuuuuaaaugcugagaccucagcagaguacuuuucuuuuuguuguuucccccacaaacccaucagucugggagagcauugggaguggaaaucauguugccugggaugcugguuucuuuguauauuauauaaaacguauguaaaugucucuccauuugggcugggguuugcauucuccccuuggcuauuuaaccaaggggagaggccagcgggcaggcggcccucacccugccuggcacgugcagagaccccagccacucugugugggcagggugcugucaagaccagaccucuuggggggguaggggcggggggguggggggaacucuuggaagggaagaaguaucacuucuuucucaaguggaguguuuacaccuugcuguaacauuugaacuuucacaagagauguaauaauuuugauaauaaaauucuuaaccauaauaaucauaaaguugag

SEQ ID NO: 14837 - RNA, 132224 nt, Homo sapiens
auuuaagaagaaauucagccuauauguaacaacaaaauuuugaauaaucaaguucagaaauuggauuuuuaaaaacuuauuagcuacuuuaacccuuuugaaauauucccaaaaaguguuuucucuuccugaguuaaauuuauucauuuauugaccuauuaaagauuuuuuuagugcuucagagcuauucuguauaucuguucauuuucguuauuuaguaguauauagaaguaauagauugggcugaauagauuuauuucaggauauaucuuagauauuuguguuuuuucaugaaucccaguuuaaggguuauugcuuucaaaaggaagaaauuugguuagucaugacuuuuggcuaguugaaguuuagagaagugcuuuauacaggaucuuuuauuuagugagaaaaaaauaacuuuuuauaauuuuauaauacugugugaaaaaccugauaccaaaacuucugaaaaagaaaccaggccuaggagaugaggauucuagggaagauuauuaaauugaggauauuuuuaaguuagauucuaaauuaguaaaucguggcuaauaagaugaaaauaaucugauccuuuaguaagaucugaaguaauauuguugcccugcaaaaaagugguuguuaucagcauaccuuauaugucagccuaagcaagauuagauuuucucuuuucucugauagaugccaauauuuaacauugacuuuuaucuacuuucaaaaauaucuaugaaauauacuuucugucucugaauuagaguguauguauauuuguguuuacuugaaauguuauagcuggaugauagauuucagagcaguuuuuaugcuuagggaagccacugccucccaaaaagguuuucuuaugagaaugaggaaaauaaguauaaauuuucauauuuauguuauuacuauugaugugcuuggauaauuguauuuauaaaaguaaaaaauguucaguauuuuaucugaaauuuaauaauggauauuguacagccuaaggaauuaaaagaaaaaggacccuuugagaaaauggcuuguucuuauguaucuuaauauauacuguguucacuuuauguuuugucagacacugaaauugaggaagagagauuuuggcguucuguugguuuauggagagaguugaucagagauugcuccuuggcugaguugcugucugcauaggcuguuaacaauuguuucucuggcagcagaucuuguucaucaggauugcaucauuucugggagaauggccaagguccacagccucaauacaaagacugucugaagcauaugaggccuguucucuuucugaagcggcacuccucuuccugccaguccucuucacaggauuacugaagcagacuuguucugaauuucuuucguuggauugguuguuuauuggacuuuugucugccagcugcuuccgccucaccugucugaugcaauuucuucuucugaaaucuguuggaauuguucauaaaacacuuuuuguuugucuucucugugagugaccagggagaucauacaggucuugugcuuucagcaagucauauagagaagagacugucagaaugaugauacagagacuguuggccauuucugaaaccaauuaaaaagaugggguaauuaagaaacauuucuggcauguucuauuuaacauccuuuucccuagaaacuguauguaaauggcaccuccuaaagagaguacucgguacuacuggaagauacaggcugugucuguuucugaauccaagaacuuacuaguguuccuguggauucugauggauuguucuggaaauaguuaaauuaauaauaaauugaaacugugaugcauucauuuacccccuacuguacacucacaucuauuucgcuguuuuccuccuuuccuuuuuuucuuucuuauuugcuauugcuucuuccuugauuuacuuuauuucuuccuuccuuuuacuguuacuuugauacuuuuauuucucuaauucuggguguacuauuuuaaaucguuucuaaaaaauaguuuauuuuccaguuuuuuaaaauuagaaaucauaaaacaucaacauaaaugaaaugcaugcguucuaaugcuugguaacuggaauccuaugaauagcucuuuucauguuuaugauauguuaaucuuuaagguguuaauaacucuggcuagcguuaaauuugacuuuuaggaaaaaacaccagagacuuaaaggauacugaucauuuucccuuccuuuuuggaagguagaaaauuaauuuaagcgccauuuuuuaagcauguuuccauuugaccgcaaauagaacugacuccuuuuuaucacucuuuuuuauaguaggacaagaaacuagaugguguggaaugaagggaaagaaaggaguaauaaauauggacuuguaauuuaaugggugaugauggccccuugucuggcuggacaguugucggacaucggguuaaagaaagaacucugaauuugagaaguguucagugaagaagggaagcaccuuuuaggagagagaaaaagaagggaucccuuggaaaaugagauaauucuaauuugaaggaagaggaaaaauuagccagugacauaaguauuuaccauuuaagucaaauaauuuccuucucuaccaucucguuucuggcuuuauggaaaaauaaaaaauuaaagggcaaaaaauucagugccggauggacguagggugguaaacgagauaguauagauguaggaugauaaacaagacaguauacagaaacauaauauagcuguagaauuccauucuguguguucaucaauguuauuucuuucuguacuaauuuuugucucaacuuuuucuaggucuucagaacuacuagcagauaauuuggggggacuucauauucagaagucuauauaaaggugacugacccaaguaaauccuuuuaauuucuguuuuauuuuuugcauuuuaaugacugcuggaaucauguuguaguaaauugugauuauaauuuacuuagcagauauuucuggaacuucucuacgugucaguuauuguuuuggccauugaaacuacagcaguggauaaaaaucccuguucucauagaguuuauauucugguaggaaaaaacaaacaaauuauaauaagaaaauacugcauuuagaugaucuguuaaauguuccucgguuaacauuuuaauagcuacauuuuacagaguuacuuagggaaggaacuauucuuaggguaauauuugagaaauuugggauuauuaacagaauuugaauuaagaagccucaucauuauuaaagcauuaguuagaaugagauggucaagcuaaccuauuaugguugcuuucaucagaagaaugaaacagucauguuaaacuagacacaaggaaaauggaauaauuuuuaugaaauagaaauuuauaguuaccgacaauguuucuuuuuuuuuuuuuuuuuuuuuuugagacagaguaucauucuuguuguccauguugaagugcaaugguacagucuugacucacugcaaccuccggcucccggguucaagcgauucucuugccucagccucccaaguagcugggauuacaggcguccgccaucgugcccggcuaauuuuuuuguauuuuuaguagagacaggguuucaccguguuagccaggcuggucuuaaacuccugaccucaggugauccgcccaccucagccucccaaaguguuggaauuacaagcgugagccacugcaccgggcugacuuaauguuucuuaaggauucaucaacuauccaaaauagcuggguugguguuucauuagugaauguagcaaucauuuauucacucauuaagauguuaucugaaguaacuuuuccaucuuuuccuuuuaguauaucuuuuaaaaauugcucuaggaaaaauaucaacuaucaucuuggguuuauaacuugucuuuuaucuagaaacuguacuuuuuuuuuuuuuuuuuuuggagaaagaguuucacuuuugcucaggcuggagugcaguggcccugucucagcucacugcagucucugcuucccagauucaaacgauucucgugccucagccucccaaguagcugggaucacaggcauaugccaacaugcccagcuaauuuuuguauuuuuaguagagauaggguuucaccgugaaaccaugcauuuuuuaaauggguguacagucguaauggcuacaacaaaggguuuuuaaugauauuaaguacgguuuuugguuuaagucuuuuacugaaaauauaaaacaauucagauucccuuugcugaucaggggagguacggugauaaucagacuuucauaugauuaucuggucagacagcuuuggggcuuuucuuuuaaucugaauuauacaguaagacuaauagaaagaguagugaccaacagcccccaguauuuaacugucuuuuggguuuacuugaugaguguucuuguuuuaucauuuacagauuuuacuucaauuucccaaaggcuuagaagauguacugccaaggucucuguuuggauauacuguuagggaaaggaaacauacauguguaagacuggccuaaaggcaaaaaaguucaucagucccuuuuuuuuuuuuuuuuuuuuuuuuuuuuuuuuuuuuuuuggcaacagggacucacuuuguugcccaggcugagugcaguggcaugaucucagcucacugcaaccuccaccucccaggcucaagcaauccucccaccucagccucuugaguuagcugggacuacaggugcaugccaccacaccagauuuauuuuuuuuuuuugagauggagucucacucugucgcccaagcuggagugcaguggcgugaucucggcucacugcaaccuccaccuccuggguucaagagauucuccugccucagccuccugaguagcugggauuaccagcgugugccacuacagcuaauuuuuguguuuuuaguagagaagggguuucaccacauuggccaggcuggucucgaauuccugaccucaagugauccacccaccuuggccucccaaaaugcugggauuacaggugugagccaccgcgccuggcgcacaccagguaaauuuuguauuuuuaguagagacaggaucucgccauguuucccaggcuggucucgaacucccaagcucaagcaauccaccugccucagccucccaaagugcugggaugacaggaaugagccacuucaucuggcccagucauuucccagcccagcuauaugucaccuccaauuggguguaggaacaggcguauugucauacccagaggucucacuucaucaucuaggcuggagugcagugcaugauuauggcucaccucagccucuaccuccugugcucaggugauccucccaccucagcucccaaguagcugggaccacaggcacacaucaccauggcuggcugauauuuuuuuacuauuuuuguagaguuggggucucacuauguugucucagcuggucucaaauuccuggacucaagugauccuuccaccuuggccuccuaaaguguugguauuacaguugugaaccacugcacccagcccacaauuuuuuuuauuugcauuaauaucaaaguaagauuggagcaucucagaccaucuaccauuuacaauuuacauuaaccggccaggcacgguggcucacgccuauaguccuagcacuuugagaggcugaggugugaguggaucaccggaggucaggaguucaagaccgccuggccaacauagugaaacuucaucucuacuaaaaguacaaaaauuagccagacaugguggcaggcgccuguaauccuaacuacuugggaagcugaggcaggagaaucucuugaagccaggaggcggagguuguagugagccaagauugcgccauuacacuucagucugggcaacaaaagugaaacugucucaaaaaauaaaaauaaaauuuacauuaacccccuggguugacucagucgguaucauguacuuuucauuccuuuaguuuuuuuaguauuaauaauuguucuaaugucuuauuaugaaucaguguaucagucaugacucucuuuguagucuuuuuugcaaaaguccuuguuaacaugggucuuugacauucacauugacuuuauucccccccaaauaaaaugcuuuuuguuucauccuuucaauguuuuuuacacuacuguaaaacuacuaauguaaagucacacaaagaacacuuguuucccucugcaccauaccuccaaaucucuuaaucuauuuuugcauuuuuuuauacuucaguaauuucugagucuuucuguucccagcuuucacugguuuauggucaccaugucaagcuauccucaccgcuuuuucauacacaguuguuuagucuuuaucaugaaacuguacucuucgugauuucggggguuuuuuuguuguuuuuaaaaaguagucaacuuuuuuagagcaguuuuagguucacaggaaaauucaucaggagauacagagauuucccaugcacccucugcacccacgcaugcauagccuccuccugguuuauauuuuuguucauaucuagcagcguauuauuaccccacaaauaaaguugcuaagaugauugcaucuucucccaaaauuauaguuaagaugauuuaaaagaaggaagagaguguucaaugacaaaagaaggcacuaagaaacagcuguuuccaaucaaguauaaacaacaaauugaucucuuuuaauuuggaagaaauaacauuauugacugcuugugaaacugcauuuauuuguggccuaggaaaaaaacuuaaaugaagaucuugaauuuuuaaagaguuuagguaaacugggauauuuuuaauaaccauccuuuaucuuaaaacuuguuugcuauauccuaggcugccagaaaauuuuguuugggcaguuuuagaauggggagaauguguugguuagugagauaggcagacucuuccuuucccuucaacugaaaagaaaaacaaaaguaaacauaacuuuuugcccccuacuuugugaaacauuaaugaaaugcauaguaaacaugggacacuguggcuguauuuauuuuauaauuaucccuuaaaagccuuauucaagaaugcagaaaaauauucaguaacauuuaagauaaacuugaagaacuaucugauaacuagguauuuauuuuacuagauauuuuccuuuucuguuacaggauuccucauguccauaacauguuggaugaggcucugcagcucacccccacucucagaguggucagucuccauuaauuggaccccgugauuuccaaucucugcuguguuggacgucaugagcauugcaaucccucugggagucaccacaucagauacauccuacucagauauggcugcuggaucagaguaagugcuacuuucuagguaguagguacauuaucagucuguguggagacagccuucuuauggauagcuaauaggauaauauguaguauuuucuuaaccagauccuauuccacuguaauuaacauuagaccuuucccuuuacccccauugaaggugguggaaaaaaggaauuagaaggggaaggaagaguuuucagagggguauuucugggcaaauaauuaauagaaccaaaguugcaaaguaggaauucauuuucauuuguuuuaauggguggagaaaauuggaauaaaguagguguuacuaccugcuucuguagaguuaaugauucugauggagggagauaagaagguguucuuuccaacugauuuuccuugaaguccucuuccuauguacuucccauuguucuagaguaaaggggccgaaacuauaugggcagguugccuagaccuucugacaucugggguagaaaacauggagaacagcgucaucuguuuuuuuauaauauucguugccuagaaagaggaccuucaaaaucagugguaccaaacuuuuuuuucagcuaagagcagcuuuaggaauucagaguuuguccaaaggcccaaucccuaaaauuauacucucaauucuugaagaauguaaaugccaaaugacaaugaagguaggccuucauuauacaacuuuauauauauuauucacaguuuuaaaauuuuuagucuuuuguaucccuucucuuuuaaguuguccgagauucccccugcucacagauucccccucuuguccuuuuaccucccuuguacccaaucuuccuugcuuacagaaaggaaguggaagcccccuaccuuucaagacgaaguggcacuacaccaggaugugaaaguccagcgaaagagacccaaggggccuagggggcagcacacccccagaagccaagucuauuccaggcaguaccagggauuagggucugggcuggaaaaauccugguguuuugaauauguucagguccaguucagacucuugaucccacagccacuucuugagugagguggguguugcucuaauuccccuguuucucuugccauuuucacagucccuggggauucuucccccuucagcaaagcaaagcaacuguaccagauuucuggguugaaugacaucccugauuaauaagugguuuucuuccuuaaaacagaauauuauuaaagagcauguauauuucuucauaaagccaccuaauauaacuuaccuguuuacugaguuccuuaaagaggaagacuuaaagcuacccugagaaauaguauauaauauucugggguagucuaaaaugaaaagcaguguuugggcuuauucccauauaaaaaggagaaaggaggguuggggguggggaaggguugauuuuguuucuucuagagcuuuuuucuucuuuuguuuuuguuuguuuuguuuuguuugcaugcaaaagguauuuaguuaugucaguaacugagacuuacuuaaccauuuuacaacucuuuccccaaauaaaguacuuaaaacucucccugcauuaguagguagccaguuuguauuguguuuauagguuuuuauaaagucagcuacuaaccugguacuauguagauugucuaacuguauagauagauagcauuaacauuugugagaaauuucaacaaagagguuaaaccaauacguuuggaauugcuggauaaaagacccagagcaguuaaucuuacaauugguguuuuccccaaaguauagacaugacugcccguaaauacugcuggggagucuaggacuaauuccagaaauaaaaauacuucuggucuacaaaugugacugcgcugucucuguuaacaccaacauauccuaggauuuccugaaacauuuucauucaugaucuccagacagauuugugauacuguggucauaacuagcuacauaguuaugcauuucugcaaagggaaagaaugucaguaacuagcuacauaccauucuguuaaauuauuaaugauauuuauuaauguuucaucaugccuauuucgcuguucugggcacuuuaagauuaaaccugguauuaagugcagcauacucaacuagauguagacuucacuucauagaauuuuaaaucugauggcaacuauaugcaauacgcauuuauuuuuguguguguuuguaggaaaauuuguagauguaacaagcaaaacaaagauuuuucugaauuuccaacucuaccauaacagaauuucaggcauuuuccaagaaauggcaugauagcagcuggguugcauguuguacuuagaacacuguugauggaguauaucuguugugagccugguuucuguguauguguccaauucagugauaggagaagaaagccuguaauuacauuugcauaaagugguuggcugcuaaagagauguaauuccauuauuccaaacuuuuaauucauauuuuaaaauauaaaaacuaguauauauaucaaggaauauuuuaggaaaucuuguaguuaccuguaagugucuaacuguguauucaaucaguaaccaauauggaaauugcagaguuucuucaucagaagauaugaguuuaaauuuuauauuuggcaugcacagcaauauauuaaaugcugugcuuaacuagaaaguauugugcagugugauggccuuuuaaccuccacaauauacauuuuauuuuuauucccuagacuugcacaugaagugcauauguucauauuuacccguuuggagauggguaagauacaaccagcauagcuccaucuccauggccaucuuugauuucaugcaacuuuccuuuuuccugucccccucccaccaaaaaaaaauccauuccuaauaaacagcuaucauguuucacuccauguguucagugguacaaaaccuauauaaaauauguacagcucuuuggaauacuuguuuaucuaguaauguaccuaguaaauuaacaauguuguauaaauuuauuacuuucuuuuaacuguccaucauagaaacuaaauuauaccuucauuuuauuaaugcuugucugccuuugguuucauuuaggaaaccccaccuguuuccuaauacucagagaugauugccucucagugagccauguucagaucaucuuuuucucaagaauacugaccugcauucuugauguaccccucccccguucccaucuugcagacacuuuuaaguaauaaaaugcaugcaccucacuaacagagaauacuuuccucugucuaaaguucuucacuuagaaauuuccuuugcuguuauuaauaagauccuuucucacaguuuuggagcauauaacugggugaguuggauacauaucucagaauuuucuuugaucccucacuucucaauugacauugcaccacauugaacugcacacuuauuccugcuguacuauauauuguauaucuuuaagcaggaaaaaaugacuuguuauuucaagcgaacaauaugcauuauuugacucccugaaagacccauuaaucucuaaguuagaguuauaccaaucaucggaguuucuaauuugugaaucuguguucuaauuaauauaaauuacaaauuacuauucuauucugcaaagccauacaaacuuuauauuuuugaauuacccuucaguauucccuaaaaccuaaccagguaacaaucagaguugaaguucuuucuucccauaaaccugauuuuuauccuuugccaucaaagccuuuuuauuguaaaggcuuauauuaauuuucuaaguuugaauacauguauaauucuacaauaauacauugcgcuugaauaguuuauuuucuacucacaaaggguacaaaaagauacuaaaccaagcuucucacuaagccugguuaauaaaggucucaaauaauuuucuuuaaaggacugaaugucauucucauuucuguaguggaaagagcauagacuuuggagucagacagacuuuguuucaaaucuuagcugugucaguguguaaccuuggggaagucauguaaucucaccaccacaucuucccacucuguaaaaauggaguauauaccauguuuagugguugcugaaauuaaaugaauuaauauguauuuaaagcaccuaacaaauauugggcaguucacaaugguagccauuacuguuguuauuauuugucaguagacuaacauaacuuuacaguuuaguuuuuauuuugaaguucuaugguauuaucaugcagcugauaaauaauuuuguccuuaauaugcuugcaugucauugguggaugagaaauuauuacucuaauauuugaaagguguuggggguucaucaagaugagagguaugauaaauauaagaugccauuguuuuuaccuguacuuucuucaggguauccugucuugguagugaauggaagagggccuggucccuggggcagugcagaaggcacuuugaucaucucacucacugcaaaugucaugugagguuucauggaaguauuaagagauccaauuaagaagaauaguucugagucuaaaccagcccagaguggcuucucuaggggaaacuccccgcucagcugguacguuuguguuugucauuagggacaccuuguaucucaggugccugccuucagacaucugccuguacuggcuucauguuacacacaaauccacauuuaauaacacuccuacuguuauuuauaggcuuaguuauguuaauaagauuguuucaccgaguucuuucucuuauccuaguggcuagugguuguggaaagaggagggguuagaaugggaaaugaaguguuaguuuaagggaagauuagguguuaugcuaucaugcauugcuuuucgccuuugugcagcccugaaucuguggaggcuaguccagcaguuaaugagaagagcguguauuccacucauaauuaugggaccacucagaggcaugggugucgaggacugccuuaugcugugaguaugcauuuguuucucuccagaacagugaucuuccuggaguguaauccauucuuauacauugugacuuucuugaaauguuuauaugcagcaugacgaaguugccccuuuugcacuucccugacuccagcggacgucuagcccugcaucauuguucuuguuuuuaugucccaguugaccuuggcauuuuguuuuaucacuuuccugguugaagccaaaaaacaaaggguacuacuuucuucuuucuuuccauauguaccauacuuuaggggagagaggggccaguguuuggacacuguugauuuaaaaaaucuuauuuucaggaucauaauuacggagccccuccuccuccgacaccuccugcuucucccccuguccagacgaucaucccucguucugaccugaauggccugccgucgccuguagaggaacgcuguggagacagcccgaacucugaaggagaaacuguaccuaccugguguccuuguggucuuucucaggauggcuuccuucucaacugugacaagugcagguaagauccuguuccaucuaaauuuaagucuggguugcugggauuaggguuucuuacaaguagggaaaagcucaaaguauucuuucuuguguuuguuaauguagaugauuccuuagugcuccuuggcucgaauucucugcacuaggugagaauugcugacaacaaggaaugagagauugauguuaaagcuauugaauuugauaugaaauuuaauguccuggaaacauuugguaggugggagggaggggguagcauaugcagagacacuucgcccaugugugcuaugaugugaugcaugcuguuggaaggacuacuuuaaguuuauuuucccucuuuaggggaaugagcagggggaagguuauuagacuucaucggcggaagcaggacaacauaucaggugagcggaagauggguuagguccacaauuugacauaaaaauauucugugaucugaauguucauuuuaagaaccccucuuggccaggcgcaguggcuuacgccuguaaucucaccacuuagggaggccaaagcgggcggaucaccugaggucgggaguuugagaccagccugaccaacauggagaaaccccaucucuacugaaaauccaaaauagccaggugugguggcgcaugccuguaaucccagcuacuugggaggcugaggcaggagaaucgcuugaacccgggaggcggaaguugccaugagcugagauugcgccagugcacuccagccugggcaacaagagcaaaacucccucucaaaaaaaaaaaaaaaaaaaaaagaaccccucuuacaaguucccauggucccccagccagcucuuuucacagaaagagauagaaguccucucaagaccacuguauaguucucucauuguaaacgaaauguguugagaacaguuuaguccuguagcaaaguauuccuugugaacacaaaaaauauggauuccuguuuuaaaaauuagccagucucaaauuguuauagauugagucagcgaagcuuagggacugaauacaaggggagaaauaaauaccaugaggaacaggguuuauaugcuuaaugccaaugacauagaaucuuguuuucuuaaggaagaugaguauuuaacguugcuuuacagaugauaagaguuaauaguggaaguaauggcuuacugcauguggggcacaccuaaaagaauaagcuacuuuuaauguacuuuugaggcuauuaguaccugaacuaugaaaucaucauuuuucagguggggauagcagugcaacagaaagcugggaugaggagcuuucuccuuccacuguguuguauacagcaacacagcacacaccuacaagcaucaccuuaacuguuagaagaaccaaacccaagaagcggaaaaagaguccagaaaagggucgugcagcaccaaagacgaagaaaaucaagguaugcaggguaaaaauaucuuaaauagaaauugucugaaauagcuuaaauuuuggagcaagaaugcaccaaaauucuuuuaagaaguuugauccagguguuugaagggccacuuuuguucuacuugcaaaaaucagcuaaucuguguuauguacauguagaccaaccucucuucugccacaccauaucaucaccacuggcucaaaguuucuucuacuccaguccccaucccagguaugaaauuccagcccuaccuggcacaaucccguauguguugcagccucaagucuaggcuuccacuauccuuacaguaucuccccaccucucaaccccaaaguacagucugaaauucuuguccugguuacaugccucaugucuuuggguugauuguuuuuccuuguuucaaaaaaaauaaaaaucaggaaacaucucuuguauggucuagguuuccucagugucauggucacuuuccuguauucucagcuaaaaugucuacgggagaaacuucuucugguuuguguucuuucuuccccaucacagcaacuuuguugcuucuaggugacuuguucaucccuuguuaaggggauuggucuuuguuuccuucuuaguuucaaaacugguaaaucugcaacuuuaaaguuuuuuuuuauuuacuuuuucucuuaguaucagaggugcauauaggauuuaagagaugcaugcucuucccuguuaauuaccuagcuucacaguagaaaguauuaaaauuagucucagaguucauuggccuugagcuaccccuauucuugguaauaguuuggggaauuccauuguauuuuuuaccuagagaaagggggacagaauagaacacuaguuugugccuuaguuuuagucucagauagguauaacugucauucuugguaccaaguuuuguuuguucuacuuguuuuccuccuugggauaggcauuucgagagggaucccggaaguccuugcggaugaagguaagggguaaucuucgcugaugcuguguuuuacuucacugugaucuugcauuuuggucagcuucuuuccugacauugauggucugggaaucuuggacucugcuuuucauuaguuuguaguuguugccauucaguuuucauagagcuuuucuccaaaguagauuuucuuggccauuuucugaaauauuuucccuuucuguaaucagccuucauugauugguuuuucauucauugcuuuccuaggggguaagugacauuuuuccaaacaaaaugaggcuaguguguucugucacugugauugaacucaaccuuaggaguggaguuuuucugguaaugauacaggaucucuugugcaucuacccuagcacugugugggcuuuaauugcaggacgcuuguauuauugauaagaauuacuguuuucucuuagcauaucuguuugguggaaaaaacuuagguaaugcuagcauguuucuuaagauaucaaauaaaagaguuuaugaaguaugauuuuguaaagaacuuggagaauagagcaaguauguggaaugguuuaaaagaaguguaaggugcugguugauuaaaaauagcuugccaaaaggagauuugauuaugcugucugguauccuccuuuacguguguguguguguguguguguguguguauaaauauauauauaugaggaaaacaugccucucaaauuauuacugggggcuucaaagcauuuaaauagaauuaaauucaaguuuaugaguauucauauuccuaaaugauacaaaagcaggaucuuuccuauugagaguuauagggcauaaauauuaaaaucuuuaguaaggccaggcgcaguagcucacgccuguaauccuagcacuuuggaagaccaaggcaaguggaucaccugaggucaggaauucaagaccagccuggccaacauggugaaaccccaucucuacuaaaaauaccaaaauuagccaggcgugguggcaggcaccuguagucccagcugcuugggaggcugaggcaggagaaucgcuugaacccaggaggcagugguuguagugagccgagaucacgccacugcacuccagccugggcaacagagcaagacuccaucucaaaaaaaaaaaaaaauucaguaaggauaagcuuuuuaggauugcuuuaugugcagcaccagugugacugguguuagcaaagauuacagguagcacuuuaccuaaaguuugaaggccccacuuaguaucuaucuuuaaacagacuugcacauaccugugaaagaguugggagaggacucagagcuacagagcaucagaggccugggaugugucuuggaagacaaaucaaucaugccuuugcuggauccgucucuugcaaguggccaaguuugcuuuagcuuccccuuuauuuuugucucauuugcuuagagaggggccuuuuaaauagacuuuggaggcagauaauagcccuaauccuggcuacuaaaugcuuuucucuuaucaagcaacuaucauaacuuaucuccagaagcucgaaaccuuucaaaagcuauaaacuggcucuaccagaaaacugcacauaaaccccauauuuugcuuacaguuuugggagguugacagccucacagguguguuaaaauuuagaaaaaaaaauuacuagucauuuugauucuuuuaauucuaaauugaguuauaaauuuuaugcucagaauuacuaguuuaaaacuccuccagugauccaggugggagccauaagaauuagaaaaaauuaucauuuggauuuuuaaucccagugucaagagcagcuucccuacugaagacuuaauuguaaaucaggguuucucagucuugacacuguugacaguuuggaccagauaauucuuuguuguggaagggacuguucugugcuuucaagaugugaacaggaucccuggugucuacccacuagaugccgguaacacucauacacucaguugagauuaucaaaaaugucuucagauauuaccaaaugucaccugggugcaaaauuucccucaauugagaaccacuacucuaaacccaacugagguagagucucuaaugccuugaaggaugggacagcagaguaaacacacagugagauuagcgaacaauggcuaauacugugacagaggcuuccagaauacaguacacuuaucaaguguaaguuuaacaauugccacuuaaagcugggaauauuguuuggacacugccagucccccuagucuguaagcuccauuaagccuaagguuuugcacuauucuuuugcgcaacugcuacugaugucaagcaggcgauacucugauugucaguauguuggcuuuagguguuucuuuagaucccuuuguuuauuguucagucuuuuggacucuaguaagaaauguggagacaauaguguugauuuuuuuucuucuauacuccuguuccuugcagaaaggauaguagacaauaaucagucagcaacagugaugcaaaagugguaaaagaaaguguuaugauaagcaucaguguuuucugugccauucauagaaaguauauuuaauuuuauuguaccuguuugcaaguuuaauguggacauggauuuucaaguagcuuugguacuacagugucuuuuccuucuaaucaucacuagcaugacaucaucacugucaguguuuguuuuguuuucugauggcacuuaagucuugaacaccguggaggagaacauguauugggcuuaugcuuugucucuguagcucaggcacugucugccuaggaagcuguuccugaguuguaguaaucuuuucucaauacugucaccauagagggcaaugguuuuccuagaggaguauagcaaaguaccuccuagacauuuucuauauucucccuaccuacuccucuccccucacuucaccucuucagauuauuuagaaugugguaauuuaaauuguugaaaauagaguguuagaaagauauacucaaauaauaacuuuuuauauggguaguaagauugggauuggauuaaugagauugauugauuaagaucacaucuagguuuagaaugaacauguauuaugaaaauaauaagugauacaaaaacaugcauucuccuggagaauagucaaaaaaccaguuugggcuaacacuuaacacagauauucagugaguaugaaaaauuuaagcagugauaaauuugaggucucuacuguucauuuguaugaagauuuucuuaugaacuugaugucaguccuuugauuagaaaauugauuuuuaugacuuuaaaauggucauaaaaucacagugaugggaugaaacuaugauccagauuaauuucuuacuuuauaaauggagaaacugagcuuccccauuuaaagaaguuauucaaggucucaccucucauugguaacaaaagcaugauagaaaccagauccucugacucccaguccauuacucuuuuaugccacaucaauugccaagugauaaauuuucucuggaaccccagcuugucccacccccauucccaacccucuauuuaugcauggacuuuacuaaccucccugaauuuguuuucuacagaauucucccucugaagcacagaauuuagaugagaauacaacugagggcugggaaaaucggauaagacuauggacugaccaguaugaagaagcuuucacuaaucaguacagugcagauguacagaacgcgcuugaacaacaccuacauucuagcaaggaauuugugggcaaaccuacuauuuuagacacuauuaauaagacugaauuggccuguaauaacacaguuauugguucccaaaugcagguaagcaccaaaggguugaggacucucuaaguagcugaaauuuuaagaacccaggaagaggguaauggauuggaauuacuguuccuuccaaauguacaaggccauggaauaacagauuagccagguguugaucauauguaaccaaaaguagguuauauuaacuggaaacuaccuggauacauauuuuuaaacuaccuuuauuaauaaaaaaauagaugaauugaggcugugugcagugcaguggcucacuccuauaauacaacacuuuggcaagaagccaagguggaaggauugcuugaggccagcaguucaagaccagccuguacaacauagugagacccucucuuuacaaaaaaaaaaaauuaaaagccguugugaugauacacaccuguaagucccagcuacuggggaggcugagguggaaggaucacuugaaugaauuugagguuauaguaagcuaugauugcaccacugcacuccagccugaaugaaagagugagacccuggcucuauuuaaaaaacagagagagagaugacuuaguaugggaaauucuauauacccuagguaggaauuauguaauauuuauagaaaguuaagcauguucuuucucaucuuuauuuuagagauagagucacugaagucuuaaucauguauuuuuuuuuuuuuuuuaauauuuucuugccguuucuggggaggcaauuucacuagauguagcaugucucuuagaaaaauugagcuuucaucacauuuuaaaauuucucaucauugaucuaaauaacauguacagauaaaaccugaaaauauuagcauguuuuccuuaauuaugaaguaauuugagugucuacuaagguguucuugcuguuguuuaauguuauugcucugguuuuauucaguuacagcugggaagagucacucguguucaaaagcaccggaagauccugagggcugcaagagauuuggcuuuggacacucuuauaauagaguaucgugggaaagucauguuacgacagcaauuugaggucaaugggcauuucuucaaaaaguaagaacgucauucauugagcagugagggcuaagguggaccugguugaccaguguuguuguaaaaaucauucuguuugauaagacgcucuugggagaaaaaaaucacaacucagauaagcucacaccugucugcuauuuguagagaagugcaaguaaaucuucaaauuguucaauguauaaaauggugacaccuccuuuccaagccaagcauuccuugcuuugugcuuguucuuuaaucaaaagcagacaaacgugaugcuuucccaaguuuaggcguugcaaaagacugcugcugcuucucucagcauaugcuucauauuuggagucaugggguggccuucuuauuuguguugagaauuacaggaauuuuaauuguaucccuagaccauaccccuuugugcucuucuacucaaaauucaaugguguagagauguguguggaugcccguacuuucgguaaugaugcucgguucaucagaagaucauguacaccaaaugcagagguaagauaucuguagcaacuucccuuugacuggaaccaucaaaugacaagcuuacugaagaagcagugugaaaacuucacucagauaaaggucuguagauaauagucgugauauuucaucgugggaggugaaaaacaaaaguaauggugcuuuuauacgacaaaaugggcgcaaggaaagaguuuucuuuagagaaggcagaaauagaaaagagcaaguuagcauuugcuaaggagaaaaagcuagacuggauaagaaaaucaaguguaguuauauuaaagagauugccauacgguggaaguagauguuguuaggccuaacuaagcuauuugguugcaguuuuuuuagauuuuagugaguaauguuuuaugagaggaucuagacauuucuagaauucauuacucagagcaaccacaucaaauaaagcaagaaaauccacagagcuuuacuuacuggcuaaggaauuuuaauucucugguggagcuggaaacagcuauaagaugugaaagcggcugggcgcaguggcucaugccuguaaucccagcacuucggaaggcugaggugggcagauaacaaggucaggaguucgagaccagccuggccaacauggugaaaccccgucucuacuaaaaaaaaauagaaaacuuagccaggcauuguggcgugugccuguauucccagguacucaggaggcugagacaggagaauugcuugaacccgggaggcagagguugccgugagccgagaucacgccacuccacuccagccugagcgacagagcaagacuguaucucaaaaaaaagaugugaaaguagagauuuuacccugauuucuaacaucucaagguuucuccacauauuuaagaaaguauuauaaauuuucaagccagugcaguauaauaguuucagaugaaaugaagggguuaaauaacagauuaccauaacuccuuaaauaaauaauagauuaccauaacuccaaauggagagaaaguaugguuuuuuucucucuuacggaaaguucauggucuuuaugaaaaauccaaccagaagccuuuucacacaggugcgacacaugauugcagaugggaugauucaccugugcaucuaugcugugucugccaucaccaaggaugcugaggucaccauagcauuugauuaugaguauaguaacugguaagaccucagaaaccuuuccuaacaggaauauccaugucuuacauauuaagcuauucacucuauuuaaagucugcucuuguuucuugccuuuuccuuuguuuacuuaaucuuuucaugacuaaugaauuuucugccuagaaauuguaaaggaaaagacaggcaagauuuuuuuuagagauacggauaccuuguaugauacugcucacaaauuuccugacagaaguguuuucgcuuaugccuuuuuagcaagaauagcaaaauggauauauauguauguaugagacacuccuggaaauuacaauagcauccuguuguuaugcacagaguacuuaugucagggaccauauagaaugagaauuuaggccaggcgcaguggcucacaggccuguaaucucaacacuuuggaaggcugaggcgggcggaucacgaggucaggagaucgagaccauccuggccaaugaugaaacccugucucuacuaaaaacacaaaaauuagcugggcguggcggcacacgccuguagucccagccacuugagaggcugaggcaggagaaucacucgaaccugagaggcugaggcugcaguaagccaagaucacgccacugcacuccagccuggcaacagagggagacucugucuuaaaaaaaaagagagagaauuuaauauguuaccucuacuuuuaauuugucaauuauacccuuauaaagcuaggggugagauuuaaagauccacccuguccacagaaaccauguuaucuagcuguauaugacagugcagaaaaccauaaagggcaauucauagaugaauaugugggauuuuuuaaaguauaugcuuuuuguucuuuggucauuuggggcaaaauagagguuaugugguaaagugauguuuggcccagguauaaggaaaaaagauguucugcuuaauucaucaaggaaaauaaaaaagguuuuaagaagguuauaaaagguuuuaagaaguagggaauuaguagguaaaagugaggacaugguaaucgugggcacaagaugaguauggccacaucagacuuuaucauugauaaacugccugcuaaauagccaauaaaccacuggggggauugaauuuagggagggcuuucuuuuuuuuuucccacugaccauggaguagaauugggguuacacaaagaaagacagaauauugaaaguguuacgucaggcgcggugacugacgccuguaaucccagcacuuugggaggcuaaggcuggaggaucacuugagcccaggaguucaagaccagccuagacaacauggcaaaaccccgucucugccgaaaauaaaaaaauuagcugggcguguagucccagcuacucaggaggcugagguaggaggaucacuugagcccaggaaacagagauuaccgagagcugugaugcaccacugcacuccagccuagaugacagagcgagauuccgucuccaauaaaaagaaaaacaaaaguauuuauaggacucucuaaugucucuguuuaacuuauucagagacaauaucagaggaaguuacuguacugauauuuuaagagggugaauggauaauguaacugaauuucaaggguacugagacaggcauuuugguuguuucuuuggagcaguaauuauaaaguggacugugccugucacaagggaaaccggaauuguccuauacaaaaaaggaauccuaaugcuacagaacugccacuccuaccaccuccuccaagccuacccaccauuggagcagagacuagacguagaaaagcacgacggaaagagcuagagauggagcagcagaaugaggcuucagaggagaauaaugaccagcaaucacaagaaguuccagaaaaaguaacuguauccagugaucaugagguaaucgccccuggucaaaugaugaugcuauggcaucaauccuccaaaggaagaggaacccggguugccgcaugguuuaaguaggggagcuauaguaacacuuagugcccuuuauaucaauguggguuuauuguguucauacauuucuuucuguuuuacaaagucaaaaacauccuuugcugguuuugcaccagagaauagggguuaguuaucaucuguguuuaccauguggccucacaugaguuaacaguuuaaagcacuagagauuguuauagagaguuuuaagcuaccagaauaaaacagauugauuuuuucucagagcuugaguacagcugaauauugccucuaucuuaaaggaaguagacaauccagaagaaaaaccagaagaagagaaagaagagguuauagaugaccaggagaaccuagcucauagcaggagggugaguacugucugacauuacuuugcuccuucucauuccugcuaccuccaucaugugaaccucuucuguucucuugacuuuguaucaucucauugauuugaccugaagguuauaauuugggcuuuuuccguaauaaagauuuuauuauaauuuuuuuauuuauuuuucucuauacacacaguaguuuuguagugauuauuaucuagugaugguuugaagagguuguuuuuuuuuuuuuuuuuuuuuuuacuaacaaucugguuuccgcugggcgcgguggcucacgccuguaaucccagcacuuugggagggcgaggugggcggaucacgaggucaggagaucgagaccauccucgcuaacacggugaaaccuugucucuacuaaaaauacaaaaaauuagccgggcgcgguggcgggugccuguagucccagcuacucgggaggcuaaggcaggagaauggcaugaaccugggaggcagagcuugcagugaguggagauagcgccacugcacuccggccugggcaaaagagcgagacuccaucucaaaaaaaaaaaaaaaaaaaaaaucugguuuccgaaaaacuggcuggucagaaucaaaauguauuauaguugguuugcucugaauuaggaauuuucuagguuuuugugaguucugaaguuuuuuuaaacccuuuuagucauaugaacuaaaauuuucuacuuuuaugcugaaaccaauccuguguguuuaugacccugauuugaugacuuuuuuuuuuuucuuuuugagaccgacucuugcucugucaccaggcuggagugcaguggcgcaaucucaacucaccacaaucucugccucccggguucaagcaauuccccuuccuuagccucccaaguagcuggcauuacaagcaugcgccaccaugccuggguaauuuuuuguauuuuaguagagacggaguuucaccauguuggccacgacggucucaaucucccgaccucaugaucuucccaccucagccucccaaaguacugggauuacaggcgugagccacugcacccauccuguuuuucuuucauauuaaaguuucaaaauaacugacccuuuuugaaaaguuuauguuugaccuugccuuuauuuacaacuauuccccacauuuaaaaugaaauauuuuauuuuuaaucuucuguuuuccaaguuauaugugucaucuuacugguaguuaaaugaauuucuguaaauuuccauuaaaaauacuuuuauaaaagcuauccacucguccucauuugaagcuuccuucuacaccaguacuaucucuuucuagaccagggaagauagaaagguagaagccaucaugcaugcuuuugaaaacuuagagaaaagaaagaagcggcgggaucagcccuuggaacagagcaacucugauguagagauuacuacaaccaccucagagacuccuguuggugaagagacaaaaacugaagccccugaaucugaaguuagcaacucuguuucaaauguuaccaucccaagcaccccacagaguguuggugugaauacccggaggucuucccaagcagggguaagaguugaaaagacuucagcacuuagacauccucaccuuugcuaaugucaauaccuaacuuuuggaauuuuuaaaaucaguguuuucagcuuugcuccauaucacaauaaauaaggccauuaacuguuuaacuggaaccauuucauuggccuauuuuauaaaugcuuauuagaaauaacgcaaacauuugucgcuagccucuuuagcucauuuaaguguauacauuuuuguauuuaaaaauuagauuuuaaauuaguguuucuaauccuuauauuuuucaucaguagacauucugaaugcuuaaagugaauaggaaauuagacuguuugcugauaaaacauuucugguaagcaucugacccuacuauugcuacaggauauugcugcagaaaaacuaguccccaagccaccuccagcaaagccuucuaggccccggccgaagagucgaauuucucgguacaggaccaguucagcccaaagacuaaagcgucagaagcaggccaaugcacagcaggcagaauugucacaagcugccuuggaagagggaggaaguaacaguuuaguaacuccuacugaagcuggaagucuagacaguucaggagaaaacaggccauuaacagggucugacccaacuguggugucaauuacuggaucccaugucaaccgugcugcaucuaaauaccccaaaaccaaaaagguaagucacaaaugcauccuuuauaaguccagucuggcaagggcugucuuagugaaaugagaggaccuauaaucccuagaagaaacuaaucucaauauuacuagauugaaaguucuaaaaugcuuugacacaaaaggcuggagucauccugcuaccuguuuccuuauuuuuagucagcuuaaaucacugauagcugaaauuauuccucucuuagugggcguggagagggugaaggaagauauccuuguguucuaguugcucaauucauucuuacugcagcugcugcaucuccuccuguccuaguuucuagaugacguuugucuuuaugaacuacacugcuaccucuugauuuauaaacuaaugaucucuuuuuuaccuuaguaucuaguuacagaaugguugaaugacaaagcagagaagcaagagugcccuguugagugcccuuuacguaucacaacggauccaacuguacuggcaacgacccuaaacauguuaccaggucuuauccauuccccguuaauuugcaccacccccaaacacuacauucgcuuuggcucacccuuuaucccugagagacgucgaaggccccuucugccugauggcacauucagcuccuguaagaagguaugucuguguuuuuguguguguguuguguuuaugugugugugcuuuauuuuuuuaagccuaagauuccuaucaucaugacauaaauaaaauguucucuagauagccacucugcccaugugaguuuauaaugaguuaguuguucagccauaaauacugauucaucaagagucugugagacugugguggaaugaauguacugcauuuuuagugcucagauuugugacuggucacugaugucucuucugagaacccuugagguuccugagugagagcacacagcaguggaugacuggguagagacggauauguuuugugugugcucuugugauauggguuaacauguccauuuaugauuauugugugagauuaggcccuggguccucuagaacacuguugcauaaaugaaaaaaauuaaauuguuuugaaucaauucaaccguuauuauccacuaucaucacuugaaggaaauuagaggaaaaauccuauuguaauuggcauaauuccuguuccuugaucaaaugacaagucggacuguuuauuccaagagaauacagaaucuacccuaaaagacucucuuucccucucuguuucugccucuuucuccucuuuccaguuacuuacuguuuuuggaucuaguggcaguagcguuuggugguguuuuuggaaugcucuuucuuaauucccagaagcccugcauauuuuccaaaggugucucuuaggaauagaucacucccucagaucuaugaugucguuuuccauguuucuagaaguauaggacacccuuucauuuggucuuccuuugagguagagucuguucccuggaacacccuuuucucuuauccucagaucuggauucaggcugccuuccucagugucugccauugcccuccuccacuggcaucacguacaugaggaugcugcauguagauuauuugaugugaugaagucuccaacuccaggcaggucuucccugacuccuccaaacuuaaaagcuuuucucuuuccccaaagaacagaaguuauuucuccgggggaggggggcaugaaagaugagccaaaguggugugggauauggaggggaggagggcaauaggaaucugcaaaaaggaaggacacuacugcugaaugagcagcacauugcagaaagucuuuuccuaauugcacaucuuaccuaaacauuggaaucacucauugguuuguucggggaaacgcucguagaauuccuaaagagaaauuugaccauuucuaaggauguuaacuguugaagcaucuuaucaagccaggucguacaaucuccuauuuugguccuuuaaggaguguaggcaauuauuuauuacagauaaguaaugaagucugagcugcaaauaauaugaacuaggcucuugaauugaaauuccuucuugauaauucuaaugcuggguugcagucuuucuguuuccaucuuuuccaacuagcagagacuuaacgaaaaccaaaaacgugucuaggacuguaacuucagaucugguagaaaaugcauuucuuuaagcuuuuuuaacuugguucugcuuuuauacuuguaucuauagcacauccuuaaauuucuacgggcaacagauagaaauuccauuuaacacaagucccuguuauauucuccaaguguaucugacuauccuuaaucucauuuauacaggcucuacucaagcacuuuuaucuaugugucaugguuagucuuuaggaagaguuuaggcugcauacacaggauuaucauaacaagacuauuuaaauaggaucuuuaaaaacuguuuaagucauugcuuuauugugugcuguucacauaucaagauucuauuuuuuaaaauacagcuuuuuaugaggcaaaauaaaaugaaauggaauguuuuagcuagaauagaauuuggcuuuauagcagugaagaagaguucuucuucuaauauuggucuucuucuaauaucuccuaauauugguuagaaaggacuuaccuaaugcagaaccuaagaacauuuucauuauucaacaaaauuguaauaaaauucugaaaaucccucagaguauaaguuaaucagauagauaagaaaacccuccaugggauuauuuagaacaauguauauuucuaauaggcucacuguuucauaucucacuaaagagguaagggccuggccuuguaaguuaaaaacuuaccaguauaggacaaauuaaaguuguaucuguauaguuguacucagauucuuaugcuauuuauuuuuauuuuuaucauuauuauucugcaacuucugaaaagaagaggaguucagguauuugacagaacauuuuaugauaucccuagaguuucuaaauugaaucauaguuuuuaagaagcauuuugcauuuuuuaguuccucaguugguauuuuaaaaacauuuauaaguggccaacaaggcucucaguaguguuucaccuuguucucucuaaacuccucuucuaaacacaauguguauagggcauuuggucuccagacuucuuagaaaaaccagucugacugauaaugaaacagugugcuuugcauugauaauuaauauuucauuuuauacacuggagcauuaucuguaaaucuccaaacauagcauugaaauuuaguugaaccgggacucggugaaaaucugcucaguguucaguacuguacuauaagcuuucuucacauacauuaucucacuuaccaugcaugaaauugggaucauuguccuaaauuuauauauccagaagcuuugucucagaaauguuugguaacuuguccaaagugaagcagcuaauaagugacacagccagauuucuucuggugggggauaguagggguucacagggucucacuguuguccaggcuggagugcaguggcaucaucacaggcucacugcagccuugaccuccugggcucaaaugguccuccuaccucaaccucucguguagcugggaccacaggcacaccaccacgccuggcuaauauucauauuuuuuguagcgacaggguuuugcuguguuuccuaggcugaucucaaacuccugagugcaaggagucugcccaccuuggccucacauucugcugggauuacagauacgagcuacugagcccagccucacagccaagugucaagccagggcuucuggacuccaaaaccuguauugcuuccuugcucuuucgccauaauagcgagaccuuuaaaauauuuauccaucuuugagccucccagaaaacuccuuugcaauauauuuuaauagagguucagagaagggagaaauguucuuuugauuuuaacaacuugcugaguaggugcaucuaaaauuaacuuauuauccaugagguuaauuguaucuuguuagauacaaacaaauguccauguuccuuuuuuauaugaguccugaaauauuguaaaauuauacaacagaaccuggaggaguagguuugauuguauuugcuguguuucaccucauagcuaaccaugguagcaucuuucuucuagaauacuccuguucugauuuuauguucccuuuuuguagucaucagauccagaauguaaauuauuuuacaaguacaucuacuagacccuggaaauauuaaaaaauuacucagauaggaaagcuuagugaccccaaaugaguguuuucugcuuugaaaagaaaaacuuaaagguggccauaacaaaagauuuuucacuccugagccuaauuuuuccauuuauaaaaugagugcuuuggacaagaugacuucuaaguucucuucuaagcuuuaaggcuauauguaugguucugacaauucaucuuuacaucauuauucuguaucuaagauaguucauucuucggauuuuuuauuuuguuuuuguguuugcuuuucagagaccugguuguauccuaaaauguuuacgugauucaaauuaccauugagagcucuuuuuuauauccuuguucacucuuccuuccaaguguuuacagguuuacaguuucaguuuugcuuucauuuggccagccacaaugacauuuguaugauguaagauuuuuuuuuuuuuuuuuuuuuuuuugguaaaauuuuuguggauuguuuccuagguuucuaagagggaaaaucuaugagaauugcucucuggugaagagaguauuuacuuaccuguaauacauguucucuaaagguauaaauuauaauaauucaccuuugcucuuccuauugggggagggucuuacucagaaauugauguuuaucaaaauucgaucugucuuaugucagggcaggagagccacagaguggugagcaaccuacaacuguauaucuuaagagaacacaauuacagguaagaaauuuucugucuuccacaggauacauaaucuuauuauccuaaucuuugcagguuuacuaucuggccuaaauuuauuucuugucaguuuauuauucuaaucuuuacuaccaaaaacuugugacugauaggucuucuuuuugacuuuuucccuuuuuuuugauuucuacugaagcucauuucgugauuugcauuacucaugcauaauuuaaccaaacuacuuguuggaggggggagucccauagguuauuucauuugaaauaaaccuuuuggaaacgcuuuugguaccuguagugaagagcuauuaauccucauccaaaaucuuccaaugaaucuuuuuuauuaccucuucacacgucucuagcacggggcagacaacuuuuaagagaucuuuaucuuccuucuaggcgcuuauuuuauauauuaguuuuauucuauacgaucacagucucuccuaaauaaauguuaagauuucuuccucagucuugccauuuuacaccaucccaaaugguaugaaaaguugaauagcagucauuuuuuauugguuuuugucuuuugaugggaucucauuauauguaauccagauuuccucaaguuuuucaguuaaaaggaauugauaggacaauguuccaauaugcugagacacaagacaauaaaaugcuugacuguguaacugaauuaguguguugaauuguaucacucaccaguugauguacauuuaaaacaggugcacuaaauaguuuuagauaauuauugauaauucucugguucuuuucaauuauagcgcuggauaaaacaagccuuagaagaagggaugacucaaacaucaucuguaccccaagagacuagaacucagcaccuauaccaaagcaaugagaauaguagcucuucuaguaucugcaaagacaaugcagguacguaucuaaaaccuuucugauuauaugaccaaugauuguuucaggucugcauaaaaaauuuaaguaugaguauuucugauacaaaaagaaauggcguguuuucuaaauaguuacuuuacaucugucuuuacagaggaagagagagaucucaagucagggaucaguuuucccaggacgacaaagaaggacuagacaguguacagauaacagcagaaaugguuauaaaaaagguuagauacauuuaaaguaguaaguuuaggaaauuuauauucauauuuauaagauggggcaagggcaagaaagugguggaacacuaauauucaggaaagaauuaaaauucugagugauuaaguugggugggacaugguugagggagcaggggaugaaugaaauaagugaaaaauuauuaucaauugauuguuuucaaaggggcuuguauaauuagcauacaauuuuuaaaagaacagccgggcgcuguggcucgcaccuguaaucccagcacuuugggaagccaagguggguggaucaccugaggucaggaguucgagaccaacguggccaacauggugaaacccugucucuaccaaaaaugcaaaaauuagcugggugugguggcaggugccuguaaucccucccuaaacaggaggcugaggcaguggagaaucacuugaacccgggagguggagguuacagugagccaagaucacgccacugcacuccagccugggcgacaagaaugaaacuccgucucaaaaaaaaaaaaaaaaaaaaaaaaaaaacaaauuuuuuaagacagcuuuaaaucuaaagucuuugugcauuuuuaaacuagaugucaaugaaaaaucaucuguuccauugguuuugacagugacuugcaaaggauguaauugaaagcacuugugauaucuuaauguauuuugugacaaucuuuuuaccaguuucuccugcaaauaucagcuuaauugaaaaguucuuugugauuuucauaacuuuucucuaaaucaguuuuuuaaauauuagacaaucaaaauaccaaaguaaauuagaugcuaaagcaaccuuucagguugcaacaaacagaauauuucacauuuucauaaaaaacccacuucauuguuccuguuuaccaacuugcugaauaaauguaaugaacuugaauuuaauuagauaaauuuuuaguagcagauauugcaacuaaaaucagaacuuuucuuaaaguucuuacuucauuuggauuuuacuucuuuuuagauuuuauuucagaaaacgugaauugccuuuuuuucuuuuuuucuuuuuuuuuuuuuuuuuuuuuugaaauggagaaucaagcgauucucccugccucagccucccgaguaacugggauuacaggcgcccgccaccucacccggcaaauuuuuauauuuugaguagagacgggguuucaccauguuggccaggcuagucucgaacuccugaccucaggagauccgcccaccucggcuucccaaagugcugggauuacaggcaugagccaccaugccuggcugugaauugccauuuuuuaaauuauggauuuaguuuauucuuuugucucuagauuagauuauaccucauaaguuaccaccuauauaccucaggauaauaaaauuccaguuaucugaaagauaaauuauacuguuuauuuaaaauauuuucuucuaguauucaccaaaaauuagggauauuuagucaaauaugaauaguauaaagaaaucuugguaccagauuuccauuuguauuauuucuuuuuuaacagcuuuuaagguguuaguaagaauauaacuuagcugaaauagacuaucauguuuguguaucuaucugguguguguguuaaugcauguguauaguuaagguugggaacaggagauugcauagcaguucacauccugacuagcaaaggauuauaggaaaagugucuuuguuaucacaugcccugguuggaaggaaauuaggauuccuagucaccagccuuuuuuguuauuguugagcuucugcccuagucuaacagugagaaacacucacaggacacaccuugcccuuaaaaagcaauguaggaaaauauuugauuuuaaaaaucaagcagcagucaaaugcgcaaguuauauugcuacaaaauuagcauaaauucugaggaauuacuuuuauuuguuggcucucuuuuguuuuuuucaagaauaccaaagagacauuaagaaaggggaaaggauuucuauaauagaaaaaaucaaacagaccuuuacuugaaaaccagcuguccccuuuacuaacuauaugauguuacuagaagucucugaggcuaggcguugguggcucacaccuguaaucccagcacuuugggaggccaaggugggcggaucaucugaggucaggaguucaagaccagccuggccaacauggugaaacccugucucuacuaaaaauacaaaaauuagcugggccuggucacguaccuguaaucccagcuauuugggaggcugaggcaggagaauugcuugaaccuggagguggagguugcagugagacgagauugcgccacuccacuccagccugggugacggagggagauucugucuuuaaaacuuaaaaaaaaaaaaaaaaacaagucucugagccucauuuguaaaaugggaauagcaauaccugcuuuauagagcuaacauuagaaugaauaauguauauaaaguucucaauauaguaucaggcccauaagaguaauuauuauacggucauuauucuacacagaauacucuuucuuguagaguauuuguggauuaauaaauacauuaaagauucuggcugggugugauggcucacgccuguaaucccagcacuuugggaggcugaggcgggcagaucacgaggugaaaagauugagaccauccuggccaacauggugaaaucccaucucuacuaaaaauacaaaaaaaauuagcugggcaugguggcaugcaccuguagucccagcuacucaggaggcugaggcaggaggauugcuugaaccugggaggcagaaguugcagugagccaaggucacgccacugcacuccagccuggcaauagagugagacuccgucucaaaaagaaagaaagaaagaaagagagggagggaagaaagaaaagagaaaagaaaagaagaaagaaauacacuaaauauuuuaaguuccuaaaagcugaaacuuuauagaaauaaaaguuauuaucaaaguagggcaggggcaugauguucauuauuuguaaaugaugugggucuauucuuagaagagccuaaguaaucagcugaaaaacuuagaauuaauaauaagaguuuaggccaggcgugguggcucacgccuguaaucccagcacuuugggaggccgagauggguggaucacaaggucaggagaucgagaccauccuugcuaacacagugaaaccccaucucuacuaaaaauacaaaaaauuagcugugcgugguggugggcacuuguagucccgcuacucggggggcugaggcaggaaaauagcaugaacccaggaggcggagguugcagugagcugagaucgcgccacugcacuccugccugggcaauagagugagacucugucucaaaaaauauauauauauacuaauaauaauaauaagaguuuauuaauaucacuggauagaaggauaaauauauaaaaaguguaaauauauuuuaaaaaaucauuuauauaccaagaaaguaaaugaauaccaauuuuuuuuguucccaaacuuaacaaaacuaagaaacugccuaggaauaaccuuaguuggguauauggaguaaacuguuacugagaaauauuuuuaaagucugaggaaauggaaauuucuuuuucuuuuuuuuuuuuucaugaaucauacgugagccuuugauaaauuucauguucauuauggaaagaauauauauauguguauauauauauuucuuucucuuucucucugucuuuauauaguucccaugaaacugccuuguuuuuggaauuugauuaaaugauucugaagucuaccuuuaaaaaaauaagaaaaaaauugaaaaaauaauaaugaaguacuuucucuugagguguaagacgagcuucuaguaugaagcuaauaguuaaauuuaguauaauauugaugcaagaauggauguauauauggaacaaaauagucagaauaggccuaaauauaaauguaaaaguugguaaauugucauggaauuuuuaguuaggagauugaaaaagaauuagaaucuagcuggacacgguggcacgugccuguaacucucaacuacuugggaggcugagguaggaggaucacucaagcccaggagucaaguucaaccugcgcaacacagcaagaccuugucuucaaaagaacuacuagguccuuugccaaagaaaauucuaggcacauucaaauauauauauuuuuuuaauucaaacuugggccuggcauggugacucucaccugcaauuuccagcucuuugggaugccaaggcagaaggaucacuugaggccaggaauuugagaccagccugggcagcagagagagacccacaucucuacaaaaaauaaaaauuagccaggcaugaugguggguugccuguagccuuaaggaggcugaaguaggaggaugacuugagcccaagaauuugaggcugcagugagcugugauaaugccacugcguuccagccugaaugacagcaagacaucugucucuaaaaauaauaaaauaaauaauucaaacuguauuaaccauguuuuugugucuauacugccucuguauuaauagaggauuaguacauuggggaaaggauuugcaguaaaacugccggggaguaauaucccugcuagcaaucugauaaaauuuaucaugugcauuaaaaauauucauaauccuuaaccuaguagucguucauuuguucugcuugguaucuuuccuacagaaauagacaaagaaaccaaaauuuauauauaagguuggugcaaaaguaauugcguuuuuggaccauuaauuuuaaaucacuguaacuagacucagacacaucuuuauuaaucaaaauaggaaccacugcaaucaacacauuuuugccacugagaaauaaguuuguuuauuccuguagccuaaaaaucuaugcuucaggauucgacaaacucuuggaaaauauuuucugcauccugcugguuguggaagcaccuucccuguaaaaaguugucagaugcuugaagugguaccugguuggcgagaggucaggugaacauggcgggugagacgaaacucuguagucaaauuuguucagcagcuucagaaguugaaugaauuguuuauuagaauaauuaauucuuaguuauuaacaauugcaaaaacuauagguuaaaaauaaucugaauuccaaccccaggaaugguagaauuuguaauuuuaucugcuugugcacauacuuguaauggaguaucauauacuauuuauugaaaaucuuauuuuugauucauuuuaucaaauuaacucccucuacccccaaaaacagcguaguaccacuuuugaauuagauuugugaucuuaccuagcaccuugaauuuguaagaauauuaaaagaauagccaggugugguggcucacgccuguaaucccagcacuuugggaggccgaggcaggcggaucacgaggucaggagauccagaccauccuggcuaacacggcgaaaccccgucucuacuaaaaauacaacaacaacaacaaaaaaaaaaaccgggcauaguggcaggcgccuguaaucccagcuacucgccacugcacuccagccugggcgacagcgagacuccaucaaaaaaaaaaaaaaaaaagaauauuaaaagaagaauauacgaugacuaagguuccuucuaggaauguaaggaugaguuaauauuugaaaauuuaauaaucgucauuuguuagcaggucaaaugggggaggagaagucauaacacagugacuuuuaucaauuuaaugauaaaauaacauacuaugaucuuuuaauaucuagcugaaaaauugccaguugucaugcaucaugaaaacuaguuaaacaucaaaauaggcuaucaaauuaucccacuauuaccauuauuauuuaauauagucuaaguaauuguuagccaaaguaauuacaccaacccccucccccccacaaaaaaaaucaacauaagagauauaaguacugguaaagaggguuaauguguuaucauguacaaauacuauuaucuaccuagagaguuaauugaaaaacugguagagauuaauaggguaacuggauaaaaaauaaguauguaaacuuuuuaaauguuaauaacauuuagauaacaaagggagagauacguuuuauucauaguaguaaaaaaaaaaaacuaaagaacucuggagaguaaacuuaauuagacaugugguauauauagaugaagagggacauaauaugugaauaacaaagauuaugccauguuccuggguaagaaugcuucucaaauuacuccugaauuucaucuaacaccaaucaaaauccuaacuuuuuuuuuuuuuuuuaauaguaugagcauggucauugaaugacuucuauaguucauugcuagaauagcuaaaauauuuuggagaacuagaacagaauaacuggaauuucccuaacaauuuuaauaaaaaguaugcugguguugauucaguauuggacaauaaguggaaagaauaacauucggaaauaaacauucagaagauaagcccaguauauguaagaaucuaauaagauaaauauauuucaaauuaauagggaaauuauaguuauucuacauuuacagaagauuuuggaagaaggugcuggcuauuuguuauggggaaaggauggauuaauugcuaccccauauuuaaguauguucuuuuuuccuuuuuuguaauggcaguuugucagugugaaauaaaauguucuuuuuuaauuaaaaucuaaauuaaaaauuaaacauggagacaaaaggaaaauaggcuggcauuuuuacagugucaggguggguuagcaaagacaugauaucagaagcagaaaauaaagugauccguuugacuaaauagaaacaaaacauauagcagagacuuguaaauaaaauugaaggcaaucaguaaacugggaaaauacauuuguaauuuuauugacaaggggucaacauucuuacuauuuaaagagcccuuacagaugaagaaaaagaccccaacaccucaguagaaugcaggcugaagaacaugagccagcaguucucacaggacuaaauauaaacuacacauauauagauauucuuuugauuuaauaauccuacauguagccauuuguucuaauagcaaaaaaugaaaaaaaaguugguuaaauuuugauaauacuaauguugugcagucauuaaaccugaacuguagauuucuauucauugucauaaaauguugaccauguauuucugagugaaaauaguuacugaguaguuuagguaaggcaagagucagugaagcaaugucucgauaaaaauuuaccaggauauuagcaugcguuuauuuguggauaugauuuucagguuguguaugugcuguauaaccuugguaauuuuuugaguaaaggugaaaaauaauaauaauaaaagauggauagauuugaccacauaaaauuuggaaacuauauaugcaggaaaaagagaaaaaguaggcaaaugacuuggcuuucuuuggccuguaaacuucuuaagggcagacaucaggucucuuguugaauacaguaucauaauaaguacucaguaaauauauguugaaugaaugccuuguacauugauuugcacguggcagauuucaccuguaucuuauaacuccuuucuacaacuaacuucaucacuuaacauaauugacuuugauaguuauaguguuggaccuagcaguacagagaucuguaagauuccauuguuuaagacccuugaaauauuaaauauauaaaaguuauuccgaauauaagccaugaauuacauguuuguuucuguuuuauaccuaggcacuuuuuaaaaggaggaaagaaaauuuaguaucuggaacaaaaggaagaugugaauauacuuccaaucuaggaauauuaaaaauccugagauaucagaaaggaaaaauaugcaucuucaauaauuuuuugcauuuauucuucccucuucaucuaaacaucuccuacccuaguuuagugccucauaauucuuugcuaacuacuguguuaacuccagaugguuucccaguuacuagucucauacugaccauugcuuccagauaaucuuccuggcccaaaaauuuuccuugaaggccuggaauaaaugucacuccuuccauccaccaagccuuggggauauacuuuaaccuauugauuaagaauauagauagauggagccaggcgcgguggcucacgccuguaaucccagcacuuugggaggccgaggcggguggaucacgaggucaagagaucaagaccauccuggccaacauggugaaaccccgucucuacuaaaaauacaaaaaauuagccgggugugguagcgagcaccuguagucccagcuacucgggaggcugaggcaggagaauggugugaaccugggaggcggaccuugcagugagccgagaucgugccgcugcacuccagccuaggugacagagcaagaguccgucucaaaaaaaaaaaaaaagaaaaaaagaauauagauagauggggccaggcgugguggcucauggcuguaaucccaacacuuugggaggcucagguggguggaucacuugaggucaggaauucaaggccaacauggugaaacccugucucuacuaaaaauacaaaaauuaagaauguagauauaugggagcaagaauaccuguuuugucucucuccacacaucaaguuucucaccuuuaauauggggaugauaauaauagugcuugauuuauagaguuguuaaaauuagauauuucacaauaaagcacauggcauagucugugguauauaaucaucauuuagaaaauacagcuuuuuuuuuuuuuuaacuaacacauagcaauaugaucaccuuucuugaucaugcuaauacuaauguguucacuuuuuuuguugugucguuuuguuuuguuuugagacagucuccucccucugucacccaggcuagaguacaguggugcagucucaacucgcugcaaccucugccuccuggguucaagugauucuugugccuccaccuccugaguaacuggaacugcaggcaugcaccaccacuccugcuuaaucuuuuuuguguauuuaguagagacaggguuuugccauauuggccaggcuggucucaaacuccuggcuuaagugaucugccugccucagccucccaaagugcugggauuauaggcaugagccaccacaccuggcccuguuucuauuucuuacaaauuuuaagccucuugaaaauagaauguaugaugaccauuuuucccuucauaccuaguucaguaaucaguagguauuaaauauauauacuuuuaacuguaaaugaauaaaacuguauuuuuauucugagaaucaagugagaaaggugcuuugaccuaaauggucacuaaaauauuuaguguagugacuugcuuuuuaaguggaucuaagaaguacagaaaauaggauuauucuagucaaaaagaaugugaaccuaauuuuuuaaugguugggagaaguuuuuguagaaaucauuucaugcuuuuuagguagaaaaggggcuagacauggaucaaggaaucauauaagaauagaaagagcuucugaaaagggacacacauauauaagagauggugaaaggaauuuggauuuagcaucccaguaccuuuaguuggugauauagcaguuuaguagaggguaacuguaacacaguaacaaagacuuuucagaaacucaauguaaaagaaagaacuguagcaguggcucacgccuguaaucccaacacuuggggcgucuaaggcgggcagaucaccugaagucaggaguugaagaccagccuggcaaacguggugaaaugccaucucuacuaaaaauacaaaaauuagccagguguaguggugcaugccuguaaucccagcuacucgggaggcugaggcaggugaaucacuugaacccgggagacggagguugcagugagcuaaguaaaugccauugcacuccagccuuagcgacagagcaaggcucugucucauaaauaaauaaaugaauaaaugaaagaauuuuauauuuugcacugguagaaauuaaauuagagaucagucacauuugauuuaccuggaguuugggagauagaauguuuucagaguuauuuuaagcaugguaauuaaagaguuucuuugggauuuugguuggauuggaggagauaacuuaaugggaugaggcagaaaacaguuaagagccauuguagauuacagauuaauggcuuuacuguagagccuuaaauuaaucugugguuucaaacucucauccaagcuuuguguuucacagacuuguugagcccauuaaagaaauggaagucucgcuaucugauggagcagaaugucaccaaguuacuucggccucugucuccagucacaccacccccucccaauucaggcucaaagaguccccagcuggccacaccuggcucaucucacccaggagaagaggagugucgaaauggauacagccucauguuuucaccagucacaucucuuacuacugcuagucgcugcaacacuccucuacaguuugaggugauuuggguuugguugcugggagugcuggauaugaaaaucaucauuuguaccuucucauuucaaauauaauaccauuccaaauguuucuuuacuaucuuucuuccccaucucaguaagagaaugggaaaccucagggucauuguggccuguuaccugguagccucucaucuuggcagccccuaugcuucccaaaauaggcauacugcuaccacaaaucccauucauguaucuuuugcaugcaguccaucaaucuccauaaguuuagguaguaagcaugcuagaucuccaucguuaucuuuacuguauacuuuggucaaaauaggccucuagcugccuguaguaucuguuaguaacacuagccugagagcacagaugauauugauugauugugucuucguuucuaggccuuuaaauaagugaagugucuuucccagguuguuugguauuuucauuguggccuuagcagagauuuagaaaacauugggguauggcuuauggcgaauguggguuuuuuccacuccagguuacuuucccucuuuguuauaaugucuuaggaaucagaaguagacaagaggcuagcaacauguauucaugagacaaauuuauuaccuucacuguuggauuaaguuagaaaugucugccucagcuguuucaaaaaguaaucuugaaucacuuuaguguucagguuugggugacagcagguuucaauagaauccauguauacuuuuuuaaaacacuucaucuauugcauguuacuuugauuuguaauuaaaauggacacugucucuuuuuuccuucucagaaaaauuuguucugaccacuaaacacacucugcugcucugcccccuuguuugcacuucuccagauguguuuuuugagaaaggugaacauuuuaaccaaucuuacguuuccuauucagcuuuuccaaguaugaggauucagaauacuuagcuuuuaugaguaacuaagaggcagcuagcaacauugaaagcagaacuguauucuuucuuacccuagaccucuacuuuuggagcagaccucuuucugggugagggaaaaaaccuccugguuacauaucaguuaucuagggaaauuacucuuuaccagauuauuuaugaaauucuuucagccagauaauaaagcagcugauucaggccuuucuaacuugacuuugucuacuugcaauugacuuugcaguuugcaccuagagcuuuauaguaagguaucaugagaggaauucucccuggagggcauaagauuauaggaauagagugucauacuuuaucaauacagguuuuauuauaaauguggaauuaugaaaauuagaaggaggccgggcgcaguggcucacaccuauaaucccaucacuuugggaggcugaggcaggcggaucacgaggucaguagaucaagaccauccuggcuaacguggugaaaccccgucucuacuaaaaauacaaaauauuagccgggcgugguagugggcgccuguagucccagcuacucgggaggcugaggcaggagaauggcgugaacccgggaggcggagcuugcagugagccgagaucgcgccauugcacuccagccugggcaacagagcaagacuccgucucaaaaaaaaaaaaaaaaaaaaaagaaaaucagaagguaagucacuuugcaaaacaagcggguucaguacucaguguguuccuuaucccuuguagcauuugggauaacuauuaaacacugcaaauauaaagugguuuugguuuuguuuuguuuuguuuuuuuuaauuggugaucauuuuaauaauacaguccaugcauaauguuagaauaccaggagggaaggaaaauauuaaauaguaaaagguccaaggcaugguuucacuugcaauuuaaggaaauuuuaccuuucucaucaauaauagaacagauuucaccacccugacccauucuaaucaccauuuuaauggccauacucuuugcuguauucuaguacagagagguggggagccuuuuuuguagcaaaggcugugacacauugugaaauaucaaaaaggugucacguauaaagaccagcuuaggcugggcaugguggcucacaccuguaaucacagugcuuuggaaggcugaggcaggaggauugcuugaggccagggguuugagaccagccuggguaacaucgugagaccacauuucugcaaaaauaaaauacaaaacuuagccagguguaguggcauauaccuguagucccagcuacuugggaggcugaagcaggaagaucacuuaagaccaggaguuuaagacugcagugagccauuauugugccacuacaugccagccugggcaacagugagaucccaucucuaaaaauaauuuaaagaccagcuuaggccagguacaguggcacacaccuguaaucccagcuacucgggaggccaaggcaaaggaauugcuugagccugggagguugcagggagccaagacugcgccacugcauuccacauuccagccugggcaacagagggagacucucucucaaaaaaaaaaaaaaaaaaaaaaaaacaaccuuacuagauuaguuuggggaaggauauuuuugagaaggaaaaaagcauucaggaaaauggugagaagucuuaagugcuaaggggaagaagguaagaagauaaacaguggaagagaacaagaucuucaggaggggaaagcaucuagaaagaagaguggaagcaacauugggaggacaagcuuaguuagccucuccuuucuaccagaauaacccuccccuccuauucuugcccugagagccauacuccacccgccauuucacacauacgugcaccuagauguacaccacccacuguccaugccaaguaaaauucacagccaaaacccugcuuugcugaagcagccucauuuccccuaccucagcaugugccugccaccuaggccacaguuauucagagucuacauuaggcacccucuccuuaccucagcccuagcaccccugagucauugucacacuaccaccuucacucucuucacguguucccauuuacaucuuuccauuaagcacucacugcucagucucuguuaugggacugcugccucaccugaaagucccaagguaaaguccuacccucuguaggauacagggaccuaaguauacacauacaugcuuuuucugcucuguugccaaaaguacaauggauuuuacaaaauaacauuaauagggguggcucaggucuaauuagauuaugccaagaaccaacucuagccugugagcuagggauuccaucaaucacauuuccuguaacugucauucaagaggaacuggccaucucccuaaccaugucagcccccagcacacuaaugucucccccuggauagcacugggagggccugaggcauauaagagaauaaagaaaugugacaagcagaagaggcauuggaugaaggaacaagguccauguaaggaggaauaagggguagggugccccucaauaacaaauacuguagguugcuaaacucucaucuaaaauacaaagacguauaacacuaaaauuucaccagucuaacucuuuccuuguaugugcuugagauguuuacuuacagcaugaaacauuauaaccaauuuauccuuaaaugcuuucagagauaccaggaagcauuuuaacaagucauucuguccauugagaugaguucugcaguuaaauauuuccccuaugcauucuuauucaacuuccccgcccccgaaaaaaguuauggcuaacaucuaugcuugcuuuuauuuuuuguuuuguuuugcuucuugacuucgaguagaugaauaauaacaagaugcuuuucccuccucuagaacauauccuccccugagaguuccccugcgcauaggcccgagucccugucacccgagguaguuaucacaccaucucaaucacacuuggaggcugagagugaguguucaugaauguguuccugaguguguggggagggcuggggaucugagucaguggggugaugggcuggagggcggccacucagucacaguaaguugaaugagucuuccugugugacugugacuacacaggacugucaauguagauggaggaaaaugaagguaggagcguguguguuuguguguguguguguuguguguguguuuggugggguugguuuuugccguuugggggaggggguggcuggaguucuauuaaagaauagaaucuagaagucaagaugcugauaugugguaggagccuuguuaaagaaaggcuaauaaaucaggaaaguugagucaaaaguuguaagagcuguuuuuugaguuggguggugacuuaugccuuguucuaggguuaaucuaacagcucuguaaaccagauguuuugaccuuugguugauagauugagcagcuucuucaggaagggaaagucauucugucuuucagcuuuccuacauuuucucugcagcuccuuacugggugcacaaggaaaccaagugagucccuggcuuucugucacaggccaccauucugcaaugguuaggauaugguugcuauacaaguguuaucucuuuaggauaucaguagagugguuuucucacaaacccuacugcuguggauaugucaaacucagauuuuagugcuagaguuucuauuauaagcuuucagauuuaguaacauuaacucugaaucuauuaauacaugggaccuuuuuucucuugaagagaaaguuagagucucucagaaauagucaacugaacuuuaacccuauccccuuccaauaaaaaauuagggcauaauucagugacagucuacuaaguucugaaucaguaguaguucacagguuaauaugaaacugaaaaagguuuuauuccacuaguauauuagagauuuucuugguguuuugacucuagcuuguuaggaaaguaaagcucucucuccucaguuguuaaagauucuaagauaacguaauuugaagacugauaugguaugguaucugguuuucugguaccauucuuugucgguuagcuguaguugaccuaguguuggaaguuuggagguuaugauaaccaaauaguaggugggguuuauuuuugguacauuucagcauuucagaaucugcagugaugagcauuaguggucuugugguauguugacguacauuagaggauaaagaagaauugaguggccagaaaguuguaugagaaacacagcuucuuuaacagugaaagugagugaagaacugguugguugaugucuuuaaugccauccuccuuuacugaaccaguaacuuaaguacuugccuuuccgucuaccuucuccuuccuccaccuuuuucccuuccccccaccuuccaucaauauuaauuuagaaauugauaaccccggaagccaguuaucuuaagacaccagucucaucuuuguuuugugcauggggcuaagguaaauuccuaauuauaccacuugucccuuaguguaguacaaggugacucagcaaccugaugaaaggcuaagcaggcaaaauagucacauuuagccaauuaccuaauucuaacuuucccaguauuucccauccagaaagacuugaaagcaauuuuggaaaggccaggauucuuuaguacucuggcccauguacacuguugcuacgugggacuuuuacagaauauaauggcuuuaucugcucuacuuccgucccucuuaucuuucccuguucaccugugucccucuccccuccuuucugcccuuugacuuuuuccuuucuccccuaccccaugucuccguugauuuuuauucuuucagcuuugucaccgaaaagaccuggauuuggcaaaaguaggauaccuugacuccaacacuaacagcugugcugauagaccuucccuacucaacucaggucauucugaccuggcuccucaucccucccucggacccacuucugagacugguuucccaagcagaaguggagauggacaucagacccucgugagaaacucagaccaggcauuucggacagaguucaacuugauguaugccuacuccccuuugaaugcuaugccucgagcagauggacuguaucgaggaucuccucuagugggggauaggaagccuuuacauuuggaugggggauauuguuccccugcagaaggauuuuccagcagauaugaacauggcuuaaugaaagaccucucucguggauccuugucaccugguggugaaagggccugugaaggagucccaucugccccccagaacccaccacagaggaaaaaaguaaguguuucauguuauaucggcgaacuuuucaagaauguuaaccaaguaguuuaguagauauucauaaguuucugcuauguguuccgcacuacucucagacaagugagacauagucucugccaaauccagugaaagacaggcuguuuuaguacaacuuggugaauguuguaaauauucagcaaauguaaaugccuguaugugccauauacuugcuaggcaauugagagguuagaacagugaaaaagaaauuuuaccuauuauuuagugugucccaaguucgaggcacuguauuaagcucuuuaaauguguuuuauccucacaguaagccuauaagauaggcaauuuucuauuuugcacaugaggaaacuaaggcaaguugaguaacuuucccguggucacacagcuaguaaauggaaggaccaggauacuacccaguuugagagagaaggcuggagugagaggcagcagguuacugauuuaacugaaucucaaacaauaaguaggagucagccaaccaacaauugagggugagguauguuacaguagagggaguagaacagguaauuagguggcacuccauuggccaggcagcaggcaugcaguauggugcaaacaguuggauguuguuguaucagguggaaggccgggggagccaggaggaaagugcagagagugcugggcugggccaggccauagagagcuugcuaauggguugggacuccacuuccaaguaaugccugaucaagaagucacaaagccaaaaauaugcuuuuguauaagugguucucaacuagggguguuugagaaugaguaggaguguuuugaauugucccagugacuugcauuuauugagcagggccagggaugcugaauguccuguauaggggacagucccauguaauggccaaacaucuguaguauccucauugaaaugaaaccuagugguuuuuuuauauuuucauuauaaugauauuaccagaauuuauuaacuucuuuccaaaauuauuucuagaaaaugcauaugcaaaacugucuauauuuuuguuccauuuggacagaaaaaugagaacccuaaggggauagaaggaggaggaaacauuggcagauaauuuggauuaagauaauaauugauuucgaagauuguugcgugaacagcauugacuaccagaaacaaacaugaaaacaaucuuuggauuucugguuuuauaauauuuacuaugugcaaaagucauagaaauuaugauauuuuauuucagaaacacuucugaaauuuauugggcacauuuaagcauaaauuuaagcauaugccaaauucugugcuggauguuaaagauaaaaagccagauaaacuuggccuuugccuuccuagaacuuauaguuuagucagggagcaaucaaggcaugguaauagguucuacggccuguguaagcaaugugccagaacaacaaagagaagguguacuaggcagggcacggauuauggugggcagggugggaugggaggucugcugucaggaaagaaugagcaagcauuagggagaugaaggggaaguuagggagaaguuaccaaguuguuuucuagagcuagcuugcuaaaauuauaaacuggaaauaauaauuuccucucuuuuuacauuaauuacaucuauguguaagacagaaacaguaauaaauuccuauuuauaucuugaaaauuugaacauauuuaaguauccuggagcauuggguuuuucuucuguuuuguuuuguuuuuccuucucucucucccucucucucuccaccuaccucuccccaccucccucuccuccaucuccuucuccucucccugcuucuuucucucaaacagcuaacucuagggguucccaaggaguacagaacagccaucagucaccugggaggcuuuuuaaacuauacaagcuuccaauucucccuucucuagguacuuccauuguugcaaauaacugugauagcaugcuucuguuacuguguaaugguaaccucacaaguuuuucugaaggcagaaaaaaagaugguggucuaauuggcaaacauucuuuagagacuugccuccuaguuuauuaucuuccucuuaccaauuuccagcugccuuaaauauguagcugugcucagaucucuuucauacuccccaaaaaaaguuaucaggguuggugucugcuuuguuugcguggcuuggcuagugguuuacuaagguaccaucuuuccuucuuucccuguugcuggugauccacuaaugauauccagauagaguaccguuuuuuguuuguuuguuuuuuccuuucuagguaucccugcuggaguaccgaaaacggaaacaagaagcuaaggaaaauucugcuggugggggaggugacucugcacagagcaaaagcaagucugcaggagcugggcaaggcagcaguaacuccguuuccgacacuggugcccauggugugcagggauccucagcccgaacuccaucuuccccucacaaaaaauucuccccaucucauuccucuaugucccauuuggaggcgguaagcccaucagauuccagaggcacuucuucaucucacugcagaccucaagagaauaucagcaguaggugguaaguuuauauuugauguuuuauaguuaaauugggggugggggggaguauauaucuaagaucauucccaguuuuaccuaaaaucuaugggaacacuugaugggaacaucugagacagccagccaacaguaccaucuguccuguucagcugauuuaauaaugucagcugcaaccccccagcuuugcagaauuaagaauuaccaacaugccuguggagcagugcuuuggaugacauguaguuauggaugcagaugagcucuuucauuuggugggcacuaacacugccuuuccuauuucucauuucacaugaaaggugagucaagaauccagccaaguuccacaugaauuaacaacagaugucucucuuccacacagcuagcauauacagagcaaaaagacauucugaaaggauuugucugguuuaggggagaccacaaauuuaaaaaugaauaauacugguggcaaauacugaggaucaaaugugugaaauagagaaugaagcacaggaguucagggaucuugaacugaaaaaaauaagucugggaaagaacaguccuggcucaaauguuucauguucauuaaucuaugaaaccuuuauuaaaccaguacuguguaucaggcacaugauuuccuaaaggagaaauuuuaacauuuuaaauggggguuaagggaaguuaacaucuuuaacccacuuuuuccuugauuucuuuuucuuuaaaagugguuguuguugauguuucucuuuugugccugacauaguuggaggcagaggaaauacguuguuuuaaauugguucugaagaaaguaauguuuaagaggauguuuuaagaaaauacacugugcacugguuagggcuucauuuguuuugguuaaguccuguggcuugaacuugcacccuguugccuuuacaggaugguucccacaucaguagaacgacuccgagaaggagggagcauccccaagguccuccgaagcagcgugaggguggcccaaaagggagagcccucucccacaugggagaguaacaucacagagaaagacucaggugagcccauggccuucugcugccaccacauucagggacacaugagccgaguccuguacaguucaugccuagugcugaguugaggugagucaguuucugaugcaguugggcuccaccgcaugcuagguuccagcccacuuaugcucauuugggcuaccacauuuguaagaucuagcauugcuugcucucugucugcucuuuuuuccccaaggaauaccuuucuguaacucucaucucuccaaaguccuggaaaucuaccucgaugaaggaugaagagaaagaagacgggaaucacaucaggcauuuagaacauagcccauaauuaaccacucauuuugcccuucuggcaugcugcacucacccaauuugucacaaagagagcaguacggguuggugauggcacuggugauuuaaaugaaaaauggcucuuucuuacuuauucuaagaagccaaguugauuuuuuuuuauauauguuaccuuccagacccugcagauggagaaggcccagagacauuaagcucagcacucucuaaaggagcaacaguuuacagcccuuccagauacagcuaccaggugagaugagaaauugcuggucucuagccauaggaguguguucugggucccaaauuguccuggucauccuuugccauugagaugcugucuuugcauauaguuucagcagccuuggaaauaagucaucaucugcuuguccucagguaauaaauuaugccagaagaugaauacggugaucaaagacagacauuuuacugccuuugguuuccuaaaaagaauacaugguuaaaagaugaagaaaaaagaauguaggguauuauaaauguucaccagccauuuaagggacuuguucgcguccuuauucguuuccucccaacuuugucuagcuccugcagugugauaguccucggacagaaucacaaagccuccuucagcagaguuccucccccuucagaggacauccuacacagucuccaggauacaguuaucgaacuacugcacugagaccuggaaacccccccucucacgguucuucagaaucaucccucucuuccacguccuauuccagccccgcccacccuguguccacagacucguuggccccauuuacggggacaccaggguauuuuagcagccagccacauucuggaaacagcacuggcagcaaucuuccaaggaggagcugcccuucuagugcugcuagcccuacccugcagggacccucagacucgccaaccucagauucaguuucucaguccagcacaggaacucugaguuccaccuccuuuccucagaacucuaggucgucauugccaucagacuuacggacuaucagucugcccagugcugggcagucagcugucuaccaggccuccaggguaucugcgguuuccaauucacagcacuacccacaccgugggagugggggugugcaccaguaccgacuccagccacugcaagggucaggagucaagacucagacgggacuuuccuagggcuucuggauuugggcaaacagaacugaaugagcccauagcugcuuccuuccagcugccucuggaaccuaggccgagcauauugcugaggaacgggggguacaaggugccagaggauugggucugguggacaagaaacaagacuuguggucacaauuggccucuggccuuggagaaagcuguaaaucuugucugaagcagagacuauaaagaaguuucucccugcugucaaggguacauuguugacaagcaaaugguguuucgguuaguaacgguucuaagugcaaugaguuguguugaagccuccgucucccauccuugccuguagcccguagucacuugugcagugaggacaucuuuuuaaauuuaaaaaaaaaaaaaaaaaaaguuuucaaaggaaaaaaaguuaaaagagccaaucucaaagccccaagccaucugaguacuguuaggguuuuaugcacuuaagaaaaaagguagguauguaaauguucauccuaagacaaccauuccaaaagcagguaucuggccaauguguguccaccaagaauacuguuuaucuuugucuuaagaucaccaagaaauaggcaaggauaguaaagcuuggaaccugcaccaacuggagggugccuggcucuuugaagaaaagcucauggucagcucuugauuauucgggagcagauuauuugaguagauugucugagccuccaacuguuaccauccuacucccccuucccaagcuauuucacagcucaguaacccaugaaguaaguagacaagaaaaggaggaaugagacaugauauaggccaauugcauugcuacuuaccagcuuuuggcaauaaauuucauuaggaaggauaccgagugguuugggaaugcuucgaauuuuauuuuuucuacucccaauuaaucaggaguugaugaucccaugagcaggaccgccuccaugauuggggagcaugcacuugugacugcaggguaagagugggaagauagguuuguggaguggcaccgacaggacugugauugugugugggccugccccacauuucucugggggaugcuuaugugagagugggcccagugaaagaguuaccaagccacccacaccccuaacacuguucuggaugagagaugagagcagaccggcuucuccccaucagugcauugugccuguuguacaccccuggaggagcccuggagccagcccaggugggguacacaaucuuuuuaaauuccauaugguugccagcuuauuucuuucacuuguuuacuguaauaucuggcguguuuuuauuuaucuaauuuuguauucaguuauaaccaugguagggguagugaauauaugacagguguaaucccuggugcugcaguggaccuucuuuucuuuuggacaagauaauacugugaguuucccuccuuccuucccucuaauuuguuuuccuuuuuuccccagccucuugcauccccuucuuuucuacccuguccuacaacuaucauaugcacagucuucucucuuugugugugacuguuacaaaauuucacuuuucaaaaucgaaaucagguguuugcucaaaugaggggagauuuuuuuuuuuuuuuuuuuuuuaaaugcugagaccucagcagaguacuuuucuuuuuguuguuucccccacaaacccaucagucugggagagcauugggaguggaaaucauguugccugggaugcugguuucuuuguauauuauauaaaacguauguaaaugucucuccauuugggcugggguuugcauucuccccuuggcuauuuaaccaaggggagaggccagcgggcaggcggcccucacccugccuggcacgugcagagaccccagccacucugugugggcagggugcugucaagaccagaccucuuggggggguaggggcggggggguggggggaacucuuggaagggaagaaguaucacuucuuucucaaguggaguguuuacaccuugcuguaacauuugaacuuucacaagagauguaauaauuuugauaauaaaauucuuaaccauaauaaucauaaaguugagaacuucuuuguccaauuuuguggcccugccuugccugguuuuccuaaugccauuuuuaucugaggagaaugugcccuugguggaguuguuuugcccaugauaauggggccaggaauacugucugaucuuccuucgcuuuuuaugauugcagucaggacagugugaaggcaaaccugcagcagggcaagugaacauuaaaaacugccuugaacuugagugguguuccugaccuuggccucauucauucagcaacuauuuauuggucuuuuucauucaaaaacaaugcuggacauuguuuuuggugcugggcuuauggugauuagaaugcugauugggggugggcaaaguaaggucucuucuuucauggaguuuacauucuaguggaggagagaacuaaacuaguauauaauuuuaaauagucauugccauguuaauuguuucauagcagauaugugacuaagacaguugaaggagccacucuagauugguuggucaagaaaagucucugaggaguugacauuuaaacugagacuucagugacaaggaggcaguccugggacgaugugagugaaauucauucuugaacguugcagacucugugguagaaaaagcuugguuaagauguaauaaauggauggggcugggaaagaggauagaagauccuguaagagggagauaggggacagaucauguagagcaggagucggcaaacucuuucuauaaagggccagauaguaaauauuuagacuuugcaagccauguauggucucugucauaacuauucagcccuuuggcugggugcgaaucaugccuguaauuccagcacuuugggaggcccaagagagcagaucacuugaggucagaaguucgagaccagccuggccaacauggcaaaacccugucuacuaaaaauacaaaaauuaaccaggugugguggugcgcaccuguaaucccagcuacucaggaggcugaggcaggagaaucucuugaaccugggaggaggagguuauagugaaccaaggucacuccacugcacuccagccugggugauggagcgagacucugucucaaaaaaaaaaaaaaaaaaaaaaaaaaaaacaacuauucagcucuuccauugcagugcaaaagcaggcauagacaguauguggcuauguuccaauaaaacuuuauuuacaggaaacaaguggcaaguuggauuugguuugcaggcuguaguuugcuggucucuaauguagaaccuuguagguauaauuuaaauaaucugcauucaguaaguacaguggaggagucauugcaggauuuuaaggagagaagugacauugucuaauuuauauuugguugauuuuuaaaaauuacucugauuguuuugauccuguuggugaagagaugaauaggagcugagaaacugguguggaagguagagcaguuguucaggcaagcaacaaugcagugguggcuucuauuaagacgguaaugauggggauaagaagugauuggagucaggauauguuuugcaaguacacagcagaacuugccaauggauugaauuggcaguauucuaacauuuguuugacaaauguuuacugaguaacuaagguagacugcaguuugcaaagcacauaagggauucaaagaugaagaugcuauuuauuaguugaaggaguuuagaaauggaaggcugggcgugguggcucaugccuguaaucccagcacuuuggggggccaaggcaggcggaucacaagaucaggaguuugagaccagccugaacaacauggugaaacccugucucuacuaaaaauacaaaaauuagccgggcgugguggugcgugccuguaaucccagcuccuugggaggcuggggcaggagaaucgcuugaacccaggaggcagagguugcagugagccgagaucgugccacuacacuccagccugggcgacagagcgagacuccgucucaaaagaaaauagaaaguggaaacauaacaaaaccacuuguuuuauuagaagaucccuccaaaaugcccuaggaauaccuagguaaccuaccaccaaccacaaccugauucuaccuggguuaggaagagaauagugugcaugaucuuuagaaaguguuuccauauacagugucuuauuuugacucauaauucugugaagaaagcaagccaaaugccagaaguuaaagaugagaaauugagaccuaguacaguguuucagcuauagcacugggcuucugauaaugaauaaaacuaacugauuucugccauaauuggaagguucuguuccaugaccauuggcugaacaccuacugugugcuaggcuauaucugaggugcugagaauaucaagguaagacagucaacugcccauucagaguuaaccuauuugcuauucuuuucaaguacuuacuguguugcuagggacuuugcuuuugauaugguguaaaucagagguguccaaucuucuuggcuucccggggccacacuggaagaauuauucaacauguaaaauacacuaacaauagcuaaugagcuuaaaaauauauauauauuuuaagaaaguuaugauuguguuaggccgcauucaaagccauccugggccacgugcagcccguggucuguggguuggacaagcuugguguaaauagaagcuagacaauauuaauuaaagaggccagugcaacaguggcaccuucuaugucacuuuacacuuuccuggacuccacuuaagucaucagcuaccucauuuacauguaacaaugugcaagguagguauaaguucagaagauacaacuuauucaagauuucucucuuuuaaguggcagacccaaaccaacaguuuuggaaauuuugcaguuaacccagaaaacaaauagaaacagcuagagaugcugugacacuaugaccagaaaucacuuaccuagcugaaaaaguauaugguacccuuuacugucuuaaaaacagcagucuggcccuuuugccccccaggugucaguuugacaguguaggguucucuguuuagcagagguuaccaugaagaaaaaaaaaaaaugcaguuguccaaacgaagcaggcccuuugcuuuuaaacugcacugaugacaacccgcauaaucugcugugaggcucagagaaaggaguugaccgaggguucguucuguuuuuauuuuaagagacagggucucacucugucacccgggcuggaacgcaguggcauaaucguagcucacugcagccuuaacccuccagggcucaagcaauucuccugcaccaccacgcccagcuaauuauuuuuuuguaaagacagggucuugccauauugcccaggcugggcucaaacgauccuccugccucagccucuaaagugcugggauuacaggcaugagccgccacaccuggccugccagggguucuuaaaauggucaguucuaaagauagaugauggaaacaguuuggaggagagcauagucauugaaggagauggugcucuuguaacuuuuaccugcuccugcauuaaaaaauuaacuggcagggauucugaaaucaugguuuuacuauuucucaaauuacccguuaaagcaccacaaagcagccaugauaggaaaccuggaaaccuuggacaacuugacagcaaaacuagguauccccagaaacccccaaacaaaaaacggguagagauaaaccacuaauagccacaagaccagcaugguaucaccaucuguucuaguggaagcaauggcacaucugauggaucucagaacuucaaaauaacaaguacucacuugaggccgggagugguggcucacgccuguaaucccagcacuuugggaggccaaggcgggcggaucacgaggucaggagaucaagaccauccuggcuaacacggugaaaccccaucucuacuaaaaauacaaaaaauuagccgggcgugguggcaggaggcugaggcaggagaauggcgugaacccgggaggcggagcuugcagugagccaagauugcgccacugcacuccagccugggugacagagcgagacucugucucaaaaaaaaaaaaaaaacucacuugaaagcucaccaagccaauuugagaacagcagcugaaacuagguggcguuugcagugaguacaaaggaugcuugauuaggccugaaagggcuggaguggucuggaccuaagaaacuuaauucaaagcccuuacaggacaaugccccacaccaaaauuccuuguuagaauccaaacugaacaggacaugcaaaaugaaggaaggggguguggagggauuaaauuuauuagauuaaaugaaguauuuugaaaaauaaaauuaugauuaucccauaaaauucagaauguacuauccuuacagaaauaauauaaagauauuaaauaacuuguucuuuaacuccugagagaaacaauuguucauaaaguugcaagcauauucuguguugaauuguugaauuuaaauagcuaugguucacacaguccauauuucaauauuucacauacacaccaaaaaugagaauacaaccaugaaaugaaaaacuaucauaagucaugccuguuuuuuaaaagugcaaaaucacuaauuucauauaaaaauggauaacagaaaaacgcaagucuuaaaaagcuacaaguaaaaaugagcagaauaacaucuauagagacaaucaaaguaugccaaagacaugcagguaaaacauuaaaaaguaacaaauggcagggcaugguggcucacaccuauaaucccagcacuuugagaggccaagguaguuggaucacuugaggucaguaguuugagaccagcuuggccaacauggugaaaccccaucucuacuaaaaauacaaaaauuagcccggcauggaauuagccaggcaugguggugcacgucuauaaucgcagcuauucgggaggcuggggcaugagaaucguuugaaccugggagguagagguugcagugagcugagaucacaccacugcacuccagccugggcaacagagugagacccaucucaaaaaaaaaaauucuuuauuuucaaaaguaacaaauaucucaggaaaccagaaguagagaggaacuuacucaauuagaacauuuacaaaaaccuagaugcuuuucuugauaaggucaggaacaaggcaaggauguccccucuuaucacuccuuuuuaauauuguacuggaaguccuaaccaaugcaauaggacaagaaagggaacuaaaagggguauauauugagaaggaagaaauaaaacuucauauucacagaugacaugauuguugauguagaaaauccaaaagaacccuaaauagcccuccaagaccucuggaacuaauuaagcaauuauagcaagacuauaggauacaagauuguugugcagaaguuaaucacauuucuguauauuagcaaugaaaaauggaauuugaaauuuaaaacaaagccaggcaugguagugcacaccuguagucccagcuacuuggaaggcugaggugggaggaucacuugagcccaggaguucaaggcugcaguaagccaugaucguaccacugcacuccagccuggaugacagagcaacacucugauacuaaaaaauaaacacaagaccauuuaaauuagugcccaaaggccaggcgcaguggcucacgccuauaaucccagcacuucaagaggcugaggcaggcagagcaccugaggucaggaguucgagaccagccuggccaacauggugaaacuccgucucuacuaaaaauacaaaaauuagccgggcgugguggaggacgccuguaaucccaacuacucaggaggccgaagcaggagaaucacuugaacccagcagacagagauugcagugagcugagaucacgccacuacacuccagccugggcaacagagcgagacuccgucucaaaaauaaauaaauaaaugcauaaauaaauaaauaaauaaauaaauaaauaaaauuaaaauaaauuaguacccuaaaaugaaauacuuagguguaauuccaacaagauacguauaagaccugcaugacgaaaacuauaaaacuaaugaaaaaaaucaaagaucuaaauaaauagagguguucaugaauaggaagacuaguauugugaagauaucaguucuucuaaacaugaucuauaaauucaaugcaaucccaacccaaauaccagcuaguuauuuuguagauaucaacaagcugauucuaaaggggguuugucuguuuuguuuuguuuuuuaaggcagggucuugugcuguuauguaggcuggagugcaguggcaugaucuuagcucauugcaaucccuaccucccagguugaagugauucuccugccucagccuucugaguagcugggauuacaggugugcaccccuaugcccggcuaauuuuuguaguuuuaguagagauggucucaccacauuggccaggcuggucucgaacuccugaccucaagugaucugccugccucagccucccaaauugcugggauuacagacaugagccacuguguccggcuaauucuaaaguuuuaaacuaacacuaccucaacacaucauaaagcugcaguaaucaagacagugugauaucagcaaaagauuaggcaaauagauuacuggaacacaauaaagaguccagaaguagacccacacaaauagaaucaucugaucuuuggcaaagaagcaaaagcaaaacgauagaguccguaauggauggugcaggaacaaccagacauccacgugcuauauauauauauguguguguguguguguguguguguguguguguguguguauauauaugaaucuauacacaucuuacauccuucauaaaaauuaaaauggaacacagaccuaaauguaaaacuauuaaauuccuaaaauaaugaacauuggagaaaauccagauaaccuuggaauugacugacuuuuuagguacaacaccaaaaggaugauccaugaaaaaagcaauugguaagcuggacuucauuaaaguuaaaacaucgcucugcaaaagacacugucaagagauugagaagauaagccacagaguaggagaaaagauuuguaaaaaacauaccugauaaaggacuauucaauacaaagaacucugaaaacucaacaaaagaaaaauaaaaacccaauuuaaaaaugggcaaaagaucuaaacagacaccucauauacaaaugacaaguaauuguaugaaaagacucccaacaucauaaaucauccaguaauugcagauuagugcuacaaugagauaccaucauacaccuacuagaaugguaaaucuaaaacacuuaaugaaaccaaaugcugacaaggauguguaacagguacucuucauucauuguuggugggaaugcaagaugguacagucacuuuggaauacacuucagcaguuucuuuaaaaaguaaacauacaauuuggcuguugcacucuugcguauuuccccagaauugaaaacagguccacauaaaaaccagcaugugaacauuuaucacagcuuuauucauaauugcaaaaacuuggaagcaaccaagauguccuucaguaggugaauggauaaguaaauggugauacauccaauggaauauuauucaguguuaaaaagaaaugagcuauccuauacuauaaugguguauaaaucacuuaauauaaacucuaguaugaagguuaaaagacaaauauuuaacuauacuacaauaaucuguuaauggauauacaguauaaaaauauguaagucauuacuuuaaagauauaaaugggagaaaguaaaaguauacaguuuuuguauggaagugauuagcuuaaaauagaugacuguuuuaagauguuuuauguaagccucaugguaaccacagggcaaaagucuauacuagauacacaaaagauaacggguaaggaaucaaaccauuccacuguaaaaauucaucacuucacaaaggaagacagcaaaaggggaagaagggaacaaaaaauuuacaaaaacagaaaacacugaacaaaaugacaauaguaaguccuugccugucaauaauucccuugaauguaaauggacugaauucuccaaucagaagacagaguggcuaaauggauaaaaaacaaaucccaacuauaggcuaucucgcugucucacuaucucaaugagccaucuaccauuuucauugcaguauuauucacaguagucaagauaugaaaacaaccuaacuguccaucgauggaugaauggauaaagaaaauguuggagaugcauuauauauacaaaaauguaaaggugcucaccaucacuaucaccaauuaucaggggaaugcaagccaaaaaccacaaugagauaucaccucauaccuguuagauaugugugugcaugccuaucuauauauagguauauauaugcccacacauaguacauuauuuuauuccacugcacauauauauguauuauauauauaugcacacacacaguaacauuauuuggccuuuaaagagaaaaucuugccauuugcaacaacaacauggaugagccuggaggacauuauacuaagugaaacaagccagacacugaaaaacaaauacugcaucucacuuguauguggaaccuaaaaaagucagacucauagaaacagaguagaagaguaauuaccacgggucaagggauggggauuaacagggauauguuggucaaauaguacaagcuuaccguuaugggugcauucuggagaaccaaugugcaguaugguaauuguaguuaauaaaauauguuguauacuugaaauuugcuggaagaauagaucuuaaguauucucggcugaccgugauggcucacaccuguaaucccagcauucugggaggccaaggugggcagaucacuugagcucaggaguucaagaccagcaugggcaacauggcaaaauccccucucuacaaaaaauacaaaacaaugagcugggcaugguggcaugugccuguagucucagcuccuugggggguugaagcaggaggauuucuugagccagagaggugagguugcagugcgcugugaucaugccacugcacuccagccugggcaacagagcaagucucugucucaaaaaauuaaaaauaaaaagcauucucaccagaaaaaaagguaacaauguuaggugacagauauguaaacuuaauuguaaucauuucacaauuguaaucguuucacaauguauauauaugucaaaacaucauauuguacaccuugauauaccguuuuuuuguuaucaacuguaccucaauaaagcuggaaugggacggagaaaugagcuaucaagccaugaaaaaaacauggaggaaccuaacaugcauauuacuauaugaaagaagccaaucugaaaaggcuacauacuauauuauuccaacuacaugacauuacggaaaaggcaaagauaaggaugcagcaaaaagaucagugcuugccugagguuaggggagagggaaggaugaacagguagagcaccaauggauuuuagggcagugaaacuguucgguaugguacuauaaugguggcuaaacaugccauuauacauuugucaaaacucagaauguacaacaagagugaaccauaauguaaacuauggacuuugagugaaaaugauaugcuaaugcagguucaucaguuguaaaaauguaccacucugguggggaauauugauguagggggaggcugugggugugugggaggaaagagauauauugggacucuguacuuuccacuaaauuuugcuguuaacuuaaaacuguucuugggugggagcagugguucacaccuguaaucccaacacuuugggaggccgaggcggguggaucaccugaggucuccugaccuuagguucgagaccagccugaccaacauggugaaacccugccucuacuaaaaauacaaaauuagccaggcgugguggugcaugccuguaaucccagcuacuugagaggcugaggcaggagaaucacuugaaccugagaggcagagguugcagugaaccaagauggcgccauugcauuccagucugggugacagagugagacuucaucucaaaaaaaaaccaaaaaaacuguucgaaaaaaugaagucuauuuaaggccaggugcaguaguucccaccuguaaucucuaaacuuuggcaggccaaggcuggaggaucacuugagaccaggaguucauuuuuuuuuuuuuuuuuuuugagauggaaucucacucugucacccaggcuagagugcaguggcacgaucuuggcucacugccagcuccgccucccagguucacaccauucuccugccucagccuccugaguagcugggacuacaggcacccaccaccacgcccggcuaauguuuuguauuuuuuuuuaguagagauggaguuucaccauguuagccaggauggucucgaucuccugaccucgugauccacccaccucagccucccaaagugcugggauuacaggcgugagccaccaugcccggcugagaccaggaguucaagaccagccuaggcaacaugagacccugucucuauuuuuuuuuaauuuuaauuuaauuguuuaaaaagaaggaaaaguaaagucuaaaaaaagggacaaacagaagacaggcaaagaagaggcaccauauguauaauaggaguucccaaaaaaguaaaaguaagguaacagaacaaauaucaaaagcuauaauuuggcaaggugcaguggcucauacccuuaauaccagcacuuuggaaggccaaggcagauauggaucacuugagaucaggaguugaagaccagccuggccaagaugguugaaccccaucucuaccaaaaaauacaaaaauuaccuaggcaugguggugugcaccuguagucccagacacucgggaggcugaagugggagaaucuauugaacccaggaggcggagguugcagugagccaaguuugcaccacugcagccugggugacagagcaagacccugucucaaaauaaaaauaaaagcuauaauuuaaggaaaguuuccugaaauauuuuaaacuacaaagugaaagagcauauugcauaccuaguaaauucaauccagaaugauaaauaaugagauauuacaguaaaauuguuagauuuuaaaaacaaaaaaaucuuaggcaaauacacacacauauuuacacacacacaaucaugucaauaggaauacauucuagaaaguacaucuuuaggugauuucauugcuauaugaauaucauggagugcacuuacacaaaucuagaugguguagccuaccucacaccuaggcuauacggcauagccuauugcuucuaggcucaaaccuguacagcauguuacuguccugaauacuguaggcaauuguaacacaauauaaguauuuguguuucuaaacauaucaaaacauggaagagguacaguaaaaauaccgcauuauaaucuuaugggaccacuaugcaguccaucauggagggaagcaugcaguucaugacauguguggguguguguguguguguauuuguuacuuauaaggcaaagaaaauuaggcuguaucagacuuuuugacagcaacacuuaaauggcaaaagaggccaggugcaguggcucacaccuguaaucccagcacuuugggaggaugaggcggguggaucacgaggucaggaguugaagaccagccuggccaagauggugaaaccccgucucuacuaaaaauacaaaaauaagugaauguggaggcgggcgccuguaauuccagcuacucgggaggcugaggcaggagaaucgcuugaacuuguagggcggaguuugcagugagccaagaucacgcuacugcacuccagccugggcgacagagugagauugcgucucaaaacaaaaaaaaaggcaaaagcuaaugggauaauuuaagauaaggaaagagacaagccaagaauuuuguacgaacugaacuuacuuuccaggguaguagccacaaauugucaucauuaucaugcaaaaacuuugggaauuuuauuuucaugaauucuuccuuagggaucuauuggaaacugagcuucaaggccgggcacgguggcucacgccuguaaucccagcacuuugggaggccgagguggguggaucacgaggucaggaguucaagaccagccuggccaagauggugaaacccuaucucuaccaaacauacaaaaauuacugagcauggaggcaggugccuguaauuccagcuacucgggaggcugaggcagagaauuucuugaaccugggagacggagguugccgugaggugagaucaggccacuacacuccagccugggcgacagagcgagacuccaucucaacaaaaaaaaaaaaaaaaaaaaaaaaacugagcuucaaacaacaaaaagccugauaguauuacuuauauauacuuacaugcagaauagacugaaugagagauauaaggagaguauauacuacaaaaugguuuacgugaccugcacaauauagauagaguacaacuuuagauaaauaagcaggagagaauguguuaaauaaucauacuggcaguagucuaucugagugcuuuaacgugugauaaauaaauacagcguccuucagaaccaauauuucccaguguugggggaaaggagguauagcuguuaaagaaguuuagccaaaacccuaaguauuaauauuaacucaugaggcauuuuaccauagguacagagagaucccaugugucuaucuauguaucaucuaucguguauguaucuuugcccugucaacuggaaaggcauagaaacagggcuucuuagagaaauggcugauuccagguuuaggagaagaaaugucuaagauuagccuggaucaucuugucauaccagucaucaaggauacuaucaaagauaauuaggguuagcuuuaaagagaauuguguugcaacuuaaagagaauucuccugaccaaagauggaacauuugagcauuaauuaugauaauacauuacaacauaaucaaaucgaacauauuuaaauccaugaguucauagugguaccaaaauaaaauuguucauucugaaggauguuaaggaacuaacuuuguauuuuugaaaaauauauauauuuauauauuuugaaaggccgcagcauuuaucuugccuuuccuguuugaguuguaccacugaguaacuacauagcaaaugaugguaaguuucucuuuauagaaguauuuccacaaguaaauaaagagugauagaauuggaacaucacuauuuugcagcuccuaaugaauuaaagauguaagcauugaagauuaacagcaacuagcaacacaaaaacaaaaacaacucgauguuaagugucucuugaccaaaaaaaaaaaaguuauuaaaaugugagaacauacacuccugaaucugguuaaguaucuagauccaauuaucaauuugcugaaaauacagaggagaacagaagaacuuacugaacuaucccacaagaaugaagccagcaaaauuccaguggcagaacacuacguaacaaauggucugguuucuucagcaguaaauugcaaaggagaaaaagagauuaaguggggaaagacaugaagaaaaaagaaguggcaacccagcacaguggcaugcaccuguagugccagcuucuugggaggcugaggccagccugccugggcaacauagcaagaccucaccucuaaaaaaaaaaaaaucuggccaggcacgguggcucacgucuguaauccaacacuuugggaggcugauggggguggaucacuugaggucaggaguuagagaccugccuggcuaacgugguaaaaaccugacucuacuaaaagaaaaaaaauagcugggugugguagugcaucccuguaaucccagcuacuuaggaggcugaggcgggagaaucacuggaaccugggagguggagguugcagugagcugagauccugccacugcacuccauccuaggagaaagagcaaggcuccaucucaaaaaaaaaaaaacuaaaaaauuaagguuaagcuguauuguuuaaagaugcucacuugggugaaaaaauaaaaguuggggaaugauuacaguaaaaagauaacgguuauucuuaggagggagggaagagauggaguuuauaggaaacaugaagggcucuggaguagcuggcagagucccaucuccuugguagcaguuagaaggguauguuauaauuaagcuguacauuuguuuuauucucuguguguuauguuuaagaaaacaaacagaaucugaccuggccacuauaaacuggcgaacagcucugcuacuaagaggccggagguaauuuguugagcucaugucugauuuauuucuauaugccuagagccuagcaguaccugaccaggguaaguuauucaauaaauguuuuguggggugaguacaugaguuugaagaagccuccaacccauucccacacccguuuuggcaccucacggagcuuuccagugccgcuggauggaucugugugggcaccccacacacuuaagcucugccuaaguggacuggaagggaguuucaaacuagggcucuguuuggaagugcgucugguaaacuccaccaaccucacccucugucccccaucccuuucaacaagagcguguucuguguccucuggccuccugacacucuacuccuacaaagcaguucucuucucccuguccgucuuucucucccaagcucucugcuguguauucaggacaucuucgcuuuuccuuggcagaaaacacuacuucccuccaucuaaucucuuggcccuugcugaauuguggccuuuccuuaggacauugccuaccuuguagcccauugaaguggaggcugcuggaucuuuuauaccuuguugcacagagguucucccuacguuuguccagacacauacaucuugucccucagauuaaaaacuccuccucuaccaaugcucccaccaucagugauuuuauccuuuuuuuuuuuuuuuuuuuuuuuuugagauggagucucgcucugacccccagccuggaguacaauggcgcaaugucacugcaacuucugccuccuggguuccagcaauucuccugccucagccuccugaguagcugggauuacaggcguaugccaccaugcccagcugauuuuuauauuuuuaguagagaugugguugccccauguuggccaggcuggccucaaacuucugaccccaagugaucugcccaccucagccucccaaagugcugggauuacaggcgugagccaccgugcccagccuauaucucuucauugcuauuaucuuuuaaucuuccaaccccucucugauucuuagauaacuuugacuagucugccccuccacccuaauuucugacauuuuccccaccauuuggauggacauccuaaccaggguuccugucaucucgaagucuucuucaagaucuacuuggaauauucaaaucaaacacucagcucucuacccacaaucaccuguccucccagcucuuucacagaaacuucagucccuugauccuaauauauucuccacuuacugacuccauccagagcuccccauguucaacacccagccuagaucucaugguggaucucaaacacucaggacacucaacucaccuugcaucuguuuucuacaaucuaccuucucuguguguacccuccugucuucucaugccaugacagauucaugauugucugucauuccuuuuauuuagccuuagcuccuuuaggaacaguuccaagauuucaccacccuucucaaaaccccucuucuuuuuuuuuuuuuuuuuuuuuuuuuuuuugagacggagucuuguucugucaccuaggcuggagcacaguggugugaucuuggugauccuggcucacugcaaccucugccucccgggcucaagcgauucucuugccuuggacucccuaguugcugggauuacaggcacaugccaccacgcccggcuaauuuuuguauuuuuuguagagacgggguuucaucauguuggccaggcugguaacuccugaccucaagugaucggcccaccucagccucccuaagugcugggauuacaggcgugagccaccgcgcccagccgagcccccuuuucucuuucaguaaacaaccuuguuuccugcuucacugagaagauggaugcuaucgggcaagaacgcacugaacuuuugcccugcccuccaccccgaaagagacguacgucuuuucagucccucaccucuucuccaguguuucugaauaggauaucucuuuuaucuucaagaccaacuuccauacccugggcugccuuacguucaccucccuggagacccuguuccuuuagucauccucucuucuuuaucauuauccucuuacuugccaugaccagugagcauugggaaugccacauaaguaaagagagguuccacacccgcuccagguaaugcuguuccuugcccacugcugguucacggaguguaauugcuccugccugaaugaauuccagucacucauuuccccuucuuauccacacuucucuaaauaguaaucuucaacccgucgccucccacucucucccugaacagaccucaguuuggcucuccccacacuccugaacaugcucuuaucaaguuucagggguggccuccuuguccccaaauccaauggacacauuuuucagucucuuauacaggaccucugugcucgacuugaccagcugacuuuccccuuaaacucuacauccuugguuucuauaaagccacacucaugauucuccuccugaccccucuccuuuguggacaucuguuccucugacagugcuuuauccugcagugcucuccagcauuccagagcuccaugcucucuccacaccacacagucgcccagagcaggcuccucuaugcuuccaguuuccaccacuaccuggauaccgaugcuucugacccagauuuuucucuugagcucccaaauccauaugucagcugacugcuggacaacuccaccaaggcaucucacaugcaucuuaaacuuagcacaucucaaacggaacugaucaucuugcuccccugcuauacuggcagaucuuucuaguccccaagcaaaaacuuuaacccucuuuuugccagccuguguguuauucccauagucaguugguucccuucuacuuccugaagauggaacuucuuacuucucuuagacccacugcgaccuccuuguuucaggccaggcuucugguuucucuuuuacugaaguggucucugauaugguuucgcuguuuguccccaccaaaccucauguugaaaugucauccccaguguuggcgguggggccuggugggaggugaguggaucaugggggugggucccucaugaaugguuuagugucauccccuuggugaugggugaguucucgcacaguuaauucacacacaugagaucugguuguuuaagagccugggacugcccucuucucucugucuugcuccugcccuugccgugugacacgcuggcuuccccuaaccuugcaccaugauuguaagcuuccugaagccucacuagaagcaaaugccagcaacaugcuaccuguacaguuugcagagccaugcgccaaaauaaaucucuuuucuuuauaaauugcccaguuuggccaggugcaguggcucaugccugcaaucccagcacuuugggagacugagacaggaagauugcuugagcccaggaguuugagaccagccuggguaacauaacaagaccccguuucuauaaaaaauuauaauaauaaggccgggagcaguggcucacgccuauaaucccagcacuuugggaggccaagguggguggaucacgaggucaagagaucgagaccaucuuggccaacauggugaaaccccaucucuacuaaaaauacaaaaauuagcugggcgugguggugcacguguguagucucagcuacuugggaggcugagacaggagaauugcaugaacccgggagacaaagguugcagugagcugagaucaugccacugcacuccagccuggcaacagagugagacuccaucucaaaaaaaaaaagagauagccaggcaugguggugccuauggucccagcuaccugggagaaugaggugggaggauugcuugagccugggaguugaggcuacagugaacugugaucucaccacugcacuccagccugggugacagagcaagacccugucucaaaaaaauaaaaauaaauuaugcaggccaggugcaguggcuuaugccugcaaucccagcacuuugggaggcugaggcggguggaucacuugagacccggaguuugagaccagccuggccaacauggugaaaucccaugucuacuaaaaauacaaaaauuagccgggugugguggugcacaccuguaaucucagcuacucaggaggcugaggcaggagaaucacuugaaucagggaggcugagguugcagugagcugagauugugccacugcacugcagccugggcaacagagggagacuccaucucaaaauaaauaaauaaaacaaaugaugcagucucagguauggcuuuauaacaaugcagaaaugggcuaacagucuaccccuaauccagcccccuaaugcuaccaccagagugcucuuucuaaaaugcaaauugagucauuuuuccuucugcuucaaauccuucagugguuccccauugcucuuaaguccaaacuccuguccauggcccccaagcuuucucauggucuggcccucgccugucucucuagacucaucucugacuccucccugccucguacuucacauuucaaacuaaguugcuuuucguccuccauacacaguucugcugccuaccucagucuuuuuccucaagcugccuucucuuugaccuuccugaccccuccugccuaacuucucauccuacagcaagaccuccuccuacgcugcccacgucaccaaaagccauuuaaaguauuccugccuaggauacccacaauacccugcauguggcaagucaugcguuauuuucacauguucaucuccccaaccagaauuaugcuuaagacagcaucucuguuuugcucauuuuuuuucuagcuuaagugcuuagcauacacuaagugcuuaaaauguguuggaagaggacuccauuuccaagucuucaauguagcuaccugguacugcgcacauuacagcgugccagauacccugcagagcaaagugcauauauucccugguauguugcuuacagcuucccuugggggagucacuauuguuuucucuauuuauucaauggggcuuuagagagaggcaaagugacuggacugagcacucuggcuagagcagaugaggcucuacucuuuucugccuguauggacuuggacaagucgugccugugcugucagaggugugcagagauuacuguaucccucucucuauucacuccuuucuccuuuguaucagaacccuauuuuuuuuuuuuuuugagacggagucuugcucuguugcccaggcuggagugcaauggcgccaucccaccucccugcgaccuccgccuccuggguucaagcaauucuccugccucagccuccugaguaucugggauuacaggcacgcaccaccaugccuggcuaauuuuuguauuuuuaguagagacaggguuuugccauguugaccaggcuggucucaaacuccugaccucaggugauccacccaccucagccucugaaaaugcugggauuacaggcaugagccaccuugcccggccaagaaccccaguuuuauuugggcuggcaaugcgccgagauaacagaccacacuuuuucagccuccuuuacuguuauguggcccaagugacacaguccuauggaauuuccagaagucuucaaaugaaauguggaccaggugacuggagcuccagcagcccacguugggccaugagguguucuugaggauguagccaggauugaaaauggcagugcagaaagauaggagccuggguucuggauaacacugagagccauaucagccgugaucuacccaccuccaggcuuuuuuuuuuuuuuuuuuuuuuuuuaaugugaugguaaaauaaacuaucuuguuaagccacaguaguaggguucuguuaauaccagacaaaccugauccauaggguuggaaucuuaccccucuugaucccagugacucagagaaguggcagccagcgugggugauagaaaguguuucuuuauuugaaugucauuccaccugcacugaagcuuaaacccagcagcagcagaaggggucaggaccaaaauaaauguuaccaaauuagacaaugaacagcgaggacacacucagacaaaacuuacuaaugggguauagacaacaccaagcuauccuaacagcacacagcacaggcccucggaggccugcccaucagagcucugcggaaggcucccuuguucccuguucaggaaacuccagucccacccaaagguuagccgugggccaggcaggggccugcagaaguuucuggugcugggaacaucccagcuucuccaaagacaggguuucccuuucucuuucucaguucacacuggaagcuggagaaagguuauuccccgugugcccaagcaggaugcucaaaaggccagggacucuccccacagccuuaucuaaaaguucucaucaucuuggcuaucaggccugaaaaggaucuugauucuuugguccucacccccucaggaaaguuuuccuucauggguaccgguccccaaagacgaaaguuuucauagccccgguucccagaaggacucaacugaccagacugugggccagggacugaaccaccccuaggcuguggcugccguggccucuccugaguccccagaucaggcagagaaaagcgggcaauggcagaccccugaucacaguuaggggggucacaguuagggggggacuucucuugggaccugaagccggaaggcucuagguuggagcccaacaaggcccuccuggggucagaaacaggcacugaucuccucugcuuaccuccuccugaaggcuaaagccagaucgcccgacgagagcagaggcaaaccacaaagcccccuucccaugaugucuuuauugccccaggagggccaucagggccucaccuggggcccccacuggagcaccugccaccugccccauccacaccucugcagaacccagggccccagucuaugguuugguccccacucugacuucuaccccuugccugugucacccugggguucccgcagacuucagcccacacaacucugccuuccugacuccaaacucccuggugcaucucccccuggcucugccaagauggcagcuggccaggugcgguggaaugggaauguugccaggcuaccccaccagggaacuagccucccuccucuccacccggcgcugacccacuccuaagucagcuggacccacuacguccucugaaguggcuuccuucacuccaguucuucccaaaaggaugcggccuuggcugccugugccccgggccuccagccucugaaaggucaguucuaucccccgcaccagggcacagguuugguggguguccuuggggaacaagguguggcaaggacaccugguggcaggcguccuugggggaacaagcucuccccucacccagugcccagauagcaacccccuccccacugccccgcauccuggcuccuucauccuccucuccuuccucugcaucccauucuugcccccaacccacaucuccauuuaccucuuccccgcucccgaguccuuuuuccgccuuuucauccauuuccccucccccaccccaagcucucgggcagccucucagcuggucucucaucucucuccaccucugccccgucucucucgaucucuccuccucgcgcuguuucucugugccugugcgucccccucgcuccuucuccaaucaucucucaucucccugucucugcaccccucuucuccucaccccagugucuucucccauucccagucgcuugcugcgccccuccccucacucucuccuaacucugcucucccccuccaacgcugggcuugguuugcaucuuugaggaacucccuccuaccccaacucccucccacggggcucccgcauccucccgcauuuaacucggacccucugucccgcagcgccccuaccccaggccgacuggacuguccgggaaggcgccggcggggaaggggagcccagcgcugggaccagagcacugcggggaggcuuugcccgggaggaguaaguggaggagugaagucgggacuugguaaguuccagguggcaggaacccacuaggucccaacaucugauuccggcuaggguccagaguggggagacaggcaggggacuucuagggucuuucuuggaaacccuaacucucagguccaaguccuguggaaaugaacacaagguuggcaaacacauggcgcucaagcgacccucuccccuccgccgaggcccgaggcggcuuccccuggcauccugcagggcaccgccccuucccugcagguccaggccgccaggagggggcgcuggacgaagccggucugcaccagcaacuagugcugagggagcuguccaggccccagggcagggaggcuccccgggagagauggcucugccgccagacccacaggggaaugacggguguucaaaaaauaccaggagucucccucaccugcucccugccaaggggaagggagacgcccccacaguggguggaggggggagaaacuucucaccugucccccaacacacacacacacacacacgcucacacgcgcacacacacgcacacacauuucacccacauacacauacacucaugccucggcuccaagcacugcccauaggugcagacccugggcauaucgcaaggcgagaggugggccaggaggaggaagaggcugggacaggguaacaaggcuuaggaagggggacagggguacccuguucagagaugaccugcaaguucaaguuaugcagaaaaguaucaaagagacaagacagucucugcccuugguagacgccugggguauggagggcaugaaaaggggcagaagggguaaugcaucccccaacuccccaccucugggguccccuccacacccccaacccugacaacagggccaagaagucugugcuguacaaaacaggccagggucaaggguccagucauuggugagacaucccagcagagaggaggccugggcaaaagaggccaaggucaagggcucagucaucagugagauguuccagcagagaggaagaggaggccaggccagcccgggcugagcagcuucuaagcuccaacugccgaggccacguacccccucccgcuaccuccagagccugaaagucuuuucugacucugggcugaucagggccccggucugcagcugacagcagggcccugugcaucccucggugcagcucucccucagggugagcugggagcaggccggaauggagcagaggaggucccaggggagacugguggcaccuggagcuuuguggcagaugugguggaaccaacaucagccaaaaaagaaaaaaaaaaaaaguaggaaagaguccagcccacccuggagcaguaucuagaauaaauuucuugaagaggcagggaccagaagaggugcggauacagccaggcggcagcccuccagacugagggggccuggggagcuggaacuacagcuccgcucucccuggggaucugcagggaccuccaggccagucuagagaggagaggagaagcccaagggccuacgcagaugcaggcucccuuaggucaaauugagggaggagcaagaauuagacccucccaagguuuggagggccucuccucucccccaggccacauccaggcuuuccucuccucaaagccuggagcuugcaggguagucggugagaaguaagucugagaucagggucuucccucagagcuugaauggagugacgagagggcagaaggcaggacaagcugaggucaggccaauuacugggcugugauccuggccuuucagggucccugugagugagccacggggcagggaaggacuccccauccagagacaucacccccgggccgcaacacggagcuuacuguagagcccacaaaaucuaagagagagagagagagagagaaggagagagaauuagagaaagucagaggcugccugggcauucaggcuuuccuugcacauuccccagggcacaagugggcagaggggccgggcgcgguggcugacgccuguaaucccagcacuuugggaggcugaggcggguggaucacuugaggucaggaguucaagaccagccugaucaacauggcacaacccugucuuuaccaaaaauacaaaaaauuagccgggcaugguggugcaugccuguaauuccagcuacuugggaggcugaggcaggagaaucgcuugaacccaggaggcagagauugcagugagccaaaauugcaccacugcacuccagccuaggcaaaaagugugaaacuccaucucaaaaaaaaaaaaaaggucagaggggcagaggggcagacugcacaagcgcugaaauccuagccucaccugaccagcaggauggccuugagcaagccauuuaaccucucugagccccgauuuucucaucugcaaaauaaggaucauagccuaccucacaggguaauuccgaagggucaaaaagagacaaauaaugacagccaaggacuuggcaguguuuggucauagaauaugcuggaaauggaagcaauuuauuuaucuauuuuuucuuugguuccagaggucuucuuuaaauauauauauauauuucuuucuuuuuaauagaaacuggguuuuguuacaucgcccagacuggucuugaacgugugggcucaagcgauccuccugccucagccuguagcugggaccacaggugcgcgccauggcuuuuggcucggaggucuuuggguuaaaacugaagugggaggcucacucaucuugaacucccagugagggacggagacucccuggacacugaagggaggaaaacuggggcuccuuuacauugauuuuuaacacugaguuguuagggggcuuugggaagggaggagaaggacaccgagggggcccacuucacaucagucacauccccacaccccuucuugagaaaggccagaucucagucugucuugcacuucugaaagcugccgccagagggcaggccuugacuucacaccaaaaccacaguaaucccggggucugagggacugcaucagguauuuagaaccugccucugaguacagguuagcagaucagcaucccaggagagcucccaaagccgugcaggaaaucucuggcuucaccagguugagacaggggggaagagcuuggacuuuggacuuggaccuggguucagauucugccuucaccacuuaagugacuuugggcaaauuacuggagcucuggaguucucugaaccuggccuuuuuucuuuauuguauuuuaaugcuacuugauauauaugaaaguuuauaugcaauacacuaauuauaaagcauacaaugugccagguaagguggcucacaccuguaaucucagcacuuugggaggccaaggcggaaggauugcuugaagccaggaguucaagaccagccugggcaacauggggaaaccucgucucuacaaaaaauacaaaaauuagucaggcgugguggcgcaugccuguagucccagccacucaggaggcugaggcaggagaaucgcuuaagcccaggaguuugaggcugcagugagcuaugauugcaccacugcacuccagccugagcagcagagugaggcccccucccccaaucucuuaaaaaaauacaauaaucaacacuggugagcucaccauucaauaacuauaacucagccgggugugcuggcucaugccuguaaucccaacacuuugggaagcugaggcaggcagaucacuugaggccaggaguuugagaccagccuggccaacauggugaaaccccaucucuacuaagaauacaacaguuagcugggugugguggcaacaugccuguaaucccagguacucaagagcaagaggcugaggcacgaggauuacuugaacccaggagcuggaggcugcagugagccgagaccgugccacugcacuccacccugggcaacugagcaagacacugucucaaggaaaaaaaaaaaaaaggacucuaacgcuacccauaauuugcauauaccuccacgcuccagcucauauacuugacuuccuccccuuccaucauaaccacagaugaccaucauccuaccuuucauauuuauuauuucuuugcuuuuuaaaaaaauauacugccacagcugggcacgguggcucacaccuguaaucccagcacuuugggaggccaaggcaggcggaucacgaggucagaagaucgagaccauccuggcuaacacggugaaaccccaucuccacuaaaaauacaaaaacuuagccgggcgugguggcgggugccuguaguccuagcuacucaggaggcugaggcaguagaauggugugaacccgggagguggagcuugcagugaguggagaucgcgccacugcacuccagccugggugacugagugagacuccaucucaaaaaaaaaaaaauacugccacaaauacauguguguuuaaacaauacauugcuuaguuuugcuuacuuucgagcucaauaaauauaucacucugucaucuucuggaacuuguuuuuuuuuuucccccucucucaacauuauauuacugagauacauccacugugguacauauaacugaagugugacauuuucacagcugugagcugcucugugaugugaacaugucacguguauuuauccggccuccuguccauggccauugggcuguuuauagcuguuugcuacagugaagcugcagccaccagcgcccuugaacgcuucucauggguuuguacccgagguggguuugcugggucacaggcaaaugaucagaucugaggcagaacaucaaaucauuuaaaaggugguuguacugucaggcagguuucuuuuuuucuuuucuuuucuuucuuuuuuuuuuuugagauaggcucucacucuguaguccaggcuggagugcaguggcacaaucacagcucacugcagccucaaccuucucaggcucaggugauccucccaccucagccuccugaguagcugggaccacaggcacuugccaccacauccagcuaguuuuuguuuuuuuuuguuuuuuuguuuuuuuguuuuugagacagagucucgcugucucccaggcuggagugcaguggcgcaaucucagcucacugcaagcuccaccucccggguucaugccauucuccugccucagccucccaaguccggcuaauuuuuuuguauuuuuaguagagacaggguuucaccguguuagccaggauggucuggaucuucugaccucaggauccacccgccucggccucccaaagugcugggauuacaggcgugagccaccgugcccagcccaguuuuuguauuuuuuuagggaggggauuucaccauguugaccaggcuacucuugaacuccugggcucaagcgaucuaccugccuuggcuucccaaagugcugggauuauaggcgugagccaccacgcccagccaggguuuccaauucaugcaacccucuuacuccuuuuauuugaaauuauccugccucccaggaccaggccuggcucccgccgcugccccccagcccacagcacacucgccuuuguucuccggcuugagcuccuccugcagcaggucuguuugccgguugcccagcacgaaggcgaggaaggagaggaugagggcguugaggaugccgaugauggccaggauguaugcccagcgcacugaacagucccccagggaguacuuccccgucuuggccccacacaugucccggauggucucggcaucccagccaucaggaaagaucaugcagcccaggacgaggcacagagcugaggggcagagcaccgggcccaccaccacggucaggaaggaagagaaaagaccauuacucgcuaguguccgcagucugggccccacccuauugagggcacaucaacccaaccacgugcuuguuacccacuuccacagagggagaaagagagggcaggggcagggaaaagagagagagaaagaggucuacgauggguagcagaaacuuucuggaacccgcaaugcccucucccuuccccaugagaucaacuccuccuccaggaagcauucugggaauaugagaacauagccacccacagccaccuccuucaacuuccucuagcaucgggaccaacucccucucccaucucucccauccucauuauuauuauuauuguugucguuguuguuguuugagacggagucucgcucuguugcccaggguggagugcaauggcgugaucucggcucacuguaaccuccaccucccgggcucaagcaauucuccugccucagccuccugaguagcugagacuacaggugccucccaccauguccggcucauuuuuguauuuuuaguagagaugagguuucaccauguuggccaggcuggucucgaacuccuaaccucaagugaucugcccaccucagccucccaaaguguugggauuauaggagugagccaccacacccgcccucauuguuauuuuuuaaauucuuguccuucacccaucaaauguuuauugggcaccauuuuccuuuuauucacgaugcuagaauauacuuucauucaugcaguugagcacuuugcuaagagcacagacuauggagugccaaugauaggacuuagccuaguucuuccccuaacuuggcuguaugaccuuggcagaugccgcugaaccugaacaggccuguuucagucaauaccauuguacuuaccucaagggcgauuaggaggauuaaaugaaguaaugcgugcaaaacacuuagcacggugccaggcacucagguagcauuuauccagggccuaccauaugccaggcacuagaccaggccugcgggguggggagacuuggauuuuagcugcauggagcuugcaauguaguguggagagagguacguaauagcaaagcgauuaagaaggcugggucucaaauccuggcucagcuauuuucuagauaugccacacugagcaaguuccuucaucuuuaagccucaguuucuucaucuguacaauggggauaaugaugguauccucaagugguuguaaagauuauggaaggcagcaaaguguaaagugccuggcacaguaaguucuggguaaaucuuagcuguuaucaaaaccagucauaaugccaaaaguaauaauuacacaaauaagaaaguaauucggagaguugguuucaggugaggaggacaaaggcaaagaggaagagaaggggcaggcucagaagggccuuggcaaugguucccuagcuagcauccaccugcuuuggauuuagcaacccaccugucccaauccccgcccaggugggcccuuggccagcacuuagccuaguggaugagacccaagccugagcugaucagcacauugcacuccucugguaagagugacuggcuuggagaguggcaccuccugcgucacagggcagucagaacccccagauucagcaggccacuguagagauggggucuuccccuccaccagcucugcaucaccggcuugauggggcccucguauugccaguccugccaacauuuggguuacuguaucugagacccaaagguuccagagggcucuguuuggaaccguggggaccuugagccugcaccagguccacagggugcuuagccuggguuuuagaugacagcaauguaaagugggggugauggucagcucugcccacuguccaccuggcccaucuaguccccagggugggaaggggcccuuggcugugccagcucccucccacaucuaccauggagggaaugcucccaggccccagccucuuccggcuuccaacggagugggcccuccuucucaucguggcacugccagauuccagccaguccuccuccucuccccaacacgugcuccucuuccagaugcaggcuccccccacaauacuaugaucgaacagacacugcagcagggcuccuccccccaccaaugcuccuccuccaagucaauuauccacuccaguggaacucaccaccuaagggcugggaaaagaguugcagccaaagggaauggcaaaagcaaaguccugcggcgggaacaagcuggaugaguuaaagaauuagcaacuuugaacaggccagagcucaggggaaaaccggggcuagacaugcaaaucuggggacucugggcacuuuagguauuuaaaucucgaggacuggacaugguggaaacugaagagaaggcuuaggacugagcccuggugcuccagcauuaacagggcaggaggaggaagaggggccugcggagaaggccuggccgucaucucuccacauagcgcugcacuuugccagacccuccaggacccuaucugaaaggaaaggagggucaaacgccaaggaaggcaacggggcagggggaggaguggucucagccccaguccuucccccgcccucggaguccccagagcccuuucccaggcgggugcgcuccugccucccuauucccggacucuaaaucuccagcaagaggcaggagugggaacgagcccaagaagggggcaaacccacaccgucccuuugccaccucucuggucguccauucccguggugccagaggcgcggguccugcaguagucgguggcucccgccaggagcauccccgucuccguggaaaccgggccugcaucccggcgcucccagcugcgcagcgcuggcuccugcgggcgguccuccuccccuccgcaaccugagcacugaggccucagggagguuuucuuccuuuugcuuuccgccugcacguuuuuucugccucugucucucucuuucauucugugucuccauuccuuucucuuccccacccuuuucaucuuucuucgcaccccccucucucucucucuggcuugucuaccuagugcucaagucucagucuggacccccgccccucccgcuuuccccuuuauuuagaucuuucagcacuuaacauucauucaacucccuccuccucucuauuucuuuucucgcuucucuauaucuauccccuccccuuauccucucuuuuugccucucacuucauagaucccacaaauacaguccugcaugcccacuaugugccaggcacugugcagugugccggggacagcaggcugggugucugucuucagggcagaggcgugugggaaggaauacagccaacaagucaacacauaaauagaagaguuacacaugucaaggugugcuucaaaggaaaaagacuagcagcugccacccacaauaacagggguacucagagauggcuggggcacucacgcugcaggguuucagaugguggcuguggggccccagaggccacuccgggaaugggaaauaucagaagucaaacaaaugaaaagccaauuagauggguuccuugcaccuaggggaaagauagaaagggaccaguagagauagccuaggccaaggaagugcccaagagggccaaccaucaggagauggaaugacugcagauaaggcaggguucaguguucccauuugcuggaugaagaaacugaggcugaggcuuuugugcuccaagcucgagucucuuuuggaauaaugggcuggcugaagacccagcugcugcuaggcacauacacgggugcaggauggcacaagcuuucucagccucaaugcuuuugacauucaagcuagaugauucuucaugaggggccaaccaaugcacugugggauacuuagcaucaucgguggccucuacccaccagaugccaggggcaccaccaaacccagucauacugauuaaaaaaugucaguugggcauggguggcucaugccuguagucccaguacuuugggaggccgaggugggaggaucacuugaggccaggaguuuaagaccagccuggggcaacauggugaaaacacggugaaaagcacaaguacaugguggcauguacucguagucccagcuccucaggaggcugaggugggaggaucgcuugagccggaagaucaaggcugcugugagccaaaauugcaccauugcacuacagccuaggcaucagagcaagacaugguuucaaaaaaaaaaaaaaaaggcccuaauguaggggauuaucccuggcugaaaaccacugguguaggggcagaggcucuaggaugggauaucucuauccagcuaccccaugguccuacugacuuucucugcuccaagcagccaggagguguuaugacaaaauuaagaugaacaauguuaauauuuuuaauauugugauacuauuguuaaaaauaguguugaguggcccggcgcgauggcucaugccuguaaucccagcacucugugaggccaagacgaguggaucaccugaggucaggaguucgagaccagccuggucaacauggugaaaccccaucucuacuaaaaauacaaaaauuagcugggcuugguggcacaugccuguaaucccagcuacucaggaggcugaggcaggagaauuccuugaacccaggaggcggagguugcagugagccaagauugcaccacugcacuccacccugggugacagagcaagacuccaucucaaaaauaaauaaauaaauaaauaaauaaauaaauaaauaaauaagcagugaugagugcuuaacuaugugccagagugcuaaguuucugacuuucauuaucucauuuaauccuauuauuaauuuaaaaaauucagccuggcauggugguucacacuuguaaucccaggacuuugggaggccgaggcagguggaucacgaggucaggaguucgagaccaucuugucuaacacagugaaaacccaucucuacuaaaaauacaaaaaauuagccacgcgugguggcgggugccuguagucccagcuacucgggaggcugaggcaggagaauggugugaacccaggagauggagcuugcagugagcggggaucaugccacugcacuccagccugggcgacagagcuagacuccaucucaaaaaaaaaaaaaaugccaugaggugggaaaaaauaccacccucauuauacgaaugaggaaacugaggcucagaggcaccaggugucuuauccaaugucacauagcuuguaagugggggaaucuguauucaagcacagauaguuccuuacugcauguuuuucuuugaauaaacucacauuuuaacuucgaugcauuuacuugaaaaguaaacuuaaauuacuuucaaagagaaggaaaccaggaucauuugccauaaauagaaaaacacuauaaauguagguauaaugaaaucaaaacaauguucuuagaaucuagcuagauacuuuugccugccuagugcucugagccugagggccgauuucucuuuguuuaaaagaccuauuaguaagugugagaggaguuaaagaugcauuagcaccaaacugaaacuuucuccuuaaaguuauggaagaaauuggaaauggaaccaugugcucgccacuggcugccggaugcaucuugcaugugucugguguuugggaaacacaccccaauuuguccugccuccacaggaggcuuggcugcauccuuuacauggcgacuguuuuuuuuuuuuuuuuuagacggaaucuggcucugucgcccaggcuggagugcaguggcgcaaucucggcucaccgcaaguuccgccucccagguucacaccauucgccuuccucagccugccgaauagcugggacuacaggcgcccgccaccacaccuggcuaauuauuuguauuuuuaguagagacgggguuucaaguguuagccaggauggucucgaucuccugaccucgugauccacccgccuuggccucccacagugcugggauuacaggcgugagccaccgcgccggccuacauggcaauuuuagguagucaguuucccccucugggccucaguuucuuccccugugaaaugaggaucaugacauuugcccaacccauuucguagagcuucugugagaaucaaaugggagcugagaaguggcgcggcaguuucauaaggguggcgugugagcaggucauggugacucuuggcagagugggaaaauaauccugaacaaaggacuuuuucuagauauucaaaaaauguuaacaauggcugccuggggaaggagguaaguuuauuuuuuugcaauuuaaccaugacagagacaaauaucuugccacaauaucuauucaucccuucuuccuuaguauuuagaacccucaauuuuuagcuaagaccuugacuguagagaauaaagacugcauuuuccaaccucucuugcagucagaugugaccauaugacuaagcaaaauacauguagauguguucuguggcguuaaggaaacaacuuuauauaaacagauucauaaggaugcuaccggguacucuuugucccauuugucuucauccaucucuccauucagcugccuggaaugcagaugugauggucaggaauccagcaggcaucucugacaauaaagauaggggcuauaccccaggaguggugagcauaaagcaggaaguuucuaaugacuucaggggcuagcauaccagcucuggacugccucacucuaggacauuuuuuuguuuguuuguuuguuuguuuguuuuuuggagacggagucucacucagucgcccaggcuggagugcaguggccgcgaucucggcucacugcaagcuccgccuccuggauucacgccauucuccugccucagccucccgaguagcugggauuacaggcgcccgccacuacucccggcuaauuuuuuuguauuuuuaguagagacgggguuucaccguguuaaccaggauggucucgaucucuugaccucgugauccgccugucucggccuccgaaagugcugggauuagaggcgugagccaccgcgcccggccuggacauuuguuuuauauaagagauaauaaccuugggucauuuauuuuauuuuauuuuguuuuguuuuugcgacaggucuugcucugucacuuguuuugucuugcucugucaccaaggcuggagugcaguggugggaucauggcucacugcguccucgaacuccuggguucaggugcuucucccaccucagcuucccaaguagcugggaccacagguaugugccaccaugcucagcuaauuaaaaauuauuuugguaaagacagggucuugcuauguugcccaggcuggucucgaacuccuggccucaaaugauccucccaccuuggccucccaaauugcugggauuacagauguaaauuauugcacccagccuugggucauuaaacugcaauuauuuugguuuuucauuucacaugcagucgaaccuaguccuaacuggcauaauguuguauucuuuuugaauuuuguaucauguguauuuauugggaaaaaucauuuaacugugcgucacugggcaagucccuucaccucuuggugauaccugcuucucaaggucacaagguagacugaguggucaccaucaucgacuguaaugguaggacaucuccauugguuuuggggugugaggguggcacgugcacucuuguaaauguacuuacuccuugacucaacuuuauccuauggcuauauccuugauuauacacaaaggaugaauacaaggguguucgcugcaccaccaucuauaacaagggaccaaaaacaugucuacuaagaggcaucuggcuauauaacuuacggugguaucuaugccauggcauaguauuaauccauuugauugaauaggguacaguuguauauguugucaugaucuucuaagauauauuaauaaauaaaaagaagguuaguagugguggcucaugccuguaaucccaguacuuugggaggaugaggugggagaagcacuugagcccagaaguucaagaccagcauagcaagacucuuguuuccacaaaaaaauuaaaaaauaaaggcagucaagguacagaauacuguauauaguauaaucccaucaauuuuuaaauaggcuuuuuuuaagaguaguuuuagguucacagcaaaauugaguaaaauauucaaagauuucccauccacucccugacccuacacaugcacagccucccucacuaucgacaucccccaccaggguggcauauuugcuacaacagaugagacaacauugacacauuaucacccaaagaucauagcucacauuaaggauuacuccugguguuguacguucuaugaguuuugacaaauguguaaugacguuuauguaccauuguagcauaucauacagaguauuuucacugcccuaaaaaauccucugugcucugccuauucaucccuuccuccucccaaccgugggcaaccacacugauuguuucacuaccuccauacuuuugccuuuuccagaaugucauguaauuguaaucauacuguauguagccuuuucagacuuggacuuaguaauaugcauuuaagguuccuccauaucuccucauggcuucauaguucauuucuuuuuagugcucaauaauauucuauauucuggauaugccauaguuuauuuauacauucaccuacugaagaauaucuuguuugcuuccaaauuuuggcaguuaugaauaaagcugauguaaauaucuauguggagguuuugguguagacaugaguuuuuuauuccuuuggguaaauaccaagguguaugauugcugggucauauaguaagaguacauuuauuuuuauaagaaacugccaacaugccuuccaaaugacuauagcauuuugcauucccaccagcaaggaaugagaguuacuguugcuccacguccuaccagcauuuggugucaguguucuggauguuggccauucuaauaaguauguagugcuaucucauuguuguuugaaacuguauuucccagaugcauaugauguggaacgucuucucauaugcuaacaugccaucuguauaucuuccuuggggugucugcuaaggucuuuugcccaauguuuaauuagguuguuucuuuucuuauuuuugaguuuuaagaguucuuuuuuuaauuuuuuugagacggagucucgcucuguugcccaggcugaaguucaggggugcagucucagcucacugcaaccucugccuuucggguucaagcaauucuccugccucagcuucccaaguaacugggacuacaggcaugcucuaccacaccuggcucauuucuguauuuuuaguagagaugggguuuuaccauguuggccaggcuggucucgaacuugaccacaggugaucugacugccucggccucccaaagugcugggauuacaggugugaauuaccacaucccgccucaagaguuauuuguauauuuuagauaacaguccuuuaucagauaugucuuuuuuuuuuuuucuuuugagagggagucucccucugucacccaggcuggagugggaugaucucggcucacugcaaccucuaccuccuggguucaagcaauucucugccucagccucccauguagcugggacuacaggcacaugccaccagaccuggcuaauuuuuguauuuuuaguaaagaugggguuuugccauguuggccaggcuacucucaaacuccuggccucaagugauccacccaccucagccucccaaagugcagggacuauaggcgugaaccauggcacccggcccagauaugucuuuugcaaagauuuucucccaguauguggcuugucuuuucauucucuugacugugucucugacagcagaacuuuuuaacuuuaaugaaguccagcuuaccaacaauugggccuucaguguuguaucuaaaaagucauugccaaacccaagguaaucuagcuuuuuuuagccuauauuauuuucuaugaguuucacagguuucacauuuaugucugugaaacauuuugaagaguguaaggucuauguccauauuauuauuauuauuaucuugcauguggauauucaguuguuccagcagcauuuguuggagagaccaucucuuccccauuguguugccuuugagccuuugucaaagaucaacugacuguauuuaugugggucuguuucugggcucuccauucuguccuaucaaucaauuugcccguucuuucaccaguaccacacugucuuuuuuuuuuucucuugagacguuggagucucacucuguugcccagguuagaguacaguggcacgaucuaggcucacugcaaccccuaccucccagguucaagcaguucuccagccucagccuccugaguagcugagacuacaggcacacaccaccaagccuggcuaauuuuuguaauuuuaguagagacgggguuucaccauguuggcuaggcuggucucgaacuccugaccucaggugauccacccaccucggccucucaaagugcugggauuacaggcgugagccauugcgcccagccacacaaucuuuuuuuuuuuuuuuuuuuuugagaugggagucuugcucccaggcuggagugcaguagcucaaucuuggcuuacuuccaccuccaccaccuggguucaagugauucuccugccucagccucccgaguagcugggauuaggggagcccgccaccacgccgggcugauuuuuuauauuuuuaguagagacaggguuucgccauguugcccagguuggucuugaacuccugaccucaggugauccgccugccucacccucccaaagugcugggauuacaggcaugaggcaccaugcccagcucacacacuuuuaauuacuauagcuuuauaguaagucuugguaagucuugaaguggggguaguaucaauccucugauuuuguucuccuugaauauuguauggcuauucugggucuuuugccucuccauauaaacuuuaaaaucaguuugcuaauauggacagaauaacuugccaggauugugauugagauugcauugaaucuaaagaucauguuggcaagaacaaacaucuugaaaauaaugagucuuccuacccaugaacaugguauauauuucccuuuauuuuagcucuucuucuauuucuuucacuagaguuugguauuuuuuuucauauaaaucuuguaaauauuuuauuagauuuauaccuaaauauuucauuuugggggugguaauuagaauaauauuguguuuuucauuucacuuuuuccagucugagaaacagacagagacccugucuguaccaaaaaugaaaaaauuuagccaggugugguggcauguucccagcuacucagggggcuaaggugggaagauugguugagcccaggccacaguaagcuaugauugagccguuacacuccagacagggcgacagagcuagacucugucucaaaaaaaaaaaaaaaaaaaauccacuuguucauuucugguacauaggaaaaugauuaacuuuucuauauugacguuauauucugcaaucuugcuauaggagguuggguuuuuuuguuuuuuguuuuuuuuuuuuugcuugauucucugggauuuucuacauagaugaucauaucaucuacaaacaaagauaguuuuacuucuuccuucccaaucuguauuccuuuuauuuccuuuucuuuucuuauugcauuaaggacuuucagcaugauuucaaaaagcaguagugaggggacacccuugccuuguucuugaucuuagugggaaaacaucuaguuucuuaccauuaaauauaaugucuguuguagguuuuuuuggcaacuugagaaaauuucccccauuccuaguucauugagaguuuuuauugugaauagguguuaaauuucaacaaaugcuuuucuucugugauuacugauaaaaucaugugauuuuccuuccuuagucuguuuaugugaucgauuacauuaauuguuuuuuaaugcuaaaccagguuggcauacuuggaauaaaucccaauuggucaugguguaccauucuuuuuauagauuauugauuugacuugcuaauaauuuguugaugauuuuggaucuauguucaugagagauauuggucuauagguuauuuuuccuuguaaugucuuucucuaguuauaguauuaguguaaugcuggccucauaaaaaugaguuaggaaguuuucucucuguuccuauuuucugaaagagaauguagagaauucuuguaauuucuuccuuuaauguuuggcagaauucaccagugaacccaucagggccuggugcuuucucuuuuggaagguuauugauuacuaauucaauagauauagguuuauuuauguugccuauuucuucuugugugaauuuuggcagauuaugucuuucuaggaauugguccauuucaucuagguuaucaaauuuguguucacagaguuguuuaaaaaagcauuucuuuauuaucccuuuuauguccacaagaucuguagugauguuuuuuuguucauuucuuuuuuuuuuuuuuucuuugaaacagagucucacucugucaccuaggcuggaguacaauggcucacugcaaccucugccucuuggguucaagugauucucauaccucagccucccaaguaggugggauuacaggcgugcaccaccacauuggcuaauuuuuguuuauuuauuuauuuauuuauuuauuuagagacagagucucucucucuguugcccaagcuggaguucaguggcacgaugucagcucacuacaaccucugccuccuggguucaagcaauucucgugucucagccuccugaguagcugggauuacaggcgcaugccaccaugcccgucuaauucuuuguauuuuuaguagagauggggcuucuccauguugcccaggcuggucucgaacuccugaccucaggcaauccuccugccucagccucccaaagugcugggauuacaggcaugagccaccgcacccaaccuaauuuuuguauuuuuacuagagaugggguuucaccauauuggccaggcuggucuccaacuccugaccuuaggugauccacccgccucagccucccaaauuacuggaauuacaggcaugagccaccacaccuggccucuuuauucauuucugauguuaccaauuugaguuucucucucucucauaguuaaccuggguagaggacuauugauuuuguugaucuuuucaaaaaaauaacuuugguuuugucgauuuucuuuauugauuucuuguuuucaauucaccugaugcucuaacuuuuguuucucugcuuucucucucguucuuucucucuuuuuuugagacagaaucuuacuucaucaacagguuguagugcaguggcaugaucauggcuuacugcagcuucagacuccugggcucaagcaauccuuccaccucauccuccugagcagcuaggacuacaggcaugugccaccaugccuggcuaauuuuuuucguuagagaugaggucucccuauggugcccagguuguucucaauuccugagcucaaggaauccuucugccucagccugaguauaagcuggcuaauuuuuuauuucuuugcagagaagggcuucacuauauugcccaggcuggucuugaacuccugggcucaagugauccuccuacuuuggccucccaaagugcugagauuguaggugugagucaccauccugguugauuuuuauuauuuauuuucuucuguuuacuuugaauuuaauuugcucuucuuuuucuagcuuccuaauuuggaagcuuaaaugauugaguuuagaucuuucuucuuuucuaauauaugcauucuaugcuauaaauuucccucugaacacugcuaucaugucaucccucaaguuuuuguaaguuguguuuucauuuucauuuaauucaaaauauuuggcugcaugguagggcucacaauuguaacccuggcacuuugagaggcugaggcagaaaguucacuugagccuaggaauuugacgcaagacugggcaacauagugugacuccaucacuaauuuaaauaaauaaauaaguagaauauuuuaaaguuuaucuugagguuuuuuguuguuguuguuguuguuuguuuguuuugagauggagucuugcucuguuacccaggcuggagugcaguggugcaaucucggcucacuacaaccucugcuucccgaguucaagagauucuccugucucagccucccaaguagcugggauuacaggcacgugccaccacgcccagcuaauuuuuguauuuuuaguagaggugagguuucaccaugcuagccagguuugucuugaacuccugauccgccugccucggccacucaaagugcugaaauuacaggugugagccacccugcccggccucuaucuugagauuuuuuauuugauccauguguuauugagaaguguguuguuuaaucuccaaguauuuugguauuuuccagcuaucguucuguuauugauuuauauuuuaacuccaauguguucugaaagcagacauuguauaauuucugguucuuacauuuguuaagguguguuuuuugguccagacccugucuuggugaaugucccaugugaacuugagaagaauguguauccugcugcugucacaugaaguaguuuacagauauccauuauaugcauuuaauuaauggugguguugaguucagcuauguccuuacugauuuuucugccuggauuuuuccauuucugauagagaggucucgaagucuccaacuacaagaguagaugcaucuauuucucuuugcacuucuaucaguuugccucauguauuuugaugcucuguuguuaggcacgugcauguuaagaaucauuaugucuuaucauuugguaaugacucucuuuauccuugauaacuuucuuugccaugaaguuugcuuugucuuaaauuaauauagccacucucauuuccuuuuccuuuucuucuucuucuuuuuuuuuuuuuugacaguguggcucuguugcccaggcuggagugcagugguacgaucauagcucacugcagccuugacuucuuggggucaagugauccucccacuucagccuccugaguagcuggaacuacuggugugcaccaccaugcuuggcuaauuuuuuuucuacuuuuuuuuuuuuuuauuagacggagucucacucugcugcuggggcuggagugcaguggcacgaucucagcucacugcaagcuccaccuccagcuucacgccauucuccugccucagccucccaaguaguugggacuacaggggcccgccaccacgcccggcuaauuuuuuuguacuuuuuuaguaaagacaggguuucgccauguuagccaggaugaucucgaucuccugacuuugugaucugccugccuuggccucccaaagugcugggauuacaggcaugagccaccacgcccagccuccacuuuuuuuuuuauuaguauuaacaugguauaacuuucuccauucauuuacuuuuaaucaauaugugucuuuauauuuaaguggguuucuuaaaagacaacauauaacugagucuuuuuuuaaaaucuauucugauaaucucuuuuaauugguggauuuagaccauuauauucaaaaugauuauugcuauagguggauuaacaucuaccauauuuguuacuauuuuauauuuguugaccuaucucuuuuuuauuuucuauuuuccugucuuuugugguuuuaauugaacauuuuaaaugauuccauuuuucucuccuuucuuagaauaucaguuauacuuaaaaaaauuuuuaaguaguugcccuaaaguuugcaauauacauuuccaacuaaugcaaauccauuuucaaauaacacuauaccacuucacaggcaguacaaguaccuuauuauuauuguuauuauuuuuuaguagagaaagguuuucaccauguuggccaggauggucucgaucucuugaccucgugaucugcccgccuuggccucccaaaguguugggauuacaggcgugagccacugugcccggccaaguaccuuauaauaacagaauaauccuauguaugacuguugucauucauucacuuuaagcauaaauaagcgugcguguguguauguguauaauugaaaacacuguugcucuauuuuaaacaaacuguuaucuguuagaucaauuaugcauaagaaaaguuuuuggcugggcgugguggcucaugccuguaaucccagcacuuugggaggccaaggcgggcagaucaccuaaggucaggaguucgagaccaggcuggccaacaugaugaagccuuguuucuacuaaaaaaagcaaaaauuagccaggcaugguggcgcgcgccuguaaucccagcuacucgggaggcugagaggcaggagaaccgcuugaacccaggagguggaggcugcagugagccgagauugugccauugcacuccagccugagcaacaagagaggaacucugucucaaaaaaaaaagaaaaaggccaggcaugguggcucaccccuguaaucccagcacuuugggaggacaagguggguggaucacgaggucaggagauugagaccauccuggcuaacacagugaaaccccgucucuacuaaaaauacaaaaaauuagccuggcgugguggugggugcauguagucccagcuacuagggaggcugaggcaggagaauggugugaaccagggaggcggagcuugcagugagccgagaucgugccacugcacuucagccugggcaacagagcgagacuccgucucaaaaaaaaaaaaaaaaaagaaagaaagaaagaaaaggaagaaagaaagaaagagagagagagagagaaagcaagcaagcaagcaagcaagcaagcgagccaggcaugguggcucaugccuguaaucccagcacuuugggaggcugaggcggguagaucacaaggucaagagucucuacuaaaaauacaaaaauuagccgggcguggugggcauggcuguagucccagcuacucgggaggcugaggcaggagaaucgcuugaaccugggaggcggagguugcagugaguggagaucgcgccacuggacuguagcuugggagacagagugagacuucgucucaaaaaaagaaaaagaaaaaaaaaaagaaaaagaaaaagaaaagucuguuuguuuguuuugagacagagucuuuauuuauuuauuuauuuauuuauuuauuuauuuauuuugagacagagucucacucuguccgccaggcuggaaugcaguggugcgauuucagcucacugcaaccuccgccucccuggcucaagcaauucuccugccccagccucccgaguagcugggauuacaggcgugugccaccaugcccagcuaauuuuuguauuuuuaguauagacgggguuuuaccauguuggccaggcugaucucgaacuccugaccucagguaaucuacccaccucagccucccaaagugagaaaaguuuuuauuuuaccuuaacuuauuccuucuucaauauucuucccuuacuuguauacaucugagcuucuaaccuauacuguuucccauuuuuuucucuaaagaacuucuuugaacacuucuugcaaagcaggucuacugguaacaaauucucucaacuuuuguuugucugagaaagucuuuauuucuccuucacuuuugaaagauaauuucagagaguacacaauucuaggcuaguauuucccccccccccaacacuuuaaauauuucacuccauucucuucuugcuugcacaguuuuugagucagauguaauucuuaucuuugcuuuucuauagguaagauguuuguuuuuuguuguuuuuuguugguuuguuucuuguuuuccuucuggcuuguuucagaauuuuuucauuaugcuugauuuuuucuaguuugaguauaugucuagguguaggguuuuuuguuuguuuguuuguuugcuuuuuuuuuuuggcauauccugcaugguguucucugagcuucuuggauguaugguuuggugucuaacaauaauuuggggacauuuucagucauuauuauuccaaaaguucuucuguuccuuucuuuuuucucuuucuguuauucuaaauauguaaauguuacaacuuuuguagccaucauauaguucuuggauauucaaguuuguuuguuaguuuguuuuagucuuuuucccuuuacuuuuuguuuuuagagguuucuacugacauaucuuugaauucagagauucuuuccucagccauggccagucuacuaaaagcccgucaaaggcauucuuccuuucuguuacaguguuuuuuaucucuagcauuuauuuuugguccucucuuaguauuuccaucucucugcuuacguugcccaucuguucuugcaugcuaauuuauuugucagagccauugcaauauuaauuauaguuauauguguaaauuccuggucugauaauuccaacaugccugccauaauugagccggguucacauauuugcucugucucuucaaacuguguuuuugccuuuuaguaucccuuguaauuuuuuucuugauagcuggaaauaauguacuggguaaaagaaacugcuguaaguaggcuuuuagugauguggugguaagaugugggaagaggggaagcauucuauaguccuacaaagaggucuccgucuuuuagugagccuuugcccuggacuguuaauuucacaaaugcuucuaaguuguugcuguuuuuuucuugcccuccuuaggugggacagcauggcuagaggcagauggaguuuccuucccccaagaucaguuagccucucucugauaaucccagcagguuaggcucuagucaccuaguuucucccaaggacaggccuggcauacaucagaauuguuccuuuuucccugcucuugccagaaccaugaggggauuuuucuucaauauucaccguaagaacuugguagagcuucaggaaguaaaacuuacaaaagugugggagccccccuaaugacuggguccccugggaguuuuuaaugucucacacuuguccacacagccuccagcaauuugucaauuacaauucaguuuucccuugccugggcauugguucccauaaagguuucugcucauggguuccuucugcuccuguaaguugugauucucugcacucaccugucugucgcuccaauuuugggggcagcaguuugcccugugaccuuacgucucucauggaucuagcaagaguguuuauuuuucaguuuguuuggcuuuuuacuugcuguuaggauggaguagcagcuuccaagcuucuuacaucccugaccagaaaccagaaguccacucaucuguguuuuuuauaaaaaggauaugcauacuaugaaaugcauugcaacaaugagaaagaauggguagcacuuuaaggacugaaagagcaagauuucuuugacacaacgucaucugaaaaaaagcaaucauaauuuuaaaaaaaauccaacgugcuuauacguuugaaaaaaugggaaaaaaugggaaacaugccagacacuguuuuaacuguuuuauguguauuaauucauuguuaccucauuuuuauauguuaugaaacaggcacagaaagguuaaaugaugagucugaccuagccuuccuggggccugaguccaugcucuuaacuaccucucuuuuucugacauauugagcagguagaaagaccauacguaggcaugaucccuuuaguuuuaaaaaaaguaggggaugguauauacauacaaugaaauauauugaaccuuaaaaaggaaagaaauucugacacaugauacaacauggaggaauccugaagacacuuugcuagguauauaaauaagccagucaugaaaggacaaacacuguaugauuccauuuauaugagcuaccuagaguaaucaaauucacagagacagaaggugaaaugguagcugccagggcucgggggagggaggaaugcggaguuaguguuuaaugggcacaaaguuucaguuuugcaagauuaaaagaguucuggagauggauggugguaaugacugagcaauaaugugaauguacuugaugcuagagaauugugcaccaaaagacaguaaaaaugauaaauuuuaugucauguguauuuuaccacaauaagaaaaugcgggaaaaaagaauguccccguacaaaucugacaauaguuugaauaacugucuuuauuuugcucacaauuguagucggcuguggucuaacaucccucauaucaucucccuccuucaagcaucucuuaaaaugauggugaauguaaugaguuuaauugcguucccucaaaaagauauguucaaguccuaaucccugguaccugugaaugugaucucauuuggaaacaggguaccugcagauauaauuaagacacaagacaaaauaaggucauuagggugggcucuaaguccaaucacugguguccuuauaggaagagaagagaaacacacacacacgugaagaccagagauuggagugaugcugcuguaagucaagaacacaaaggaaggcugacagccaaaagaagggagaugagaucagggaagcuucccucccagagucugcagggggcaugaggcccugcccacacuuugauauuggacuucuuagccuccagaacaagaauaaauuuuuguuguuuuaagaaaaaaagaaaaaaaaagguuaaaaugguaaauuucauguacauguauuucacugaaaggaaggaaggaagagaaggagggagggaaggagacagaaggaaggaaaggaaagggaagggagaaagaaguaagcagggguacacagaagaugacaugauauaguuuccuuauggauauauauguaaaugugcagaaaaagaucagggaagauagaaaugaaguuuauaagagugguggccucuggguggggcuuggguggggacuuuagucuuuuuguaauauuucagcuuuuuacagaguggguauauucauauauuacuugugaaauuuaaaaacauaauuuugaccaggcaucguggcucaugccuguaaucccaacacuuugggaggccaaggcagguggaccacuugagcucaggaguuugagacuagccugggcaacauggcaaaacucugacacuacuaaaaaaaauaauaauaauacaaaaaguuagugggcaucguggugcaugccuguagucucacuuauuugggagugcugaggugggacgauugcuugagcccaggagucaaaaucagccugggcaacauggugaaaccccaucucuacaaaaaauuagucaggcaugguacaagcgccuguagucucagcuauuuggaaggcugaggugggaggauugcuugaggucagaaggcagagguugcagugagccaagaucaugccacugcacugcagccugggcaacagagccagauguugucugaaaaacaaaaacaaaacccauauacaguagacuaguguggcggaauaauuuuuuuaaaaacccagaaaaccaauaauuguacaaauuaauuuuucaaauacaaacacacacacacacacacacacacacacacacacacacacagaggcauacccuggggauauugcgaguuugguuccagaccaccguaauaaaacaaauauugcaauaaagcaagucacacaaauuauuugguuucccaaugcauauaaagucauguuuacacuauauacuaauagugugcaauagcauaugucuaaaaaaaacccaauguguauaccuuaguuuuaaaauacuuuauugcuaaauuaucaucugagccagccuucagcaaguugcaaugaagguuugaguagcuguagcaauuucugaaaauaagauaacaacgaaguuugccacaucgauugacuuuucuuucacaaaaguuuacucaguagcauaugaugcuauuugauagcauuuuaucuacagaacuucuuucaacauuggaaucaauccucuuaaaugcuacuccugcuuuaucaacuaaguuuauguaauauuuuaaaucuuuugugggcauuucaacagugcucacagcaucuucaccaggaguagauuccaucucaagaaaccacugucugcucauccauaagaagcaacuccucauccauucaagucugaucaugagauugcagcaauucagucccaucuucaggcuccacuucuaaugcuaguucucuuucuauuuucgccacaccuucaguuacuuccuccacugaaguauucagcuccucaaagucauccaugagggcuggaauuaaccucuuucaaacuccuguucauguugacauuuugaccuucucucaugaaucaccaauguuccauuuauuauuauuauuauuuuuugagacggagucuugcucugucgcccaggcuguaaugcaguggcgcaaucucagcucacugcaaccucugucucccggguucaagcaauucuccugccucuaccucccaaguagcugggauuacaggcgugugccaccacacuggcuaauuuuuguauuuuuaguagagaugggguuucaccguguuagccaggcucgucuugaacuccugaccucaggugaucugcucaccuugaccucccaaagugcugggauuacaggcauaagccacugcacccagccccccaacuuuuuuuuuuuuuugagauggaaucucacuguguggcccaggcuggagugcaguagcacgaucuuggcucacugcaaccuccaccucccggguuuaggaaaaucaccaauguucuuuuuuuuuuuuagauggagucucacucugucacccaggcuggagugcaguggcacuaucucagcucacuacaaccucugccucccagguucaagcgauucuucugccucagccucccaaguagcugggacuacaggugcgugccaccacacccagcuaauuuuuguauuuuuaguagagacgggguuucaccauguuggccaggcuggucucgaacuccugaucuugugauccacccaccuuggccucccaaagugcugggauuacagaugcgagccaccgcgcccggccaugaaucaccaauguucuuaauggcauaucuagagugguaaauucuuuccagaaggcuuucaauuugcauugcccagauccaacagaggaacaacuuaucuauggcagcuauagccuuucaaaauguauuucuuaaauauuaagacuugaaagucaaaauuacuccuugacucaugggcuacagaauggauauuguguuagcaggcaugaaaacagcauuaaccuccuuguacaucuuccugagagcgcuugugugaccaggugcauuauaaaugagcacuaauauuuugaaaggaaucuuuuauuuuauuuauuuauuuuuuuuugagauggaggcucauucuuucacccaggcuggagugcaguggcgugaucucggcuuacugcaacuucuaccucccggguucaagcaagucucugccucaggcuccugacagcugggauuacaggcgccugccaccacaccuggcuaauuuuuguauuuuuaguagagaugggguuucaccaucuuggccaugcuggucuugaacuccugaccuucugauccacccaccucagccucccaaagugcugggauuacaggcaugagccacugugccuggcucuuuuuuuuuuuuuccuauccugagcaauaggucucaacaguggacuuaaaauauugaguaaaccaugcuguaaacacaugugcugucauucaggcuuuuuccauuuauagagcauagguggaauagaguuagcauaauucuuaagggcccuagaauuuucacgugguaaaugagcacuggcuucaacuuaaagucaccagcugcaugggucccuaaugugagagucagccuguccuucgaagcuuuaaagccaggcauugacuucuccucucuagcuauaaaagaccuagauggcaucuucuuccaacagaaggcuguuucaucuacacugaaaaucuguuguuuagucuacccaucuucaucaaugaccuuagccagaucuucuagugacuugcuguagcuucuacaucaccaccugcugcuuuacuuugcacuuuuaugcuauggaaauggcuuauuuuauuaaaccacaugaaccaaccucugcuagcuuccaacuuuucuucugcagcuuccucaccucucucaaucuucacagaauggaacagaguuagggccuugcucuggauuaggcuuuggcuuaaaggaaugcugugcugguuugaucuucuauccagacugcuaaagcuuucuccauaucugaaauaaggcuguuuucuuucucaucauucaugugcucaccggagcagcacuuuauuucauucaagaacuuuuccuuugcauucacaacuuggccaacuugcacaagagcccucacuuuuggcuuaucucaguuuugacacaccuuccucacuacuucaucauuaacagcuuuuguuuuuaaauauuuauuuauuuacuuauuuuuuagagacagagucuuacuauguugcccaggcuggucuugaacuucugaucucaagaaauccuccugccucagccuccugcaaagugcugggauaacaagcgugagccaccaggcccagcccacauuucaaucuuuugauuuaacgugagagauguaugauucuuccuuucacuugaacacuuagaggccauaacaggguuauuaacuggccuaauuucaaaacuguugugucucagggaauaggaaagccaaaggagggagagagacaggggaacagccagcagguguagcaaucaaaauacgcacauuuauuuaugaagcuugcugucuuacaugggcgcaguucauggugccccaaaacaaugacaauaguaacaucaaagaucacugaucacagaucaccauaaaagauauaaucauaauagaaagguuugagauauugugaaaauuucaaaaaugugacacagagccacgaagugggcacgugcugcagggaaaauaguuccgacagacuugauugacucagggugccacaaaccuucaauauauuaaaaauacaauaucuguaaagcacaauaaagcaaagcacaauaaaacgagguaugccugcauauacgcuugaguaucuauaagcaugucuggaaggauacagaagcagcuuaaugacgguuaccucugagaaguagccugggggagagagggaaggaggcagggaaggagagcuuuuaagaaauaagaaacucagcugggcaugguggaucaugccuguaaucccagcauuugggaggccgaggcggguggaucaucugaaauaacaauucgagaccagccuggccaacguggugaaaccccgucucuacuaaaaauacaaacauuagccagguguguggugcgcaccuguaaucacagcuacuugggagacugaggcaggagaauuguuugaacccgggaacgggaggcugcagugagccaagaugggccacugcacuccagccuggguaacagagcgagacuccaucucagaaagaaaagaaaagaaaagaaaagaaaagacuaaaaaacuaaaggagaguucaaaggaagauuacuugaguuuagggaauaaaauuaggaugagccuaagaagagguaaagaauaagagaacauauacuuuauacucaggugcuuguuuucuuuaaagcuugugcuaucgauguacuuuuauguaaagccuuuucauaaugcauuuuaugcugagcuauugcuuuuuaguuguugugguuuugagauggagucucacucugucacccaggcuggaguacaguggcacaaucgcggcucacugcaaccucugccucccagguucaagcaauucuugcuccacagccucccgaguagcugggauuacaggugugcaccacuacacccagcuaauuuucuaaauauuuuuaauagagacgggauuucaccauguuggccaggcuggucucgaacuccugaccuuaggugaucugcccgccuuggccucacaaagugcugggauuacaggcaugagccaccgugcccggccuugaguuauuguuauuauuauuauacuuuagagauaaggucuugcucugucacccaggccggaguacaguggugugaucauagcucacugcagccucaaacaacuggucucaagugauccuccugccucagccuccccaguagcugggacuagaggcacaagccaccacacccagcuaauuuuuauuuuuuuguagaaauggagucucacucucuuucugggcuugucucaaacucuuggccucaagccucccuccuuggccucccaaagugcugggguuacaugcaugaggcaccgcgccuggccuaugcuuaucuuuuuaauaggguuucauuagaacacgguuacaccauccucuuuuagggaggccuuuuuuguguucaguugccccucugugcaugacucaacacagcugccaccuguuauaggggaucaggcugggugugcucagggucuucuguccuugaacagacucuccagaggccccacucccuucucccuugauguggccucucugaucugccaccuaccacuuuuucaccugggucccugucccccaggcccugcagauggaaguucagcuauagggaagaaacaggccucagugggggcagaagauucugcugcugcaggggcccuggaggacagugcggggcugcagaagcugccaaaggagcuuucaccugcccaccccacgccacauguccccugugugcuaggacccuccucagcaagagaaggaaaaugucuacaaguucaaagggggcaggcacuggaaggugauccagcaccagguauuacagucuccaaaagcugcuugcuguagcaucugcuggggcugaacccacugaaccauccccuagacccagaccccucuuuucaggcuguccccagcugaacuguguagaugaguucaccaaaacauaugugcuagaagguucguaggagcuuuacucacaaucccaaauuggaaacaacacaaaugucuauuaacaauguaauggauaaauaaauugugcaguuuacuccaacaaaauaguauacagcagugaagacggacaaacugugguuaccugcaacaaccuggaugaaucuucaugugaagcaaaagugugauuccauuuauauacauuucaaaaacaggcaaaaucagucuauaggauuaaaagucaggccgggugcgguggcucacgccuguaaucccaacacuuugcgaggccaaggugggcggaucacgaggucaggagaucgagaccauccuggcuaacaugaugaaaccccgucucuacuaaaaauacacaaaauuagcugggugugguggcgggcgccuguagucccagcugcucaggaggcugagucgggagaauggcaugaaccugggaagcggagcuugcagugagcugagauugugccacugcacuccagccugggcaacagagcaagacucugucucaaaaaaaaauaaagucaggauuaccuuuggaggagugacuggaagggggaaugagguuuaugaccuaggugcuuuuuucauagucauguucacuuugugauuuucuuugggcuguagauuuaugacuuuaaaaaaaaaaagguugcauagggucggacacaguggcucaugccuguaauuccagcacucugggaggcugaggcagguggauugcuggaguccagggguuugagaccagccugggcaacguggcgaaaccccgucucuacaaaaaauaccaaaaaauuagccaggcaugguggugcaugccaccaugcaguaguccccgcuauuugggaggcaggagaaucauuugaaccugggaugcagagguugcagugaccugagauugucccacugcacuccagccugggugacagagcaagaccuuuucuuaaaaaaaaaaaaaguagggggguugcauaccaugauguguaauaaguaaacauuggaaauaacuuaaaugcccaccgauagguaacugauuagguauagugccccuuugcaguagcauucaauaauauaaucagucauuaaagagaaugaggaagcuccuuaugugcugguguggaaugaucucuggauacccugcuaagugaaaggcaaggcucaugguaacaaauacugcacaauguucccauugcaaagaggcaggaaaucauauguauguggggguauauuuucuugcagguacauaaaauauuuucagacauauuuauaagacacugacaaccuuggcuccuucuaaagaggggcauuggguagcuggaggagcagauuuuucucugauaaccuguugcaccuuuugaauuugaagccggguaaauaaauuaccgacagaaaccauaaagugggugggguuugacugcuaguaaaugacuauuaccagagauuuucauucacuuggaaugaaauaauuaaagcagcaaagaaaggcaaugcagaggucaaauguaacuuauagaaaucauggauuaaucucaaaaacagaaaaaugaaacguuuaaaccucuuuugacugagcuugccaauuuacaggaauuuaucgaagaaaauguucacagauguccucuaagauuuaacugugaggauguucaucacguugcuguuuauaaaagaaagagggaggggaagacgaaaaagaugaggaggaagaguauaagagcaaggggaggagaaggaggagaaauaaugaaggaagggaggaaagacaaaaacuccuacuauaucgauacaggaauauagcucuuucauaccacagaguacuacucagcuacuaaaaguauacugaggaagguuuaaugauauauaagaaauacucaugauguguuaggucucaaaaggcuuuuaaaaauaacacacaacauaauuucuuuuugggaaaaauguucacacagugacagcaaauaguuauauagaauuuaccaugccaggcacuauaauaaguacuuuacacaugcuaguucauuuaaucucuacaacucuauggaauagauacuguuauuaucuucuuuuuacagaugaggacacugaggugcaagacguuugagguuauccaaguuauccagggucacacaacugguaaguugcaggauuuggacccagacagccugcuucuaaccagcacucuauacuguuaugaguauagacuaugcagugaagaaugacuauugcugagacacuaagacuacggguguaauucugcucaaaauauauucuccaauuuuuccacaaagaacaaugauaauuuuuaaaaagcaauaaaacucuuagaaaaggugagauauacaaagaaucacuguagcacagaauacacagccagcuguuuguguccgcugacagucccuccuucaauuuaggaagguuuuuccagaaggaccuggcuagguuugagacugaggggaguccagugaaugauuucuguccacauuggggccacagcuugcuugcucgcuugcuugcuuuccuauauuuuuauuuucauuauaauuucuuuuugagauagggucucacucuuguugcccaggcuggagugcaguagcaugaucuuggcucacugcaaccucugccuaccagguucaagcgauucuccugccucagccuccugaauagcugagacuacagccacgcaccaccacgcucagcuaauuuuuguauuuuuuuagagaggggguuucaucauguugcccaggcugguuuugaacuccugacuucaggugaucugcccaccucacccaaagugcugggauuacaagcgugagccaccaggucuggccaggggggccacagcuuucaaagggaauggcuuccccaggacacaagggggccguggugacaacugucucacagggagaucccccaggagaaggaaguucgggaaguggguuggagaugccuguccacaggcccucccuaccaggucugagcacucagcucuguuccugcccauccagggcaggggcuuaucuuacaagggagacugagcuucuccuuuuaaaaucugagacauccaggcccaaucuuaaugccccuaucagcuccuaggaggugacuccugucccauccaacaaccuagaugcugaggccagccugggagguauccuagauccucccuuucucucaccuccuacacccaauccauuugcaaggcugacuaacucaaccuccaaaaaauguccagcaccagaccccuucucuccaucuccacugcuagcuaccaccuugcuccaagccccaugaccuuccucccugauuaccacagucaccuucaaacuaguuucucugcuucuacccuugcuccaccaucaccuguuccacauucagcauccagaaugaacauucaaaaacaaaugguaucauggcugggcacaguggcucaugccuguaauccuagcacuuuggaagagugaaaugggaggauugcuugaggccaggaguucgagaucagccugugcaacauagugagacccuaucucuaaaaaaaaaauuagcaggaggcugaggcaggagaauggcgugaaccugagaggcagagcuugcagugagcugagaucgcgccacugcauuccagccugggugacagagcgagacucugucucaaaaaaaaaaaaaaaaauucagccgggugugguagugcgcgccugcagucccagcuacucaggaggcugagaugggaggaucacuugagcccaggaauuugaggcuacagugagcuaugaucgugccacuguacugcagccugggcaacagagcaagacccugucucaaaaaaaagaaagaaaccagcucuccuacuuaacucucucuucauggcauucagaauaaaauccugccaacagcugaccguggcuuccaggccccagccucccuccauuuccucuggugccauucagcuucucgcuugcacucuggccacacugcccuccuuucuguuccugaaaacgugucaaauucauccucucuuccugggacacucuuucucuaagucauucagucucaacucgugguuccagaccuugaggggcucacaguuuuggagggggguacuguugggaacacaaauaauggcaucuggcaucacagaugacuuguggagagauggaaccccaucacuuugugcaguaauuauuugguaacagcauuuacucucaucugccacccuaggcccagccugcaaggaguccacagccuguuaauaaccuuggcaucugucccuccucaggguaccccuauuguccuaggcuggcucugccacauccaccucuaggauuuggugaaaagccucccacugcucucuccaucccuuccaaguccaccuucuccugcagacauguggccuuccucgagccuaucuuccucagccccucaauugcuaauuugccuccuccugcucugacuccugucucacaguuaguuuuucuggcucuuccuccuccgcccgccccuuaagguugcuguucccuaggcugucucuucucccuccauacguucuccuugggcaauuucaucuaugcucagauucauacaaugaugccucaaaucgccauccacagcugagaccuucuccucauccccagaccucaguaacacucauuggaccuuuccccuugcacaucccauaagaaccucaaaaucaguguuucccaaauagaccuucucuuccuccacccuaggucugaucuucauccuauguccuuugugaaugucacuccacagacccaauuaucuguaagaaacuuggagucauuguaacaacugccuuguccucaaaaccaacacacccauuggucuucuaaauaggucuccaaucuuucuccuccucuccauccgccauccuuggcaucucucaccuggaucgccuucuucccgggcucccuccucccaucaagccuccaacugguccauucuccgcagcagccucccaagucaucuuucuaaacccacaucugacccuggucacucccaugccugaaagugauuguccaucaucuaggaauaagacccgaacuccaaagccacugucaaggcccuccauaagccagcccuaacuacuucuccaggcuccucucccaacuguucccacuuuucaacccuuucucccuuguucuagcacaggccauggaauguuggaaagcugaagccaaagugauuugauuccggucacacaacaacaaauaauaauugcuaacguuuauuaaguguuuuguuugugccauggugugcacgcaaauucacaaucaauccuucaacagcgccaugaggcaguuauuauuauuguccccauuuuauaggugaguaaaccgagacucagaaaucagguaauauuccugagagcacuuaguugguaacaccacagucagaauuuaaauucagguuuucuuucuuuuuuuuuuuuuuuagacagagucuugcucugucacccaggcuggagugcaauggcgcaaucuuggcucacugcaaccuccgccucccugguucaagggauucuccugucucagccuccugaguagcugggauuacaggcaugcaccaccacgcccggcuaauuuuuuguauuuuugguggagaugggauuucaccacauuggccaggcuggucuugaaccccugaccucaggugaucugcccaccuuggccucucaaagugcugggauuauagaugugagccaccacaccuggcccaaauucagguuuucugaccacuaaacugugcugccuccaaaggaauggguggcagagcugagacuuaaaucagauaucaucauuaauucauucaauagacauuaauuaagcaccuauaugccagguacagauuccugauccagggcacucauaaugcauuaaauuccucuggggcugggcaugguggcucacaccuguaauccagcacuuugggaggcugaggugaguggaucacuugaggucaggaauuccagaccagccuggucaacauggcaaaacuccaucucgacuaaaaaauacaaaaauuagcugggcacgguggugggcgccuguagucccagcuacuugggaggcugaggcaggagaauuguuugaacccaggagguggagcuugcaaugagccgagauugcaccacugcaccccagccugggcaauagagugaaacuucgucucaaaaaaaaaaaaaaaaaaggaauaguucaacccuuguccuccugauaccuccaauccauccucuccaccaacaaccagauccgaucauguuccccucagacuugaaacacuucagagccuuucuagguauaacacuaaacccagcaaccauaaaagagggaauuugcuuauaguaaaaagaaaauaauuuccccaugggggaaaaauccauagacaaagucaaaagauaaacugagaagcaauauuuguaacucaucucacacacagaaggcuaccuuucuuaguagauaaagagcucuuacaaaucaaaguggaaaaaugccauuacauugauuuucaaaauuuaagaaaugacaguuuaaaaauauauauauaauauaacaauuacauauauaaaagagguauucaaucucauucauaauaauagaaaggcaaauuaccacaauaagagaguguuuucuaucaggguggaaaaaaaugaaauauuugauaacacacucaguuaacaaggacauggaggaacagguacuaucauacaucgcuggugggaguguaacuuuguacaacgucugugaaggacacuguugauagaucugucaaauuguaaauguauauaccacuuaaccagcaauuccccuucuagggcuuuauccuuauacuuacauauguauuagauuauuuacauauaacauuauuaacugaagcauuauuauagcaaaauauuguaaauaaauauuauuuaaauugugaugcaccuauagaaaaguuuauuacguggcuguuaagaaaaagguggcucuuuauacacugauauggaacuaucuccaagauguauuguugagugaaaaagcaagccacagaaccaaauguuuaguauauuaccauuagcaguggcuuggaaauauguccacaaauucuuugauauuccucccuucaagagaaggauccuaauucuccucuucuagaaugugggcuggauuuaggaacuuacuucuuguaauagaguguggcagaagugauggugugugaugucugcuaucaggacauaaaaggcagugugauagccagaacaaccuugaaaaugaagaacaaaguuggaggacucacacuuucugauuucaaacugacuagaaagugacaguaaucaagacagccuggguuggucauaguggcucaugccugucaucccagcaauuugagaggcuaagagggaggacugcuugagcucaggaaguugagaccagccugggcaacauagcaagaaucugucuuuucaaaaauuuaaaaaaaaaaaaaauuaaugaggcauggugguguaugccuguggucccagcuacuggggaggcugaggugggaggaucaguugaguaaggcuacagugagccgugaucacaccacugcacuccagccugggcgacagagugggacccugucucaaaaaaaaauaauaauaaaaaauaagaaaugaaaauaaauuuuaaaaauaaaauaauuuuuuuuuuugagauggagucucacucugucacccaggcuggagugcaauggcaugaucucagcucacugcaaccucugccuccuggguucaagcgauucuccugccucagccucccugaguagcugggauuacaggugugugccagcacacccagcuaauauuuuuuguauuuuuaguagagacgggguuucaccauguugguuaggcuggucucgaacuccuggccucaugauccacccaccuuggccucccaaagugcugggguuacaggcgugagccaccgcacccggcaaaauaaaaauuuuuaaaagacagucuggucuggcauaaggauagacauauagaccaauggaauagaauugagagucuagaaagcaaucuauguaucuauagucaauugacauuugacaaggguaccagaaccauucaguggaaaaagaacaaccuuggugcugggaaacugaauagccacaugcaaaagaaugauguuggacccuguaugucacaccguauacaaauauuaacucaaaguggaucaaaggcugggcaccauggcucgcgccuguaaucccagcacuuugggaggccaaggcggguggaucacaugaggucaggaguuugagaccagccuggccaacauggugaaaaccugucucuacuaauaaugcagaaauuagccaagugugguggcgugugccuguaaucccaucuaauagggaggccggggcaggauaaucacuugaaccuggagggcagagguugcaaugagucgagaucgcaccacugcacuccagcgugggugacagagcaaaauuucgccucaaagaaaaaaaaaauggaucaaagaccuaaauguaagagccaaaacgacaaaaccuuuagaggaaaacagggguaaaucuuugcaaucuuggauuuggcaagccacuuugggaacaucugucaguuucucaaaauuuuaaauacagaguucucauuuguccaggcaauucuacuucuagguaaguacccaagagaaaugaaggcaugugucuaccuagaaacuuguacacaaggccaggcguggugacucaugccuguaaucccagcauuuugggaggccaaggagggaggaucaccugaggucgagagaucgagaccagccuggccaacauggugaaaccccaucucuacuaaaacuacaaaaauuagccaagugugguggcaucugccuguaaucccagcuacuugggaggcugaggcacaagaaucgcuugaacccaggugguggagcuuacagugagcugagaucccaccacugcacuccagccugggcaccagagcgagacucugucucaaaaagaaaaaaaagaaauuuguauacaaauguuuauagcauucuucauaauagccaaaagguggaacaacccaaauguccaucagcugaugaauggauaaacaaaacaugguaugcccauucaaggggauauuauucagccauaaaaagaaaugaaauauugauaugugcucuaacaugaaugaacuuugaaaauguuaugcuaagugaaaaaagucagucacaaaagacuauauagugcccugacaugguggcucacaccuguaaucccaucacuuugggagaucgagguggaaggauugcuugaguucaagaguucaagaccagccugggcaacauagagagaccucguuucuaccaaaguuuuaaaaaaauuagccgggcauggugacacgugccaguagucccagcuacuugggaggcugagaugaaaggaucgcuugagcccgagacugaggcugcagugagcuaugauugcaacacuguacuccagccuggguaacagagcaaggcccuaucucaaaaaaaaaaaaaaaaaaaagucacauguuauaugaucccauuuauaugaagugucuagaauaggcuaauacauagagacagaaaauaaauuagugguugcuuagggcugagaaggaaggagggucagggguuaaugggugauagcuaaagugcaugagguuucuuucugagauaaugaaaaauauccuaaaacugguuguggucaugguugcauaacuccaugaauguauuaaaaaccauguaauaguucacuugauaugggugaauuauaugacauaugaauuauaucucaauacaacugauaccacaaaaagggggugggcaguguggcuucuuccuuuuucucucucggagcacucauucucaggucuccugccggcacccacaugaaugaacuuaaaaguggguccucggccgggcaugguggcucacgccuguaaucccagcacugugggaggccgaggugggcggaucacgaggucaggagaucgagaccauccuggcuaacauggugaaaccccgucucuacuaaaaauacaaaaaauuagcugggcgugguggcgggcgccuguagaccuagcuacucgggaggcugaggaaggagaaucgcagaacccaggaggcggagcuugcagugagccgagaucgcaccacugcacuccagccugggcaacagaaugagauucugucucaaaacaaaaaaaaaagaaaaaaaaaguggguccucuagcccaguuauccuuaggaugacuguagccccagcugaggucuugguugcaacuucaugagagacccugagucauagcuaccugcccaucuaagcugcucccaaaguacucugacuuuauagaaacaaauaucauaaaugcuuguugacucaggcgacuacguuuuggggugauuuguuuguuuuugguuuugguuuuuuuuuuuuuuuuuuugagucaacaucucacucugucacccaggcuggagugcaguggcacaaucacggcucagugcggccuugaccucucugggcucaggugacccuuccaucucaaucuccugaguagguggaauuacaggcgugugccaccaugcccagcuaguuuuuguagagaugggguuucaccauguugcccaggcuggucucaaacuccugggcucaagugaucagcccaccucagccucccaaagugcuaggauuacagaugagugccagugcacccagccugggguaauuuguuaugcagcuauagauaaauaauacucuaauuauguaaaaacaccauuugcauuugcuugcauauuuaagaaauuucuuggaaaggguacucaagaaacugguaauggggguugucucugggagaaacaggugggggagaggauggaaaggagacuuaugucugccuguguacccuuuuuaccuuccaaauuuugucucuuguacauguauuacuuuuccaaagagucaaaagucuggaaauaauuacaauaaaaauuaaaaaaaaaaaacccuuuaacaaugaacugcugucuacaaguaaagucuggggucaggcaugguggcucaugccuguaucccaguacuuugggaggucgagguagguggaucacccaaggucaggaguucaagaccagccuggccaacauggugaaaccccgucucuacuaaaaauacaaaaauuagcuaggcaugguggugggcaccuguacucccagcuacucgggaggcugaagcaggagaauugcgugaacccgggaggcagagguugcagugagccgagaucagaccacugcacuccagaccaggccauagagugagacucuaucucaaaacaaacaaacaaacaaacaaaaacaaauaaagucuaaacuccuuaccaugacuuagaaggucucuacaauccagcucuggcccacuuccccagucucaacucuuaccuuuccuggccuaguugcuuagaguccccagauacagcuacuauucccaccuccaugccugugaucauccuguuccucuuuccuacccauccuuuaagacucagcucaaauguuacccuuuugggaagacuucccuggcucucuuuaacuguguuggaaguccccucccugcccucagaauacccuguacaugaaucucccauuucauguauuguaccauauugugaugaucuguuuuuguuccugccucucccaucagacuaugagcucccugggagcaaggauucuuacucaggauuucuagaggcuagcacagugccugacacacacacacgacacggucaguaaaggguugaugugagaaacacaagaagagggguggggagagggaagugaggcaaaaguaaagggagggaaggaaaggagaacagaagagaggaaagaagguaaaacagugacucaaaaguacuaaaaaagagagaggaaggaagggagaauugggggaggaagaaagaaaugagggaggaacagaggaaagagggagaggaggagggaaagcggaaagaaauucucucaauguguuuaucaguaucacgcacauacaacaaagacaguggaagaauaaaauuccaaaucaaaucugaaacaagacccagggcaaugugcugggcaugguggcucaggccgguaauuccagcacuuugggaggccaaggugggaggaucacuuaaggccaagaguugaacagucugggaaacauagugagacccugucucuacaaaaaauagaauaaaggccaaggugagcagaucaccugaggucaggaguucaagaccagccuggccaacauggugaaaccccaucucuacuaaaaaauacaaaaauuagcuagaaauuguuugaacccaggagguggagguugcagugagccaagaucaugccauugcacuccagccugggcaacagagugagacuccaucucaaaauaaauaaauaaauaagauaaaauaaaauaaaauaaaauaauuaacaaggcaugguggugugugccuguaguucuagcuacugagggagcugaggugggaggauuucuuaagcccgggagcccaggguuacaguaagccaugaucgcaccacugcacuccagccuggacaacagagccagacucaguuucaaauaaaagaaaagaaagaaagaaauggagagaaauguagaugaauauucuaugccauagugaugggaguuccugguugagguuccuagcccagagacccugauaauuaagaacacacaucugggccaggugcaguggcucacaccuguaaucccaguacuuugggaggccgaggccagcggaucacuugaggucagcaguucgagaccagccuggccaacauggugaaacccugucucuacuaaaaauacaaaaaauuagccaggugugguggcacgugccuguaaucccagcuacucaguaggcugagacagaagaaucgcuugaacccgggagacagagauugcagugagcugagaucgcaccacugcacuccagccuaggugacagagggagacucggucugaaaaaaaaaaaaaagaaaaagaaaaaaagaacacacaacuggaaggcugaaagguacucacuucuagaucccccaaaccccucuaccugccuccucccaccuccaggguccaccagcuuccauuccauucuacacauucuauucucugcugcgguccagguaccaggguggugccuggcacacaauaagcacuuaguauugaaugaauguggucagaaccaccucccuuccauggaaugaggauaggucuggguacaagucucacucugucaccaugaacuugucccuucucucugagacucagacccaguccuuacaucuuuaaaaugagggaguuggggaaguggauugauaagacucuuuccagcugacaguuuaugccuucuuaagcccuuuggucaucccagcaaguccaaacucuaagugucaaagaucccucacaaacugcucuucccucggacuaugucacaagaguaacagcgacuauguauugaaugcuucucauacaccaggaccacacucagcauuuuacuaccuucauuuccaaagcaggugcaaugauaauuucuauuuuuauagauggagaaacugagauucagagaggcaaacccauuucuccaaggcccacaguuggaaaguggaagagcagggauucuaaguccucuauucuugguucguuuuguuuuauuuuugagacacggucuggcucuguugcccaggcuagagugcagcggcaugaucauggcucacugcagccucaaccuccugagcucaaguaauccucccaccucagccuccugaguagccgggaccacaggcgagugccaccacauccggcuaauuuuuaaauuauuuguagagauggggucucacuauguugcccaggcuggucucaaacuccuagacucaagcaacccuucugccucagccuucgaaaaugcugagauuacaggccugggccacugugccuggccauaaguccuguggucuuacacgacuagcacauacuuauccuggcacccccgacccuuaaccacacuucaccuugaaucucaaacccaguugggagugucccccggcuaacuacaccgggcccacagguaacauuuaguccauggagauuauagcucuguaauuuguguauucacuuccuggguuccaguucagugauacaaacagguucuagaucuguauuagacuugcguugaguuuuagcuccaccuuucacuaaaugugugaccuuggagcaaguuauuucaacagaugaggauuaaaugacaacgagugugaaaacgucuagcauagaagcuggcacauuggauauucuuaguaaaugggaacaaccggguaaaaaacguagcagagauauccugccucucuacuuaguuagcaguugacucuucuggcaaaaacaugcuguugcuauccccacaauuaauccuccuuuaaccaagaucucggagauuuuuguucuuuguuuuguuuuguuuuguuuuguuuucuuuuauugagacagggucucacucugucauccaggcuggagugcaguggcaugaucauggcucacugcaaccuccgccucccaggcucaagcgauccucccgccucacccuccugaguagcugggacuacaggcacaugccaucacaacuggcuaauuuuuguauuauuuguagagacaggguuucaccauguugcccaggcuugucuuguacuccugagcucaagugaucagccugcuucagccucccaaagugcugagauuacaggcaugagccaccgagccuggcugaucuccgguuuuagagucagacauauggaguuacaauucgggcuccaccacuuaccaacuguaugaccuuggacaaaugacuuuuuccucuuugaagcucagcuugaucucaccuauacaauaugaauaaugguaccuacuccacaagauuguugugaguaucaaauuauauaaugcauguaaaauguuagcuauuuuucuguaauaaugauaacagucauagcaguauccaacugcugcugauuaaagucgaaauucuuugacccagcauacuguggcccccauaauuccuuccucuccucuccucaugcugcuccccuauguggaugccacacucaagccagaugugucuuucucaccgcugugucuuugcccaugaucuuccucuccauucaggaugcucucucauaccucccaccugguaacacccugcccagcucaagccucgcuucccaacuaagcuggcagcccccucugcugcuccggguuuccauggcauuuccagcccgcacauauuagugcucagacugcccaggggaaaacuucuguuggcgcuugucuugcccaugcuaccccucuuccagugcucacacuugauuuaucuuugagggaauuggccuuucuccacuaucaguccaugugugguuccagggauaggcauguggcucgggccuuagacagagucaccaugauuaauuaagagguggacacuugaccaagcugggccaaucuggcucagcccuggaacguuugcuggaauuauucuuuuuccacaagcacugcuaagcugaaacaauguaaauuagaucuacuaguagccuuauuugucaccuugaagacagaaguggauuuaaaaugagcgagcacagaggaaccaagaaauggagagagacagauucuucauggcgugauuugaacaucuggaucuguccaugcccgaagccaaauacuccugacuuucaaauuaagugagccgauaaacccuagccucuuuauuuuuuucuaauuuauuuaagccagcucgaguuggguuucugucauuugccacugaaaaacugcugacuaauauagugacguaacuagacaguaugcucccugagagcaggaauugcauuuuauagaccuaagauccuuggagacagggaugaugucuuaugcaucucaguauuacaggacuaagcauagggaugguuauagagcuggugaagaacaaacaaaagaauaaauaucuuuuuguauuuucccaaugcccccaugcucugcacucagaagacccuaaaauacuugaauaaaaguuaacaggaacaggccaggcaugguggcucaugccuguaaucccagcauuuugggaggcugaggcggguggaucaccugaggucaggaguuugagacuagccuggccaacauggcgaaaccccaucucuacuaaaaauacaaaaaauuagccaggcguuguggcaggcaccugugaucccagcuacucaggaggcugaggcaggagaaucacuugaacccagaaggcggagcuugcagugagccaagaucaugccauugcacuccagccugggcaacaagagugaaacuccgucucaaaauuuaaaaaaaaaguuaacagguacaaaaucauaugagaggcacuuuaauucuuaucugacaaaaacagagcccuuugauucuccacaguuccucugaggaugacugauuuaucacuuucugaauggaaugaucuugaugaaagaguugucccaggauccccacagggcugaaagagauacuuuauuuuuuacuuauuuuauguuauuuuuugcagagacagggucuugcuauguuggccaggcuaaucuccaacuccuggccucaagcaaucuucccaccucagccucccaaagugcugggauuauaggcaugagccaccaugccuggccaagagauacuuuaaaucaccuuaucuaccugcucccaguccccuauuguacaaaugggaaauugagauuuaaacuaaaaggcuuacuuaacacugcauggugagucacagacccaagucagccaagaacccccaccccaagacucguaguccaguggucuggcuucuggccuggugucacuuuauuaagcaaagugaaucagucacucacccagagaacucagaaaucucugaacaaaauggaauaaacugcucaacucugccaacugcccccucagcccacauggguggggcaguaaugcaagcaaaagugcccugggccagaagucaaggacccccggcuguagaacuagcuuccucccuuaacagcugugugaccucaaguaagcccuucccaucucuauacucaguuuccucucucuaaaacagggggaggggaaggugggauuugaaggagcugaucucuaaggugccugaaauucuauuauuauauggggguuguuggacaauucaucaaauccccaggauuaaacccacacagauuacagagaauuugaaagccaagaggucagcaacccaucugcagacuccaaauuaagguugaugaguugaggauuccagcuugccuuugcaggagaaauagaauagaaauacauaauaucaccucccuggguaccacagagaaguauggagccauaucccccauauccuauaguucaccuuucccacccucuucaaagauccacaucuaaauugaguugggugagaugaauuugaaacaagcccauuagaauguccacaucugccuucuucaaaauaguccuuuuaggaguuugggcaauucuuccaaugaggcaguaauuccucccuggauuuguaaaaguccucuuguggaaacagaccagccucaugacuuuguccucacaccuuggcugucauuccaagugacaauuaucaauuugaugacccaucguauucucuauacuugaucuggagugacuuccagccauuuccaaaaguuacauuccuccuuuaaaagauagagguuucuccucaaugaagauauucaagugauuacaccccaugcuccaaagcuaauucccugcaaugcucugaacaauggaaucaucagcaagugauauaaugccuccuccagggggucucuuuuggaauggcagucacuuguugaauguccugaggugcuuauuuuaaaaaaccaucucugcugcaugauaaucacauuucccccuucucuuucucaucccuggaagacuccaaacuuuucccuucacuagcucuccucccccaccccucccauccccuggccccacuuuccccaguccaacucucuucccugccagcaauuaggcaaaagcccaaguugcugagucuucaaaaucuaucucugaucgaaagguggguggaagugggggacucuaauggauccuggaaaacugucucagcauuucucauucccaaaaagcccuucucugguucuuaggguaagaugacugucuuggucaaacauuucggagggucucagggacucacucccauugggcauggcaccagaacuuucuugcauggugcaggggugggaguggggauggagaccugcccuccagagacccauaucacccaaugcuuucaaccacucacaucucaaacaguggauaagcacaauagacagccucucccccuuaucacagcauuuuaaagguuacaaaacacucuuucauuuguccuuuuggaaucuucuccccuguuuuacagaugaggaaaccgagccucagagaaguaaagugaaacacccaaguugauagugucaacaaauuaaaaguccaagccagaucucuugauucaccauuucaugcuuuuuuucaacauaacagaaauugaucauaccuacaguaaccccucacucagauaaauauuucccccaagacagccaacagagacccuuagagacacuaacuuaaugcuaaccgagcaauaaaugcagcguacccauacccaagcauacagacccacccacccagucccaaggcucuguccccugcccuaaggugucucucugcagcguacccccuccccaauacccacugaggguccgucagccaaagaggugagugucuuaacacagagaagcagaaucuauccgacuccuucaggaaggggaccuggcaggaaggagccccgucccuggcgcuuguucugggaguuccguccacccccuccccuaccugccaagagcugcauccaggcgcagaucuuguagaccguagccguguugcagaagaagaaaagcgaaaagcaggugaugcagccgaggaucagcaccauggagagcagcacgaagaaggcggccgccuugaaggcgcuggacgggauggugcugaagucggugaaggagccccggcaggugagcucgcggcccgccagcccgcugcccacgcaguaguggaagaggccgaaguagccaggcuugggggugcucacgcugucgcccacccaguagggcuggaugaagaccaccacguugaugauggcgaagcagauggugaagauggcccacagcacgccgauggcccgcgaguuccgcauguagugcucgugguagagcuuggaggccuccugcgagggcagcauggugcccggaggcggggccggcggcggcggcggcuggcgggggccgccggcccgggacggagcgccgggcugccgggcgggagcuggggacgcacgcgagaagcggcccugagucaaggaacccgcgagggcggggccuggggcagagcugggggcgucugggagcugcuaagggagagaggaaggggucaugagaguguugaggccgugucuagggggacuggcaaaggucuccuacuggggggccuaggagggggccaugagaaaguuggggggcgccuaggauggggauaugagaccuggaagugcggggggaggugcuugaaaguggccaugggggaguuggggaggggguuugagagcugguauuacgggaguaggaggggacaaggggagguggaauggaggcuggagacugguguuggaggacuagcagaggggcugaauuuagggagcucagaagggaauuuggggacugguauuaagggguagaaggaggucugguauugggugucuagcaagggacuaugaggcgguggugggcgcuucuaggaugggggaagagggaauuuaagaggcugggacugggugguugggaagguaauaugggggcugggacggggaaugggggcugguaugagggucuaagagggcaaaguggcagaauuaggauacagcuagagcgggaucgggggcugggacugcuggacacggggcgaggaagggggggcuguccucagaagccagggcuggagguaggcuggagggagccuaggauuggcgggccaggguuggagagaggggguuuccaggccaaaggaacgaaagaccggggccggugagcagcggggcccgcgaggagcaggcggugggcaggggcuguccccggggggcuggggagcggccgggcccgaguagggccgggguugggggggcggcugccccgcgcccaggccggacgcgcgcgaggcugcggccgcggggaaagggugcggggagaccaaccugggcacggccggaggcagcggauccgggacuggcacggccuaggcgccgcggcucggcgcucccagcagcggcugccucggcccaggcggcggccucugcgcggccuccaucuugcucggguucuccccggggcgcgcucccgcgccgaggcgcgcgcucucgugcaccg

SEQ ID NO: 14838 - RNA, 16323 nt, Homo sapiens
gaaagugcagcucaguagcgccgcggcgccacguuuacccugcgcagacgccgucgccgccgcugcugccgccgccgcugccacagccuuugccgccacggucuccgccgccgcuguccucgcgcugccucugggagccuccauuguuccagcagcgcccggucccgagaccgggcaucuugggggcucgcgaaacgggcggcggccgacggaguugagaccccagggcgccggcgggaccaggagcggcaggggucagcucaggaaucccggggagccgggaccaaagcguggggcggcagggggccgggguggcgaggucuacggucuccggaguuggggcucccccuucccggcccgacuuuccccgccgaccuccccaaguggggucggagccccggcgggcgcccccggcgaugagcccggacucgagguggccggugagugcgggccugggaccagggcgggaguggccggcagggaagggguaggcuacguucgugggacgcgcacugagccgcguggcccgggaaccucucuggcaacuccaguugggagaacugacagugcauugcuucccagcaggcauccuggggcaacaguguaucuuucggggcugcccgggcuaguggcaggcggggagccuuguuucacuuguuacacuuccacaaaggggaaacgccgccgcauccggagagugggcugcgggcacugccggggcccagcccuaucccuccggcccccgccccuuacuuccuccagcccccugagcuucaggggcagaugcagccgccauucuccuugggcccuccccacgggcuuucuggucuaaguucucgucucccucgccugugccucugcugccggguuccaaggggagauugcugauucgcugugcuacuuugggaaccauucacccgggacccagcuuggaaagaggagagcuuguuugugcuucgguugguuuauguuuaaagacacagccgcagguaggaaauagaagaguugcaguuggacguguagcguuacugaugugaaaaucaggagccguugacaguggagcuggagcagcccacuugccugguuaaggcacagguggagaggccaagagggguuauuuugucagggagcucaugauagcccugccuggcugggauggugccaagccccuagcugaaugguugaacucaacuaggccgagagaaauuggggcagucucugaccaagcugggcuuccugaggccuggugccaucugcugucuacacucacccaggaauguuggggagcggggagggagggccccugcggaccagcauggagcugagcaugccuagauugucgcguucguguuuguacccuuagggccuggcacuugguagucacucaguugaugugugagugggugaacagcucaaauguaauacaagcugcugucacugacuaaaugaccucaguuuucacuuuguuucacaguacaucuccuacccaguaccagggccaggcuccccauaaagaccucaaaaguaaaugaauucuuucugugauccagugauuucugcaggaguccaacgcuaaagcauuagccacccacccauucagcuuucuacauggccuucaucccaucugagcucucagucuggugauccccucauucagcuauucguucaacaggucauucauucguucgccaaaaacugaauguccagugcaugcuagguacuggggauacagagguggauaggcucugguacccuugcuacacagcucccaguccaggggggagacaacuuucaguaugucaagugcugugguagaggugagaauggaaugcuguggaaacagcuccccaugggagagucagagaaguugugucagaagugacauuugagcugguuuuuugaagaaugaguaggagcccaccaaucagaaaguauggagggcauuccaaauagggaucauuuugcaggaaugagagguuauaacauucagggaauggcaagauccccuguguagacaaaaacagcuguaacuuguaaaaagaaaggaggacuagggccagucagugaaaggagcucuuugaauggcaucauagagaauuuggaauauuaucuugaaggaacugggagcaucaggaggcuuuuaaugaagagagugucaugaucauuacuaccugguagaaagaucauucuccuacaugaugugagauugggcuaaagaaguugagacauagggcaggauaaccaggcaagaggugaugagggcccagauaugggcuaugguggaggagauggcauuuggagacacuguagagguaggcuggccagaaucuggugacuccaagugagggggagggcuagaaagacuggggucucuggugcaaauggccaggaacucauccccagccuuauguuaacugaucuguguauucuagaugugacagcauggggguggacuuugaugugaagacuuucugccacaacuugcgggcgacuaagccaccauacgagugcccgguggagaccugccgaaaggucuacaagaguuacagugguauugaguaccaccuguaccacuaugaccacgacaacccaccacccccacaacaaacuccacuccgcaagcacaagaaaaaggggcgccagucacgcccagccaacaagcagucacccagccccucagaggucucacagucaccaggccgugaggugaugagcuaugcacaggcccagcgcaugguggagguggacuugcauggccgcguccaccgcaucagcaucuuugacaaccuggauguggugucagaggaugaggaagcccccgaggaggccccugagaauggcagcaacaaggagaacacugagacaccagcugcuacucccaagucaggcaaacauaagaacaaggagaagcgcaaggacuccaaccaucaccaccaccacaauguuucugcgagcaccacucccaagcugccagagguggucuaucgggagcuggaacaggacaccccugaugccccaccccggccaacuuccuauuaccgguaaggccaccucuaccuugcagcucuggaaaacuggucaagcagggcucacuagccagagagaggugagaggcacagauagaagagugacaggaauaaagaauagugaaagaacacugauuuugccagggcagugaguggaaugguacgccacuaaugcacuuacucuacagugccacacgcuacuccuuuauuuuauucucaaaacucucagguagguauuuuucucauuucacagaugaggaaacuauggucaagaaagggugccagauuuauccuuuuuuuuuuuuuuuuuuuuuuugagacagggccuggcucugucacccugccuggagugcaguuggcucaccccaacuuccuccuuccgugcuuaagugauccucccacucagccuccugaguagcugcaacuacaggcacaugccaccaugcccagcuaguuuuuaaaauuuuuuguagagaugggguuucaccauguugccuaggcuagucuugaauuccuggacucaagugauccacccaccucagccucccaaagugcugggauuacaggcgugagccacugugccuggccagacuuaucugaaaucacaugccaguagauagcugaacugggauucaaacucaggucccucugacuccauagcuguacuguuuccacuguggcaaaacauccuguuucugauuccugguccucuccauuuccuuaugcaugaccuugggaaaugcauccaaauuaacguguguuuuaaggaccccaucugcagagcagauacgguauuucucugucucccaaaagguagaagacuaggaucacugauuucauaagguacuaaaagcacuuuguaaaucugcagagguaauucucccacuauuuguucuguuauugucaucuguccuuuaacauguuuaagcaguauuuuauacuuaaacaauauuuaauacuccuccaguggcccuuuuauuuuugucauuuaauuguuucuuuaacaugagguaaaagaugaagggauauggggggcaguguggugcugaaacuacauggagaaauccuggcugaaggauggcacuaaaaccaaguguaaaaccucucugaaaguuggcauccaaggcaaaaaaggcauucugaugaguuaauuugccaagaguguaaguuuguuuucagcuacuuagaaggccuggucucugaggaggauuugucauaaaagcuuuuauaugaaaagcauuuuuuaccaaaagugcaguccacaugauguuaaaccuccauuuuuuuuuuuuuuuuuuuuuuuuugagacggagucucgcucugucacccaggcuggagugcaguggcgugaucucggcucacugcgaccuccacuggguucaagcaauucucacgccucagccucccgaguagcugggauuacaggcacgugccaccacacccagcuaauuuuugaguuuuuaguagagaugggguuucaccauguuggccaggauggucucgaucuccugaccucaugauccacccgccucagccucccaaagugcugggaugacaggcaugagccaccgcgcccggccuaaaucucaguucuuuaaaagcaaaucuggaaacaagcaauauggccuguagcacuuucuucucuccacuguuugaguuuaagcccaucucccacuuccucucccauucuuucaucuuuucaguccaacuccacuuccuucuggcuuuccacagucuuucucuuuucuguucacacugacugcccuacccaccucugcccuacuccaaacacacagaccccucuuuggacuuccccucccucccaauggcccuugagcucucucugcucuaacaggcagcccagcccagcucauucagcugcuuuucuuccucccuccacuuagacugacucuuucuuucuggggaucagauauguucuucaggggagcaguucucagcagguacacugcaaacaacugagauguguauugcauggaauuuguuaccacuguugguaaaacugcccaaguuuuggaaacgauuuacuuuuuauauaaauugagaagauuugaggucaucucucuaauagcaucacuuucucuugcuugcauucuaauaugcuuccuugagggggagagagaggguggcaugucagcuggugugccaggaauuauacgugacaugcagccuaccuuaucuguacugcagccuguaaucugggugccugugggaguguguuaugcaccaucacauaaugucacgugugucauggcagagaaaagggugagaauuggugcugaagagagcuggugccaaggccuggaagaagccagaugguucacaccauccaugagucauacccuuguucaaagauagggagguugcagucaccuuggggaagagguaaaaggcuaaaaaggaagaagcugcuuccuacaauguuucagucucucuccucccuuccacccccaaaaugccuuucaaaugaacagugaugagugccuguaucuguauggcgaaucagacacaauccccacuucuaucguguaguggaggaguuagacacauacacagcuauaaugcuaggaagguggguaaaggccauacaaaaacuaauaaguuaacauuuauugagugcuugcugcacaccaggcacuguccuaagcacuuuaccugcauuaacucauuuaaugcucagaauagcuaugugaaauagguucagauuauuagcaucaccacuuuacagaugaacaaacaaggcucagggagcuuagcucacuugcccucuguuagacagcacccaggcaguguggcuccagagccugugugugcuggcccacucuagcagccaaaguuccauuucccacauaagaggagaaacgagcuaauguuuuucuagggccugcugugugccacuugacuuagcucauucauuuuucaaaacaacuuuuuaauaaaaagauaaauguacauauuugcacacgucuguauguggucacacaugacuuagugguuagguggcauuuuacaccaaggugcucacacuuccuuccaugggccugcuggggguugcuggagccugaugggguaguaggcacugggcaagguaguauauaaauaaauguaaaggccaagaguuuguggccuauucauuuuuauaauuccauauaacccugacaguuucuuugugaguggguaguauuauccucguucugucaucaguaaaacugagguuuaguacagcagugauguccuaaaagucauaaaauggcagaggcaggauuuaaaucugguuugcuuagaagccaaagccccaucccuuccuuuguacccuguaguuuacagugccagagucuaggccaccuauagcaugccaggcaaggagcaccuucucugugugacaagcaccgagagcagcccucaauuccaggccuguuggcauaguaagugauacagguuggacauuaagagcacugggcuggagguugaaugccucugccucugccacucccuuguuaugugaccuaucuauguuuugauuaacuucucaaagcuuaaguuuucuuaucugcaaaaugaggacaacaagaacacuaacucuauggcugugguaagaauaaauguaauaguuaagcacaaugccuggcucauaggaaauccucaguaaaccuuagcuauuauaauuguuaucucccaaggcuauccagugaacaaacauagcaccuagaguuugacggagccuugagcugaugcugacacuagcugagagaagauccauggcagcucuagucgaggcccugcccaccagugcuaaaacaacuuauauguaauuugucaaugacauccaaugaccuuccuucuuccccgauucuucguaccaucaucuggaccacucuaagggguacuagcugccccaccuuccuccuuuuagaggaggcuggcugagccucugcaaccccaagaagauggugucacauauagcagcuaggacaugagcuuugcaguggcagaccuggguucacaucccagcuccaccacuuucucacaagugagcuggggccaggugauuaaccuuccaagccuuagguuuccuuuucagcaaaauagaaacgaugauaguaccuauaauaucuggaguuaaggugaggaugaaaugagacaacacaucugaagggcauaggcacagaguaagugcucaauggcaaaugacccaucaucuuuaagggagggaaaucucaaccaugugaugcugaguucccuguuuguaccguagguacaucgagaagucugcagaggagcuggacgaggaaguagaguaugacauggacgaggaggacuacaucuggcuggauaucaugaaugagcgucggaagacagaggguguaagucccaucccgcaggagaucuuugaguaccuaauggaccgacuggagaaggagucguacuuugagagucauaauaaaggcgacccuaaugcgcuaguggacgaggaugcuguuugcuguaucugcaaugauggugagugccagaacagcaaugucauccucuucugugacaugugcaaccuggccgugcaccaggagugcuacgguguccccuauaucccugagggccaguggcugugccgccguugccugcagucacccucucgugcuguggauugugcccugugccccaacaagggcggugccuucaagcagacagaugacgggcgcugggcccauguggugugugccuuguggaucccugaggucugcuucgccaacacggucuuccuagagccuauugacagcauugagcacaucccaccagcucgcuggaagcucaccugcuacauuugcaaacaacggggcucaggggccugcauccagugccacaaggccaacuguuacacagcuuuccaugugacaugcgcccagcaggcuggccuuuacaugaagauggagccugugcgggagacaggcgccaacggcaccucuuucaguguccgcaagacagccuacugcgacauccacacgccuccagguucagcacgccgacugccugcccugucccacagcgagggugaggaggaugaagaugaggaggaggaugaggguaagggcuggagcucagagaaagucaagaaggccaaggccaagucccggaucaaaaugaagaaggcacggaagauccuggcagagaagcgggcagcagcaccuguggugucagugcccugcaucccaccacacagguauguggggagccgguggacaggcagaugagggagaaaggagccuccaggagaggagcuggcagccuccugaguggaauggcagggcugggcuaucuucccaggagcugcauagaaguuaaaaagaacauauuuucaaaacagauaguugucuuuagcaggucaccugacuuucacauuaagagccagaaaugucagcuuuuaucuggcauagcuaacaggcguuuuggaacugcccuucauuuugauggugugguuuguuaaguugggauggaagaggauggaacugccacuggcagcaauggaaaaaauggucugaauaugaagaaacaaauagaaugaaaagcggggaaggggaagcucaagaaguugugaagugguuacugcugcucauuugggcugugauggccagggauuuuuuuaguucucuugugccguuuauuugauuuacuauauauuucugcuguacaguuguacuucauuuuaaaaccuucaaaggcucagucucaguggggcucccagggucaaauaguacucugggcugcagugacuagagcagucuuaggggcagaagucccugauugcugguguacaggguuagggaucugguuuagugcugggagcuugguuuccugucugccacgguaccacugauggcaccacucuuucuuccuugccuuaaguccagagucccaggccuuuuggacaagagauccucucccuucauccccauucaggaacuuucacuggccagagacccuugcucugcuuaagagaaucagggcccaacaaguuuuacucuuuguuuccugccucccaggcuuaguaaaaucaccaaccgccugaccauccaaaggaagagccaguucaugcagaggcugcacagcuacuggacacugaagcggcagucacggaauggggucccauugcuacgucgccugcagacacaccugcaaucucagaggaacugugaccaaguugggguacuguguccaguucccugugggcucugggaacuagcgccagggggacgaaaaccaaaauuugcaacuguaguuuccagugucagagggcuuagacucuuuccuccuuuaagcuagcccucaaaccaggaucagcauggaauguucaaugaaaagauguuguuccuauguguuuauguauucauucaacaaacacauaccaagcauuuauucugccaggccuuggggacacacagauugaggcacuaccaauaaauuacugugcucccucuuuuggcuugaccugaguuuccugggcucucuucucccuguugaccuuuccucuggcuuucuaaucauccucugaucuucguuuugccucuacagagagauucugaggauaagaacugggcccuuaaagaacagcucaaguccuggcagcggcuccggcaugacuuggagcgagcucggcugcucguggaauugauccgcaagcgggaaaaacucaaaagggagacggugagugcuccugggccagcccuauuuuauaaaagaaaaaacaaaaaauuagccaggcaugguggcaggcgccuguagucccagcuacucgggaggcugaggcaggagaauggcgugaaccugggaggagggguuugcagugagccaagaucgugccacuguacuccagccugggcgacagagcgagacuccgucucaaaaaaaaaaaaaaaaaaaagacccaggagaaggaauagcguguguaccccagccagauagcagcagggcugacgcuggagucaggucuccuggugcucggugugcuuuuaguucugcuggaagcagaaugucacaggagcguaugaacagaauccucaguuaugugacauagguagcuggugcugguaguucaagaaagggggaagccagaauuguuggugcaaguuucccuggguggagccucauagaagguagaccuguaugaguacacccagcugugagggugggaaagaaggcggguucccaggccagcugggaccauauccucagaccucuuugccacugaacuggccgaggccuggcugaucaggccuuuuucuauguuagaucaagguucagcagauugccauggagaugcagcugacuccuuuccucauccuccuucgcaaaaccuuggagcagcuccaagagaaggacacaggcaacaucuucagcgagccggucccucugucugagguaaccgaauuggacgaaguaagaaucccuuccccucacuccaccuucucucuguuccucucccaguuggaccccugcugcaggucugggccaggacuagauggggaccuugaagagaggggcugguggcucuggggcaggaugaacuggagccacauguaucaccuggacucugucuugucccugucacaccccaagggcccagaaugggaggcagucugcacuccuuccccagaggcagggacugagucugccaaaugaauaaucccagggcaggaagacacuuucggggugcugaacccuagaacggagacuuuagaaggcucagcaccuaaagaaccagcucugaagcccuagguccugacuggcagacucuucucucuaaaagguauaaaaugagaggccugaggcagcagccuccuuauaaguuacuguuaaguaaaaagagcuguaggaaugcaaggugguguuuauuuucagaggaguccccaagccauuuucuuacuaaagccucauauagucuagaaaguauauuuggcucuacuuucaucauuuuccaggagaggaaaaguaggcccagagagguuaagagacuugccaaagucacacagcuugugacugguaaagucaggaccagaauccagcuuuccuuuccccugugcuauaugccugccucuaacuguggugggaggagguugcuggauguguuucaggggggcuuguuaggagcaggguucggggcaauaaggaggauaucuccacuuaaaacaaaccugcccugcccuuccagguaccugacuaccuagaccacaucaaaaagcccauggacuuuuucaccaugaagcagaacuuggaggcuuaccgcuaccugaauuuugaugauuuugaggaggacuucaaccucaucgucagcaacugccucaaguauaacgccaaggacaccaucuucuaccgggcagcagugcggcuucgugagcaggguggugcugugcuccgccaggcccggcgccaggcagaaaaaaugggcauugacuuugagacgggcaugcauaucccccacagccuggcuggagaugaggccacacaccacacugaagauggugggugauauaucacacacacauauaagaggccaaugccggggauggacagcuuuccaaaaguccccuccugggagcaggcaguguaggcagaaagcagcuaggcugagcaguggcaagcuauccccaggaaugcuccccaagaagccagacugggugaauggauagcagugcccgccauuccacaucuuggugcugcuauuuuacagcuguuccuggugagaagcccaggggggaugaguggguuucuugcugccugcccagguucaaggggcccugagggcugcccugagucugaccuuuccccuccaacccuaccccuagcagccgaggaagagcggcuggucuugcuggagaaccagaagcaccugccaguggaagaacagcuaaagcugcuucuggagcggcuggacgaagugaaugccagcaagcagagugugggccgcucacggcgugcaaagaugaucaagaaagagaugacggcacugcggcggaagcuugcccaucagcgagagacgggacgugauggcccugagcggcauggccccucgagccgggguagucugacaccccacccggcagccugugacaaggaugggcagacagauagugcggcagaggagagcagcagccaggagacaagcaaaggucugaaucccauggcaagguggaccccaaagcaagucagacuuuggcucugcagcacacacucaaccccugccauuccccaggcagaggucccuccuacacagcuagcuguacuuucucccucauuccccaaucaggggccucuuagcugccucucuggcuauuuguauaagaguuaaucuuccaaauuccaagccccuaaaaugaucuccccaacguuagcuggaguaaugguccuauaugcccagggcaugacccuggauaucuacccuucucaaaucaggccccucaccaacucuccuucuuucuuucucugcuccaggccugggucccaacauguccucaacccccgcacaugaggugggcaggagaaccucaguucuguucuccaaaaagaacccgaagacagcuggaccgcccaagaggccgggccggccccccaaaaaccgggagagccagaugacccccagccacggaggcaguccuguggggcccccccagcuccccaucaugaguucccugcgucagcgcaagcgggguaggagcccccggcccaguucgagcucagacagcgacagugauaaguccacagaagaccccccaaugggugagccuuaccaucacccagccccccaagagagugagcaaagcugccauucuucccagcauacucccaguuaccccuuuauuugcccauaaaagagcgagcuagaaggguccuuaggaauccuuuaacuccacucacucaucuuacaguugggaaaacugaggcccagagacacuacgacccagcuaaagucccauccagggcccccugccuccauuguaucacuuuaccuuuucucuucucaccuuccuuggggaucuccugcccuuuaagccauuuguguccuaaagccaguaacugccgagggaagcaagggguggagcagggcuguggccaacugugguagacacugcccagagcuagcucugcuggccaagguuggaggaauuuuccagcacagaaggggaacccaagcuccaagucccucuuaccuccaugucaucucugaucuacaucuuccugaccgguuccuucccuccuccccuucccuucaaccaagacuuaccagccaauggcuucagcgguggaaaccaaccagugaagaagaguuucuugguauaccguaaugacugcagccuuccccggagcagcucagacucugaguccagcagcaguagcaguagcagcgcugcuucagaccggaccagguaccagcccuccagaucgaggccaaccucaggggaugcccuuccagggcucuugggccuguguagguuucccuguuggaagugggguggcagccaucucagucuagauuaagauggcucaaacucaagguucucugcuaaauaaauaaaucaguguuaccauuaauagaacagagagaaccauccuggauuaaggugaugauuagaguaugcacuccugccgccacugcucaggcuaacccaccucuguuaggucaucagccuagccccuguggguguuugaauuugaaauuccucauauagccucugcuuuccaaaagucucagacccugcgggcuuuaagagcugagggcacauaccaugcuguuccccauucuuccccuccuuugagcugagcucccauugucuuguccacagcacaacgcccucaaaacaaggccggggcaaacccuccuucucucggggcacuuucccagaggacagcagugaggauaccucaggcacugagaaugaggccuacuccgugggcacuggccgcggcgugggccacagcaguaaguucccuugcccaaggccagggaugcuggggacccagugucagggucucgccagccccccagcugcugauccacccccucucccccauuccugugaagugguaaggaagagucugggccggggagcuggcuggcugucagaggaugaggacuccccgcuggaugcucuggaccucgugugggccaaaugccgaggcuauccaucauacccagcucugguaugcuugcuucuguuacacuucuugcuuuccaaucccagaauacagauucacaguuagcagacuuuuccuacucccugcugagcuguggggcacagaguuucuugguaagguagacuggugggcagauacagcuugaguaccacuuagaggcucccacucaguuucuccaucucucccuuuugcuucucuuugcuccuugggcucugaaauaauuuagcauggaaagaagcugagggucagcauugcaguucuaguagcaugauacccucucuguccccacuucagacauacucucuaaguucuugaggaggaaaagccuugggaggacauggacugaaccaaacugggcucuuauuauauccucagaucauugauccaaagaugccccgagaagguauguuccaccaugggguucccaucccugugcccccacuggaggugcugaaacuuggggagcagaugacccaggaagcccgagagcaucucuaccucguccucuucuuugacaacaaacgaaccugguaaggaggggagcauuuggugugacucacagccacagaugcagcccugugugguaugggggcagacugccaggaaacuccagcaacaggcagacugggcuaucacaagucagugggggagggacuuagaacaguuuuuugagcgaaaggguugugucgaccaugugucugagaggcugagugggcacuaguggacacagcuauagcuagaaaccaaaggaccaucagagacuuaugacaaauauagagguggcucccacccagacucagauggcuucuagacuuaguuuucccaccucugccuccacagugacaaaaugaggauaaagcaggcauaaacauucaggcucugaaucccuguucugucacauuuacacauguagucuuuuuguuaauugucugcagaggauauucaaugucaguaaagucugccuagagccuauggcacaggguagcuauuucuggugaggucagggugccuccuuuuuguacccauaaauacccugugauuacccucccgccgccaccacacaguauaacuguugacugggcucuuucaucucuagaccaugaacaguccuuugagggcagggaccaucacagagucuggccagagugggugcuugggugguguguuugagugaauagaggaggaaggcugguccuuguucucccugagaugauuuauuugaucuucaccuuauccuauaggcaguggcugcccaggaccaagcugguuccucugggugugaaccaggaccuagacaaggagaagaugcuggagggccgcaaguccaacauccgcaagucaguacagaucgccuaccacagggcucugcagcaccgcagcaaggugcaaggcgagcagagcagugagaccagcgauagugauugauacugcucaacacagcccaaccuauagugcccugugacuucucuccuccccuuugcucacuguccuggaguggcaccggccucugcacugacucauuucuggucuuggggccagucucaggggaagcugggugggggaggucccuccugcccuaagugcagcuggacuguacagaacacuccaagggccaauggcaguucagcgcaaggagagggagggcccacaggucagaaaaagcuccagagaccucacagcauuguagggcgggguggugggccaaaguuaggacacugcguaaaacaggccaucccaccaccucuaccugcucaugccaggagaauccauaacugccuagaggccuggggccccuaccggucgugaggugagugggcaucuguccagccuggaagaggggcacuaggugacucccuccccugcuguuguaaauacuguaauuaucggagaauuuaaauuauucucauuuguaacugcguuuccgggucgcgccagagucauuugguacuaaaaaaaaaaaaaaaaaagacugggggcuguccccauuucccuucucuuucccauagauucccccaccuuucaaacugguuuguauuuauuucaaaggaagaaaauauauugauucuuagaaaauaaacugucaauuuagaauucuuu

SEQ ID NO: 14839 - RNA, 16562 nt, Homo sapiens
gcuuucuacauggccuucaucccaucugagcucucagucuggugauccccucauucagcuauucguucaacaggucauucauucguucgccaaaaacugaauguccagugcaugcuagguacuggggauacagagguggauaggcucugguacccuugcuacacagcucccaguccaggggggagacaacuuucaguaugucaagugcugugguagaggugagaauggaaugcuguggaaacagcuccccaugggagagucagagaaguugugucagaagugacauuugagcugguuuuuugaagaaugaguaggagcccaccaaucagaaaguauggagggcauuccaaauagggaucauuuugcaggaaugagagguuauaacauucagggaauggcaagauccccuguguagacaaaaacagcuguaacuuguaaaaagaaaggaggacuagggccagucagugaaaggagcucuuugaauggcaucauagagaauuuggaauauuaucuugaaggaacugggagcaucaggaggcuuuuaaugaagagagugucaugaucauuacuaccugguagaaagaucauucuccuacaugaugugagauugggcuaaagaaguugagacauagggcaggauaaccaggcaagaggugaugagggcccagauaugggcuaugguggaggagauggcauuuggagacacuguagagguaggcuggccagaaucuggugacuccaagugagggggagggcuagaaagacuggggucucuggugcaaauggccaggaacucauccccagccuuauguuaacugaucuguguauucuagaugugacagcauggggguggacuuugaugugaagacuuucugccacaacuugcgggcgacuaagccaccauacgagugcccgguggagaccugccgaaaggucuacaagaguuacagugguauugaguaccaccuguaccacuaugaccacgacaacccaccacccccacaacaaacuccacuccgcaagcacaagaaaaaggggcgccagucacgcccagccaacaagcagucacccagccccucagaggucucacagucaccaggccgugaggugaugagcuaugcacaggcccagcgcaugguggagguggacuugcauggccgcguccaccgcaucagcaucuuugacaaccuggauguggugucagaggaugaggaagcccccgaggaggccccugagaauggcagcaacaaggagaacacugagacaccagcugcuacucccaagucaggcaaacauaagaacaaggagaagcgcaaggacuccaaccaucaccaccaccacaauguuucugcgagcaccacucccaagcugccagagguggucuaucgggagcuggaacaggacaccccugaugccccaccccggccaacuuccuauuaccgguaaggccaccucuaccuugcagcucuggaaaacuggucaagcagggcucacuagccagagagaggugagaggcacagauagaagagugacaggaauaaagaauagugaaagaacacugauuuugccagggcagugaguggaaugguacgccacuaaugcacuuacucuacagugccacacgcuacuccuuuauuuuauucucaaaacucucagguagguauuuuucucauuucacagaugaggaaacuauggucaagaaagggugccagauuuauccuuuuuuuuuuuuuuuuuuuuuuugagacagggccuggcucugucacccugccuggagugcaguuggcucaccccaacuuccuccuuccgugcuuaagugauccucccacucagccuccugaguagcugcaacuacaggcacaugccaccaugcccagcuaguuuuuaaaauuuuuuguagagaugggguuucaccauguugccuaggcuagucuugaauuccuggacucaagugauccacccaccucagccucccaaagugcugggauuacaggcgugagccacugugccuggccagacuuaucugaaaucacaugccaguagauagcugaacugggauucaaacucaggucccucugacuccauagcuguacuguuuccacuguggcaaaacauccuguuucugauuccugguccucuccauuuccuuaugcaugaccuugggaaaugcauccaaauuaacguguguuuuaaggaccccaucugcagagcagauacgguauuucucugucucccaaaagguagaagacuaggaucacugauuucauaagguacuaaaagcacuuuguaaaucugcagagguaauucucccacuauuuguucuguuauugucaucuguccuuuaacauguuuaagcaguauuuuauacuuaaacaauauuuaauacuccuccaguggcccuuuuauuuuugucauuuaauuguuucuuuaacaugagguaaaagaugaagggauauggggggcaguguggugcugaaacuacauggagaaauccuggcugaaggauggcacuaaaaccaaguguaaaaccucucugaaaguuggcauccaaggcaaaaaaggcauucugaugaguuaauuugccaagaguguaaguuuguuuucagcuacuuagaaggccuggucucugaggaggauuugucauaaaagcuuuuauaugaaaagcauuuuuuaccaaaagugcaguccacaugauguuaaaccuccauuuuuuuuuuuuuuuuuuuuuuuuugagacggagucucgcucugucacccaggcuggagugcaguggcgugaucucggcucacugcgaccuccacuggguucaagcaauucucacgccucagccucccgaguagcugggauuacaggcacgugccaccacacccagcuaauuuuugaguuuuuaguagagaugggguuucaccauguuggccaggauggucucgaucuccugaccucaugauccacccgccucagccucccaaagugcugggaugacaggcaugagccaccgcgcccggccuaaaucucaguucuuuaaaagcaaaucuggaaacaagcaauauggccuguagcacuuucuucucuccacuguuugaguuuaagcccaucucccacuuccucucccauucuuucaucuuuucaguccaacuccacuuccuucuggcuuuccacagucuuucucuuuucuguucacacugacugcccuacccaccucugcccuacuccaaacacacagaccccucuuuggacuuccccucccucccaauggcccuugagcucucucugcucuaacaggcagcccagcccagcucauucagcugcuuuucuuccucccuccacuuagacugacucuuucuuucuggggaucagauauguucuucaggggagcaguucucagcagguacacugcaaacaacugagauguguauugcauggaauuuguuaccacuguugguaaaacugcccaaguuuuggaaacgauuuacuuuuuauauaaauugagaagauuugaggucaucucucuaauagcaucacuuucucuugcuugcauucuaauaugcuuccuugagggggagagagaggguggcaugucagcuggugugccaggaauuauacgugacaugcagccuaccuuaucuguacugcagccuguaaucugggugccugugggaguguguuaugcaccaucacauaaugucacgugugucauggcagagaaaagggugagaauuggugcugaagagagcuggugccaaggccuggaagaagccagaugguucacaccauccaugagucauacccuuguucaaagauagggagguugcagucaccuuggggaagagguaaaaggcuaaaaaggaagaagcugcuuccuacaauguuucagucucucuccucccuuccacccccaaaaugccuuucaaaugaacagugaugagugccuguaucuguauggcgaaucagacacaauccccacuucuaucguguaguggaggaguuagacacauacacagcuauaaugcuaggaagguggguaaaggccauacaaaaacuaauaaguuaacauuuauugagugcuugcugcacaccaggcacuguccuaagcacuuuaccugcauuaacucauuuaaugcucagaauagcuaugugaaauagguucagauuauuagcaucaccacuuuacagaugaacaaacaaggcucagggagcuuagcucacuugcccucuguuagacagcacccaggcaguguggcuccagagccugugugugcuggcccacucuagcagccaaaguuccauuucccacauaagaggagaaacgagcuaauguuuuucuagggccugcugugugccacuugacuuagcucauucauuuuucaaaacaacuuuuuaauaaaaagauaaauguacauauuugcacacgucuguauguggucacacaugacuuagugguuagguggcauuuuacaccaaggugcucacacuuccuuccaugggccugcuggggguugcuggagccugaugggguaguaggcacugggcaagguaguauauaaauaaauguaaaggccaagaguuuguggccuauucauuuuuauaauuccauauaacccugacaguuucuuugugaguggguaguauuauccucguucugucaucaguaaaacugagguuuaguacagcagugauguccuaaaagucauaaaauggcagaggcaggauuuaaaucugguuugcuuagaagccaaagccccaucccuuccuuuguacccuguaguuuacagugccagagucuaggccaccuauagcaugccaggcaaggagcaccuucucugugugacaagcaccgagagcagcccucaauuccaggccuguuggcauaguaagugauacagguuggacauuaagagcacugggcuggagguugaaugccucugccucugccacucccuuguuaugugaccuaucuauguuuugauuaacuucucaaagcuuaaguuuucuuaucugcaaaaugaggacaacaagaacacuaacucuauggcugugguaagaauaaauguaauaguuaagcacaaugccuggcucauaggaaauccucaguaaaccuuagcuauuauaauuguuaucucccaaggcuauccagugaacaaacauagcaccuagaguuugacggagccuugagcugaugcugacacuagcugagagaagauccauggcagcucuagucgaggcccugcccaccagugcuaaaacaacuuauauguaauuugucaaugacauccaaugaccuuccuucuuccccgauucuucguaccaucaucuggaccacucuaagggguacuagcugccccaccuuccuccuuuuagaggaggcuggcugagccucugcaaccccaagaagauggugucacauauagcagcuaggacaugagcuuugcaguggcagaccuggguucacaucccagcuccaccacuuucucacaagugagcuggggccaggugauuaaccuuccaagccuuagguuuccuuuucagcaaaauagaaacgaugauaguaccuauaauaucuggaguuaaggugaggaugaaaugagacaacacaucugaagggcauaggcacagaguaagugcucaauggcaaaugacccaucaucuuuaagggagggaaaucucaaccaugugaugcugaguucccuguuuguaccguagguacaucgagaagucugcagaggagcuggacgaggaaguagaguaugacauggacgaggaggacuacaucuggcuggauaucaugaaugagcgucggaagacagaggguguaagucccaucccgcaggagaucuuugaguaccuaauggaccgacuggagaaggagucguacuuugagagucauaauaaaggcgacccuaaugcgcuaguggacgaggaugcuguuugcuguaucugcaaugauggugagugccagaacagcaaugucauccucuucugugacaugugcaaccuggccgugcaccaggagugcuacgguguccccuauaucccugagggccaguggcugugccgccguugccugcagucacccucucgugcuguggauugugcccugugccccaacaagggcggugccuucaagcagacagaugacgggcgcugggcccauguggugugugccuuguggaucccugaggucugcuucgccaacacggucuuccuagagccuauugacagcauugagcacaucccaccagcucgcuggaagcucaccugcuacauuugcaaacaacggggcucaggggccugcauccagugccacaaggccaacuguuacacagcuuuccaugugacaugcgcccagcaggcuggccuuuacaugaagauggagccugugcgggagacaggcgccaacggcaccucuuucaguguccgcaagacagccuacugcgacauccacacgccuccagguucagcacgccgacugccugcccugucccacagcgagggugaggaggaugaagaugaggaggaggaugaggguaagggcuggagcucagagaaagucaagaaggccaaggccaagucccggaucaaaaugaagaaggcacggaagauccuggcagagaagcgggcagcagcaccuguggugucagugcccugcaucccaccacacagguauguggggagccgguggacaggcagaugagggagaaaggagccuccaggagaggagcuggcagccuccugaguggaauggcagggcugggcuaucuucccaggagcugcauagaaguuaaaaagaacauauuuucaaaacagauaguugucuuuagcaggucaccugacuuucacauuaagagccagaaaugucagcuuuuaucuggcauagcuaacaggcguuuuggaacugcccuucauuuugauggugugguuuguuaaguugggauggaagaggauggaacugccacuggcagcaauggaaaaaauggucugaauaugaagaaacaaauagaaugaaaagcggggaaggggaagcucaagaaguugugaagugguuacugcugcucauuugggcugugauggccagggauuuuuuuaguucucuugugccguuuauuugauuuacuauauauuucugcuguacaguuguacuucauuuuaaaaccuucaaaggcucagucucaguggggcucccagggucaaauaguacucugggcugcagugacuagagcagucuuaggggcagaagucccugauugcugguguacaggguuagggaucugguuuagugcugggagcuugguuuccugucugccacgguaccacugauggcaccacucuuucuuccuugccuuaaguccagagucccaggccuuuuggacaagagauccucucccuucauccccauucaggaacuuucacuggccagagacccuugcucugcuuaagagaaucagggcccaacaaguuuuacucuuuguuuccugccucccaggcuuaguaaaaucaccaaccgccugaccauccaaaggaagagccaguucaugcagaggcugcacagcuacuggacacugaagcggcagucacggaauggggucccauugcuacgucgccugcagacacaccugcaaucucagaggaacugugaccaaguugggguacuguguccaguucccugugggcucugggaacuagcgccagggggacgaaaaccaaaauuugcaacuguaguuuccagugucagagggcuuagacucuuuccuccuuuaagcuagcccucaaaccaggaucagcauggaauguucaaugaaaagauguuguuccuauguguuuauguauucauucaacaaacacauaccaagcauuuauucugccaggccuuggggacacacagauugaggcacuaccaauaaauuacugugcucccucuuuuggcuugaccugaguuuccugggcucucuucucccuguugaccuuuccucuggcuuucuaaucauccucugaucuucguuuugccucuacagagagauucugaggauaagaacugggcccuuaaagaacagcucaaguccuggcagcggcuccggcaugacuuggagcgagcucggcugcucguggaauugauccgcaagcgggaaaaacucaaaagggagacggugagugcuccugggccagcccuauuuuauaaaagaaaaaacaaaaaauuagccaggcaugguggcaggcgccuguagucccagcuacucgggaggcugaggcaggagaauggcgugaaccugggaggagggguuugcagugagccaagaucgugccacuguacuccagccugggcgacagagcgagacuccgucucaaaaaaaaaaaaaaaaaaaagacccaggagaaggaauagcguguguaccccagccagauagcagcagggcugacgcuggagucaggucuccuggugcucggugugcuuuuaguucugcuggaagcagaaugucacaggagcguaugaacagaauccucaguuaugugacauagguagcuggugcugguaguucaagaaagggggaagccagaauuguuggugcaaguuucccuggguggagccucauagaagguagaccuguaugaguacacccagcugugagggugggaaagaaggcggguucccaggccagcugggaccauauccucagaccucuuugccacugaacuggccgaggccuggcugaucaggccuuuuucuauguuagaucaagguucagcagauugccauggagaugcagcugacuccuuuccucauccuccuucgcaaaaccuuggagcagcuccaagagaaggacacaggcaacaucuucagcgagccggucccucugucugagguaaccgaauuggacgaaguaagaaucccuuccccucacuccaccuucucucuguuccucucccaguuggaccccugcugcaggucugggccaggacuagauggggaccuugaagagaggggcugguggcucuggggcaggaugaacuggagccacauguaucaccuggacucugucuugucccugucacaccccaagggcccagaaugggaggcagucugcacuccuuccccagaggcagggacugagucugccaaaugaauaaucccagggcaggaagacacuuucggggugcugaacccuagaacggagacuuuagaaggcucagcaccuaaagaaccagcucugaagcccuagguccugacuggcagacucuucucucuaaaagguauaaaaugagaggccugaggcagcagccuccuuauaaguuacuguuaaguaaaaagagcuguaggaaugcaaggugguguuuauuuucagaggaguccccaagccauuuucuuacuaaagccucauauagucuagaaaguauauuuggcucuacuuucaucauuuuccaggagaggaaaaguaggcccagagagguuaagagacuugccaaagucacacagcuugugacugguaaagucaggaccagaauccagcuuuccuuuccccugugcuauaugccugccucuaacuguggugggaggagguugcuggauguguuucaggggggcuuguuaggagcaggguucggggcaauaaggaggauaucuccacuuaaaacaaaccugcccugcccuuccagguaccugacuaccuagaccacaucaaaaagcccauggacuuuuucaccaugaagcagaacuuggaggcuuaccgcuaccugaauuuugaugauuuugaggaggacuucaaccucaucgucagcaacugccucaaguauaacgccaaggacaccaucuucuaccgggcagcagugcggcuucgugagcaggguggugcugugcuccgccaggcccggcgccaggcagaaaaaaugggcauugacuuugagacgggcaugcauaucccccacagccuggcuggagaugaggccacacaccacacugaagauggugggugauauaucacacacacauauaagaggccaaugccggggauggacagcuuuccaaaaguccccuccugggagcaggcaguguaggcagaaagcagcuaggcugagcaguggcaagcuauccccaggaaugcuccccaagaagccagacugggugaauggauagcagugcccgccauuccacaucuuggugcugcuauuuuacagcuguuccuggugagaagcccaggggggaugaguggguuucuugcugccugcccagguucaaggggcccugagggcugcccugagucugaccuuuccccuccaacccuaccccuagcagccgaggaagagcggcuggucuugcuggagaaccagaagcaccugccaguggaagaacagcuaaagcugcuucuggagcggcuggacgaagugaaugccagcaagcagagugugggccgcucacggcgugcaaagaugaucaagaaagagaugacggcacugcggcggaagcuugcccaucagcgagagacgggacgugauggcccugagcggcauggccccucgagccgggguagucugacaccccacccggcagccugugacaaggaugggcagacagauagugcggcagaggagagcagcagccaggagacaagcaaaggucugaaucccauggcaagguggaccccaaagcaagucagacuuuggcucugcagcacacacucaaccccugccauuccccaggcagaggucccuccuacacagcuagcuguacuuucucccucauuccccaaucaggggccucuuagcugccucucuggcuauuuguauaagaguuaaucuuccaaauuccaagccccuaaaaugaucuccccaacguuagcuggaguaaugguccuauaugcccagggcaugacccuggauaucuacccuucucaaaucaggccccucaccaacucuccuucuuucuuucucugcuccaggccugggucccaacauguccucaacccccgcacaugaggugggcaggagaaccucaguucuguucuccaaaaagaacccgaagacagcuggaccgcccaagaggccgggccggccccccaaaaaccgggagagccagaugacccccagccacggaggcaguccuguggggcccccccagcuccccaucaugaguucccugcgucagcgcaagcgggguaggagcccccggcccaguucgagcucagacagcgacagugauaaguccacagaagaccccccaaugggugagccuuaccaucacccagccccccaagagagugagcaaagcugccauucuucccagcauacucccaguuaccccuuuauuugcccauaaaagagcgagcuagaaggguccuuaggaauccuuuaacuccacucacucaucuuacaguugggaaaacugaggcccagagacacuacgacccagcuaaagucccauccagggcccccugccuccauuguaucacuuuaccuuuucucuucucaccuuccuuggggaucuccugcccuuuaagccauuuguguccuaaagccaguaacugccgagggaagcaagggguggagcagggcuguggccaacugugguagacacugcccagagcuagcucugcuggccaagguuggaggaauuuuccagcacagaaggggaacccaagcuccaagucccucuuaccuccaugucaucucugaucuacaucuuccugaccgguuccuucccuccuccccuucccuucaaccaagacuuaccagccaauggcuucagcgguggaaaccaaccagugaagaagaguuucuugguauaccguaaugacugcagccuuccccggagcagcucagacucugaguccagcagcaguagcaguagcagcgcugcuucagaccggaccagguaccagcccuccagaucgaggccaaccucaggggaugcccuuccagggcucuugggccuguguagguuucccuguuggaagugggguggcagccaucucagucuagauuaagauggcucaaacucaagguucucugcuaaauaaauaaaucaguguuaccauuaauagaacagagagaaccauccuggauuaaggugaugauuagaguaugcacuccugccgccacugcucaggcuaacccaccucuguuaggucaucagccuagccccuguggguguuugaauuugaaauuccucauauagccucugcuuuccaaaagucucagacccugcgggcuuuaagagcugagggcacauaccaugcuguuccccauucuuccccuccuuugagcugagcucccauugucuuguccacagcacaacgcccucaaaacaaggccggggcaaacccuccuucucucggggcacuuucccagaggacagcagugaggauaccucaggcacugagaaugaggccuacuccgugggcacuggccgcggcgugggccacagcaguaaguucccuugcccaaggccagggaugcuggggacccagugucagggucucgccagccccccagcugcugauccacccccucucccccauuccugugaagugguaaggaagagucugggccggggagcuggcuggcugucagaggaugaggacuccccgcuggaugcucuggaccucgugugggccaaaugccgaggcuauccaucauacccagcucugguaugcuugcuucuguuacacuucuugcuuuccaaucccagaauacagauucacaguuagcagacuuuuccuacucccugcugagcuguggggcacagaguuucuugguaagguagacuggugggcagauacagcuugaguaccacuuagaggcucccacucaguuucuccaucucucccuuuugcuucucuuugcuccuugggcucugaaauaauuuagcauggaaagaagcugagggucagcauugcaguucuaguagcaugauacccucucuguccccacuucagacauacucucuaaguucuugaggaggaaaagccuugggaggacauggacugaaccaaacugggcucuuauuauauccucagaucauugauccaaagaugccccgagaagguauguuccaccaugggguucccaucccugugcccccacuggaggugcugaaacuuggggagcagaugacccaggaagcccgagagcaucucuaccucguccucuucuuugacaacaaacgaaccugguaaggaggggagcauuuggugugacucacagccacagaugcagcccugugugguaugggggcagacugccaggaaacuccagcaacaggcagacugggcuaucacaagucagugggggagggacuuagaacaguuuuuugagcgaaaggguugugucgaccaugugucugagaggcugagugggcacuaguggacacagcuauagcuagaaaccaaaggaccaucagagacuuaugacaaauauagagguggcucccacccagacucagauggcuucuagacuuaguuuucccaccucugccuccacagugacaaaaugaggauaaagcaggcauaaacauucaggcucugaaucccuguucugucacauuuacacauguagucuuuuuguuaauugucugcagaggauauucaaugucaguaaagucugccuagagccuauggcacaggguagcuauuucuggugaggucagggugccuccuuuuuguacccauaaauacccugugauuacccucccgccgccaccacacaguauaacuguugacugggcucuuucaucucuagaccaugaacaguccuuugagggcagggaccaucacagagucuggccagagugggugcuugggugguguguuugagugaauagaggaggaaggcugguccuuguucucccugagaugauuuauuugaucuucaccuuauccuauaggcaguggcugcccaggaccaagcugguuccucugggugugaaccaggaccuagacaaggagaagaugcuggagggccgcaaguccaacauccgcaagucaguacagaucgccuaccacagggcucugcagcaccgcagcaaggugcaaggcgagcagagcagugagaccagcgauagugauugauacugcucaacacagcccaaccuauagugcccugugacuucucuccuccccuuugcucacuguccuggaguggcaccggccucugcacugacucauuucuggucuuggggccagucucaggggaagcugggugggggaggucccuccugcccuaagugcagcuggacuguacagaacacuccaagggccaauggcaguucagcgcaaggagagggagggcccacaggucagaaaaagcuccagagaccucacagcauuguagggcgggguggugggccaaaguuaggacacugcguaaaacaggccaucccaccaccucuaccugcucaugccaggagaauccauaacugccuagaggccuggggccccuaccggucgugaggugagugggcaucuguccagccuggaagaggggcacuaggugacucccuccccugcuguuguaaauacuguaauuaucggagaauuuaaauuauucucauuuguaacugcguuuccgggucgcgccagagucauuugguacuaaaaaaaaaaaaaaaaaagacugggggcuguccccauuucccuucucuuucccauagauucccccaccuuucaaacugguuuguauuuauuucaaaggaagaaaauauauugauucuuagaaaauaaacugucaauuuagaauucuuuguucuugcccccugccagggcaaaggggauacaaagggagguucugugccccagggaugauacauaauugggcccaagugguugcugacugcugugcaugcuacauuucauaagacacagcaaagagagccccuguugcccaugcauggagugaguggcaggcccuguguugagcaccuuuagacauucagcuuugcguaauccuugcaauaacuauaggguaguuuaauaauagacugguuaucuccacaaagaugcugaaguuucaaaaaauuaucuugccuaaguuccuacaacuaggaaggugcagagcuagaauuggaacccaggucuguuugcaaaccuggcucuucaaccaguaugcugaacugccaggggaagagucaacuaucgauuccuacuuggcccuuagaggccucaaguccuuugccaguggcauggcccaaguguuucagcaucaauacagcugagaccuuccccacugcuuaaccggagacagagcugggauggagacgguugcucuuugcucacccccaaccucagcaccuucuuuccagacuccaccgacauuuauugaaggaaugccuuccaagugcuaggcgccugugggauggcaugccuacagauaggaacagucacaggaagaaggggcggcccaggccuugcagccacugaggacuggcacugagacaaugauggcacuggucugauguugauuccaugcugacgguacacuccgcuaggucucuggcugggacacaagggucaauccgcugcagauguugcucuucaagaauuugcagucugggcggggugcgguggcucacgccuguaaucccaacacuuuaagaggccgaggcggcuggaucacgaggucaagagaucgagaccaugcuagccaacauggugaaaccccaucucuacuaaaaauacaaaaauuagcugggcgugguggcgcgcaccuguagucccagcuacucgggaggcugaggcaggagaaucgcuugaacccgggaggcggagcuugcagugagccgagaucgcgccaucacacuccagccuaggcgacagagugagacuccgucucaaagaaaaaaaacuugcagccugauaguuaagauacagcaaccccaaaucccuaugcuaaaaggugagaauggcccagauaaaggucaugucuccuagcucccugcuuuuucaugccauccuccagaagggaagaaauuaaauaauccauccuccuacuccaggcgacuagaaggcaggcugccucagggccacacacugggacuuggacucaaccugaugggcuucugggcccagccccagacaaacccccggcaaacgucccauuccgaggaaagcaugagcagauggaguauggaagaaaugcccaagacggcaggcagcagcuguggcggccggcgggacgacaauccgaggagaggccucugauguccugaggucucagaggacgccuaaaggccuugaaugggacaagcuuagcgggcgggcgcagaagagaauaauacucuggagacacuucccgagggcucuggggccggagcuguguucgcuccgguucuuggugaagacaggguucgugggaggcggcccaaggagggcgaacgccuaagacugcaaaggcucgggggagaacggcucucggagaacgggcuggggaaggacguggcucugaagacggacagcccugaggaaccgcggggcgcccagauggaacucguuagcgccccgagugcagacaaucccggagggggaaaggcgagcagcuggcagagagcccagugccggccaaccgcgcgagcgccucagaacgg

SEQ ID NO: 14840 - RNA, 8211 nt, Homo sapiens
cagaagaacacagcugugcgcgcccacaggcucugggggcgggagaagauaagucgcaaggagggggcgggaccuacaccucaggaaagccggagaauuggggcacgaagcggggcuuugaugacccgcaaagggcgaggcaugcaggagguggaggaauuaagugaaacagggaagguuguuaaacagcaccgugugggcgaggccuuaagggucgugguccuugucugggcggggucuuugggcgucgacgaggccugguucuggguaggcggggcuacuacggggcggugccugcuguggaaaugccugcccgcgcgcuucugcccaggcgcauggggcaucguacucuagccuccacuccugcccugugggccuccaucccgugcccucgcucugagcugcgccuggaccugguucugccuucuggacaaucuuuccggugagugacugagccugagaagccuguccccucggacuggcuccugccgccucaacacugccuggcaugggguacaaaggaauuugggggaugauggaagaaacccgggguacaaaagaggaaacaagcacggguagccaaccuguuaccuuuaauaugucuguacagugauaauuguaaggauccagcgguauaaccgaugcagaagauaauagcacuuguuuuucuuuuuuugagacagggucucgcucuguugcccagguaggaaugcagagaggcccauuccagccucgaccccccgggcgcagccucccgaguagcugggacuacaggugugcgccaugcccgguuaaauuuuuguauuuuuuguagaggugagguuucgccauguugcucagacuggaagauagcacuguuacuuguauuaguuucguacauggagcuauuguaggauaggagggaccccaaagggugcaagaaaggaaauugagugccaggguugucaugugccuugggcucagguggagggagcaaaguccugcacacuggagugguguacuagcggaucaaguauggacacugacucagacugaggagcagcuccacugcacuguguaccgaggagacaagagccaggcuagcaggcccacaccagacgagcuggaggccgugcgcaaguacuuccagcuagauguuacccuggcucaacuguaucaccacugggguuccguggacucccacuuccaagagguggcucagaaauuccaaggugaguacaggaccugggcugggguuaggguucuuggacauaagucacuucucuaugacucaguuuugccaccuguaaaauggggauuauaucuacuucauaggcuuuuaugaggauuuaaggaacuaauacauguaaagugcuuagaauaaugccaggcacauaguaaguauuauuaccauuauuauuauccugcuaaucaccauagugaagugacaaggauuuugagcccauuccugguugugugaccuagggcaagugauuucauucauucuguaaauauauacaaagcaucugcugugugaccggggauacaccagugaacaaaacagacccaaaugccaguccucauggagcuuacauuguggccucuuuaucuguggaaugggaugguaacucagcccucacaagaugcuaugaggaaugagaggucugguguugcuuucucuaacggugcugacucucauucuccugggauccuccuggaguuuugguaccuaggaucugaccugugggugggaagaggccacacccaacagcagguaccucuccuacccccugcauuucuggucuccaggugugcgacugcugcgacaagaccccaucgaaugccuuuucucuuuuaucuguuccuccaacaacaacaucgcccgcaucacuggcaugguggagcggcugugccaggcuuuuggaccucggcucauccagcuugaugaugucaccuaccauggcuuccccagccugcaggcccuggcuggugaguagguggguccccugcccccaggccuuccaucagcuuucaagaucuguucauuucuccccugguuaccuucucaaggcuuccugccuucccaaacacuuccccuauccagaaccgcccugccuggucugaucaacuccaguuacucauccucccuaugcaucccuaaaaugucagcaccucacuggucugugcuuuuugcccaauggguucaaugccuaaucagaaaaauaucuguauacaauguacaguaguuugggguuaagagcaugcauucuggggacagacccaugccugguucugaaccccaacucucacuugggcacauuauuuagcaucucuguacuaaaguuucuucaucugugaaguagaauaauaauagcaccuaccuaugcuauuauuggaguugucaugaggguugaagaaaggaauauacauacugcaccuagcacaguguuuggcacacaggaaguauauguaaaauucaagcugguaucagccaggcgcaguggcucacaccuggcuaacacagugaaaccccgucuccagccugggcaacagagcgagacucugucucaaaaaaaaaaaaaaaaaaaaaaauucaagcugguaucauuguagugaaugggauaguuuuguaucuaagaacacguguguucuucacaguagcccuguaaggcaaauguuuuacagaggcaaguguaucgauuggcagaugugagaaccaagcuaggacaagugcuugggaacugcauagcaaagagacagacugccucaaaacaggagaauguuuuuggugcuuagaaacccauuccuggccgggcgugguggcucacgccuguaaucccaacacuuugggaggucgaggcaggcagaucaucugaggucaggaguucaagaccagccuggccaacauggugaaaccccaucucuacuaaaaauacgaaaauuagucaggcgugauggcaggcaccugucccagcuacuccggagggugaggcaggagaauugcuugaacccgggagcaggaggcuccagugaaccaagaucagaccacagcacuccagccuggguuacagagcgagacuccaucucaaaacaaacaaaaagaaaccugggucaggcacgguggcucacaccuguaaucccaacacuuugggaggcugaggcagguggaucaccugaggucgggaguuugagaccagacuggccaaccuggugaaacccgcucucugcuaaaaauuagcugggcgugguggcagguaccuguaaucccagcuacucaggaggcugaggcgggagaaucauuugaaccugggaagcagagguugcagugagcugagaucaugccauugcacuccagccugggcgacagggcgacagggcgagacuccgucucaaaaaaaaaaaaaaaaccuggccgggcgugguggcucacacccguaaucccagcauuuugggaggccgaggcggguggaucacgaggucaggagaucaagaccauccugccuaauacggugaaaccccgucucuacuaaaaauacaaaaaaaauuagccgggugugguggugggcgccuguagucccagcuacuugggaggcugaggcaggagaauggcgugaacccgggaggcgaagcuugcagugagccgagaucgugccacugcacuccagccugggcgacagagugagacucugucucaacaaaaaaaaaaagaaaccuguucuugagucucagcuccuggcuuaguuagucauaaggccucaagaaagucauucaccucuuccggcuucucuuagcuuguuuguagaaugggaauaacaguuucuaucuagaagggcuuugggagugaauaaagcaaucaugaggcaguguaguguaauggguuaagagcacggcguuagccaggugggguagcucaugcugguaauuucagcacuuuugggagcccaaggugggaggauggcuugagcccaggaguuugagaccagccugggcaacauagugagaccucaucucuacaaaaaauaaacaaaauuagccaggcauggugacacaagccuguagucucagcuacucaggaggcugaggugggaggaucgcuugagccuuaggaggucaaggcuguagugaacugagauugugccacugcauuccagccugggugacagagcaagacccugugucaaaaaaagaaaaagcacaggucuuggugucccagaccuaggugcaagaucuuaucucccccauguccuuucuuaaguaaguuaaccucuucuaagcccucauuuucuccacauguaaaaugggaaaacagcaguacugucagugggguucuugggaaaaguaagcaugauaauauaucugaagcauguugccuagcacuugaucauagaagcuguugcuauauugugguuauuuuuuuagaucaugagugugaacacucuuucggaaagguuaaggaacucaguuggggagcuccucaagggaagcaaguccucagucccuggacuagacuugggcuccggggccaauucauagcaggugcucagaaaacauguguagagggacaggacccaggccuaacccuuucccuugcacauaaaaguguccacuaucccauagaggguggggagguaggaggggaacuuaggaaaagcacucuugugagguagagagcucacuuacuagccuaaggacaggaagaacuugaagaugccugaugcuugcccuccuccucacuccccgcagggccagagguggaggcucaucucaggaagcugggccugggcuaucgugcccguuacgugagugccagugcccgagccauccuggaagaacagggcgggcuagccuggcugcagcagcuacgagaguccucauaugaggaggcccacaaggcccucugcauccugccuggagugggcaccaaggugaggccccaggggguaggagcugcccucucuacugacacuaagaggagagcaggaaaugagccaagccugggagcuggguggaggcuuggcuuccggaggcagagcaggaaggagaaaggauauaaguagauguuuuaugagagaaaaaagcagagugcagaaagaguagaaaggauauagcccuuugaaugaauuucuagaaagaccauuuguucagaugcaacacauauaugcugcuauauauaugcagcaauuuccagaaggaaauugcaggaaacuaaauaauaguuuccuugggggagacaaaugggaagauauuucuucuuuucgguuuuuuguuuguuuguuuguuuugguagaaauaggcucuuaacaauguugccuaggcuggucuuaaacucuugcccucaagcaguguuccugcuuugcccucccaaagugcuggaauuacagggaugagccacugcucccggccacauuuuguuccuuucguaaaaugacauguacugacaaaacuuuuugcuugaugucaauaggguuaacuggcaauaagaugacuggaaauuaggcauuugucuuuuuuuuuuuuuuuuugagguggagucuugcuuuguugccaggcuggagugcaguggugcaaucucggcucacugcaaccuccgccucccggcuucaagcuauucuccugccucagccuccagauuagcugggauuacaggcaugcgccaccacacccagcuaauuuuuguauuuuuaguagagaugggguuucaccauguugggccaggauggucucaaucugaccucgagauccaccugccucagccucccaaagugcugggauuacaggcgugagccacugcacccagccuuuuuuuuucuuuauacuucucuguaguuuaaaaaaugaauuuuugcuuaaagauuuuuuuuugaugggcuuuggacuacagccuaacauuaaaucuugguucugccuauucucagccaugugacuuuggccaggucacuucaccuuucaaagccucaguuuucuugucuguaaagugggugugguaauaccuucuucccagguuaugauaaccuggcccacauagguguucagcuaguagcaccucuuauuacagcaauuucaguguauucauaggccgcgcaugguggcucacgccuguaaucccagcacuuugggaggccaagguggacagaucacuugaggucaggaguucgagaccaggcuggccaacauggugaaaccccaucucuacuaaaaacacaaaaauuagccacacgugguggcacaugccuguaaucccagcuacuugggaggcugagguaggagaauugcuugaaccugggagagccaggauugcaccagugcacuccagccuaggcaacagagcgagacuccaucucaaaaacaaacaaaaaaaaaguguauucauagauaguaucuguugauugagaauauagaacaacaguaaccccagagugaaggagaaagcagccggcuuuggggcuauaagcaagaugcuggccacaugcugcccuucuuccacaagggcucauucugugucugucaaagguggcugacugcaucugccugauggcccuagacaagccccaggcugugcccguggauguccauauguggcacauugcccaacgugacuacagcuggcacccuaccacgucccaggcgaagggaccgagcccccagaccaacaaggaacugggugaggaaagugggcugcaggggcuggcagugggcugggaugguagaaacuucucucucucuuagucaccucucccucagacccuacuucuguugaugggucacagaaggggucagauaacuuagucucaucacuucugauuuaggaaacuuuuuccggagccuguggggaccuuaugcuggcugggcccaagcggugaguguaccuagguguccucccuagguuuccucuccuccagcccagacccaguggacucuuccaccaccgccccagguggcccuaaaggacucuccagccaccccugucccaaccccaguggauucucauugccuucggcccuguuccccaaggacucuuccaccucccaacacugucacuagucucaccagcccugaccccaguguacccuccuccccacacagacuccacccuccuacaggugcuguucagugccgaccugcgccaaucccgccaugcucaggagccaccagcaaagcgcagaaaggguuccaaagggccggaaggcuagauggggcacccuggacaaagaaauuccccaagcaccuuccccuccauuccccacuucucucuccccauccccacccagucucauguuggggaggggccucccugugacuaccucaaaggccaggcacccccaaaucaagcagucaguuugcacaacaagauggggugggggauauugagggagacagcgcuaaggaugguuuuaucuucccuuuauuacaagaaggaacaauaaaauagaaacauuuguauggaaaaugcagugaggagugguagggaagcaggugaggaggggacagggcagagaaacucccgguucagggagggaaggggagcaggcugcccccaagcccucccacgcagaggaucaugacccgagguccagggcccuagagcugguggggcagugugggggacaguucugugcccggcuccacgcagcagucucgacagcaacagccagcugccggcccugcaugggaagacagaacagagguggccgcaggggcaggcccuccacuccagcccgggugcaccuuuguggaccacccaugcccuucugcagagcccgcuccucacccccagccacuggugucagcagcuccccauggcucgccgucugccccugccccuccuggcuggugcccagcugcaguuuccucaugugccgcaccacagccguggcauugaaggcuugcuggcauugaaggcauugaagggagaggggagaaaggacuuuugagagagucaagucauggggcaggggcgcagugggauucuugcaauuguucuguuauuuucauucaggaguuauuuuauuaauuccccuaaagccccccaaaaaccucuacaaggcuuuauuauauauuuacacacacacacgcacauauguuagauguauguguaucuauauauauaaauagaaacauaacuauaauucauauuaauauguaauagcaaacacuauagcacuguaugucaggcacuguucuaagcacuuuacguaguaauucauuuaaucuucaugaaagucuuugagguag

SEQ ID NO: 14841 - RNA, 12941 nt, Homo sapiens
ugacaucagagccgcaggcgggcggagagagccgccgagccgagccgagccccagcuccagcaagagcgcgggcggguggcccaggcacgcagcggugaggaccgcggccacagcucggcgccaaccaccgcgggccucccagccagccccgcggcggggcagccgcagguacagccgggccccccaucccugcaccccugggcgcugcgugggggcggugggagccccuagccucuggguauccuuucccaaggaguggccacugggcacucucccgggcgggcuggacccugaggggcagggcugggccuuucuccaccucugucccaggcccagcaggugccaggcgggccuaugggacacugaguggguaauagagaagggggccugugugagcgccuucagcugggccugacuggaagggcgugggcauuuggagguauccauggggugggggggcuugcggaguguacugucuuaggacaggcgugugggucagacauggguggaggaucugggaaucuguguguuuuuuguuccagagggguguccacguguuuugugugcugguauuuggcucucagggucuuaagucagaguuaggaggggguguacaauuguguacugaggauguuuggaguuagguguguaaggacuugggguuugguuuggaauacaggagcuuccaggggaugggguagaggagcuggaggguguaggguacgucugguauaugagggugugugugugugugucugggugucaucuugugugggugcggguggauguguguuuugggguguaagagggagcugggugagggauguuuggauggacaggcagguguucgggugcagggcugucuggggcacugugugguguggacaugugugcugaugucugggaguacauguaugaucaggugucacgggauguggauacaaggcguacuggaucugggaggcagguguuugaguucagggcuguggagggggcuugguguggcaugucugcuacagggauguguguggaucugugaggguuguauuugguaggccuccauguggguuucagacucugccucuagagcuuacacucgagucuccuuuccuagaagauucugccccuggaugggugggcaggguccccugggaaaaagguccuguuccaggaguggaaucucacaccagaggcccuagucagggcaccuucuccucauucucccuuagagaaaaagagagaaggaaagugcucucccugaggucacaaagcaugcugggcucuguuuuggccucaucuguggauggguugggaggcuguguucucugaauggggcccauucuggcuucauauuggaaguaccagccaaggccauucgauggccuuugcccucagcaagcuuagcugggggccccaggccaggugucauuagggccucuggagccagccucuaccuaacuccaaccucagucuccccauucuucaucugauaaaugggagagaacucccacccucuccugcuggaugagacagaccucagcagaggaagggccaggcuggauaggguuagauggggccaggaagggacagagugagcaggaccauuucucaugcucccgggacccagauggggagucaggagggagaggucuggggagcuccagcuguggcuguuguugcugugguaacagugcagaaagagcuauuuaaaaauguggcugagauguugcuggaagcccaggcugcuggaaaccugauuucggagaggccggggagucgggggaaggaggagggaaaggagacaccccagcaauccccaggguggggcggggacaucacugguucuggggacagggggauccuccaggcuucuaccagcugcucuggggguuuaucuguuguacugccagaagucaggguuucccuaggugcuuggauuuggauagggggaaaacugggaagagaacuagaauaaaugaaugaaugaaugcaugacuuuguuaaauaaagaauuuugcugccacugugaaagguuuuucucuaggcaugagaauuugcugaauguugaauaaacaaaugaauguuuguugaaugauuuugucaaauggaugaaucaaggaugaauaaaugcagguugaaugacugaauggggccugcaguaaauucccagacagagggcugggcucugcugagucuccuccuuccauucuccuuacaggagcccuggcuguggucggggggcagugggccaugcugggggcaguggaaggccccagguggaagcaggcggaggacauuagagacaucuacgacuuccgagauguucugggcacgugaguccagggcaggauugggugcuggauggcugagggaggcugaguccaggguggggcuuccucuggucaauuaaugcuuccuguuucccacagcccaggcccuguggcagcacuaucuagggccuaaacuguccccagcuuuucacuucuggaugacagugggugggacacgggcugcucucccaauagcccuggguucuugaagagaaagaagucgagagaaugaaggugccagucaguccauuuaacuugcugccaagagcuaaguguucuagccuagguuugggaacugaggcuggagauggcucuguucuuggugcugggaaugcagaaauaacucaaaccuggucucugcccuucaaguugaucccagacaugugcaagagacagaccuacagaaaaugacaacagggugugugcugugcuccaauuaagguugggauugagggcuuuguggagcccagagagagcugugccuucugccugggggaaaacuuccuggagaauggggcauuagagcuggggacugaaggauggguaggugugcacuugucagagaggaagaaggacauuccaggcagaaggaauagcauaaacaaaggcuuagaggcaugguucuauguggagagagguagagugugauggagcuuaaaaucacaggcuggggggagaguggaaaaaggggcuggagaugaaagugggacaguuuguguaggguuuuggaagccaggccagggaggcuggauauugucccauaggccaccgggagacacuuaagacuuuuuggcaggugugcaauucaggauagucacucuggccacagcuuggaggguaaauuggagagggacaagacuggaaaccagugaugagguuacuacaguaacuaauuaucccugaggauugaaauuucaccacgagagaugcuuuucuuugacuuaugacuucuuauucucccagagaaagcaaacagauguggaaagaauacccuagcaaauccucuuuaaucaguuaacuuuaguuaaaugaguuuauuuguuccuuuuuaagaaccuguucuaaaacacugcuucuuaaaguucaaugagcauacaaaucaccugaggauuuuguuaaacugcagauugauuuaguaaaucuggggcagggccuaaaguuuugcauuucuuuuuuuuuucuuuuuuuugacccaggauccaaagcaguagagauuuugcauuucuaaaaaaguucccgggugaugcugaugguucuuuaagguucuaaaggguguuaaauuagccaugacucgaauuagcagaaaaagggaugaaccaacuguacacauaauccaaaagcccagggguagaccucaggcauggcuggauccagagggccacauaauguuaucaggaaauauauuuggccauuucucagguuggacuuccuuuguguuaauuucauucccaagcaggcucuccccaggugguggcaaagaugaucgccauuagcuccaggcuuacauccuaccagcucaacaggagacucauucucaaagugcuaguaagcuggcuugcaucacaugaccaauuacuguggccaggggagagacuacuuugacuggccaggccugggucaugugaccaucucuggagccaggggauggaugagugacuaggggagggucauccacguccuugguccagcaguggucacagaacccauagggaauggaggagaggcuggagggaagcugggguuccaguucuucaccuugugaauccccucucccgauaggggggccuucucggaggugauccuggcagaagauaagaggacgcagaagcugguggccaucaaaugcauugccaaggaggcccuggagggcaaggaaggcagcauggagaaugagauugcuguccugcacaagugcgugggccacagccuuucccugccccaagcugacccugccuuggcccucccauccuccuccuuuccugcuuuggacaaaucauuuaaacucucuaagccuuaaauugccccuuuauaaaauggggaucacaauuuccacuuggcaggguuguggggaacaucagaaguccuuuauuucaagugccuggccuaacaugacagaugugauggaggugccagugcuuagucacagggguuuaacuguucaaucagguguaaagauccauccugaacauggcuuggacccacauaucucaguugguguugucucuggaccuaccucaaguuccccucacauauuaaaaccacucagcaaguuuaaaaaugacugucugcugacccccagacuaaauccacaaccaacuggucuaugaauugcucaugcugauaugaaaccuccuguccucacuggaaaacuuacagagaaucacuuccaaucucuccccugagcuuccaaccacccugggcagauaauuuuuuuuuuuuuuuugagauggagucucacucuguugccccggcuggagugcagugacgcaaucuuggcucacugcaaccucugccucuuggguucaagcaauucucuugcuucagccucccuaguagcugggauuacaggcaccugccaccacgcccggcuaauuuuuguauuuuuaguagagaugggguuucgccauguuggccaggcuggucucgaacuccugaccucaggugauccacccgccucggccucccaaagugcuaggcaugagccaccacacccaacuccuggcagagcauuucuaauaagacccagagaggacagggauuuguauacagucacauggcaaguuuguggcagagcugagccuuccucaucaucaagaucaauuaucgccugaccaacacggagaaacccugucucuacuaaaaauacaaaauuagccaggcgugguggcacaugccuguaaucccagcuacuugggaggcugaggcaggagaauugcuuaaacccgagagguggagguugcggugagccgagaucacaccgugcauuacacuccagccuaggcaacaagagcaaaacuccaucucaaaaaaaaaaaaaaaaacaaaaaaaaaacaaaaacgccaggcgcaguggcucacgccuguaaucccagcacuuugagaggcugaagugggcagaucaccugagguggggaguuccaaaccagccugaccaacauggagaaacuccgucucuacuaaaaauacaaaauuagcuggacaugguggcgcaugccuguaaucccagcuacuugagaggcugagaaagaagaaucacuugaacccaggaggcagaaauugugaugagccaagaucaugccauugcacuccagccugggcaacacuccagccugagcaacaagaguaaaacuccgucucaaaaaaagaaaaaaaaaaucaauuaccauuauuguuucacuuaugaguauuuaccgugugccaggcacugugccaagcaccuuaccugcauuaucucacaugauccucacuccaacucuuugagggaaguacuaccauuggcuucauuuuauagaugaagaaacugagguucagagagguuacauuaaaucuagcaccuacccuguaccaggugcuggaggaacaguggcaagcaagacaaagccucuggauucggggagcuuaugucuggugggggaggcugacaaacauguaaacacagaaaacuauauauauauauuuuuuuugagauggaguuuugcucuuguugcccaggcuggaguguaauggcaugaucucgacucacugcaaccuccguuucccagguuuaagcaauucuccugccucagccucacagauagcugggauuacaggcaugugccaccaugccuggcuaauuuuuguauuuuuaguagagauggguuuucgccauguuggccaggcuggucucgaacuccugaccucaagugauccgccugccuuggccucccaaagugcugggauuacaggugugagucucugugccuagccagaaaacucuuaagagguauguaucaggcugggugcaguggcucacuggugaaaagaucugcacccaaauagcaugugacgggcaggauuuggacccaggucuguguaugccagagcccaguguuuaucccucugcucucucaccuuccaaaaaaugguaauaaaccaugguaagcuagcuuuucccuuuggggacgagauccuugguuuguccuacccagguauguaggcaguggucggggguuggggguggcugagcuguccugagcucuaaaccgcuguuuuuuuuuuuuuuuuuuugagacagggucuuacucuguugcccaggcuggagugcaguggcuagucacaggugcaaucauaacagacugcagcuuugaacugcuggggccaagugauccuccugccucagccucccaaguucccaaguagcuuggacuacaggugcacaccgccaugccuggcuaaaccaccucauuucuccuuucaggaucaagcaccccaacauuguagcccuggaugacaucuaugagagugggggccaccucuaccucaucaugcagcugugaguggcccaaccucugcccugcccccacaccucucccagcugucccaacccucuuugccagacugcccuauccccugcugcagggugucggguggggagcucuuugaccguauuguggaaaaaggcuucuacacggagcgggacgccagccgccucaucuuccaggugcuggaugcugugaaauaccugcaugaccugggcauuguacaccgggaucucaagguggggcucaaggggguguggugagcuaggguacccagggguggggccuuugcaaaccccaaacugucugaccuugggcaacuuucacccccucacugagccuuggauuuccaucuacaaaguggaucuuguaaccuuuaaacugccuccucccauucuaguccagauacucaaaggaacacgagugaauuguguggcauuuuauccaaacaacauuuugucuuuuucugauuaaaaaaaaaaaaaucuggccagacaggauggcucacgccuguaaucccagcacuuuaggaggcagagacggguggaucaccugaggucaguucgagaccagcuuggcaaaacccugucucuaccaaaaauacaaaaauuagcccggcgugguggcagaugccuguaaucccagcuacuagggaggcugaggcaggcgaaucacuuggacccgggaggcagagguugcagcaagcugagauugugccauugcacgccagccugggcgacagagcgagccuggacgacagagcgagacuccaugucaaaaaaaauaaaauaaaaacaaaaaauccuauuccccuucuguagaaaacuuggaugggacagcaaaacauaaagaaaaaagccagaaauccccgaaauccuacuccucggaaauagcgacggggcucacauuuagcaguacaucucaauccguucuaggagaagggcacuuggggugugacaugccugguuuugaauucuggcucugcuacugccuaacuguggguucuugggugagucacuuugccuccaaaggcaucaguuuccucaucuguuaggugagauuauacagacuggccuagcagggaagcagugaggauggcauuaaaucaagcacuaauccagggucuggcauaaaauaggcauucaaacauuccuuuagggcuuuacagugcacaccugagguuuagagacaguucccccccacacccucuugagccuuguccuuccuggaauuuuuggccuucuugagagcuuccuugauuuucuuaugacagccaugaagccacaguggcuuuuggggauccauuauuucucagaaggugcuuggagcggcagaagguucuaccagccucuaaccaucucugauugccccuucucuucccuccugcccuucaagccagagaaucugcuguacuacagccuggaugaagacuccaaaaucaugaucuccgacuuuggccucuccaagauggaggacccgggcagugugcucuccaccgccuguggaacuccgggauacgugggugcggagggcccugggcuggggcugugaugguggggggaaccaggaguugaagggcagagauuugucaccaccacguccucuucccuccacagccccugaaguccuggcccagaagcccuacagcaaggcuguggauugcugguccauaggugucaucgccuacaucuuguaaguggggcuuggccaugguaggcuguggcuccagaguuguccucucgccuacuuuccucucuuccuuccucugcucucccucugcccucccuuccuucccucccucccuuccuuccaccaaucaauuaccaguauuacuucauucaauagauacuauguuucaagcacugugccaagcaagcacugggguaaauuuagcacagcacaaaccagacaaagugccugcccucagggagcugacuuucuuucuaguagggaagacagacaaucaacaaguaaauaaaucuacaaacugacgucaggugauaaaaauaaauacuguggagaaaaaccaagcaggaauagggagacggggugaugccauuucaguagggaggucagggaagggcucgcuguggaggugaugaccgaguggugagggagccagacauuggagguguggggaaagaguggcauaggcagaagcaauggcaagugcaaaggcccugaggagggcaagauggcggcacauacaaggaacagaaaggauaauguagcuagaacaggagugagcaggcagggcugguagaguuuauaaagggggaacuccuuccauggcuccugccugaccccugagacugccccagugcuccaccccggagccaacggcacccgaaaguggaaaugaggaugaguuucucccugcccaggcucugcgguuacccucccuucuaugacgagaaugaugccaaacucuuugaacagauuuugaaggccgaguacgaguuugacucuccuuacugggacgacaucucugacucugguauuuggggcuuugcuuuuuuccccugggcccugccucugguuccucccucaccugcuuugggggcggucucccuccugccuuccuucugucggauuuuccagcaccacacaaagagcugucuucgagaccagacacccuaccccuucuuccuucugcuuggguacuuccuucugcuuggcucccagagugagaaacuaggcauucauuuguucaaucuucaaacauagucuauuugaaaauaccucuccccuauugacacccuaaugucuaaaacaccaccauaaacauuuucauccuccuuuugugcccccuauuaagaagcaaaccugugaagcuacuaucguuuaucaucagugugaaugcacugagauuagucaagaacaacuuuuuuuuuuuuuucuuucuuuuuugagacgcagucucgcucuguugcccaggcuggagugcaguggcacaaucucggcucacugcaaccucugucucccggguucgagcaauucucugccucagccucccaaguagcugggauuacaggcgcccaccaccaugcccggcuaauuuuuuuuguauuuuuaguagaaacaagguuucaccaucuuggccaggcuggucuugaacuccugaccucgugauccaccugcauuggccucccaaagugcugggauuacagacaugagccacugugcccggccauauguuuuucuuaagagagaaaggaaagagcuggaaggcacggggugggagggccugaagaagagcauagguugggugggguggggcauggacugauuuggccucuuugucuugaugccaggccagaccugagggaguggguaugcucuuggggaguacacaggcaguaccaugcugucauuaucuuugcuuuugucuuggggguuuagccaaagauuucauccggcacuugauggagaaggacccagagaaaagauucaccugugagcaggccuugcagcacccauggugagaauucacacaaccugugagcuggggcgggauuuggggcccucaggucugcuucugcccucauaggcaacccaccacauaaccccauccuaggauugcaggagauacagcucuagauaagaauauccaccagucggugagugagcagaucaagaagaacuuugccaagagcaaguggaaggugaguccauaucccuaguucuggucccagccuccccaggacuccuccccaucccuacccaggcucagcuugcacagcaccuggcaucacacugggcacacaguaacugcuuagggauccuuacugaaggacuucauucauucacucuuucauucaacaaacacucccaacaccuucucuauuccagagagggucccucaccuccaagucuagaggaagaagucuguaauucuucaggaggcaucugauccagccuaugggguccgagaaaggucauaaaaguggugaugaccugacagagcugucaguuaaguaggaauuagugaggcauagcggaauaaugucuauagccauuccgggaagugcaagugcuaagccuggccagacuggaggggcugaggggacugagaggcaggagcccaauuuagagaagcagguaaggggccaggccucuuagggccucauaugccacagaggagcaccaacuugauccugagggcacugaggagccccagaagaaucuuaggcaaguauuugcugcauagaaagggcucucagggccaggcaugguggcucacgccuguaaucccagcacuuugggaggccgaggugguuggaucaccugaggucaggaguucaagaccauccuggccaacauggcaaaacccugucucuacuaaaaauaaaagaauuagccacacaugguggugcgugccuguaaucccagcuacuugggaagcugaggcaggagaauuacuugaaccucggagauggggguugcagugagcugagaucgcgccacugcacuccagccugggcaacaaagugagacuccaccucaaaaaaaaaagaaagagcucucaggaugcagagaauggcauggaguaaagacugggugacgcauuaggaggcuguggcagagauacaggcaggagaugguaaggguuuggaaccacaguagcagcaacagggggcagagaacagugguugauccaggagucauuuaggaggugaaacugacaagacaugacgaugcaauggauguugggggaaagagaugucaagggcuggcccaagacuguggcugggaacagaauggaugguggugguaccaugacugagaugguuaucacagggacagaaacauguuuuggggggaugguuuuaguuuuagacauggugaauuugaggggugugugggacaccuagguggagauauugaauagagacacaccugagcaaguuacuucagcuuucugugccucaguuuccuccuuugaaaaugauaauaguaccuaccucaaagacuuucaugaagauuaaaugaauuacuacguaaagugcuuagaacagugccugacauacagugcuauaguguuugcuauuacauauuaauaugaauuauaguuauguuucuauuuauauauauagauacacauacaucuaacauaugugcguguguguguguaaauauauaauaaagccuuguagagguuuuuggggggcuuuaggggaauuaauaaaauaacuccugaaugaaaauaacagaacaauugcaagaaucccacugcgccccugccccaugacuugacucucucaaaaguccuuucuccccucucccuucaaugccuucaaugccagcaagccuucaaugccacggcuguggugcggcacaugaggaaacugcagcugggcaccagccaggaggggcaggggcagacggcgagccauggggagcugcugacaccaguggcugggggugaggagcgggcucugcagaagggcaugggugguccacaaaggugcacccgggcuggaguggagggccugccccugcggccaccucuguucugucuucccaugcagggccggcagcuggcuguugcugucgagacugcugcguggagccgggcacagaacugucccccacacugccccaccagcucuagggcccuggaccucgggucaugauccucugcgugggagggcuugggggcagccugcuccccuucccucccugaaccgggaguuucucugcccuguccccuccucaccugcuucccuaccacuccucacugcauuuuccauacaaauguuucuauuuuauuguuccuucuuguaauaaagggaagauaaaaccauccuuagcgcugucucccucaauaucccccaccccaucuuguugugcaaacugacugcuugauuugggggugccuggccuuugagguagucacagggaggccccuccccaacaugagacuggguggggauggggagagagaaguggggaauggaggggaaggugcuuggggaauuucuuuguccagggugccccaucuagccuuccggcccuuuggaacccuuucugcgcuuugcugguggcuccugagcauggcgggauuggcgcaggucggcacugaacagcacc

SEQ ID NO: 14842 - RNA, 13130 nt, Homo sapiens
ucagauugggcaccaaauuaggacaagccgaagcggacgagcccuucguuucuuccgguucuguacccccauccuuucucucgccccuccuacccgcagcuccuggcgcucggcggggcuaacugcagcgcggagaucucggccgccaagcuccgccucccgccccgggcugugccccggggcucgccugaggccgaccacccgcaccccaccucuagcggcuuugcucgaggcccaccuucuucccacccccggcaaacuccaguaggcucgcccucgcugacuccccgcccccgcgucaacugcaaggggcccgcccauagccaguuccggggcgguugcucacaucgaccggaacuccccgcccccucccgcggccccuggggccguaggaggccgcagcgaggagguagagggggcgggggucgcacuagggugucccuagagaacgaggacucugaaggcgggacauuugggcgacccccgggcggggccagccauuaaacagucccacuucugugccagacacugaacugggcucuugacgggcaucaucucuuaauccucagaacaucccagggagguagguacuauuguuauccccauuuuucagauucagacuuuuaauggggaaacagaccgagacuucuuuuguccccauuuuacagauggaaaaacugagacugaaaaaggucaaauaacauguucaggggcauauaaguagagaaugguaaagccugggcuugaacccaggucugucuggcuuaccagcccacguucuaaaccacuguuagugacuagagaagggagaaagguggaauaggguaagaaaagaggccaagagucccagagaacaugguaagaauggggugcuuggaacucaaagucuuagcagaacccaagagaaauagaagggaaggaaagagcaucagaaaggcgaggcaaggcauagcaguauagcauggugaucagggugcagacucaagacuagcgggguucaaauugcaucuuggaagcauaggcacauacccacccuuacagagucucaguuucuuucucuguaaaaacgagaucacaaugguccuuguucauggugcugagugagaaauucagugagauaaacugauaaagugcucugcaccuagcuugguacccaguuaagugcccugugaguaggaacugugccaucaauuuugucaguaagggacugaagcugggcuuccuugaggcugucccuggagguaagaagcccuugggcuuuucucagaccacuuugucucccaucaauggcccuguccucuccagcuccacaggauccccauauccugggccaugagugaguugaaagacugccccuugcaguuccacgacuucaagucuguggaucaccugaaggucuguccccgcuacacggcagugcuggcacgcucugaggaugauggcaucggcaucgaggagcuggacacccugcagcuggagcuggagacccugcugucuucugccagccggcgccugcgugugcuugaggccgaaacccaggugauaaccccagagaggggccagcaccagagauggacugcaacaaguuaugggaugggucauugaguuagccccauaugcugagacuugggguacagggguuuguggggagagggagagagacgcaaacuggguuugcaugacacaaaaaauacacaagaauaugcaugauccucuuaaauugcaagauuucuaauucaguaagcuuuuauuggcaccccacucaucccccauuguguucuggguccuaugcuagucauuagagaaagguaauuaggacaguuauggcugucagggagcuuggcaacuaggaaagugagaaagucaaguacauaccaggugaugugauguugugguuagcaguccuagggaacuggaauggggaaaccuggauuugaauccuggcauaagcgcuugcuagcauugcuguuuccuagcuaugugacuuugagaaaguugccucauaucucugagugucaguuucccuaucugcaaaguggggugaauaauaggaccuaccuuagugcuuuugugaggauuaaaagagaauuuuuugcaaaaacucagcccaaugccagacacuaaguaaguacuucagauguuauuuauuugcuacucugaugacuuuauucacugcauaaagaugccuugagccuugugugccaggcgcuaugcuguauucugcaaaauagagaugguuaaggugggcuuucugguccucaguagcuuauggucuaguugaagagacaaggugugauggucauuccagugugaccaaacaacacgauugggugcacguuggagcugugaagugccagagacuuguggaggaaggaggugccaacuggaccuaaaaggaugaauggaauuaacuugucccugggaauccauggacccuccuugaggaaggcuaugacucaaguuguauuuuagcaucuaagaaccuggguaacugauugagagaaggcaucucaguaguggugacaucgaagugaagguuugcugagaggacucuucuguuaaacaguaugugacuggcaugggugauacagaagugaaucaguauagaugaacaagugaaugagauuaugagaaguauaugaauaaaguucuaggaggccaggcacagaaaaugagcugaauuuugaaggaugaguaagaguuuacuagguaaaaagaggauggggaaagacccaggagccucuguagauucuagauccuaauuuauucacuagaggaaagagauauucuguguuuucccuucucccccucagugacacuuucuguaaauuucagauccucaccgacuggcaggauaagaaaggugacagacgauuccugaagcugggucgagaccaugaacuuggagcuccccccaaacaugggaagcccaagaagcagaaacuggaagggaaggcaggacaugggccgggcccuggcccaggacggcccaaauccaaaaaccuucagcccaagauccaggaauaugaauucacugaugacccuaucgacgugccacggauccccaaaaaugaugcccccaacagguucugggcuagagaacauagaagggggccucaagguucuggugguggaggcacugguggggcaggggcgcccacucaggaucugcuucucccugcagguucugggcuucaguggagcccuacugugcugacaucaccagcgaggagguccgcacacuugaggaguuacugaagcccccagaagaugaggcugagcauuacaagguagaaacucugggccuugauagacaugaugcggaacaagagaguucagaggugccugagaaguaaagcuaccaaagccaugcaucaucuuccuuccccaacccugcccagucugcugucugcuccaucagugccuccagacaccuaggcccaaacucagcuuucuccgugcacugccuccccucuaccccagccaaaugucaacacgcccucaagcaucuacuuaagugaagucugcccauguuccuuuauccccauccccucugcuuugguccaagccuucaucaacuucuauccaaacagccucuuaacucucuuccuguuucgaggccucuggaggaaccuuucuucuuucuuuaagauauaaaacuugggcugggagcaguggcuuaugccugcaauccuagcacuuugggaggccggggcgggcagauugcuugagcucaggaauuugagaccagccugggcaacauggugaaaccccaucucuaccaaaauacaaaaaauuagccaggcauggcggugugcgccuguagucccagcuacucgggaggcugagucaggaggaucucuuggacccgggagguggaaguugcagugagccgagaucacgccacugcacuccagccugggcaacagagcaagacuccgucuccaaaaaaaaaaaaaagauauaaaagucaccucacgccuguaaucccaacacuuugggaggcuguggcaggcagaucaucugaggucaggaguucaagaccagccugaccaacauggugaaacgccgucucuacuaaaaauacaaaaauuagccuggcacgguggcaugcaccuguaauccuggcuacucgggaggcugagccaggaaaaucaccugaacuggggaggcaucgguugcaaugagccaagaucgugccacuguauuccagccugggugacagaaggagauuccauccauuaaaaaaaaaaaagccgggugcgguggcucaagccuguaaucccagcccuuugggaggccgaggcgggcagaucacaaggucaggagauugagaccauccuggcuaacacggugaaaccccgucucuacuaaaaauagaaaaaauuagccgggcgugguggcgggcgccuguagucccagcugcucgggaggcuaaggcaggagaauggcgugaacccgggaggcggagcuugcagugagcugagauugugccacugcacuccagccugggugacagagcaagacucugucucaaaaaaaaaagaagauauaaaacuauguuuuaaugaugaaaauaaauaaaacaugcuccauuaaagaaaauuuagaaaauacagaaaaauguugagggagaauccucccauaggugagcugucaugaucagaugugcucaugacauggcgcugcauccaggccuuucuuccucccguuaucuacaggaucaaguccacgcaucccaguccuugcuggcacagcuccagugccccucuccauuuuccucggccauaucccucuucauugccguguugaccagucccaccaaguaucucgcccucauuccaggacaccacagccuccucgcuggucucugggccucuggcaagcucuucucucccucuugucuccuugacagacuugacucacccuucaaggcccugaucucauguuaccuccaccaaagcacucuuucagauuccccagcagaaaguuagucagucucuccuuugugcugccacaacacuuugaucucucucuuucacuucacuuaucugauuucuuaaaaauuuaucugaaaaagaguucauacagacagcaguaaauucaagcaauacaaaagguaauucccugucacccgugaccugaaggcuccuaauucucucgagaggcaauugcugugaccugagacaaucuguguacguauucugcaccuucuaucuugggaauuauuucagauuggcuucugugugugugucuuaguucuuuuuggaccugucucccuuacuagagugugaaguacagguuuuaucuucguuguacuuucuuaccuacaccugacacugggcuuggccuuggacuagggacuugagagagauauaagauagguaagugaaugaaugaaugaagcauggcuggccagugcuuacccacucaggguugggugccaucuuuuccacagaucccaccccuggggaagcacuacucccagcgcugggcccaggaggaccugcuggaggagcagaaggauggggcccgggcagcggcuguggcugacaagaagaaaggccucauggggccacugaccgaacuggacacuaaagguaggccucucaccucccugccaaccccaggucaggacuugaauuccagaacuucagcccaccuccccuccuuuccugugcccgcuuagauguggaugcccugcugaagaagucugaggcccagcaugaacagccggaagauggaugccccuuuggugcccugacgcagcgccuccugcaggcccugguggaggugagcagccuaacccaaaagaggaaccauauuuacuuuguguuuuaauguguuaugcuuauuuuuuaucggaauuuaucauacauuuauuagguuggugcaaaaauagguuggugcaaaaguaaaaaccuggacuaauauauagcaaaagauugggaauaauauauaacuugugcaccuaauagaaaagugcacagaucauaaauguacaguuuucacaaaugagcuuguauuaccagccuggagauuacaaaaugaaacauuacuauauccuagaagccccucucaugccccuguuuuucuccaacuuuccccaaagguagccuuacuccacaauuacuuuugcuaagcaucuguuggaggggcuuuauacacauccucccacuggaggccaggacagugguuaacgcuguguuacagauaagaagauugaggcucagaaaagggaacuguucacuugaggucucacacaccaggauucaaacccuagcuucaggggcccugucuuuauaccugcugguugaccuuagacacacccucacacucuuucaccucauugagacucaguuuucuauucuggcucaaacacaagaguuuaucucauggaacagucuggguacauguugcagguuaucuaagguaggggaaggggcaggucucuaucucauaucaucagacagggaccccagcugacgguggccuugcagucugcacaaggucacucugggcguaauugucacuccagucccacagaauaagagcaaggaggccgggcgcgguggcucacgccuguaaucccagcacuuugggaggcugaggcgggcggaucacaaggucaggagaucgagaccauccuggcuaacaugaugaaaccccgucucuacuaaaaauacaaaaaaauuagccgggcauaguggcaggcgccuguagucccaacuacuugggaggcugaggcaggagaauggcaugaacccaggaggcggagcuugcaguaagccgaaauugugccacugcacuccacagccugggugacaaagugagacuccaucucaaaaaaaaaaaacaaaacaaaacaaggaggagugugugaaggaaacuuuuuggcccaugccuagcuauggcucuuaucucuucugaucacuuuccccuggagagaacuugucacaugaccauacccgccugcaagagagccugggaaguacaacuggacaggcauugccuagcugccguggaggaaagaagaguauggcauucggacagcuagcaucuccgccacagcaggccuagcacacugccuggugcguugcagacgcuucacaaaccuuagcuguucauuaccaucauugaguguuaaucauuucucuucuguguuccuuuuucuucacaucaguacgaaaauaaaagggauuucuagaaugaucaaagcaauuugggauugguaugggaaggcuucccacgguaggugggaugggaaagauaaaaggauauuucugguguuugaagacugucaguguaggucagaaaggagcaggaaaguggaacagcuauuuuuccuuccacucauuuuuguggucuucuaggaaaauauuauuuccccuauggaggauucuccuauuccugacaugucugggaaagaaucaggggcugacggggcaagcaccuccccucgcaaucagaacaagcccuucaggugagugguguccuauccacaacccacagucuggcccccgcuucuguuggcuucucuccaucucaaccuggggaaguccucaucaguaagaggcugggggcaguuaggugaagccuaauagcagucucaagugugagugaugacccagcgugucugcaugcacagacugagugcaggguuguucagcacagaacuguucauaccauaaauaacccaaauguccugcugaaggggaaugguuggcuaaauuggcauaacuccauaugaugaaauaacuuggggcuauuaaucauauagcugcaaguauagagaaauauaguuaaaugacaugaaaagauguaaauuauagagugacaaguggagaaaauauuaguuguagcccaguauggaugguauaauacuauuuuuacuuaaaauauauuucuuuuuuucuuuuucuuuuuuuuuuuuugagauggagucucgcucuugucguuuagguuggagcgcaauggcgcaaucuuggcucacugcaaccuccgccucccagguucaagcgauucuccugccucagccaccaaguagcugugauuacaggcgccugccaccauguauggcucauuuuuguauuuuuaguagagacgggguuucaccaucuuggccgggcuggucuugaacuccugaccucaggugauccucccaccucggccuuccaaagugcugggauuacaggugugagccaccaugccuggcuuacuuacaauauauuuaaauaugugcacauaagggaaaaaaccuggacuaauauguagcaaaagauuaggaauaauauauaacaaaaucuggaauauauauaauaauauauaacaaaauaauaguaauucucucuggguuguuggcauuauggguuuuuccauauuuuuugaauaguagauacauacguugcuuguuuuaaaaaccagaccagaugugucugucccucccuuuguaucuggauagauacagagggggugcccaaagggaaaggcagguuuucacugaccuugggaagcccugggaaccuccaaggugggcccuucuccaagcuggcucuugagucugacgggccugccucccgcugcagugugccgcauacuaagucccuggagagccgcaucaaggaggagcuaauugcccagggccuuuuggagucugaggaccgccccgcagaggacuccgaggaugagguccuugcugagcuucgcaaacggcaggcugagcugaaggcacuuagugcccacaaccgcaccaagaagcacgaccugcugaggugagcguuagcaggaugcacagucccggggguggccuuggaggcuguggccacggcuagucaccuuucagggguuuuacaacaggcuuuccaauccuggcuggccucuaaaucaccuggagagccucgaaaaaaacagcaguggccaguccaccggguaugucccaaacaaauucugauuccacagaguggggcucaggcaucugugacugaccgauugauuugauuuguuuuuguuuuguuuuuuuuugagagggagucucgcacugucacccaggcuggagugcaguggcaugaucucggcucacugcaagcuccgccucccagguucaugccauucuccugccucagccuccugaguagcugauacuacaggcacccaccaccacgcccagcuaauuuuuuuguauuuuuaguagagacgggguuucaccguguuagccaggauggucucgaucuccugaccucgugauccacccgccucggccucccaaagugccgggauuacaggcgugagccacugcgccuggccuaguuugguuuuuuaauuaugguaaaggcauaauauaaaauguaucuccaugggaggcugaggcaggagaaucaguugaaccugggaggcggagguugcagugagcugagacugcaccauugcauuccagccugggcaacaagagugaaacugcaucucaaaaaaaaaaagaaaaaaaauuuacgcuucuuaaccauuuuuaaguguacaguuuaguaguguuacccauauucacauuguugugugauuuauuuuuugucuuuucaugcuucuuuucuuuuuauccccaaaguuuuguuauuaaaaauuugauacacacagaaaaucugaaagaaucauacaauaaacaucaguauauucuccaccuagacuaauuaacuguuaacauuuuguuggagaucugugauuuuuauuugcucaucacaagaaauugaccaguguuuuaggacauguucuuuugggaauccaucacagugccugccauucauuugaugucaacucccauccaucuuguucugcauugaucacgaggguauaggugacaucuugaggaagacuguggaauagcuacccuuuagguaaagagauagggaagcaacccgaacaagucucuuugcuucucacagacaagugcugugucuuaacuucauagagcccugacaggacagggcacauucauucauuuggccuuuuuuuuuuuuuuuugagacggugucucacucuguugcccaggcuggagugcagugccaugaucucggcucacugcaaccuccgccucccggguucaggcaguucuccugccucagccuccugaguaguugggauuacaggcaugcacuaccaugccaggcuaaucauuuggccauucuuacugucucuuagauauugugcugggggccagcaagagaggcagagcaagggacuugcagauuacuagcagaugaucaguaaagauaagugccauuaaaaggagagguaguugcugacaagcugccaggguauuuaaggauaagagugacuaauguaugcugagggccuacugugugucaggggcuuuauguacacucucucaagugucuugacaacaacccaggagggaggagcuauuuucguuguuuaccagaugaggaaauaaaggcccagugaagcgaaaugcucugcugaaggucacacagucaauaaacagcaagcugagacuugaaccugugguugaaucaaagccucuuucuauaauaguuuguuuucucugaaaggugagaagaagaaaacacagauggaagaggcacugagggaagcagagggagagagaggaagagagagaaaagcaggcaugugcaguuacagaaguagugggcccuagcugggccugguggcucaugccuguaaucccagcacuuugggagacugaggugggaggcuuguuugagcucaggaguucgaaacuagccugggcaauguagucagacccccuucucuacuaaaaauuuuuaaaaaucagcuaggcaugguggcacaugccuauaguccuacucaggaggcugaugugggaggauugcuugauccugggagguagaggcugcagugagcuugaucaggccacuguacuccagccugggugacagagugagaccugucucaaaaaaaaaaaaaaaaaaaaaaaaagaaguaaugggcaaugaagaaauggcuugcagcucucaggaaaccagagcacagcccuuacccugcugcagagcagcugcaaggccuuaagcagccccugaccugagcaucuccuuccccuucuggaaaacuggcaggcuggacucaaucacuaagugaccuuccagcuccaccaucgaugaaauguauaaaucagacccuguucagagagauugaucuggugucucacccaccuccugucagccucaggcugccuagaccuuagggggcucuggaaugcagaugccgacguaagcaggccuucugcuggcaccggaacaccugaaacaacaguguuuaaaaacaagaguuuggccccagccugcuccagaucucccccucacuaacugugggauccugggaucaucuuugagccucauuuuccucacggguaacauaugaauaauaguacauauuuugcaggguuguuaggauuaacugaaagacagagagagagagugggugugccuguguguguguguuuguguguguguauguauauauauauauauuuuagagacagggucuuacucuguugccgagguuggucucaacuccuggcuucaagugaucuuccugccuccaucucccaaagcgcugggauuacaggcaugagcuacuuugcccagccuacuguguauauuuuuaagaccuuuuuuuuuuugaagacacagucacgcucuguugcccagacuggaguguaguggcaugaucauaguucacuguaaccuugaacuccuggccucaagcaauccucagcucccuuggaguugggacuacaggugugcacuaccacacccagcuaauuuuuuaaauuuuuuguagagacagucucacuauguugcucagacuggucucgaacuccugggcucaagugauccuucugccuugggcucccaaagugcugggacugcagaugugaacccccaugugcagccaagacuuuauucuucuagagcaguuuuaaguucacaacaaaauugagagaaagguacagagaauucccguaucucccuguccccacaugugcacagccucccccgugaucaacaugaguuaauauuuuucaggagcuuaagauagugccauguaaguguaggucaguaacugcuuuuuggucacgacuguaugacacaauccacaggcaugccagccugggcugguggguaggcucggucuugaagagggagggguuguucucuggaggugggcugacccuggcaccuggcuggcugguccccacaggcuggcaaaggaggaggugagccggcaggagcugaggcagcgggugcgcauggcugacaacgaggucauggacgccuuucgcaagaucauggcugcccggcagaagaagcggacucccaccaagaaagaaaaggaccaggccuggaagacucugaaggagcgugagagcauccugaagcugcuggauggguagcccucaccccugccucaggcugauuaucuggccuaggggaggggaagggaggcccacuuccuucuuugggcacaggaaacauuggccuguggcugucccucaaauggcggcagucucuagagggccguggcccuuccccugaggucuuuuggccuagcucuguacaaccaggacacaggaagcccugcugggcuagccugaggccuagucucugcuugguccccgagaugggguuggaggggacuucguuucugggucuuccucuuccccucuuuaccaucccccacucccuaauccccuaccccugucuccccuucaaggacuucucccuugugguuuuguaaagugcaaacuuaagaauaaagugacugcugugguuuuucaaaaaaagcauccagucuuugaaugucuguuacaguggggaggaaggaaccagugugggugguaagguuugugggggguaugcuugguggcucucagcccauggccacuaacccauggcauucagucagggagaacuuucugaguaccucuuucugaggauacuuguggcugcacguaacaaugcccccccagcucaaaguggauucacaguaaggaaauguguuggcugcaggaugggcaguccugggacagaguggccuucacgguuagccaaucuagcaauucuucagggucaucaaggguc

SEQ ID NO: 14843 - RNA, 6444 nt, Homo sapiens
ucagcaguaagcaagauccguaauaaacauuuacuuucuuagcaaauccucaaaaccauaacaugagguaggaacuuuuauuaucacaaguccagagagguaaaguuacuugcccaaugccacacagcaagcaaguggccuguccaggaugugaucuuagguuugucugacugcagagcccccacccucacuuuccagugugugugagggggucaggaacagagggaggacuauuguaagcggagccccaggcacuguaggguccuggagaaauaagggggcaguggugccaggagcucaacaggggugucccuggcccuggugccugggagaaggagccgauguagguggaggugcaagggcagcugggcagccugggagggggucagguggaggcgucugaggagggcuucauccaggaccuggagcgggagagguacguuguguucagccccacauuuuccaagcagcugaguacccagcucuaagggaaaugggaguaaggcgggcgcuuccuccauuccccacuguucugcaacuguuaaucauuuccucuuugcacacagaugugcacauucacacaggcacucacacugcagcagagacuggcuagggggucacccaaucaguuuccuccuaggcacacaccucaacuccauuucccagcccucucacagcuuggugagacgugagugagcucuagcugagugaauguggguggcaguauguaugccacuuccacaccuggcccagaaaaaccuuauccacuugaaccuacacugucuccccucaucuggcuggguaucaacagccugggucccugaguacuuagugcuugaagcagagcccacucccauuauuugaccuuaacaugagggcacaguucuugugugaagacucugguagucugggcuuaguguguuagagcagguagaggcaucugguguccuaauacacgcaugccuuugacccuuuguaccagacucaaagaauggcagacuuaagagggcuuuagaaauuagccacaucaacucccuuauugaacacauggacagaaugaagcccaagagagugaguguuacuugcccaaggccacacaccaagauguggguacggauacagccuugggagccaaaagggcugccucccaguagucccaagcugcacagauaaggucuggagaugcugcccaugcucaccucucccuccaccccucagaaagcagcaggcaggugggcuggaguaccugucuuuggggcuuguuguucucagcuggcagcagaaaucgcuggcccaggacagugcccacacgggcagaguacaugugguccccaagcacagggcagagcuguaguaccaugugcaccuguaguugacuggagaacacugggcaacaggaaagccaggagagacagugggcagcuacucguucugugccacccaguaucacuccuccccuuuuccuuuggggaaacaccacccccuuucucagaucauauguuucagugaggucaguacuauggccccugcauccagagagggacacauaacacgucaggacgaucacagcuaucaaucugccuggcugugggauccacucaugaugagaugcaacccugauuuaauugcugaagccaccgggccuaaggacuguucuuuccuguuggggugcuagccugaagcugccuccucuagcugggccuggucacauacaccucugggggccaucaaaugcuccccaggcugcugcugauaccacugucuccccagcuccuugccucccuaagccaagugcaguuuuuuuuuuuuuuagccagcguuucacucugucucccaggcuggagugcaauggugugaucuucgcucacugcaaccucugucucccagguucaagcgauucucccgccucagccucccaaguagcuaggauuacaggugcgugccaccaacuccagcuaauuuuuguauuuuuaguagagacaggguuucaccauguuagccuggcugguuucgaacuccugaccucaagugauccauccgccuuggccucccaaagugcugggauuacaggcgugagccaccgcgccuggcucaagugcaguuuuuuuuuuuuuuagaugaagucuccucuaucaccuagacuggagugcaguggcaugaucuuggcucauugcaacuucugccucccagguucaagcgauucuccugccucagccucccgaguagcugguuuuacaggcgccugccaccgugcccagcuaauuuuuguaguuuuuaguugaaacaggguuucaccaucuuggccagacuggucuugaacuccugaccucgugauccaccugccucagccucccaaaucaagugcaguuuuaaaggcuggcuagggugccagaccuaccugucaguggcugcagcuggaccagggcacagccagagccuguggcuaccacacgaaagugacugagagucuucuugacaccuuccaggauguccuuucgggauggggccuucacuggaacugucuguggugccagccaagagugaacaagccuuacacaggucugggagcuauacccagacccucccugcucccaauagacuccgggcagggccacaguauaggcaguggucacuugccuguuuuaggggacaggagagccagccaucccaaauccauaccccugacuccucucuguagggguacuauaucuagaagcaccccuccucuucccagacccggacucacgagauugaccccaucaauguguuccaguuucagggcagccuggaucuuccccucagaagcagcugggaucccaucagugacagcacugagaaaggggcaggaggaggucacaggguggcuugcugggaccuccccaccacucuaggaaccucccagcaccucucaccaguagguggcugugggccuuugggcucuccgugcaugggugaaguacuucuggaggcgacuagcugucuggggacagcuggagaggaguacaagcccagagcuuucucuggaauaagcagacaaaucacacaaguuaaagucccuugaacucgcccacuaaaaaggaaacucuuaggaacacugaccugcuucaggccaaacacuaacaccaggacuauaaccuagaccaacuccugagaaacaaguaagguuuccccuucuuugauaacaagacuauguagcuuaauguguuucucauuuugccccggcccccagggaacucagagccaaaugucguaacgauugucuaccaugugccagaauucuacuagaaauucuguacauauuagcucuuaaauaaguucucuacaaaaaagcucaugaguuuguggaacugcagaaauauuucaucucaaguaccaucuuuaauugauggcaguuagaggaaagaguaucauggaucgacuagcaaugccugccacgaguaccgucauggagaaaugacugcacacugagcauagguauuauuuucucuauuuuaccauuaggggaacugaagcucagggaggguauuuguuuuguuuuguuuuuuugagacggggucucauucagguuguuuaggcuugcguacaguggcgggaucucagcuuauugcagcugccaucuucugagcucaggugauucucccaucucagccacccgagcacuacaggcaugugcugcucugcccagcuagguuuuuguguguguguguguguguguuuuauuuuguuuuuuaaguaaagauaggguuuugccauguugcccaggcuggucuugaacuucuggacucaagcaauccucccaccucggccucccaaaguccuauugauuauaggcaugagccaccacgcggaaaguuuuguuguuguuuuuccagagauggggucuauuuugcccaggcuggucucgaacuccugggcucaagugauccucuugccuuggccuccagaaguguugggauuacaggugugagucacugugcccagcgucagggaggugucaugcuuugccugguaucacaccauuuguacuugaggauuugaacccagagccaucggcuuccucuucuucacaguacuuguauccaccucuaugaucucaaaccuucccauggaaaaugucucagcuuauccccaagcagcuguuuccccaccacagauggaugccuguacuccuagcuuccugucaccccuaccacuuacuucccagaugcucggacaaccugaagcuccugcucccugagcccuagggacuggcucagcucuggcagcacugagaacaacgucagcucuccugguuuuccuggaaaguaagaaagaaaaauuacaagaggccaaagcuucaugccuucacuuuucccucccucagucacgaaacccccuuccgcugcauucccuucccacauccccggcccauaccugucacugguagacccuguggcuuguucaacgucacuagagguccugaaacauacaucacacgaacaucagcaaaagcaacgguaacccuuuaugcagcacuaaagaguuuccagagcacuuucucacgcaucuuagcacauguccccaucaugacucucagacaugaguuaacuaccccacaccaaauucaacuucuuucuguuccucugccaccucagagccucggcacuugcuguuuccuguccccaaauuucccaggucuggcucccuaucaucuuggcucaaaugucacaucacggagaggucugaaucuccaaucuaaugucugccuuccuccugcaguuccucaccaucauaacacccuguuuuaguuuaugcauagcacuuaccacuaguaacuuguucauuuauuuucugacauccauuucucccguuagagagaaauccauuucuccccugagagcagaaaccauaucuaucuuuuucagcacuguauagccugccuagaacagugccuggaacauagcauauguucaagaaauaguugagaaaaggaauaaaucacugaauagagagugggguucagagaaauucaguuauuuuccuaaagccgcacagcaagcugaucacagagccuagguaugucugacuccaaagccuguguuuuguccgucgauaaauaaucauuauuuauuuauuuauuuauuuagacugagucuugcucugucaucccaggcuggagcgcaguagcacgaugucggcucacugcaaccucugcuauccggguucaagugacucuccugccucagccucccgaguagcugggauuacaggcggacgccgccacaccuggcuaauuuuuguguuuuuaguagagacgggguuucaccauguuggccaggcuagucucgaacuccugaccucaggugauccgcccgcgucagcacccuaaagugccgggauuacaggcgugagccaccgcggccaauaaacaauaaucuaguauagcaacucccguaacugagcgccggcuaugugcaaggcucgguaguuauuugcaucuucuccccacucuuaacccuacugcaucauggcaguaggguuaaaagcggggagagggugcaaauuagguggcuugucccagcucaugcugcuagugggaggcagaagcagggcugaucccguggcuucaauggagagcccaacugcacgccgaggcaguccccucccgguccuugugcggccgugccucucaccccucaccuuuccgguccaccacggcugcccgcagcgcaucaaccagcuccucccgacugagguuuuuuggcagcagccccgcgaagggcugguccccgaggggccccgaccguuggcaggagccgcgggguugccucugaugccuggacaaggagggagaagcaaugggagucauuccaucccgaggugccacccauuccuaucuccggacgccucuucccaaauccugcggccucugacaaaugccucacaaugucugggcugaccucgaaaauucagguacgaccggucccauucuacagcggagggcaccgaggcucagagaggccaacggggcuguuuucggguaacaucuaccugauccagaucccgcacgugccuucccccugcccuagccuccgucccgcaugagagaggggguacuuaaucaccgggcuucggugccaaagccugcguccucgggcacugggcggacacccaggccccgccgccagccacuccagaaccggcccaaaacacggcggccguccaucucccgagccaggacagcgcgcaugugcguccagaggggcagacccgcgcuccagccagcgcgcugauuggucagcuggagugucaaucggaauggugaccgggcgggacucagagccugaggaggcggggcuuuuccuccgcccaggaaggaaaugcagaaaugccuuccuaugcuuuuagggagagcgcuguagcagaagaauuugaucugaucaaaaaaccugucuuagcaaaaaa

SEQ ID NO: 14844 - RNA, 6444 nt, Homo sapiens
uuuuuugcuaagacagguuuuuugaucagaucaaauucuucugcuacagcgcucucccuaaaagcauaggaaggcauuucugcauuuccuuccugggcggaggaaaagccccgccuccucaggcucugagucccgcccggucaccauuccgauugacacuccagcugaccaaucagcgcgcuggcuggagcgcgggucugccccucuggacgcacaugcgcgcuguccuggcucgggagauggacggccgccguguuuugggccgguucuggaguggcuggcggcggggccuggguguccgcccagugcccgaggacgcaggcuuuggcaccgaagcccggugauuaaguacccccucucucaugcgggacggaggcuagggcagggggaaggcacgugcgggaucuggaucagguagauguuacccgaaaacagccccguuggccucucugagccucggugcccuccgcuguagaaugggaccggucguaccugaauuuucgaggucagcccagacauugugaggcauuugucagaggccgcaggauuugggaagaggcguccggagauaggaauggguggcaccucgggauggaaugacucccauugcuucucccuccuuguccaggcaucagaggcaaccccgcggcuccugccaacggucggggccccucggggaccagcccuucgcggggcugcugccaaaaaaccucagucgggaggagcugguugaugcgcugcgggcagccgugguggaccggaaaggugaggggugagaggcacggccgcacaaggaccgggaggggacugccucggcgugcaguugggcucuccauugaagccacgggaucagcccugcuucugccucccacuagcagcaugagcugggacaagccaccuaauuugcacccucuccccgcuuuuaacccuacugccaugaugcaguaggguuaagaguggggagaagaugcaaauaacuaccgagccuugcacauagccggcgcucaguuacgggaguugcuauacuagauuauuguuuauuggccgcgguggcucacgccuguaaucccggcacuuuagggugcugacgcgggcggaucaccugaggucaggaguucgagacuagccuggccaacauggugaaaccccgucucuacuaaaaacacaaaaauuagccagguguggcggcguccgccuguaaucccagcuacucgggaggcugaggcaggagagucacuugaacccggauagcagagguugcagugagccgacaucgugcuacugcgcuccagccugggaugacagagcaagacucagucuaaauaaauaaauaaauaaauaaugauuauuuaucgacggacaaaacacaggcuuuggagucagacauaccuaggcucugugaucagcuugcugugcggcuuuaggaaaauaacugaauuucucugaaccccacucucuauucagugauuuauuccuuuucucaacuauuucuugaacauaugcuauguuccaggcacuguucuaggcaggcuauacagugcugaaaaagauagauaugguuucugcucucaggggagaaauggauuucucucuaacgggagaaauggaugucagaaaauaaaugaacaaguuacuagugguaagugcuaugcauaaacuaaaacaggguguuaugauggugaggaacugcaggaggaaggcagacauuagauuggagauucagaccucuccgugaugugacauuugagccaagaugauagggagccagaccugggaaauuuggggacaggaaacagcaagugccgaggcucugagguggcagaggaacagaaagaaguugaauuuggugugggguaguuaacucaugucugagagucaugauggggacaugugcuaagaugcgugagaaagugcucuggaaacucuuuagugcugcauaaaggguuaccguugcuuuugcugauguucgugugauguauguuucaggaccucuagugacguugaacaagccacagggucuaccagugacagguaugggccggggaugugggaagggaaugcagcggaaggggguuucgugacugagggagggaaaagugaaggcaugaagcuuuggccucuuguaauuuuucuuucuuacuuuccaggaaaaccaggagagcugacguuguucucagugcugccagagcugagccagucccuagggcucagggagcaggagcuucagguuguccgagcaucugggaaguaagugguaggggugacaggaagcuaggaguacaggcauccaucugugguggggaaacagcugcuuggggauaagcugagacauuuuccaugggaagguuugagaucauagagguggauacaaguacugugaagaagaggaagccgauggcucuggguucaaauccucaaguacaaauggugugauaccaggcaaagcaugacaccucccugacgcugggcacagugacucacaccuguaaucccaacacuucuggaggccaaggcaagaggaucacuugagcccaggaguucgagaccagccugggcaaaauagaccccaucucuggaaaaacaacaacaaaacuuuccgcgugguggcucaugccuauaaucaauaggacuuugggaggccgaggugggaggauugcuugaguccagaaguucaagaccagccugggcaacauggcaaaacccuaucuuuacuuaaaaaacaaaauaaaacacacacacacacacacacaaaaaccuagcugggcagagcagcacaugccuguagugcucggguggcugagaugggagaaucaccugagcucagaagauggcagcugcaauaagcugagaucccgccacuguacgcaagccuaaacaaccugaaugagaccccgucucaaaaaaacaaaacaaaacaaauacccucccugagcuucaguuccccuaaugguaaaauagagaaaauaauaccuaugcucagugugcagucauuucuccaugacgguacucguggcaggcauugcuagucgauccaugauacucuuuccucuaacugccaucaauuaaagaugguacuugagaugaaauauuucugcaguuccacaaacucaugagcuuuuuuguagagaacuuauuuaagagcuaauauguacagaauuucuaguagaauucuggcacaugguagacaaucguuacgacauuuggcucugaguucccugggggccggggcaaaaugagaaacacauuaagcuacauagucuuguuaucaaagaaggggaaaccuuacuuguuucucaggaguuggucuagguuauaguccugguguuaguguuuggccugaagcaggucaguguuccuaagaguuuccuuuuuagugggcgaguucaagggacuuuaacuugugugauuugucugcuuauuccagagaaagcucugggcuuguacuccucuccagcuguccccagacagcuagucgccuccagaaguacuucacccaugcacggagagcccaaaggcccacagccaccuacuggugagaggugcugggagguuccuagagugguggggaggucccagcaagccacccugugaccuccuccugccccuuucucagugcugucacugaugggaucccagcugcuucugaggggaagauccaggcugcccugaaacuggaacacauugauggggucaaucucgugaguccgggucugggaagaggaggggugcuucuagauauaguaccccuacagagaggagucagggguauggauuugggauggcuggcucuccuguccccuaaaacaggcaagugaccacugccuauacuguggcccugcccggagucuauugggagcagggagggucuggguauagcucccagaccuguguaaggcuuguucacucuuggcuggcaccacagacaguuccagugaaggccccaucccgaaaggacauccuggaaggugucaagaagacucucagucacuuucgugugguagccacaggcucuggcugugcccugguccagcugcagccacugacagguaggucuggcacccuagccagccuuuaaaacugcacuugauuugggaggcugaggcagguggaucacgaggucaggaguucaagaccagucuggccaagauggugaaacccuguuucaacuaaaaacuacaaaaauuagcugggcacgguggcaggcgccuguaaaaccagcuacucgggaggcugaggcaggagaaucgcuugaaccugggaggcagaaguugcaaugagccaagaucaugccacugcacuccagucuaggugauagaggagacuucaucuaaaaaaaaaaaaaacugcacuugagccaggcgcgguggcucacgccuguaaucccagcacuuugggaggccaaggcggauggaucacuugaggucaggaguucgaaaccagccaggcuaacauggugaaacccugucucuacuaaaaauacaaaaauuagcuggaguugguggcacgcaccuguaauccuagcuacuugggaggcugaggcgggagaaucgcuugaaccugggagacagagguugcagugagcgaagaucacaccauugcacuccagccugggagacagagugaaacgcuggcuaaaaaaaaaaaaaacugcacuuggcuuagggaggcaaggagcuggggagacagugguaucagcagcagccuggggagcauuugauggcccccagagguguaugugaccaggcccagcuagaggaggcagcuucaggcuagcaccccaacaggaaagaacaguccuuaggcccgguggcuucagcaauuaaaucaggguugcaucucaucaugaguggaucccacagccaggcagauugauagcugugaucguccugacguguuaugugucccucucuggaugcaggggccauaguacugaccucacugaaacauaugaucugagaaagggggugguguuuccccaaaggaaaaggggaggagugauacuggguggcacagaacgaguagcugcccacugucucuccuggcuuuccuguugcccaguguucuccagucaacuacaggugcacaugguacuacagcucugcccugugcuuggggaccacauguacucugcccgugugggcacuguccugggccagcgauuucugcugccagcugagaacaacaagccccaaagacagguacuccagcccaccugccugcugcuuucugagggguggagggagaggugagcaugggcagcaucuccagaccuuaucugugcagcuugggacuacugggaggcagcccuuuuggcucccaaggcuguauccguacccacaucuugguguguggccuugggcaaguaacacucacucucuugggcuucauucuguccauguguucaauaagggaguugauguggcuaauuucuaaagcccucuuaagucugccauucuuugagucugguacaaagggucaaaggcaugcguguauuaggacaccagaugccucuaccugcucuaacacacuaagcccagacuaccagagucuucacacaagaacugugcccucauguuaaggucaaauaaugggagugggcucugcuucaagcacuaaguacucagggacccaggcuguugauacccagccagaugaggggagacaguguagguucaaguggauaagguuuuucugggccagguguggaaguggcauacauacugccacccacauucacucagcuagagcucacucacgucucaccaagcugugagagggcugggaaauggaguugaggugugugccuaggaggaaacugauugggugacccccuagccagucucugcugcagugugagugccugugugaaugugcacaucugugugcaaagaggaaaugauuaacaguugcagaacaguggggaauggaggaagcgcccgccuuacucccauuucccuuagagcuggguacucagcugcuuggaaaauguggggcugaacacaacguaccucucccgcuccagguccuggaugaagcccuccucagacgccuccaccugacccccucccaggcugcccagcugcccuugcaccuccaccuacaucggcuccuucucccaggcaccagggccagggacaccccuguugagcuccuggcaccacugcccccuuauuucuccaggacccuacagugccuggggcuccgcuuacaauaguccucccucuguuccugacccccucacacacacuggaaagugagggugggggcucugcagucagacaaaccuaagaucacauccuggacaggccacuugcuugcuguguggcauugggcaaguaacuuuaccucucuggacuugugauaauaaaaguuccuaccucauguuaugguuuugaggauuugcuaagaaaguaaauguuuauuacggaucuugcuuacugcuga

SEQ ID NO: 14845 - RNA, 5034 nt, Homo sapiens
gacagugggcagcuacucguucugugccacccaguaucacuccuccccuuuuccuuuggggaaacaccacccccuuucucagaucauauguuucagugaggucaguacuauggccccugcauccagagagggacacauaacacgucaggacgaucacagcuaucaaucugccuggcugugggauccacucaugaugagaugcaacccugauuuaauugcugaagccaccgggccuaaggacuguucuuuccuguuggggugcuagccugaagcugccuccucuagcugggccuggucacauacaccucugggggccaucaaaugcuccccaggcugcugcugauaccacugucuccccagcuccuugccucccuaagccaagugcaguuuuuuuuuuuuuuagccagcguuucacucugucucccaggcuggagugcaauggugugaucuucgcucacugcaaccucugucucccagguucaagcgauucucccgccucagccucccaaguagcuaggauuacaggugcgugccaccaacuccagcuaauuuuuguauuuuuaguagagacaggguuucaccauguuagccuggcugguuucgaacuccugaccucaagugauccauccgccuuggccucccaaagugcugggauuacaggcgugagccaccgcgccuggcucaagugcaguuuuuuuuuuuuuuagaugaagucuccucuaucaccuagacuggagugcaguggcaugaucuuggcucauugcaacuucugccucccagguucaagcgauucuccugccucagccucccgaguagcugguuuuacaggcgccugccaccgugcccagcuaauuuuuguaguuuuuaguugaaacaggguuucaccaucuuggccagacuggucuugaacuccugaccucgugauccaccugccucagccucccaaaucaagugcaguuuuaaaggcuggcuagggugccagaccuaccugucaguggcugcagcuggaccagggcacagccagagccuguggcuaccacacgaaagugacugagagucuucuugacaccuuccaggauguccuuucgggauggggccuucacuggaacugucuguggugccagccaagagugaacaagccuuacacaggucugggagcuauacccagacccucccugcucccaauagacuccgggcagggccacaguauaggcaguggucacuugccuguuuuaggggacaggagagccagccaucccaaauccauaccccugacuccucucuguagggguacuauaucuagaagcaccccuccucuucccagacccggacucacgagauugaccccaucaauguguuccaguuucagggcagccuggaucuuccccucagaagcagcugggaucccaucagugacagcacugagaaaggggcaggaggaggucacaggguggcuugcugggaccuccccaccacucuaggaaccucccagcaccucucaccaguagguggcugugggccuuugggcucuccgugcaugggugaaguacuucuggaggcgacuagcugucuggggacagcuggagaggaguacaagcccagagcuuucucuggaauaagcagacaaaucacacaaguuaaagucccuugaacucgcccacuaaaaaggaaacucuuaggaacacugaccugcuucaggccaaacacuaacaccaggacuauaaccuagaccaacuccugagaaacaaguaagguuuccccuucuuugauaacaagacuauguagcuuaauguguuucucauuuugccccggcccccagggaacucagagccaaaugucguaacgauugucuaccaugugccagaauucuacuagaaauucuguacauauuagcucuuaaauaaguucucuacaaaaaagcucaugaguuuguggaacugcagaaauauuucaucucaaguaccaucuuuaauugauggcaguuagaggaaagaguaucauggaucgacuagcaaugccugccacgaguaccgucauggagaaaugacugcacacugagcauagguauuauuuucucuauuuuaccauuaggggaacugaagcucagggaggguauuuguuuuguuuuguuuuuuugagacggggucucauucagguuguuuaggcuugcguacaguggcgggaucucagcuuauugcagcugccaucuucugagcucaggugauucucccaucucagccacccgagcacuacaggcaugugcugcucugcccagcuagguuuuuguguguguguguguguguguuuuauuuuguuuuuuaaguaaagauaggguuuugccauguugcccaggcuggucuugaacuucuggacucaagcaauccucccaccucggccucccaaaguccuauugauuauaggcaugagccaccacgcggaaaguuuuguuguuguuuuuccagagauggggucuauuuugcccaggcuggucucgaacuccugggcucaagugauccucuugccuuggccuccagaaguguugggauuacaggugugagucacugugcccagcgucagggaggugucaugcuuugccugguaucacaccauuuguacuugaggauuugaacccagagccaucggcuuccucuucuucacaguacuuguauccaccucuaugaucucaaaccuucccauggaaaaugucucagcuuauccccaagcagcuguuuccccaccacagauggaugccuguacuccuagcuuccugucaccccuaccacuuacuucccagaugcucggacaaccugaagcuccugcucccugagcccuagggacuggcucagcucuggcagcacugagaacaacgucagcucuccugguuuuccuggaaaguaagaaagaaaaauuacaagaggccaaagcuucaugccuucacuuuucccucccucagucacgaaacccccuuccgcugcauucccuucccacauccccggcccauaccugucacugguagacccuguggcuuguucaacgucacuagagguccugaaacauacaucacacgaacaucagcaaaagcaacgguaacccuuuaugcagcacuaaagaguuuccagagcacuuucucacgcaucuuagcacauguccccaucaugacucucagacaugaguuaacuaccccacaccaaauucaacuucuuucuguuccucugccaccucagagccucggcacuugcuguuuccuguccccaaauuucccaggucuggcucccuaucaucuuggcucaaaugucacaucacggagaggucugaaucuccaaucuaaugucugccuuccuccugcaguuccucaccaucauaacacccuguuuuaguuuaugcauagcacuuaccacuaguaacuuguucauuuauuuucugacauccauuucucccguuagagagaaauccauuucuccccugagagcagaaaccauaucuaucuuuuucagcacuguauagccugccuagaacagugccuggaacauagcauauguucaagaaauaguugagaaaaggaauaaaucacugaauagagagugggguucagagaaauucaguuauuuuccuaaagccgcacagcaagcugaucacagagccuagguaugucugacuccaaagccuguguuuuguccgucgauaaauaaucauuauuuauuuauuuauuuauuuagacugagucuugcucugucaucccaggcuggagcgcaguagcacgaugucggcucacugcaaccucugcuauccggguucaagugacucuccugccucagccucccgaguagcugggauuacaggcggacgccgccacaccuggcuaauuuuuguguuuuuaguagagacgggguuucaccauguuggccaggcuagucucgaacuccugaccucaggugauccgcccgcgucagcacccuaaagugccgggauuacaggcgugagccaccgcggccaauaaacaauaaucuaguauagcaacucccguaacugagcgccggcuaugugcaaggcucgguaguuauuugcaucuucuccccacucuuaacccuacugcaucauggcaguaggguuaaaagcggggagagggugcaaauuagguggcuugucccagcucaugcugcuagugggaggcagaagcagggcugaucccguggcuucaauggagagcccaacugcacgccgaggcaguccccucccgguccuugugcggccgugccucucaccccucaccuuuccgguccaccacggcugcccgcagcgcaucaaccagcuccucccgacugagguuuuuuggcagcagccccgcgaagggcugguccccgaggggccccgaccguuggcaggagccgcgggguugccucugaugccuggacaaggagggagaagcaaugggagucauuccaucccgaggugccacccauuccuaucuccggacgccucuucccaaauccugcggccucugacaaaugccucacaaugucugggcugaccucgaaaauucagguacgaccggucccauucuacagcggagggcaccgaggcucagagaggccaacggggcuguuuucggguaacaucuaccugauccagaucccgcacgugccuucccccugcccuagccuccgucccgcaugagagaggggguacuuaaucaccgggcuucggugccaaagccugcguccucgggcacugggcggacacccaggccccgccgccagccacuccagaaccggcccaaaacacggcggccguccaucucccgagccaggacagcgcgcaugugcguccagaggggcagacccgcgcuccagccagcgcgcugauuggucagcuggagugucaaucggaauggugaccgggcgggacucagagccugaggaggcggggcuuuuccuccgcccaggaaggaaaugcagaaaugccuuccuaugcuuuuagggagagcgcuguagcagaagaauuugaucugaucaaaaaaccugucuuagcaaaaaa

SEQ ID NO: 14846 - RNA, 4238 nt, Homo sapiens
aacggagacgcgugugggccacauggguagaaaaacagcgucugccuuuauuuaagucccgucccccgccccaggucccgcgccuggucccaccccgcgucccggcgcgggaguccccgggggauggaaguagcuauccagggcuggcugaagggcccgggacacuugcuccgcucucucuuggagccgcccggaacgcggggcgcgaggcugcugcagggcccccaggaagucuggcaguugggagggcagugugaagacgggcacggugcggaaaagggcggguacggcguccggguggagcagccugucgaagcaggcccccacguagcugccgggcgcccggcccugcaagaagucgggcagcacgcagcugagcgaggcgcggaaggcgucgugcgggccgugcgccccgggcccggacaccccauccuguagccacucgcugcacagcgccaccgcaccgggagagaagagcaagaccaccacgccgcccuccugcagggucuggcgccgcugcgcgugaaaccaagccacgggccccugcgcgcucaguucacgacggcuccacaggucuacggccacgcgcagcggcagcuggcacagggccgacgccagggcgcccaccaggcgcucgaaacccgagucaucggcugaguagaggagcagagccgcgcggccccuggcggccgcugccggagaaaacagauggggagggaagaggugagcuggcacaggccuggcuccccgggggcggcccuccgcccagcgcuugcucccacucaccccccgagcggacguccuguuucaagagccucagccacccuguuaggggagaggggcggaggcagccagugagcucggccgccgcuuucccucggagaacucccacagccacucugguccucccccaggggaauggggagccgggaagcgcucaccuuucgcgugauccuuuuugagaaggaggaugagggaaagcgcagcggcaaagaguaggcaggccagccacacgagggcccagcgcuuguggaugucugggagacccagagaagaagaguuagaaacuuacccuccacagagaagaaaaacugagacuuaacagaaaugaauugggccgggugcgguggcucaugccuuuauauaaucccagcacuucgggaggccgaggcgggcagaucacgaggucaggacaucaagaccauccuggcuaacacggugaaaccccgucucuacuaaaaauacaaaaaauuagccgggcgugguggcacacgccuguaaucccagcuacucgggaggcugaggcaagagaaucgcuugaacucgggaggcagagguugcagugagccgagaucgcgccauugcacuccagccugggcgacagggugagacuccucucaaaacaaaacaaaacaaaacaaaaaacgaagaaaugauuugcccagaguccacagcacagugucagagccaguggaugaauauagcuccaucuguuuaggggucuuugaauaaguaaugucacccucugccucaguuuucuccucuguaaaguuguaccugugucauaggguuggugugaggacuaaauauauuaauacauauaaagcuuaacacaauguguuaauacauacuuaacacaaugccgagcaucuuaagugcuaaaaugucagcuguuuuucuccccuaagcuaggguugcugggcccuugaucuugcuguccugggugucugcaacuaccuggugucccugcccugucuuuuuuuuuuuuuuuuuaccuccaauugauuugccuugaauugauucaugacagccucagagaucuuuuaaaaauauaaauuugggccaggugcggugacucacgacuauaaucccagcacuuugggaggccgacgcgggcggaucacgaggucaggaguucaagaccagccuggccaagauggugaaaccccaucucuacuaaaaauacaaaaauuagcagggcaugguggcaggcgccuauuaaucccagcuacccgggaggcugagguagagaauugcuugaacccgggaggcagagguugcaguuagccgagaucgcgccauugcacuccagccugggcaacagagugagacucugccucaaaaauaaauaaaaaaauaaguauauauauauauauauauauauauauauauaugugugugugugugugugaaauauauaaaaauuugaucguagcuccugcugcucucaacauaagauccaaauccccuacaugucuccugcaucuuuaucucaugacagaaaccugccuguccaagacccuguaucucuacccccuuccccuagcucagucuucagaguuuugcuggaaccuucccccugagccccucaccccucaccccacccaggucagguccacauuguaugcauuuacagcacugaacacuugguggugcuucaguagcucccacuuuaaauguaagugacuggcucaugucuugcuagucuucuagggguggggcgggggcaaggauuuauauuuuugguguuccugcgaucccugcaagcucucaucauuuuuugagugaaugaaggaaugacccucuguuuaucugaucucagggaaggacaaggccauugcaugugcugugcccaagaguggucccugucaagauccccacuccugguacagaaaggaaaggcaguucuuacaauacucacauuuguccauggggcaggcccauagcgcucccaagucaucgucccauagcuguaagauacaaacagaaccaaauccagggcaccagccagguguuccaauauucaccaagcucugguggccugaucuccaaauucccagcaucaacuaugcauaucucccggcuaagguuccugcagcugcucugccuuugugcugugcccacugacuaggguaugacuucuuccauaccaaaucuggcuuauaggaagaaauucuucccggaagcucucccuggaacccaaaacuuagcaccuguaggugugguuaucuguuuaugggugucuagccaacagugugcuccuuggggauaggaacugugcuucuucuacucuuaacuuucccagggcugaacauaaaauaagccuaaauagacaguaggugagugcuaguuuuaggccuguugccccuaggcauugagguggggcccuucuuccaccagcucaccugcagacacuggccugacugcaggucuuguaguaaguacucuccaaggcgagcugcccucugccaagccaaaggaugggggcacuguuaccuggagguagcacccuuagggcagcaccuaccaggcuacagcuggguagaaugagguagaggggacugggagacuuuggugaugccgcugaauauggcccuggucugagucaccccccauguucccagagaccggcacaggguggauggagugaaaauuugaggccagaugugagaugcauuuggagagaucuguggaggagggucgcccaguccuaaccguggaggcuuugcuggguagugaaguacagccacuggguuccaaggcacagagggaucuguuguccugggggccucgugucuccaacaguagcacaucgucuuugagaggccccagggagucuggaaggggugagaggccacucugaccaagacccauccuugcugggauuggccacuugccugccucccaugcccugaccuucaccccuaggagguggcccugccccagcugcccccaggcccaacucaccagcccacaagcacuccugcagcugcagcuucuccgagcuguucaccugcugggaagagaccaugguuagggccacuaagaaaagcaaaagccaaaggcagaaagaccagaauggggcaggcaacagaaggccuguuggguugggaaucugcacucaaucugaccugaggcagauguggauucaaggcugggugauuaggaaucacuacaucuuucucugccccagccuugugagaucaucuguauaaagcgucuucugacccuaaagcuguuuuuaugucuuacggagcaugguuccccucucaucuaaccuucucaaagagauuccuuucucacaugaccacccugcuaaaaauugcaaccccagucccaccuuaucccuuucccaugguauuuguaugcaauuuuaagauacuauaugauuuauuuacaaugucuguugccugccuuucuccauuacaauauaaguucuaugaggguagagauguuag

SEQ ID NO: 14847 - RNA, 11253 nt, Homo sapiens
gcaagcuccgcccccuggacugcggcgcggguggggguugugcguuuuacgcaggcuguggcagcgacgcggugaggagacggcccacggcgcccgcgggcuggggcggucgcuucuuccuucuccguggccuacgagggucuggauccuucucugccggcucgugggccgugccuuugcccuucugcgaggcccugaaucugaucccuucccuucauauccggauccgggcuccucccuccaagcccgggguuccggacaccucccccaagacaaccccucuggccuccucuccuucaguacuuggaaucugaucucuucucccuaauucugcggauccggccccuaauauucuuuaucagacccucagacaagaggcugacuucugcccccuugucaaggagcgaggccacuuuccucuccaccccaugcuagcgaggauaacuuauuucucuucuggaauugcaucuuaugcgccuuuccccacccauccccacagccccugcaauacccaguuuggccucuuuugcuuguaauaacgcagaucccagcgccacggcaccuuagaacagaccuuuuucuuucucgcguggggccugacuccuucagugaagccucuccacgcccucuaucugcagguccccagccuggguaaagauggccccauggcccccgaagggccuagucccagcuaugcucuggggccucagccucuuccucaaccucccaggaccuaucuggcuccagcccucuccaccuccccagucuucucccccgccucagccccauccgugucauaccugccggggacugguugacagcuuuaacaaggugggugcaccggcagccucguuagaggggaacacagcgauuuagaguggggaacucugggaugcaaaucugcguggauuuaaguuucaucuuggucucuuacuaguuguauggcccuaggcagguugccuuucugugccucaguuuccuagucaguagaacagugaagugcuagcaugugccaggcacuguacuuagcuauuacuaauuuucuguuuccagggccuggagagaaccauccgggacaacuuuggagguggaaacacugccugggaggaagagaauuuguccaaauacaaagacagguaaggggcugcugggggaagggguguauauuccccuccccgccaaaucucugcucugcugguguagggcuaggaacucuuggggagcacuuauucauucaacaaauagcacugaacaucuauaguauagcaguaaacaaggcaagcaaaaugcccccuuccuggagcucacauucuaguagagaagacaagcagugaaugaguaagugaauaauauuaugucagaugaagaacaaacagugaagcacgguagacugcaggacggugggaggcaagguguucaagguuuggcauuugaacagagagacaggaagugaagaagcgagcuaugugacagggagggaauugggcagaggaugggacugagcuugguguauuugagaaguggcuggaguggagugagccaaggggagagugcuagaaggugaaggcaaaggcuuaagccucgagggcuacagaaaagaguuuagauuuuuuuuggaguguaaugggaagcucuuggaaggcuaugagcagaaaaagugauacugucuucucuacaccuuuaaagauuacucacacugcuauguagcaaacggauuguaaggggcaagggcggaggaagcagggagaccaguuugggaggcaagugcaucaucuagguacaaaggcaacacaagcuagugugguaucuaguggaggacaugaugaagaggucacagucuggguauauuuugcagagagaacaauaggaccuggugauagauucauuauggguauagagaaacaguagaauaaaagaugcuuacuagauuuugggccugagcaacugggugaguagugcagcuguuuucuaagauggugagaugcgaaaccgagaagguuuaggggaggggugggaugugguguucuuugaacguauugggcugaaauguccauuagacauccagguagacuccauacaaaucuggaauucagaaaagaguaggaauuggaaacaggaauuugagaguugucauuauauagucaguauguaaagaaagccaugggaaggauacagaaagccauuauauagucaauauauguaauacagaaagccauuuauauagucaguauguaaagaaaggcaugggaaggauacagaaaggcgagcccugagcccuccagcuuuucaaagucagauggaagaggagucagcaaaggcucagaguuagaccugguugucgguucuuaaccucucagagccacaguuucuucaccuguaaaauggggauauuaauaccugguuugccuauuucauagaaguguggaaaaggcuuaacugggaugcccacuagaaauaaagguuuuguuauuauguaacauuggucauuuucucuuuuccuucgccgggccugaguuuccucauucaggaaugaggggauuggcuaagacaaccccagaggcacuuccagcuuuguaauggcuccugcguugcuugcuuuuuuaaaucaccuccuauaugccaggcacugugccagacccuuuaaauacaggauauaagacaucaaauauuuauauauguguguauauauauguguguguguauauauauauguguguguauauauaugugcauauaugucugcguauauauaugugcguauauauaugcguauauauauauauauauguauauauuugugguaaaauacacauaaaaaauuucccauuaaagacauuuaauaauauuuacaauguuguguaaccaucaccacuauguaguuccagaacauuuucauuacccccccaaaaaauccuauaccuauuacacagccacucccuauucuccccuucccucggcucuuggcaaucacuaauuuguguuagucaagcagaaauuauggauuugcugauuucauuggaaucauaaaauauguggccuuuugugucuggcuaguuucacuuagcauaauguuuucaagguucacccauaccguagcauauaucaauacuuauuccuuuuuauggcugaauaauauucucauuuggcuguaccacauuuuguuuaaccaugcaucaguugauggacaucugcauuguuucuaccuuuuggcuguugugaauagugcugcuaugaacauugucuacaaguuuucguuugaacaccuguuuuccauucuuuugggucuauauccaguaguggaauuggcagguccuauggcaauuccauguuuuacuuauugaggaacugcuuuuccacaguggugaugccauuuuguauucccaccugcagugugggaggauucuaauuucuccacaucccugccaacacuuguuauaggauguauuuuuagccauaucuacccagcaaggguauuauauuccauugcucagaugcaggaacugauguauguuacaacaaaccugcagggaagguauugucauccccauuuuacagaugacaaaacaaagagguucagagagguuaagugacuugcccacuagaucuaccacuagauuugaacccaggucucucugcuucccagaaccaugaccccuuccauuauaccucauggccucuccuuugauauuuucaccgcacgaggaaggguggagagagacuugaggaggguggugggugggguggggcauguuucccaccagcccugcccuguccgaucagugagacccgccugguagaggugcuggagggugugugcagcaagucagacuucgagugccaccgccugcuggagcugagugaggagcugguggagagcuggugguuucacaagugaguggcaaagggccuucccuggaagugggucacaggugaggccuggugauaaggccugauuuggccgagaagcaggggggugcaugcuggggcccauguccugguugugcuccuuccaaacccaggucugcuaagaacuugccgggggacuugcgcuccacuuugagccucaguuuacccuucugccaaauggggaaagggcauuggucagauggccuuuugggucuuauguccaagcuggguugaaucacagauucaggcaugggggaaugggaacagcacuuaugacacuaucucagcaccuccuccccaccucccuccacccugccccugccucaggcagcaggaggccccggaccucuuccaguggcugugcucagauucccugaagcucugcugccccgcaggcaccuucgggcccuccugccuucgugaguuuuuaaguugcucuuggggaugggaggggaccaccgaguccagggauccaguccuggcucugucccuaguucgcugugugaacucaggcuacucagauaaacuucucuggaccucaguucuugccugccugacagggcuggggagaugggcaaaucaguggggaaaggcuuggagaaagcacaggggcuagacugagucauaugcaguauaguuaucaucauguacuaaagaaaugauagacuucccagccccuucauuucccaugccagaucggacuaugguaccuuccuggggaggggcgggugcugaccuggagccuccaugaucgccauccauccucacacacaguccuggcacaagagcugaacuuacuaccagccucuuuuagagcagucuuuccugaagcuacagauaaagagcuagcuacaaagauggcaaauucagucuuuguaaaagaaaauauuggcugggcgcgguggcucacaccuguaaucccaacacuuugggaggcugcgguggguggaucaugaggucaggagaucgagaccaucguggcuaucauggugaaacaccgucucuacuaaaaaauacaaaaaauuagccgggcaugguggcgggcgccucuagucccagcuacucuggaggcugaggcagaagaauggcaugaacccggcaggcggagcuugcagugagccgagaucaugccacugcacuccagccugggcgacagagcgagacucugucucaaaaaaaaaaaagaaaauauuugguccaguggcucguaccuguaaacccagcacuuugggaggcugaggcaggaggaucacuugaggccaggaguuugagagaccagccuggguaguagagcaagacccugucucuuaaaaaaaaaauaguggggcaugguagugcagccuguuguuccccuaggcugaggugggaggauugcuugagcccaggaguucgaagcugcagugagcuaugaucaugucauugccugggaaacagagcgagacccugucacuaaaaauaaauaaauaaauaaauaaauaaauaaauaaauaaauaaauaaaaggucuguaaaaucuaauuguuccacaagaggaaauugguuaaguaaaugucaguuuuaugacaaaauauuaugucauuaaaauuaauuuucuucuccaaaaauguuuacugauaugcagagcagaaaauauuaucuuguuuuuuuuguuuuuuugucuuuuuuauugaucauucuuggguguuucucccagagggggauuuggcagggucauaggacaauaguggagggaaggucagcagauaaacaagugaacaaaggucucugguuuuccuaggcagaggacccugcggccuuccgcaguguuugugucccuggguacuugagaucaaggaguggugaugacucucaaccagcaugcugccuucaagcaucuguuuaacaaagcacaucuugcaccgcccuuaauccauuuaacccugaguggacacagcacauguuucagagagcacaggguuggggauaaggucauagaucaacaggaucccaaggcagaagaauuuuucuuaguacagaacaaaaugaaaagucucccgugucuacuucuuucuacacagacacagcaaccauccgauuucucaguguuuuccccaccuuucccccuuuucuauuccacaaaaccgccauugucauccuggcccguucucaaugagcuguuggguacaccucccagacggggugguggccgggcagaggggcuccucacuucccaguaggggcagccgggcagaggcgccccucaccucccggacggggcggcuggccgggcggggggcugacccccucaccucccucccggacgggcuggcugcccggcggagacacuucucacuucccagacggggcggcugccgggcggaggggcuccucacuucucagacagggcggccgggcagagacgcuccucaccucccagacggggucgcggccgggcagagacgcuccucacuuccuagaugggauggcggccgggcagagacgcuccucacuuuccagacugggcagccuggcagagaggcuccucauaucccagacgaugggccgccaggcagagacgcuccucacuucccagacggggugguggccgggcagaggcugcaaucucggcacuuugggaggccaaggcaggcggcugggagguggagguuguagcgagccgagaucacgccacugcacuccagccugggcaccauugagcacugagugaacgagacuccgucugcaaucccggcaccucgggaggccgaggcuggcggaucacucgcguuuaggagcuggagaccggcccggccaacacagcgaaaccccgucuccaccaaaaaaauacgaaaaccagucaggcgugguggcgcgcgccugcaaucgcaggcacucggcagguugaggcaggagaaucaggcagggagguugcagugagccgagauggcagcaguacaguccagcuucagcuuggcaucagagggagaccguguaaagagagggagagggagaccauggggagagggagagggaggccauggggagagggagagggaaagggggagggggaggggagggggggagggagggaaggcaagggagagggagagggagagggagaaaauauuaucuuguauaucaagguuguauagaugaccucaccugguuuggugucuucccacagccuguccugggggaacagagaggcccugcgguggcuacgggcagugugaaggagaagggacacgagggggcagcgggcacugugacugccaagccggcuacgggggugaggccuguggccaguguggccuuggcuacuuugaggcagaacgcaacgccagccaucugguauguucggguagguagccaaaagguguggcacugggcaggggcagauggggcaccugccugcccauccucaugcugcccccauuccacccagcuuguuuuggccccugugcccgaugcucaggaccugaggaaucaaacuguuugcaaugcaagaagggcugggcccugcaucaccucaaguguguagguaaguggggcccuagcuaggucugggaagauggucaggggccugggcuugguccuuuauucucucaacacaagccugggcuagacuagccuagucuccaccuucauggagaucucaaccuggcugggaaggcagaaaaguaaccagauacuuacaguccaguacacagguacuguguaguauagucccuguguacagugagagaugccucugaucuaguucaguggaaguggugauggggaaucaggaaaggcuucuuggaggaggcguuacuuuggccaaguccuaaaaauugaggaaggggcugggcgcgguggcucacgccuguaaucccagcacuuugggaggccaaggcgggcagaucaugagaucaggagaucgagaccauccuggcuaacauggugaaacccugucucaacuaaaaauacaaaaaauuagcugggcgugguggcgggugccuguagucccagcuacucaggaggcugaggcaggagaagggcaugaaccugggaggcggagcuugcagugagccgagaucgcaccacugcacuccagucugggcaacagagggagacuccaucucaaaaaaaaaaaaaaaaaaaaaaaaaaaugaggaaggguuggcuaggagaaugaggacacugaacuuggggucaggaaaccuggguucaagacuugguuuggucccagccuagccacuuauauagacuaaaguaaaggcuaagcugcuguaacaaaaauccccaaaagacuguggcuuaaagaguauagagguuggcugggugugguagcucacucacgccucuaaucccagcacuuugagaggcugaagugggguggaucaccugaggucaggaguucgagaccagccuggccaacauggcaaaacccugucuguacuaaaaauacaaaaauuuagccaggcaugguggcaggugccuguaaucccagcuacucgggaggcagaggcaggagagucgcuugaauccaggaggcagagguugcagugagccaagaucacaccauugcacucuagccugggugacaagagcgaaacuccaucucaaaaaaaaaaaaaagaaucuagaggguagagguuuauuuuuuuuuaucauauuacagucccaaagugaguaguccaggcuggcaggggagcucugcuagucauaaucauuccaguacccagauuauuccuguaacuuacugcacaaucauccccuugggcguugucugcaugguugaagcugaguccugggcaucucugugucccacaugccagcacucaggaagggagaagggaaagaaagugcauugaggaguccaagcauuguuuuaagaccaagcuaacgguggagcucaucacuccuguuuacauccuguuggccagaacucaaucacagggacacacuuagcuucaagacagguuggcaaauguggucucuggcugggcagccugaaguccagcuagucugcuucuguguugguagacagcuugcagucucugccauaccauuuaaucccaggcaagaccauuccccaacggcucuggcuucagcuucccuacuaaauagggauugaaauucucacccugcucaccucucugcagacauugaugaguguggcacagagggagccaacuguggagcugaccaauucugcgugaacacugagggcuccuaugagugccgaggucagugucuacuucugcagaggaggggacgugaggaguggaggaagagcugcuccacaccugucccuccaaaccuuccccuucucaggcuucagagcacccccaggccuccgcuucuggagcguggcuccccugggccuaggugcacaucucacccucaucuuucucuccucucuccagacugugccaaggccugccuaggcugcaugggggcagggccaggucgcuguaagaaguguagcccuggcuaucagcaggugggcuccaagugucucggugagucuccugcugaugggacacaggcaccugggagugccucacccagcaugaauggugaagaggcuggaauaugggcaggugggggaaggaaggguggaauguugccugggcaagggcagaggggaguguugagagauggacaagauggagucagggugcuggguggggggcccuagcaggacucugaccccucccuccccucaagauguggaugagugugagacagagguguguccgggagagaacaagcagugugaaaacaccgagggcgguuaucgcugcaucugugccgagggcuacaagcagauggaaggcaucugugugaaggagcagaucccaggugagcccuggggcgggagaggggagguccucauucaaagagaaggcaggcaagccccuuccccagguagcaguggcagcuccaggcccugccccaucccuacugccacccagcccccuggaggcugcacugagaccgggcucuacaucugaucuccagguuggcucucagcagccuuauaccuuccaggguacaaagggaaucagaccuggcaucaaaucagucugccuccuuaaccuguuuccucaucuauccaaugggaccaguguuugcccuggccugcugagagcuguccuaggccggggguguggugagaugcaggguaaucacaacgaugauggcagggaccauuuccccagcaauuacugugucagaugcuguucuaggugcauuccccaucuuaacugauuuaaccccugaaacaacccgacgcuggaaguuggguucucauccccacucuacauauguaaaaaugaagaugcagagagaugaagcuacuuucccagggcuauauggcaagcaagucgcaaagcugggaucccaauccagacagucugaccguggaacgagacucauacacguaauaaaugcucugcccccaacuuguccaccacauggccuuggcaaguccaaccccuuuaccucucugagccucacuuucccauuuagugagacagggaugguaacugccccuugcagggugguuuugagcaguaaauguagugugccuggcuugcugggcaggccugguggccaugaugaucaggugugugggaguucuggggagacuccaagaacuaccaggaacagggauacgagugccaggcugcaucucuugcuccucugcagagucagcaggcuucuucucagagaugacagaagacgaguugguggugcugcagcagauguucuuuggcaucaucaucugugcacuggccacgcuggcugcuaagggcgacuugguguucaccgccaucuucauuggggcuguggcggccaugacuggcuacugguugucagagcgcagugaccgugugcuggagggcuucaucaagggcagauaaucgcggccaccaccuguaggaccuccucccacccacgcugcccccagagcuugggcugcccuccugcuggacacucaggacagcuugguuuauuuuugagagugggguaagcaccccuaccugccuuacagagcagcccagguacccaggcccgggcagacaaggccccugggguaaaaaguagcccugaagguggauaccaugagcucuucaccuggcggggacuggcaggcuucacaaugugugaauuucaaaaguuuuuccuuaaugguggcugcuagagcuuuggccccugcuuaggauuaggugguccucacagggguggggccaucacagcucccuccugccagcugcaugcugccaguuccuguucuguguucaccacauccccacaccccauugccacuuauuuauucaucucaggaaauaaagaaaggucuuggaaaguuaaaagg

SEQ ID NO: 14848 - RNA, 11253 nt, Homo sapiens
ccuuuuaacuuuccaagaccuuucuuuauuuccugagaugaauaaauaaguggcaaugggguguggggauguggugaacacagaacaggaacuggcagcaugcagcuggcaggagggagcugugauggccccaccccugugaggaccaccuaauccuaagcaggggccaaagcucuagcagccaccauuaaggaaaaacuuuugaaauucacacauugugaagccugccaguccccgccaggugaagagcucaugguauccaccuucagggcuacuuuuuaccccaggggccuugucugcccgggccuggguaccugggcugcucuguaaggcagguaggggugcuuaccccacucucaaaaauaaaccaagcuguccugaguguccagcaggagggcagcccaagcucugggggcagcgugggugggaggagguccuacaggugguggccgcgauuaucugcccuugaugaagcccuccagcacacggucacugcgcucugacaaccaguagccagucauggccgccacagccccaaugaagauggcggugaacaccaagucgcccuuagcagccagcguggccagugcacagaugaugaugccaaagaacaucugcugcagcaccaccaacucgucuucugucaucucugagaagaagccugcugacucugcagaggagcaagagaugcagccuggcacucguaucccuguuccugguaguucuuggagucuccccagaacucccacacaccugaucaucauggccaccaggccugcccagcaagccaggcacacuacauuuacugcucaaaaccacccugcaaggggcaguuaccaucccugucucacuaaaugggaaagugaggcucagagagguaaagggguuggacuugccaaggccaugugguggacaaguugggggcagagcauuuauuacguguaugagucucguuccacggucagacugucuggauugggaucccagcuuugcgacuugcuugccauauagcccugggaaaguagcuucaucucucugcaucuucauuuuuacauauguagaguggggaugagaacccaacuuccagcgucggguuguuucagggguuaaaucaguuaagauggggaaugcaccuagaacagcaucugacacaguaauugcuggggaaauggucccugccaucaucguugugauuacccugcaucucaccacacccccggccuaggacagcucucagcaggccagggcaaacacuggucccauuggauagaugaggaaacagguuaaggaggcagacugauuugaugccaggucugauucccuuuguacccuggaagguauaaggcugcugagagccaaccuggagaucagauguagagcccggucucagugcagccuccagggggcuggguggcaguagggauggggcagggccuggagcugccacugcuaccuggggaaggggcuugccugccuucucuuugaaugaggaccuccccucucccgccccagggcucaccugggaucugcuccuucacacagaugccuuccaucugcuuguagcccucggcacagaugcagcgauaaccgcccucgguguuuucacacugcuuguucucucccggacacaccucugucucacacucauccacaucuugaggggagggaggggucagaguccugcuagggccccccacccagcacccugacuccaucuuguccaucucucaacacuccccucugcccuugcccaggcaacauuccacccuuccuucccccaccugcccauauuccagccucuucaccauucaugcugggugaggcacucccaggugccugugucccaucagcaggagacucaccgagacacuuggagcccaccugcugauagccagggcuacacuucuuacagcgaccuggcccugcccccaugcagccuaggcaggccuuggcacagucuggagagaggagagaaagaugagggugagaugugcaccuaggcccaggggagccacgcuccagaagcggaggccugggggugcucugaagccugagaaggggaagguuuggagggacagguguggagcagcucuuccuccacuccucacguccccuccucugcagaaguagacacugaccucggcacucauaggagcccucaguguucacgcagaauuggucagcuccacaguuggcucccucugugccacacucaucaaugucugcagagaggugagcagggugagaauuucaaucccuauuuaguagggaagcugaagccagagccguuggggaauggucuugccugggauuaaaugguauggcagagacugcaagcugucuaccaacacagaagcagacuagcuggacuucaggcugcccagccagagaccacauuugccaaccugucuugaagcuaagugugucccugugauugaguucuggccaacaggauguaaacaggagugaugagcuccaccguuagcuuggucuuaaaacaaugcuuggacuccucaaugcacuuucuuucccuucucccuuccugagugcuggcaugugggacacagagaugcccaggacucagcuucaaccaugcagacaacgcccaaggggaugauugugcaguaaguuacaggaauaaucuggguacuggaaugauuaugacuagcagagcuccccugccagccuggacuacucacuuugggacuguaauaugauaaaaaaaaauaaaccucuacccucuagauucuuuuuuuuuuuuuugagauggaguuucgcucuugucacccaggcuagagugcaauggugugaucuuggcucacugcaaccucugccuccuggauucaagcgacucuccugccucugccucccgaguagcugggauuacaggcaccugccaccaugccuggcuaaauuuuuguauuuuuaguacagacaggguuuugccauguuggccaggcuggucucgaacuccugaccucaggugauccaccccacuucagccucucaaagugcugggauuagaggcgugagugagcuaccacacccagccaaccucuauacucuuuaagccacagucuuuuggggauuuuuguuacagcagcuuagccuuuacuuuagucuauauaaguggcuaggcugggaccaaaccaagucuugaacccagguuuccugaccccaaguucaguguccucauucuccuagccaacccuuccucauuuuuuuuuuuuuuuuuuuuuuuuuuugagauggagucucccucuguugcccagacuggagugcaguggugcgaucucggcucacugcaagcuccgccucccagguucaugcccuucuccugccucagccuccugaguagcugggacuacaggcacccgccaccacgcccagcuaauuuuuuguauuuuuaguugagacaggguuucaccauguuagccaggauggucucgaucuccugaucucaugaucugcccgccuuggccucccaaagugcugggauuacaggcgugagccaccgcgcccagccccuuccucaauuuuuaggacuuggccaaaguaacgccuccuccaagaagccuuuccugauuccccaucaccacuuccacugaacuagaucagaggcaucucucacuguacacagggacuauacuacacaguaccuguguacuggacuguaaguaucugguuacuuuucugccuucccagccagguugagaucuccaugaagguggagacuaggcuagucuagcccaggcuuguguugagagaauaaaggaccaagcccaggccccugaccaucuucccagaccuagcuagggccccacuuaccuacacacuugaggugaugcagggcccagcccuucuugcauugcaaacaguuugauuccucagguccugagcaucgggcacaggggccaaaacaagcuggguggaaugggggcagcaugaggaugggcaggcaggugccccaucugccccugcccagugccacaccuuuuggcuaccuacccgaacauaccagauggcuggcguugcguucugccucaaaguagccaaggccacacuggccacaggccucacccccguagccggcuuggcagucacagugcccgcugcccccucgugucccuucuccuucacacugcccguagccaccgcagggccucucuguucccccaggacaggcugugggaagacaccaaaccaggugaggucaucuauacaaccuugauauacaagauaauauuuucucccucucccucucccucucccuugccuucccucccucccccccuccccucccccucccccuuucccucucccucuccccauggccucccucucccucuccccauggucucccucucccucucuuuacacggucucccucugaugccaagcugaagcuggacuguacugcugccaucucggcucacugcaaccucccugccugauucuccugccucaaccugccgagugccugcgauugcaggcgcgcgccaccacgccugacugguuuucguauuuuuuugguggagacgggguuucgcuguguuggccgggccggucuccagcuccuaaacgcgagugauccgccagccucggccucccgaggugccgggauugcagacggagucucguucacucagugcucaauggugcccaggcuggagugcaguggcgugaucucggcucgcuacaaccuccaccucccagccgccugccuuggccucccaaagugccgagauugcagccucugcccggccaccaccccgucugggaagugaggagcgucucugccuggcggcccaucgucugggauaugaggagccucucugccaggcugcccagucuggaaagugaggagcgucucugcccggccgccaucccaucuaggaagugaggagcgucucugcccggccgcgaccccgucugggaggugaggagcgucucugcccggccgcccugucugagaagugaggagccccuccgcccggcagccgccccgucugggaagugagaagugucuccgccgggcagccagcccguccgggagggaggugagggggucagccccccgcccggccagccgccccguccgggaggugaggggcgccucugcccggcugccccuacugggaagugaggagccccucugcccggccaccaccccgucugggagguguacccaacagcucauugagaacgggccaggaugacaauggcgguuuuguggaauagaaaagggggaaagguggggaaaacacugagaaaucggaugguugcugugucuguguagaaagaaguagacacgggagacuuuucauuuuguucuguacuaagaaaaauucuucugccuugggauccuguugaucuaugaccuuauccccaacccugugcucucugaaacaugugcuguguccacucaggguuaaauggauuaagggcggugcaagaugugcuuuguuaaacagaugcuugaaggcagcaugcugguugagagucaucaccacuccuugaucucaaguacccagggacacaaacacugcggaaggccgcaggguccucugccuaggaaaaccagagaccuuuguucacuuguuuaucugcugaccuucccuccacuauuguccuaugacccugccaaaucccccucugggagaaacacccaagaaugaucaauaaaaaagacaaaaaaacaaaaaaaacaagauaauauuuucugcucugcauaucaguaaacauuuuuggagaagaaaauuaauuuuaaugacauaauauuuugucauaaaacugacauuuacuuaaccaauuuccucuuguggaacaauuagauuuuacagaccuuuuauuuauuuauuuauuuauuuauuuauuuauuuauuuauuuauuuuuagugacagggucucgcucuguuucccaggcaaugacaugaucauagcucacugcagcuucgaacuccugggcucaagcaauccucccaccucagccuaggggaacaacaggcugcacuaccaugccccacuauuuuuuuuuuaagagacagggucuugcucuacuacccaggcuggucucucaaacuccuggccucaagugauccuccugccucagccucccaaagugcuggguuuacagguacgagccacuggaccaaauauuuucuuuuuuuuuuuugagacagagucucgcucugucgcccaggcuggagugcaguggcaugaucucggcucacugcaagcuccgccugccggguucaugccauucuucugccucagccuccagaguagcugggacuagaggcgcccgccaccaugcccggcuaauuuuuuguauuuuuuaguagagacgguguuucaccaugauagccacgauggucucgaucuccugaccucaugauccacccaccgcagccucccaaaguguugggauuacaggugugagccaccgcgcccagccaauauuuucuuuuacaaagacugaauuugccaucuuuguagcuagcucuuuaucuguagcuucaggaaagacugcucuaaaagaggcugguaguaaguucagcucuugugccaggacugugugugaggauggauggcgaucauggaggcuccaggucagcacccgccccuccccaggaagguaccauaguccgaucuggcaugggaaaugaaggggcugggaagucuaucauuucuuuaguacaugaugauaacuauacugcauaugacucagucuagccccugugcuuucuccaagccuuuccccacugauuugcccaucuccccagcccugucaggcaggcaagaacugagguccagagaaguuuaucugaguagccugaguucacacagcgaacuagggacagagccaggacuggaucccuggacucggugguccccucccauccccaagagcaacuuaaaaacucacgaaggcaggagggcccgaaggugccugcggggcagcagagcuucagggaaucugagcacagccacuggaagagguccggggccuccugcugccugaggcaggggcaggguggagggagguggggaggaggugcugagauagugucauaagugcuguucccauucccccaugccugaaucugugauucaacccagcuuggacauaagacccaaaaggccaucugaccaaugcccuuuccccauuuggcagaaggguaaacugaggcucaaaguggagcgcaagucccccggcaaguucuuagcagaccuggguuuggaaggagcacaaccaggacaugggccccagcaugcaccccccugcuucucggccaaaucaggccuuaucaccaggccucaccugugacccacuuccagggaaggcccuuugccacucacuugugaaaccaccagcucuccaccagcuccucacucagcuccagcaggcgguggcacucgaagucugacuugcugcacacacccuccagcaccucuaccaggcgggucucacugaucggacagggcagggcuggugggaaacaugccccaccccacccaccacccuccucaagucucucuccacccuuccucgugcggugaaaauaucaaaggagaggccaugagguauaauggaaggggucaugguucugggaagcagagagaccuggguucaaaucuagugguagaucuagugggcaagucacuuaaccucucugaaccucuuuguuuugucaucuguaaaauggggaugacaauaccuucccugcagguuuguuguaacauacaucaguuccugcaucugagcaauggaauauaauacccuugcuggguagauauggcuaaaaauacauccuauaacaaguguuggcagggauguggagaaauuagaauccucccacacugcaggugggaauacaaaauggcaucaccacuguggaaaagcaguuccucaauaaguaaaacauggaauugccauaggaccugccaauuccacuacuggauauagacccaaaagaauggaaaacagguguucaaacgaaaacuuguagacaauguucauagcagcacuauucacaacagccaaaagguagaaacaaugcagauguccaucaacugaugcaugguuaaacaaaaugugguacagccaaaugagaauauuauucagccauaaaaaggaauaaguauugauauaugcuacgguaugggugaaccuugaaaacauuaugcuaagugaaacuagccagacacaaaaggccacauauuuuaugauuccaaugaaaucagcaaauccauaauuucugcuugacuaacacaaauuagugauugccaagagccgagggaaggggagaauagggaguggcuguguaauagguauaggauuuuuuggggggguaaugaaaauguucuggaacuacauaguggugaugguuacacaacauuguaaauauuauuaaaugucuuuaaugggaaauuuuuuauguguauuuuaccacaaauauauacauauauauauauauauacgcauauauauacgcacauauauauacgcagacauauaugcacauauauauacacacacauauauauauacacacacacauauauauacacacauauauaaauauuugaugucuuauauccuguauuuaaagggucuggcacagugccuggcauauaggaggugauuuaaaaaagcaagcaacgcaggagccauuacaaagcuggaagugccucugggguugucuuagccaauccccucauuccugaaugaggaaacucaggcccggcgaaggaaaagagaaaaugaccaauguuacauaauaacaaaaccuuuauuucuagugggcaucccaguuaagccuuuuccacacuucuaugaaauaggcaaaccagguauuaauauccccauuuuacaggugaagaaacuguggcucugagagguuaagaaccgacaaccaggucuaacucugagccuuugcugacuccucuuccaucugacuuugaaaagcuggagggcucagggcucgccuuucuguauccuucccaugccuuucuuuacauacugacuauauaaauggcuuucuguauuacauauauugacuauauaauggcuuucuguauccuucccauggcuuucuuuacauacugacuauauaaugacaacucucaaauuccuguuuccaauuccuacucuuuucugaauuccagauuuguauggagucuaccuggaugucuaauggacauuucagcccaauacguucaaagaacaccacaucccaccccuccccuaaaccuucucgguuucgcaucucaccaucuuagaaaacagcugcacuacucacccaguugcucaggcccaaaaucuaguaagcaucuuuuauucuacuguuucucuauacccauaaugaaucuaucaccagguccuauuguucucucugcaaaauauacccagacugugaccucuucaucauguccuccacuagauaccacacuagcuuguguugccuuuguaccuagaugaugcacuugccucccaaacuggucucccugcuuccuccgcccuugccccuuacaauccguuugcuacauagcagugugaguaaucuuuaaagguguagagaagacaguaucacuuuuucugcucauagccuuccaagagcuucccauuacacuccaaaaaaaaucuaaacucuuuucuguagcccucgaggcuuaagccuuugccuucaccuucuagcacucuccccuuggcucacuccacuccagccacuucucaaauacaccaagcucagucccauccucugcccaauucccucccugucacauagcucgcuucuucacuuccugucucucuguucaaaugccaaaccuugaacaccuugccucccaccguccugcagucuaccgugcuucacuguuuguucuucaucugacauaauauuauucacuuacucauucacugcuugucuucucuacuagaaugugagcuccaggaagggggcauuuugcuugccuuguuuacugcuauacuauagauguucagugcuauuuguugaaugaauaagugcuccccaagaguuccuagcccuacaccagcagagcagagauuuggcggggaggggaauauacaccccuucccccagcagccccuuaccugucuuuguauuuggacaaauucucuuccucccaggcaguguuuccaccuccaaaguugucccggaugguucucuccaggcccuggaaacagaaaauuaguaauagcuaaguacagugccuggcacaugcuagcacuucacuguucuacugacuaggaaacugaggcacagaaaggcaaccugccuagggccauacaacuaguaagagaccaagaugaaacuuaaauccacgcagauuugcaucccagaguuccccacucuaaaucgcuguguuccccucuaacgaggcugccggugcacccaccuuguuaaagcugucaaccaguccccggcagguaugacacggauggggcugaggcgggggagaagacuggggagguggagagggcuggagccagauagguccugggagguugaggaagaggcugaggccccagagcauagcugggacuaggcccuucgggggccauggggccaucuuuacccaggcuggggaccugcagauagagggcguggagaggcuucacugaaggagucaggccccacgcgagaaagaaaaaggucuguucuaaggugccguggcgcugggaucugcguuauuacaagcaaaagaggccaaacuggguauugcaggggcuguggggauggguggggaaaggcgcauaagaugcaauuccagaagagaaauaaguuauccucgcuagcaugggguggagaggaaaguggccucgcuccuugacaagggggcagaagucagccucuugucugagggucugauaaagaauauuaggggccggauccgcagaauuagggagaagagaucagauuccaaguacugaaggagaggaggccagagggguugucuugggggagguguccggaaccccgggcuuggagggaggagcccggauccggauaugaagggaagggaucagauucagggccucgcagaagggcaaaggcacggcccacgagccggcagagaaggauccagacccucguaggccacggagaaggaagaagcgaccgccccagcccgcgggcgccgugggccgucuccucaccgcgucgcugccacagccugcguaaaacgcacaacccccacccgcgccgcaguccagggggcggagcuugc

SEQ ID NO: 14849 - RNA, 9158 nt, Homo sapiens
gaauaugggcaggugggggaaggaaggguggaauguugccugggcaagggcagaggggaguguugagagauggacaagauggagucagggugcuggguggggggcccuagcaggacucugaccccucccuccccucaagauguggaugagugugagacagagguguguccgggagagaacaagcagugugaaaacaccgagggcgguuaucgcugcaucugugccgagggcuacaagcagauggaaggcaucugugugaaggagcagaucccaggugagcccuggggcgggagaggggagguccucauucaaagagaaggcaggcaagccccuuccccagguagcaguggcagcuccaggcccugccccaucccuacugccacccagcccccuggaggcugcacugagaccgggcucuacaucugaucuccagguuggcucucagcagccuuauaccuuccaggguacaaagggaaucagaccuggcaucaaaucagucugccuccuuaaccuguuuccucaucuauccaaugggaccaguguuugcccuggccugcugagagcuguccuaggccggggguguggugagaugcaggguaaucacaacgaugauggcagggaccauuuccccagcaauuacugugucagaugcuguucuaggugcauuccccaucuuaacugauuuaaccccugaaacaacccgacgcuggaaguuggguucucauccccacucuacauauguaaaaaugaagaugcagagagaugaagcuacuuucccagggcuauauggcaagcaagucgcaaagcugggaucccaauccagacagucugaccguggaacgagacucauacacguaauaaaugcucugcccccaacuuguccaccacauggccuuggcaaguccaaccccuuuaccucucugagccucacuuucccauuuagugagacagggaugguaacugccccuugcagggugguuuugagcaguaaauguagugugccuggcuugcugggcaggccugguggccaugaugaucaggugugugggaguucuggggagacuccaagaacuaccaggaacagggauacgagugccaggcugcaucucuugcuccucugcagagucagcaggcuucuucucagagaugacagaagacgaguugguggugcugcagcagauguucuuuggcaucaucaucugugcacuggccacgcuggcugcuaagggcgacuugguguucaccgccaucuucauuggggcuguggcggccaugacuggcuacugguugucagagcgcagugaccgugugcuggagggcuucaucaagggcagauaaucgcggccaccaccuguaggaccuccucccacccacgcugcccccagagcuugggcugcccuccugcuggacacucaggacagcuugguuuauuuuugagagugggguaagcaccccuaccugccuuacagagcagcccagguacccaggcccgggcagacaaggccccugggguaaaaaguagcccugaagguggauaccaugagcucuucaccuggcggggacuggcaggcuucacaaugugugaauuucaaaaguuuuuccuuaaugguggcugcuagagcuuuggccccugcuuaggauuaggugguccucacagggguggggccaucacagcucccuccugccagcugcaugcugccaguuccuguucuguguucaccacauccccacaccccauugccacuuauuuauucaucucaggaaauaaagaaaggucuuggaaaguuaaaaggcaucagucuuacuaccugucccaccacccccaccuuagggaaauguccuagaauccugggaaauugagggcuucuuugauggugaguggagaaaagauagaggagaagguugccccugaagugcuguuaggagaaggaggauagaggaaucagccuuaggaggguuccaugccagcugucauuuggcaaaggacccuggacagaugacuuuugccucugaacuucacucuucucuuuccucaaaugggcuucauaaugcuuuccacucaggcuuaacaugagaauuaaaugaggugacaaaugugaagaccuggacaguacacaacagauauucaauaaaaguguggucgccauuaugaccagagccuccaagccucaagcaaccuuuccucggaguccugcucuccguccaauacacaggacuuagaaugacugggaggcagggccuccagucucuccuuccuccuaugaguacaggauccuggcauggccagagggaagcaugagccaaguccuaaggguuuauuucuuuggcacaaagaggacaaucuagacaagcgaggcucaucacuccacguuggggagucuggggcaccugcucccuguucuucaugcccgaauccaugcacacccacccuguauuccgcauaagacacggccucugugcaaaaugccggcugaaaaaaaaauagaaauauuaaaagcaaaaaacggcauggggguggggugaguucaaaccuggcugucccccggggguugccgucagguagagaggccuggggaugccuuuuuuuuuuuuuuuuuuuuuuuuuuuuuugagacggagucucacucuugucacccaggcuggagugcaauggcguggucucggcucacugcaaccucugccucccuguucaagcaauucucccgccucagccucccgaguagcugggacuacaggcgugugccaccuggcuaauuuuuuuguauuuuuaguagagacgaggguuucgcuauguucgagaccaggaggcugaucucgaacuccugaccucguguuccacccaccucggccucccaaagugcugggauuccuggcgugagccaccgcgccuggccaggaugcccauuuuuuaaaggcucaacugucccaguaggccaugccaugugggcaucgggcaggguccuggcccugcgucaggaccgcucuucaaagcucgaugguaucacuggaggcgcugcgggauuccccaggcuugccgcgcggcuggaccucucccuggccgucccccugccgagcggcgguagaaucaggggcuggggucggggcaggcaguagcuguaccgugcugggcaacucaucuaggggcagacuguccacugaugacagcccguggcgccagggguuccaacugaucuugagugaaccccuggagaagcugucgagggagcugccagaagccgcagcggcugccccgucgggugcuuccacuacgugcugugggaccggcccgcgcacgcgcacgucgcugagcgaccugcagcggccgcggaggagcgaggagccagcgucgucgagcucggcuuugggauggcugccccggcgcggccgcagagcgccuccaggcggcggggaggccaggccgcggaggccgcagcgcuggaacacacugucucgcacuaggugcucgcggaagagcgcggcgucgaugcugcggcucagguugaugggcgauggcggccgcagauccagcucgcucagcgauggcgccggucccacaccguugcgggacagucccgggccacccugggguccgcgacccaacgacgcagccgagccccaggcgccugaacugggcguggccagcugcccacucuccgccggguugcggaugaggcucuugcugauguccaagcugccugcaccaacguugcugggcccugcauagcaguuauugggucgcuccggcaccucgcucuuuccugacggcgccgggcacgccagacgcaucagcuuagcccagcaagcgugcuccgugggcggccugggucucgcggcagccaccgcggccaacgccagggcgagcgcccaugucagcuccaggaggcgcagccagaaguggacaccccaccaggcccacgagaagcggcccacgcggccugggcccggguacagccagagcgcagccgccagcugcaagccgcuagccagcagccccagcgcgcccgccacagccaacagccgagggcccgggcuggcaucccagccccgugggccguccagcaggcggcgacggcacaggcagagcgugcccagagccacggccgcgccccaggcgcacgacaagcccugcgucaggagguugagcacagaccauguggacagcaggucugucgcgagcaacccuacaccaugcaccagcgccacugcucccagcaggaguggguuuugcagcgguggcggcagccccgcgcccaggccgagcagagucagggcugccagcgccguaagcagcaaggggaagggcagguuguagagcaccaggcccccgcgaacgcccagccgcgccugcgagccguaagggucgguaagcauguaggcggaucgcagcgccgaagccacgagcaccagcaccgcggccaccaaugccagccggggcccugcuggggcggcugccagcgcagccagcgccaacaacgcgggcagcagaaagaguacccccaccccguagacgugcagcucccaggagaagcucaggacccgccgaagggggccccagcguagcgggggugcaguggcguuggcuggggggcuggaggcuggggcugaagccauggagcuggcggugggcuccggagggggaggcuggcccagggcucgcugcguggugacucgaaugaggccccggcgugacgucgagggggccuggacugggggugcugggggauggcuuugggggcgccccggccacuccucggcuucaucugcaauuauaacaauauuaaaauagccauuugaaaagugcuuuugauuuuguaucacccucuagugugguuggcaagucauuuaacuuuuccaaacaaaucugcaaaauggagauaacagcaccugccucauugcguugugaagaagaugaaauguuuagcccggugcccaacacccaguaagugcuaaauggaugucagcuaucauuuucauuaaugcuacuaucagggagguaguaccccagcaguucgacacaugggcugcauauuagaaucuucuggagaccaaggaauaagaauuucuugggacguggcuugggcauuggaauuuuuuucuuuuuuucuuuugacagguucucacucugucauccaggcuggugugcaguggugcaaugugggcuuacugcagccuugaccuccaggacaagugaucucccaccucagccuccggaauagcugggacuacagguaugcaccaccacgcccaacuaauuuuuauauauuuuuuuuguucuaaacauauccauguuacauauuagaacauucuagccccaaaagggcaaaugacuucucccagauuucccagugaguaugaauuuauuauccuagguuguuugaaggaggcccugggcaacuccuuuaaggaggugauugucuccauucauuccccacccuccgcccccauacauccccaacagagguucucaguuacuagacagagcacucccucuccccacaccccagccaugcucucaccuggcugcagggcccccauggggcucucuguucgguuuacagcugggccagggucugagggaccagggaugagagacuugggggugccuggggccuccacagcuccucucacccgcuggggggagauggggucugcuccauucauugcugcucucucugaaaugacaaagcagucaucaccuuaccugacccuccuaugguccuccuaaucccucaggauugagucacaaucaaccucauuugccacaaagaggaaaaugagaccuagagggacccagggucaaacagaauugaggcauccagcugccccagaacaucgcucagcacacucauugauacccaccuggcuuagacggccgaucaggagccucugaggcggguggauccgugggcugggguccuggugaauccuuagcgucaggaaggucagccugcuugggcgggggaccuggggagcugacuucccaggacaccucagcgccagcccucuugggggucucaaccggcagcuccucagcaggaggaaggcuucuggccaaugccaagucuggcugggccccuggcuccugagaguacaccaccucaacuggggguacugagccaacaucaggggcugcuggauccugcugggugaaguggggaccuugagcugccuccugcaaguguuccucaaacccacccuguccuuccagcacuggccucuugacaguaccugagugggaaacaaggguguggggugggcccugguggucugagggagaagugggugggacccugcucuuaguuuuggccuucagacccucaucucuagguggccacugucccucuuggccuucaugcugcagggagggaggaacuguggcuacccugaguugacgucugggaguuguggggaugaaagugagaugaggguggcccacuggguggggagccacugcuucuugcugcagaagcucuugugaguccagagguccuguccagccgugggagcuugguccuugagccaucuggaggucaucaguuacugggagucguucucucugagcuccuugugcugcuuugggcccguacagggcugggccaaggggagaggcuacaggcuucucaggcaucucuucagcaggggcguggcggacaucagaguuccugugacugucagcucugggguucuccgggaacacgucaaaggccuggggcucugagcccacagagcccuuggggugggcuccagggaucauagggauuucggaguuuucaaguggccugggaaagccccuccccagggcagggccaguccccaggaguggcagcagcaacagcagaaggccacauacacagccccaugggcuggaggccauggucuacuccgaugccugggccuaaagcccccaccuuccaguccucacuggaugagccuaaaaaaaaaacagggcauggaaugacaugugagggcugggggcccccaugccuuccucaaggggcugacaggaaagaaaagcaacgcaaggcagcagcuucucugcuuuuaaaauugcuggacguggcacuugcccugcuuuaaaaccuucaguggcuccccauuucccucaagaaagaacauaagcuccucuccuggccuuccaagacccuggccaccacaagcuguucaucuguccuccaacacccacuggacuguguggcucccaugccuuuugcuucugcuguucugucagcagggaaugcucucucccuuccccuucacuuacugaaauccuguucuuuuugagacggagucuugcucugucgcucaggcuggagugcaguggcgugaucucggcucacugcaaccuccaccucccagguucaagugauucuccugccucagccucccgaguagcugggguuacagacaugugccaccacaccuggcuaauuuuuauauuuuuaauagagaugggguuuugccauguuggcaaggcuagucuugaacuccugaccucagguaaucugcccaucuuggccuccuaaagugcugggauuacaggcaugagccacugcacccugccugaaauguuauuccuaaaggcccacuucaaaaaugagagacguggagagggagaggaauaugcaccggccuuuggcgaggggccugaguuugaaucccagugucuucauuuccugggggagucauuucaccucucugcaucauaguuuucccaucaguaaaauggggauaauaagcaugccuaacucaaggcaugagacaaauaaccaaacagguaugggcgagguucauaccugaugcuugacaagcguuacacauuccucuucccgccuuccuucccucaucuuccugggcacuugucacucuggucugauucuauaauaaucuccugccucuuauuucaaaccugcagccuccaguauauaccuggccccacguggauauccccuaaaaguuccuguucucgagagccugucagugggccagggaggcaggaaggggccccaccaccaggagagguuucauggagggugcgagagcugaagccuggguguguuuggcggcagaggcccugcucuuuuccucucuggggagcagcuguccccaaagcuuccuggcuguuaacccaugguggcucacagacaccuuaagaagccacugaaaaccccuggugcucucccggggaaaagacccaggcucaccgaaaguugugaacaauuucaagggguucaaagaccuuugagucccauccuccaaacucgaguuuagacucugucuuaaagccuuguuaguucauuucucaaacauucacggagccccaugggcugcuccuggucuaggcuaggugcugggggcccagagacagggcuuugcuccaggguugggaguaggggugcgcugagacgccccuaacacagguacuggcuaaaaacagugcuccuguguuuaguucuuucccagugaggcuccugcgcugagcuuagcaacacgucacuccgcccucccaauacaaggugugggaacagccauuucacagggggaagaaacggggguucagagagggugagcaacucccccaaggucacacagcugaguggacacaaucgggguugugaaacccucggaggcucaucuuccacaggagguccaaaaagcuuugccgagaaaacggcugaauggggccuccaaagauaaacaugccaucugccuaccacugccaacccaagagaugugggcaccugcggacaaggcgggggcuugcccagcccugggcucccacucugcuggagaggcugugggggguggcggaucucucugccgcagggacuggggagaggccggccugggggcagggcgaggccguugcggggcagccucggagcugguccaucucggguuaccucuccuccuccuccuccuccuccuccgucuccucucucccuggcuccgcgccuucccgcaguguccuggaugggggugggcgccgugcaggccuggucgccugcgcccgcgacgggggcagcaggccacgcuccccgucggggucccgccaucgcccccucccugggccagcuccucaccugcgcgccgcagcccccguguucaccuugcgcgcgucccugcagccgaucgccgcgccgcauccuccgagaugcuca

SEQ ID NO: 14850 - RNA, 9158 nt, Homo sapiens
ugagcaucucggaggaugcggcgcggcgaucggcugcagggacgcgcgcaaggugaacacgggggcugcggcgcgcaggugaggagcuggcccagggagggggcgauggcgggaccccgacggggagcguggccugcugcccccgucgcgggcgcaggcgaccaggccugcacggcgcccacccccauccaggacacugcgggaaggcgcggagccagggagagaggagacggaggaggaggaggaggaggaggagagguaacccgagauggaccagcuccgaggcugccccgcaacggccucgcccugcccccaggccggccucuccccagucccugcggcagagagauccgccaccccccacagccucuccagcagagugggagcccagggcugggcaagcccccgccuuguccgcaggugcccacaucucuuggguuggcagugguaggcagauggcauguuuaucuuuggaggccccauucagccguuuucucggcaaagcuuuuuggaccuccuguggaagaugagccuccgaggguuucacaaccccgauuguguccacucagcugugugaccuugggggaguugcucacccucucugaacccccguuucuucccccugugaaauggcuguucccacaccuuguauugggagggcggagugacguguugcuaagcucagcgcaggagccucacugggaaagaacuaaacacaggagcacuguuuuuagccaguaccuguguuaggggcgucucagcgcaccccuacucccaacccuggagcaaagcccugucucugggcccccagcaccuagccuagaccaggagcagcccauggggcuccgugaauguuugagaaaugaacuaacaaggcuuuaagacagagucuaaacucgaguuuggaggaugggacucaaaggucuuugaaccccuugaaauuguucacaacuuucggugagccugggucuuuuccccgggagagcaccagggguuuucaguggcuucuuaaggugucugugagccaccauggguuaacagccaggaagcuuuggggacagcugcuccccagagaggaaaagagcagggccucugccgccaaacacacccaggcuucagcucucgcacccuccaugaaaccucuccuggugguggggccccuuccugccucccuggcccacugacaggcucucgagaacaggaacuuuuaggggauauccacguggggccagguauauacuggaggcugcagguuugaaauaagaggcaggagauuauuauagaaucagaccagagugacaagugcccaggaagaugagggaaggaaggcgggaagaggaauguguaacgcuugucaagcaucagguaugaaccucgcccauaccuguuugguuauuugucucaugccuugaguuaggcaugcuuauuauccccauuuuacugaugggaaaacuaugaugcagagaggugaaaugacucccccaggaaaugaagacacugggauucaaacucaggccccucgccaaaggccggugcauauuccucucccucuccacgucucucauuuuugaagugggccuuuaggaauaacauuucaggcagggugcaguggcucaugccuguaaucccagcacuuuaggaggccaagaugggcagauuaccugaggucaggaguucaagacuagccuugccaacauggcaaaaccccaucucuauuaaaaauauaaaaauuagccaggugugguggcacaugucuguaaccccagcuacucgggaggcugaggcaggagaaucacuugaaccugggagguggagguugcagugagccgagaucacgccacugcacuccagccugagcgacagagcaagacuccgucucaaaaagaacaggauuucaguaagugaaggggaagggagagagcauucccugcugacagaacagcagaagcaaaaggcaugggagccacacaguccaguggguguuggaggacagaugaacagcuugugguggccagggucuuggaaggccaggagaggagcuuauguucuuucuugagggaaauggggagccacugaagguuuuaaagcagggcaagugccacguccagcaauuuuaaaagcagagaagcugcugccuugcguugcuuuucuuuccugucagccccuugaggaaggcaugggggcccccagcccucacaugucauuccaugcccuguuuuuuuuuuaggcucauccagugaggacuggaaggugggggcuuuaggcccaggcaucggaguagaccauggccuccagcccauggggcuguguauguggccuucugcuguugcugcugccacuccuggggacuggcccugcccuggggaggggcuuucccaggccacuugaaaacuccgaaaucccuaugaucccuggagcccaccccaagggcucugugggcucagagccccaggccuuugacguguucccggagaaccccagagcugacagucacaggaacucugauguccgccacgccccugcugaagagaugccugagaagccuguagccucuccccuuggcccagcccuguacgggcccaaagcagcacaaggagcucagagagaacgacucccaguaacugaugaccuccagauggcucaaggaccaagcucccacggcuggacaggaccucuggacucacaagagcuucugcagcaagaagcaguggcuccccacccagugggccacccucaucucacuuucauccccacaacucccagacgucaacucaggguagccacaguuccucccucccugcagcaugaaggccaagagggacaguggccaccuagagaugagggucugaaggccaaaacuaagagcagggucccacccacuucucccucagaccaccagggcccaccccacacccuuguuucccacucagguacugucaagaggccagugcuggaaggacaggguggguuugaggaacacuugcaggaggcagcucaagguccccacuucacccagcaggauccagcagccccugauguuggcucaguacccccaguugaggugguguacucucaggagccaggggcccagccagacuuggcauuggccagaagccuuccuccugcugaggagcugccgguugagacccccaagagggcuggcgcugagguguccugggaagucagcuccccaggucccccgcccaagcaggcugaccuuccugacgcuaaggauucaccaggaccccagcccacggauccacccgccucagaggcuccugaucggccgucuaagccagguggguaucaaugagugugcugagcgauguucuggggcagcuggaugccucaauucuguuugacccugggucccucuaggucucauuuuccucuuuguggcaaaugagguugauugugacucaauccugagggauuaggaggaccauaggagggucagguaaggugaugacugcuuugucauuucagagagagcagcaaugaauggagcagaccccaucuccccccagcgggugagaggagcuguggaggccccaggcacccccaagucucucaucccuggucccucagacccuggcccagcuguaaaccgaacagagagccccaugggggcccugcagccaggugagagcauggcugggguguggggagagggagugcucugucuaguaacugagaaccucuguuggggauguaugggggcggaggguggggaaugaauggagacaaucaccuccuuaaaggaguugcccagggccuccuucaaacaaccuaggauaauaaauucauacucacugggaaaucugggagaagucauuugcccuuuuggggcuagaauguucuaauauguaacauggauauguuuagaacaaaaaaaauauauaaaaauuaguugggcgugguggugcauaccuguagucccagcuauuccggaggcugaggugggagaucacuuguccuggaggucaaggcugcaguaagcccacauugcaccacugcacaccagccuggaugacagagugagaaccugucaaaagaaaaaaagaaaaaaauuccaaugcccaagccacgucccaagaaauucuuauuccuuggucuccagaagauucuaauaugcagcccaugugucgaacugcugggguacuaccucccugauaguagcauuaaugaaaaugauagcugacauccauuuagcacuuacuggguguugggcaccgggcuaaacauuucaucuucuucacaacgcaaugaggcaggugcuguuaucuccauuuugcagauuuguuuggaaaaguuaaaugacuugccaaccacacuagagggugauacaaaaucaaaagcacuuuucaaauggcuauuuuaauauuguuauaauugcagaugaagccgaggaguggccggggcgcccccaaagccaucccccagcacccccaguccaggcccccucgacgucacgccggggccucauucgagucaccacgcagcgagcccugggccagccucccccuccggagcccaccgccagcuccauggcuucagccccagccuccagccccccagccaacgccacugcacccccgcuacgcuggggcccccuucggcggguccugagcuucuccugggagcugcacgucuacgggguggggguacucuuucugcugcccgcguuguuggcgcuggcugcgcuggcagccgccccagcagggccccggcuggcauugguggccgcggugcuggugcucguggcuucggcgcugcgauccgccuacaugcuuaccgacccuuacggcucgcaggcgcggcugggcguucgcgggggccuggugcucuacaaccugcccuuccccuugcugcuuacggcgcuggcagcccugacucugcucggccugggcgcggggcugccgccaccgcugcaaaacccacuccugcugggagcaguggcgcuggugcaugguguaggguugcucgcgacagaccugcuguccacauggucugugcucaaccuccugacgcagggcuugucgugcgccuggggcgcggccguggcucugggcacgcucugccugugccgucgccgccugcuggacggcccacggggcugggaugccagcccgggcccucggcuguuggcuguggcgggcgcgcuggggcugcuggcuagcggcuugcagcuggcggcugcgcucuggcuguacccgggcccaggccgcgugggccgcuucucgugggccuggugggguguccacuucuggcugcgccuccuggagcugacaugggcgcucgcccuggcguuggccgcgguggcugccgcgagacccaggccgcccacggagcacgcuugcugggcuaagcugaugcgucuggcgugcccggcgccgucaggaaagagcgaggugccggagcgacccaauaacugcuaugcagggcccagcaacguuggugcaggcagcuuggacaucagcaagagccucauccgcaacccggcggagagugggcagcuggccacgcccaguucaggcgccuggggcucggcugcgucguugggucgcggaccccaggguggcccgggacugucccgcaacggugugggaccggcgccaucgcugagcgagcuggaucugcggccgccaucgcccaucaaccugagccgcagcaucgacgccgcgcucuuccgcgagcaccuagugcgagacaguguguuccagcgcugcggccuccgcggccuggccuccccgccgccuggaggcgcucugcggccgcgccggggcagccaucccaaagccgagcucgacgacgcuggcuccucgcuccuccgcggccgcugcaggucgcucagcgacgugcgcgugcgcgggccggucccacagcacguaguggaagcacccgacggggcagccgcugcggcuucuggcagcucccucgacagcuucuccagggguucacucaagaucaguuggaaccccuggcgccacgggcugucaucaguggacagucugccccuagaugaguugcccagcacgguacagcuacugccugccccgaccccagccccugauucuaccgccgcucggcagggggacggccagggagagguccagccgcgcggcaagccuggggaaucccgcagcgccuccagugauaccaucgagcuuugaagagcgguccugacgcagggccaggacccugcccgaugcccacauggcauggccuacugggacaguugagccuuuaaaaaaugggcauccuggccaggcgcgguggcucacgccaggaaucccagcacuuugggaggccgagguggguggaacacgaggucaggaguucgagaucagccuccuggucucgaacauagcgaaacccucgucucuacuaaaaauacaaaaaaauuagccagguggcacacgccuguagucccagcuacucgggaggcugaggcgggagaauugcuugaacagggaggcagagguugcagugagccgagaccacgccauugcacuccagccugggugacaagagugagacuccgucucaaaaaaaaaaaaaaaaaaaaaaaaaaaaaaggcauccccaggccucucuaccugacggcaacccccgggggacagccagguuugaacucaccccacccccaugccguuuuuugcuuuuaauauuucuauuuuuuuuucagccggcauuuugcacagaggccgugucuuaugcggaauacagggugggugugcauggauucgggcaugaagaacagggagcaggugccccagacuccccaacguggagugaugagccucgcuugucuagauuguccucuuugugccaaagaaauaaacccuuaggacuuggcucaugcuucccucuggccaugccaggauccuguacucauaggaggaaggagagacuggaggcccugccucccagucauucuaaguccuguguauuggacggagagcaggacuccgaggaaagguugcuugaggcuuggaggcucuggucauaauggcgaccacacuuuuauugaauaucuguuguguacuguccaggucuucacauuugucaccucauuuaauucucauguuaagccugaguggaaagcauuaugaagcccauuugaggaaagagaagagugaaguucagaggcaaaagucaucuguccaggguccuuugccaaaugacagcuggcauggaacccuccuaaggcugauuccucuauccuccuucuccuaacagcacuucaggggcaaccuucuccucuaucuuuucuccacucaccaucaaagaagcccucaauuucccaggauucuaggacauuucccuaagguggggguggugggacagguaguaagacugaugccuuuuaacuuuccaagaccuuucuuuauuuccugagaugaauaaauaaguggcaaugggguguggggauguggugaacacagaacaggaacuggcagcaugcagcuggcaggagggagcugugauggccccaccccugugaggaccaccuaauccuaagcaggggccaaagcucuagcagccaccauuaaggaaaaacuuuugaaauucacacauugugaagccugccaguccccgccaggugaagagcucaugguauccaccuucagggcuacuuuuuaccccaggggccuugucugcccgggccuggguaccugggcugcucuguaaggcagguaggggugcuuaccccacucucaaaaauaaaccaagcuguccugaguguccagcaggagggcagcccaagcucugggggcagcgugggugggaggagguccuacaggugguggccgcgauuaucugcccuugaugaagcccuccagcacacggucacugcgcucugacaaccaguagccagucauggccgccacagccccaaugaagauggcggugaacaccaagucgcccuuagcagccagcguggccagugcacagaugaugaugccaaagaacaucugcugcagcaccaccaacucgucuucugucaucucugagaagaagccugcugacucugcagaggagcaagagaugcagccuggcacucguaucccuguuccugguaguucuuggagucuccccagaacucccacacaccugaucaucauggccaccaggccugcccagcaagccaggcacacuacauuuacugcucaaaaccacccugcaaggggcaguuaccaucccugucucacuaaaugggaaagugaggcucagagagguaaagggguuggacuugccaaggccaugugguggacaaguugggggcagagcauuuauuacguguaugagucucguuccacggucagacugucuggauugggaucccagcuuugcgacuugcuugccauauagcccugggaaaguagcuucaucucucugcaucuucauuuuuacauauguagaguggggaugagaacccaacuuccagcgucggguuguuucagggguuaaaucaguuaagauggggaaugcaccuagaacagcaucugacacaguaauugcuggggaaauggucccugccaucaucguugugauuacccugcaucucaccacacccccggccuaggacagcucucagcaggccagggcaaacacuggucccauuggauagaugaggaaacagguuaaggaggcagacugauuugaugccaggucugauucccuuuguacccuggaagguauaaggcugcugagagccaaccuggagaucagauguagagcccggucucagugcagccuccagggggcuggguggcaguagggauggggcagggccuggagcugccacugcuaccuggggaaggggcuugccugccuucucuuugaaugaggaccuccccucucccgccccagggcucaccugggaucugcuccuucacacagaugccuuccaucugcuuguagcccucggcacagaugcagcgauaaccgcccucgguguuuucacacugcuuguucucucccggacacaccucugucucacacucauccacaucuugaggggagggaggggucagaguccugcuagggccccccacccagcacccugacuccaucuuguccaucucucaacacuccccucugcccuugcccaggcaacauuccacccuuccuucccccaccugcccauauuc

SEQ ID NO: 14851 - RNA, 63716 nt, Homo sapiens
acuuccgcgccggaaguggaaggccgggcagcccagcugaaggcaauaagcugggcucaccgcugcagcagaguucugugcuagccgggcauaggggcgagagaaggcccagaggcgacgucagagagaagcaacugcgccccggugaagagaagcucgcccaucaccggcugggagccagcuuucagugaagauggcagggccagaacuguugcuugacuccaacaucugccucugggugguccuacccaucguuaucacucuucguagacaugauccgccacuacguguccauccugcuggagagcgacaagaagcucacccaggaacaaguaucugacaggucagcgcccucccuuccccagccuaccucacaccgccgugaccuuggacaagaaagugcaggcguugugucaguuugccuagguucacgucucgcccccacuggcaaggugaccuuacccguuaccucuguguuucacuuuuguccucugugaaauggggauaauaacaguaccucccucauagacaggugggaaucaaauuagaugaugucuguaaaucccuuagcacaggaucuaggacguauugaguguuaaaaacaaaaaacaaaaacggugcuguuaauccuuuagguuagucgccaacccucgguggguuuaccuaugaacuaucccaucccacccuuucguugggaagagugccuggugcuuuauagcuuuuaguauuuguaacauccagucaagugagugugauaaucugcauucuaccaaauuacuguuccaaugguuagcugagaugcuaagcaccaaagcgcuuugcaaucuguaacacugcuguuagacauguaaggaauuguaauuaucauuucccuuccuaggguggaggcaacuuccucacauacuucauugcaguauuuauuuauuuauuuaauuuaacuuaauuuaauuuuugagacggaguuucgcucuuguugcacuagauuaaguaucuauuauuuuuccguuugcauauuuuaucacuugaacagaaacucugagcgcagggucaugaccuugccuuacucuauaccccauagcaugcagcagagugcaaggcacaugguaggccaucaaaaaacuuguucacagccaggcgugguggcucucaccuguaaucucaauacuuugggaggcugaggugggaggaucgcuugagcccuggaguucaagaccagccugggcaacacaaugagaccacugucucuacaaaaaaauuuaaacauuagccaggugcaguggugugugccuguagucccagcuacucgggaggcugaggugugaggaucacuugagcccgggaguucgaggcugaagugagccaugaucgcaccacugcgauugcagccucaaucacugcagccucgaccuuuuugguccagccugggugacaaagcaagacccugucuccagaaaaacaaacgaaaaaacacuuguucagucuacgauaauucaagacuuuuccaggcaguguaaucaaaagaaauucaucuagcucuccuauauuuacgcugcugaauaguuuuguagaaauggaguugaauaucaugacccugagguauuuuaagacccuaaauaagcaaucuuaaauuauccuguauuuucuaaacacucaauaucuguguuaucugaaguuugcaaauuccgcaagaaauuuuuaauuuuguauuuuuauuuuugugaauaucuaaaaauaaguccuuguacuguuauaaagauaaagcuuuguaauuuguaacugaaagacaucuauuuauuuuuggcagagacagggucucacuauguugcccaguuggucucaaauuccugggcucaagggauccucccaucucagccucccaaagugcugggauuauaagugugagccacuguaccaggccuaaaugacauugucuuagaauaaaacuuuaaacucgguaccucucaaaccagaguuccauauucuuaagaaucuaugucuucuccuuuccaaaaagucaguaguauauucuucaaguucgagaaccauuuuuuacacacauucuauccccaaaccuagucuaauauauuuuauucauguauuuuucagcuuugguuuaauaccugucagaauuuuuuuuuuuuuuuuuuugaaacauugucuugcucuguugcccaggcugaagcuggggaauaaggucagugaugcuucugccaucccuauggagccacagagccagucugggaagccccacuucauagcuccuuggcugccagggaaagaacaagugggcuggacucuaugagguggaacuggagcccaggcccucuguuguggaaucacuacccagagacuuuaucaggguaccucuuggcuccuggcuucaggguucauagucuagaaaaauauuguccaauaaaauauaauguaaguuacauuuaccuuuuaauugugguaugguuuccuuccucuaaaaguuuacaauucaggguuuuuuaguauauucacaaaguugugcaaucaucgccacuaucuaacacugcggugacuaauaggcuggaaugcaguagucauaagccuaucauaagcguaaguagagagucuuuaggggugcuaaccaucugguugucucgaugcaggggacgaggcacccacagucccucucccauaagccugccaagaagauugauguggcccguguaaccuuugaccuguacaagcugaacccacaggacuucauuggcugccugaacaugaaggcgacuuuuuaugauacguacucccuuuccuaugaucugcacugcuguggggccaaacgcaucaugaagugagcaaauugggguuuccuggggacaagguggguacgggcaaugggagagccccugucuguucacauggacucagccuucucagcaccugggucuggcuuuggugcugacaaagcauagccuguaucagacaacacggagccugaugggcucucgaagugcuguggacaacacuggcgugugcccaggggugcacauguuccuccugguggaaccuggaugcauuuuauuuuuaugacuacuuuccacucuagcaacuacauuuuuucauugaaauaggaaguuuuccuaaguagucuucuagucaguuuuuuaaaaaugaacauguguuggccaggcauaguggcucacgccucuaaucccagcacuuugggaggccaagguggguggaucacuugaggucaggaguuugagaccagccuggccaacauggcaaaacccaaucucuacaaaaauuagcuggacauggcagugcaugccuguaaucccaacuacucaggagccugaagcaggagaaucguuugaacccaggagguggaggugacagugaggcgagauugugucacugcacuccagccugggcaaaacagcaagugucuuaccaaaaaaaaaaaaaaaaaguaugugucaaagauuucauugaauucauuaauuaaugagagaacuagcaagaaguuacaaucaguucaaaggagaauucaaaaucccacacauauauagguccaguaagaaugaugagauaggcugggugcaguagcucucaccuggaaucccagcacuuugggaguucaaggcaggaggaucucuugagcccaggagcuugagaccagccucggcaauagugagagagagagagagagacacacacacuuacacacacacacggcaggaggaucucuugagcccaggaguuugagaccagccugggcaacacagugagagagagagacacaugcgcacacacacacacacacacaccccugggcaacauagagagagacacacacacacacacauacacacacacacacacacacacacacacacaguuugagaccagccugagcaacauagugagaggcaugcacgcugggagcagugguaguaugugccuauaaucccagcuaggugggaggauugccugagcccaggaguuugaggcugcagugagauaugaccauaccauuguguacuccagccugggcaacagcaugaggccuugucucuaaaaagaagaaaaaaagagauaaauguauacauacaaaauuggguuuuuucucccauggggaugggagggaugaaauaaucuucccuccauaggacagaauuaguuugcaagucuuauggaccagagucauuuguacuauauaaugaacuuuucuuaaaacuuauuuugaaagccuaaccaagugucucaggaagcaugagaauaugugagguuagaagcugcaugccguuauggugauguuucccaaauucugccgcuccaguggcgcccuggggcauccuuccccauuggguggauguagccacugaggcugaagugauugaaucaguccaaagccgcaaaacuugcaagcagcagagcauggcugcuaguccaucuuuccgauagucuauucuucuccaguuccuucauucaguguuuccugagugcccacugugugccuggcccuaugcuguaacuacagauucagagaugaacaaaauaccagauagaacaaguucccugagggcaggaauuuuuguggccuucagcaccuuggugaaugcugacacauaguaguuauuuaaaugauuguagaauaaaugaagacacaggcgaucucuauucacauggggcuucugagaaauccugcucaggaucccaagaguucuaccagaucacauguagcuagaacauaucagaccuucuugcuuucuuaguugaucuccugcagacccaaucugcaguugaggaaacugaggcugugugggucugcuugccagagacaacaguggguggcaggcuugagccugguucuguggcugagaguuccauuuuccuccucggcuacuucuuccaggauacuaccaucucaugccaccucuugaccucagacuaccuaccaccaguagucugcauuauuucaaaauuaugaacaagaaguuucagaccagcugggggcaguggcucacaccuguaauccuagcacuuugggaggccgagggaggugaaucaccugaggucaggaguucgagaccagccugggcaacaaggugaaacccccgucuuuacuaaaaauacaaaaauuagccgggcguggugacacacugcuguaaucccagcuacucaggaggcugaggcaggagaaucacuggaaacuggaaugugaagguugcagugagccgagaucacaccauuguacuccagccugggcgacagaauaagacucugucucagaaaaagaaaaggucucagaccuuaaacucaguccaguuaggggaggugggacacuucgaccuaaacacagucuggugacuggaaucaguuuagugacuuagugguaucacuagguuuuuuuuaauuauaguaaauauguauagcauaaaaucuauuguuuggaccauuuuaaguguacaauucagugccauuaaguacguucacaauguugcccagccaucaccaccauccauuucuagaccucuugcaucaucuuaaccagaaacucugucccccugaagcacuaagucuccauuccuccuccagacacugguagccuccacuccacuuucuauguuugccaauucuaguaccauauggaacuggagucagucaauacucguucuucauuucuagcuuccuugacuucggauuuucaagggucguucauauugcaguauggaucagaauuucauuccuuuuuuuuuuuugagauggagucucacucugucacccaggcuggagugcaguggcgcgaucucagcucacuacaaccucugccuuccagguucaagcagccucagccucccgagcagcccgccaccaugcccggcuaauuuuuuuguauuuuuugaguagagacacgguuucaccauccuggccagguuggucuugaacuccugaccuugugaucugcccaccucagccucccaaagugcugguauuacaggcgugagccaccgugcccggccucagaauuucuuucuuuuuuucuuuuuuuuuuuuuuuuuugagacagagucucauucugucgccaggcuggagugcaauggcacgaucucagcucacugcaaccucugacucccggguucaagcgauucuccugccucagccucccgaguagcugggauuacaggcacgugccaccacgcccggcuaauuuuuguauuuuuaguagagacaggguuucaccguuuuggccaggauggucucgaucuccugaccucgugauccgcccgccucggccucccaaagugcugggauuacaggccugagccaccacgccuggccgaccucagaauuucauuccuuuuuaaggcuggucagcuagguugucagccucaguuccuuaauuugagaaguggguauacuucuaaguuauaaccuugaaaauauaaaguauucucuuguguagaugugaauaguucuaagucuuucugccacccacaccccagucagaccauaaauucacuuauugaaugaauguuaauaaaagacuaaaguuugaacaacagccagguaacauuucuuugccuuuuauuuuccacuccccuaucucacuuaggacuagacaccucgagugacccucacauuccccuuucaaacagauuugguaagaauuugauuaaaauuaucuagcauucuuuauauuuuuuuagagacagcgucucacucugucaucuaggcuacagugcaguggugcaaucauggcucacugcagccuuaaccucguaggcucaagugauccuccugaguagcacaagugugugcuaccaugcuuggcuaguucuuuaauacuuuuguagagacaaggucucacuagaccaggcuggucucaaacuccuggccucaagccauccuccucggccucccaaaaugcuggaauuauaggccugagccagugcaccuagccaaaguugucuagcauucaaccagcugcucuugaaccugcccccgcuuccccauuuccccuacuuuucaaauauccaaccccacguuaauugcuuuaugcuauuucagccuuaugacccuggguggcaggugcaaucccauuuuacccaugagggagcugaagcucaaaacuagagcaguuugcugaaguucacccagcuaauaagacuggauuaggacuuaggccugccugauucagguucaguucucaguacaugcucaugccaggcauggaugucuucauguccagcacucugaacaugagcuagacugcaggugacuuagaaaggccucagagucuagaacagagugucucaagggcagagccacauuauggagauuaaucuggcuggaccaaaguaguaguagaaaaauagaaagccauaugaaaugagcugggguuuugcaugagaaaguagggagguuccgggcaucucaguuaagguggaauugcagguccucgcccuaauccugaucccaucugcagcaucuguuccuauuugcacauugcucuagaauugaugaaaugcuuuuagugcuaccaccucagugguauucaaauguuauuaaugaagaaaacaaacauaaugaaaccaaucccuuccaggccaacaugggaauaauggguuguagggagguguacacuuauguuuuauucuuacuuguuuuugagacgcucuguugcccaggcuggagcgcaguggugcaaucucagcucacuucaaccucugucucccggguucaagcgauucucaugccucagcuucccaaguagcugagauuacagcugugugccaccucaccuggcuaauuuauuuguauuuuuuaguagagacgggguuucaccauguuggccaggcuggucucaaacuccugaccucaagugaucugcccgccucagccuccuaaagugcuaggauuacaggcgugagccacugagcccagcuuuguuuuguuguuguuggugaugguggugguuuuuuuguuuguuuguuuuguuuuguuuuuuugagacagagucuugcucugucacccaggcuggagugcaguggcaucaucucagcucacugcaaccuccgccuccuggguucaagcgauucuccugccucaggcucucaaguagcuggaauuauaggcgcccaccagcaggccugacuaauuuuuguguuuuuaguagggacaggguuuuaccauguuggccacacuggucucaaacuccugaccucaggugacucacccaccacggccucccaaaguguuaggauuacaggcaugagccacuacgcccaaccuacuucgugguuuugacuugcgugcccucucauuccacccagggaagcucuccacugggcccuuuucagcaugcaagccacgggccacgugcugcuucaccuccuguuaccugcagcagcuccucgaugccacagaggacgggcauccccccaagggcaaggccucaucccucaucccgaccugucugaagauacugcagugaaagcccaagcccuagcuuuccccagugaaggacuagacuaggggccccacgcucaacugguaguggccacaagccuggcagcuguagagccgcuaaccucccgacaccucccucaccacacaggacccugagugaggaggaggggcuggaaaccugggauggguuggccaaaggagaaccucaggcuccuggccuggcccagcuccuuccugcccaagguagcuuagcccauccagacugguccugaagucugucccuccauuggcaugaagucugccccucagcaguccggccucacaggcuguacuuucauggugcucucuaccuucuggcccccaucccagaacauucgugagugaauucgcaagcauacuagcaugugauauuagggaguuugcaauaaauuauugaugcugauguaucuuugccuguguucuuuggggugggguucuagcuggaagguuggagagggcuaaaggaagagaugaaucuguugucaaacuauucuccauaacauaagauuacaaauaauaguuuuucuaccaaaggggggaaaaaaaaaaaaagcugagcacagugacacgugccugcagucccagcuacucagcaggcuguggugggagcaucccuugagaccaggaguucaaggccagcccggggcacaauagcaagagcccaggcucuuuaaaaaacaaaauugcagggguggggggaggggggagggauagcauugggagauauaccuagugcuagaugacgaguuagugggugcagcgcaccagcaugucacauguauacauagguaacuaaccugcacauugugcacauguacccuaaaacuuaaaguauaaaaaaaaaaaaaaaaaaaaaauuugcaggccgggugcaguggcucacgccuguaaucccagcacuuugggaggcccaggcgggcggaucacgagguugggagaucgagaccacagugaaacccugucucuacuaaaaauacaaaaaaaaaauuagccaggcgugguggcgggugccuguagucccagcuacucggagaggcugaggcaggagaauggcgugaacccaggaggcggagcuuacagugaggcgagaucgcacuacugcacuccagccugggcgacagagcgagacucugucucaaaaaaaaaaaaaaaauugcauuugauuuugaaacuaaagucggcuaaauuugaggcuugagcugaccauguaauugauaccauaaguaacaauuuccuaauuaaauucaccuaucagaggagcuucaauugagcaggugggauuaagucacucuucuaauuucucagugucccguuuuauaauaaccauuuaagugguuaggugaaaaaguacuacucaagcuguaaggcauuuccccgucaaugcccauccuaacuugccagacagcuuaucuuucauguucaggacuuucaaccucgggauuucaaagugggcucauagguagccccaaagaguaggagcuucucaucagugugagcuggcauuuuccaauauuggacaacucaagacaagcaugaaaggcugaauuuaggcugggcgugcuggcucaugccuguaaucccagcacuuugggaggccaaggcagguggauuaccugaggucagcagcuggagaccagccuggccaacauggccaaacccucucucuacuaaaauacaaaaaauuaaccaggcaugcuuguaggcaucuguaaucccagcuauuugggaggcugaggcaggagaauugcuuaaaccugggaggcauagguugcagugagccaagaucgugccauugcacucuagccuggacgacagagugagacuccgucucaaaaaaaaaacacaaacaaacaaaaaaaaaacgaaaaauaaaacaaaaccaaucguuuuacaacucuuacuauaaagccuauuuggauguaguaaauacuaaggcaaaggucuguauuaccaaagauggucugggagcuauuucuggcagcggacccaaacccugcaaccugugggugaagcugcugaagcucacugaagagggccugcuauucugggcucuccuucucuugcaguuguggcuggaggcuggccuggugucaggcuggcuccauggggugggccgucuggcagggaggccugauguuuguauuagcacagaaucuaucccaguccacccuugccgaagcuguggcggggccuacgugcuccuuccguaaagugcucaguaacagaguuggagugggggugggaggcucgguauuugucccaagcuucccuccuccugggauccggaguuucacaagugaaucuugagcaacugcccacggucucuuggcauugagcccagggaaaacaacguucuuccuuuucuuccaggagcucgaggcuaauggagucaaagcagcuguggucagugaacaggaaaaggcagccuuugaugaggcuggggggcuggggagggaagauuccaaacagcaaaggagcuugagccucaguagggccuggcgauccuagugggagaauggccuuuccuggagacccccccgcacagccaggagcagcugucgucaaggugggcugugucccagccccuccagcucagccuuuucaucuguucaggcuggugcucacgagugcacaggacgccuuucagaaggaggauucuaaaucccgggggucuguaauggcacagccacaugucugagcccaaaacaagagaaccacauguguuuuugccacacuucuugccagugcuguccauauuuguguacauaauuuuuuguuucuuuucuuugagacagagucucacucuugucacccaggcuggagugcaguggcacgaucucagcucacugcaaccucugccugcuggguucaagcaauucuucugccucagccucccaaguagcugggauuacaggcacccaccaccacgcccagguaauuuuuauauuuuucauagagaugggguuucgccauauuggccaggcuggucucaaacuccugaccucaggugauccaccugccucagccuccgaaagugcugggauuacaggcgugagacaccacacccggcucuugugcacguaauucuauuuuauuugagauggagucuugcucuguugcccaggcuggagugcaguggcaugaucucggcucacugcaaccuccgccucucaggcucaagagauucuugugccucagccuuccagguagcugggacugugcaccaccaugcugggcuaauguuuguauuuuuaguagaguugggguuucacuuagccaggcuggucucgaacuucuggccucaaaagaucugcccgccucggcuucucaaagugccuuggauucccaaagugcugggauuacaggugugaaccaucaugccuggccugugcacaucauuucaauaacugauauuuugaaaacauuguuuauugacauaauuuauguacaauaaaauguauuauuuacaaguaugucuuucaauaaguuuuggcaaauuuauacaguuauguaaccaccauuucuggcaaaccagaaagcugccaucugucccuuuauagucauguaaauagacuuuucuaaaaugucauguaaauagaaugauauaucuuaaaaauuuuuauuucuauuuuuguaaauuaaaaaaaguauuuagaaaauuaugaaucauauagucuuuuauaucuggcuuagauuuuuaaacuguguguguguguguguaugugugugugaagaagaaauauaucagcaagguaaaacauuuaagcuguuccaaaggguaaacauaauuacucaucuaaccccaucugauuccuucagaagcaaacaccaucuuguuuuuguguguacuuucagaaacacagaaggauguaaauaugacuaagaaauuggccgggcgcgguggcucacgccuguaaucccagcacuuugggaggccgaggugggcagaucacgaggucaggagaucgagaccauccuggcuaacauggugaaaccccaucucuacuaaaaauacaaaaauuagccuggcgugguggugggcgccuguagucccagcuacucgggaggcugaggcaggagaauggugugaacucgggaggcggagcuugcagugagccaagauugugccacugcacuccagccugggcgacagagcgagacucugccucaaaaaaaaaaaaaaaaagagacagaauaaauaguaaauaguaaaaugcaagaagugaggcuucaccaccccaccuagcugauuuuugucuucaucugugcaacuauguuggagcaaucuuauuccuccuuuucuucgguggacacaugcagcaaaaucuuaauagaagugaaagaugcguccuccggcagcccuguggcagccccaguuucuuuucuuuucuuuuuuuuuuuuuuuuuuuuugagacggagucucacucugucccccaggcuggagugcaguggcacaaucucggcucacugcaaacuccaccucccagguucacgccacucuccugccucagccuucugaguagcugggacuauaggugcccgccaccaagccuggcuaauuuuuuguauuuuuaguagagauggaguuucaccauguuagccaggauggucucgauuuccugaccucgugauccucccgccuuggccucccaaagugcugggauuacaggcaugagccacugcguccggcugcggcagccccaguuucuuguuggcuaggcugaugucacagccucaggcuguccagcuuggacaacacuggcuuccugugaugauugucgcugggcaagggacguuucugggucucugccacugcugcuggugguguggguggagguagaggccacagcgucacgcuggggggcuuugccaaaacuguccggcuuccucugcaggcuggcaggggcacuggcaggaacaguggucuucugcugaaugcugaauaugggacaagcuggcucgcugugagccugcuucagugggagagagaagguggaaacuucaguggauagagaaggacaggugggaaccccaggaggaagggaccauggucugaugguggacugcuucuuuuguuuguucuaaaaugagguagguggccauaggauagugaaacgcuuuuucuuugauuggcacagagauguucuuggccuggaaucccauggccaccaugagcugggugguauguuggcucauggcucuuuguauguuguccguggcaucuccuaaccacaguucacccaccagucccucaaaacuucuuucagugggggccacucccuggguucuaguguuaguaacuuuugaaugaaucuuucaaguugaagggaaaaaaaauggugaggcgugguagcuuccugugaaaauuugauucuugagguccaucguguucccugaauagaaggguagggccccggccaccauaugguagaguaugacgccaaggccccauauguccauggcagggcacugguacccccagcccaggaagaguucugagcaggaaugguggucuucugccuucacuucucgccguccuugggcagucaaaaauuaaaagugggaacagcuggcucccuuugagcccucuuugguuccacaaggaaggcagacuuugucagauggggaagaacaggugggacccccaggaggaagggcugugcuccaaugauggagcgcuuccuccucuguacuuuucucuaccccaggauuagguacguggccaugggauaaucacauauguauuuuuuguuggggagaauauugauuccgagaugugugcugcuuggaaucccauggccaccauuaccaggguuguagggggcauagguguccagggucucuguauggugucagcagugucuucuggccagcauugacccaggggucccacgucagcugguuuagugggggccacucccuggggucgaggcugaggaauuguuuuacuaguguuuccaguggaaacgaagaaauaggugggcagucauacugucacauagccugaggcaggaagggaccacggguggggcuggauguuuuucagccucccuggcagagaucacugacagaguggucagcuuggccaaguuucugcgguggcuggcagaagagggagagggaggcaguccccagagcaggaaugccuucccuugcaggggaaaaaccggccauccuccccucagagccuccuucacugcagcccgugggaagugagugaccugggggauccgugccccaggggcuaaccucugggcucuggcuuagccccaccccggggaaacauucacagccccuccugaagagagccuugcugcaggaagacucuggcggcggguguggggggguggugcccagcugggagaguucugggcuguugguggcaguaccccaggcuccaaacucucugggccugggggcaauucccuucccugaguacaacagauucccaccccgcccugcccuacugcccgccccgcagggaaguggcccaggagaggaggcguggacagguaucccagugacuccagucggagucagcuuggguagcauggcccgcggaagacagaccgggcgaacggggcgggccccaggcuaccgagcugcagcugacaggcaguccggcggcgucgggucuccauggauacggggguggggccaggcggcggcgagcggcggcgggcggggcuuuuaacggccaucggccccucccagccuggacaaagacacagagcgcggccugggaggcggagcucugcgggcggccggggccgccuccuuccaggcgcugcugccccaacacaggcgggcacucucugcgggucccgcggcucccgcggcuuccggcccacucagcgccuccagaggccucaggugagggucaccccccgcagcuuggggucacuccccugagcccccggaucuucccauggguccuuuggaggccuggguuuuggaguuuguccuucguuaagugccgcccgccgggcgcggcugcuccaggaccacaggugaccgagugcggccgcguccccugcgggccacccaucaagggcauaggggagaggcuccucaaggcgcagugaccagcccugccccgggcugacccucaggguggggagggggcacuaacucggguccucucccccuaaggcuccuuccucaccuggggugaagggcucccaguccuagcaccucaggggccuuccuguuucauucaugccaacaagugaacauugagcauuugcugugugcagggacagagaagacagacacgcuggccacugagugggggagggagucuagucuaucagugcagaaaacuccccauagaggugggggcuaugacggaaacaccaggaaaagugaugguggaagaugggggugaccuacugcagauggggugcucagggagggcuucucugaggaggugacauuaacuagauugacaaaagggaugaucaaggccugugaaaguuuuuuuuuuuuuuuagacgagucucgcucuguugcccaggauggagugcaguggcgcgaucucggcucgcugcaagcuccgccucagccuccggaguagcugggacuacaggagcccgccaccacgcccagcuaauuuuuuuguauuuuuaguagagacgggguuucaccguguuagccaggauggucucgaucuccugaccuugugauccgccugccucggccucccaaagugcugggauuacaggcgugagccaccgcgcccggccgaaagucuuuuaagauagggaagagcagugcccaguggggugucccagggauaaaaauagggcaguaggugaaggcggggggugugagccaggcaggcaggggggaccagacaccaugugaugggugcaggggugggacccacggaggcucugaaaaaggccugggccuuagaagauggggaagcaggaggacccacuuagaggccuucacaaccuucuagggcacaggccagaaugcgguauagguuucagaagggggcugggucccucacgcucuucuugaaccgaaagggcuccagguucuugggcccuuuccacgcagacaugguucuggggccccggcuacacagacacccuucugaugguugucgucugcagccagacagggggcgugggcugacccgccccuuccuuugccaaguggacagaugaagggagccucugagggcaggauugcuggacugugaauuggacugggaguguaauccaaacgccccacgggccccgccucuucucuggaacucggcuucaagaaaacugggacaagggauggcaagagcagcucucagggcccuugccccuccaccccgugaugcuucuagaugguucucaggggccaccuuuuucaggaagaauucucggguuauaggaaaguaaagggaggaaucgugcuuugaguggcacuuugaucaggcucuagacuagguguugguuuggugggguuugcuuuuccucccgccucauaccccuucacaaaaccugaguccuggcuaggccgggagugagauuccuguuucuagauuuucaucauuccguguugcacaggaggaggucuggggggaaaggggacagauacuagcaaguauauagaagauauauaugcaccaggcucuggagcagcugcugacaucugguccagcggucauggagacaggggcgggaccagguggcagugacgcagcggggggcguggcucccaacggccaacggccccgcccaggcugggcugagucggagccggaacugggagguagagccagagacccguaagcggagccgaaccccuaugagcuugcccaguagggagcucaggauccccaagauuggacaggcaaauaagcuuagugauagucccaccagucuucccgagagucacgguaggcauccgcuuccccugccgguccccaggccugcucuaucaggcaaccuuggggacggacucagggcugcauuuccaaugcucugcagacacaccucgggcuugaaucccagggucucacugauugcacaaauacugauugagggccuccugggugccagagauguguggcugucagggaggcaaggucccuguuccaguaggggugacagguguaaaacaggaugacuucagaaccugagaauggggacaaagcagaguacugggaaguggcuaugugggugcggggcagccugggacgggguaaacagcaaaucuuugccaucuguuccuggccagauuucgcuggggaugcuacuugaucucucuucagccucaguuuccucaccuggacaguggagcugaacccaccccccacuaucugacccugcucucugggcugucuuuugggaacccgcccugcugaggccugcuccccacccuccauggcugucagccccccaggagaagaaugucugccauauggaggcugcuggcagcaaagggagaugaacaagccaagguugcccggccugcaugccggcccagguagacacuugaaaggaccuucucuguuuguggguuuuugcccuggugccuggagccccuucccuauagucccuugacccagcccagcucuaugggcuggaagcccuggcuucugaagaggagaugucaagcucuaccacaggucacagccagaaagaauucuggccucguccagugauaguaaaagccacgccuggggaaugugcccucucacaggacagcacuuccagagggggcacagcagcaagguggagggacagacucugaugggcccuuggggagcucaagcagaacccacaggggcccucuuucuggggguacaaacuggcauuggguggagggacauccaguauugacaccugagggaccuucauccccaauguggauuuaaaggacagcagcucacuggggagacaaggagcccuauaacacucccacccucuccugagccugcuucuugcuuccugguccuguucuuuauuggggaaggagaaucuuaucugacugggggaacuccaggacugacccuggccaccaucaguaguggguaggguaaccaaauguucaagguugccacacucagaugccggccaugcacaaggguggggccuucuggaccuaccucaagcucauuaggaacccacaaggaagcuccuugaugggugcugaugggcaucugcacccacagauucacugccagacacggacaaaccggguuccugggaagcuggaaccuaccuuaugaaagcccccauucccaccacccccuccaucccucagggcugcugcugugucuugccaucaacccuccccugacacccaggaugccugccucacccagaagcacuccuacgucaggccucugagggggagcgcuucaugccacuguuaucaaaagaagaaaccaucgaagcagaaaggccaaugccacacuagacagccaggagcccagcagaacaaguggcccccuaaggcacuuuggggaccacaccccgccacugaccccagcacagucugguucccagggcuucaggauccuccuggggaccucucagcaugauugacacaggcagacgggaccugaaggggcugcugguccuucugaaaauguucaccagguagugugaguguggggaagccaugaacaaugugugggacucuacccugcaccugcucagagccucagcccuucagagccacuacuaaugauuugcuguggguggggucacccugauacuucucugagguggcuuuuucuugcaguuuuucugaguaacugacaggaauccuugacugcaugccgccuaaacuagggugugcacagcccucguucugugcaaagagggugcaaagcagcagagugucugugacccauuugccaccuaauguuacuacaagauuugcaagaaccggucacuuaucaguaaccauuuuuauuuaaaaagauaaaauagagcuuugcaggaaagugcugcaggcucccacguugccgggcagacgacaaccugggcgccucgcccagcuccuccccacagccauuggcauccacugucagguuucaauguucuuggaccucagggccuucguccucuccaaucuaaaugcagagagacauuugacauggacucucucagguguuuugcaaaaugcaacacauucucauugacucuggucacucugcugugcacuacaugucaaaaccucuuccuccucccugagacuuugguccuuuaacugacaaccccccucccauucccucccucugccacucucugaccccuggucaccaucgaucuacuugcuacuucuauggggucaacuuguuuagaucaacacuucugggaccucacguggaauuggucucucugagguaguggagaugcuaaguagugggauuuccucauuccacauuguaccccaugaaugaauacaagcaugauuugccaauugaagcaauacaauaaagacagaagaaauguaaaaugcaggaauuguggcuugaccaccacaacgacuugauuuuugucuucagccaugcaacuauguuggggcgaucuuauuccuccuuuucuuugguagagacaggcaaaaauauuuuaauaguaugcaaaggcaucuaucuccuggcaacccugcggcagccccagcuucuugccgagcaggcugacgucacagccucaggcuucucagcuuggacuucucagcuuggacgaugcuggcuuccugggaugguuuuugguguaucagggacguuucuaagacuucaccaguugcuggugcucugggugaaaggggagacaauagggucaugcugggggcuucacuaaaacuuccuggcuuccccgaucuggcuuccucuguaggcuggcagguguacuggcaagaauggcggucuucugcccugacaucuggcuuucuucgggaggcugaacguuaaaagcuggcucccuaugagcccgcaucagugagagagggaagguggaaaguucaguggauggggaaggagaggugggaaccccgggaggaagggacaguucucugaugguggagcacuuccucucuuguuuugugugcucuaaaaugagguagguggccaugggauaguugaauuuucuuucuaugauugccacagagauguucuuggccugaaaucccauggccaccaugagcuggauuguuuggggugguccaggaguggcucuucguaugguaucaguggcaucuucuggcuacuuuucacccauggauuuuucaucaguuacagugaaggacacuuccuggcguucagcauuaguaauuuuuuaaugagucaaguugaagggcaagaagugguggggcaugguaucuuccugugagaauuuuuucuugaaguuuggaggcuucccugaguaaaagggcaaaguccuggcccuucuaccuacuguauuccugaaauacaguaugacacugaggcuuuguaugucccuggcgggucacuggcaugccuggcccagggagcguucuggggccacguagggguacaugccacaaaaagcugucagcaucugccccucucugaauguuguacugaagccaaaguccacaauguauguugccucauucuuugaauaggauguuuuguggcuuuaggucuggaugugugauuuuuuuuuuuuuuuuaaguggcaguacugcagggcugacagaaucugccugaacaugguccgggccuccucuuccuccucgauguggccauagugguauaucugguggugcaacucuccuccucugguuuacucccucaccaccuggaagagcugaaugauauuugggugauggaaagucuucaagauggcaaccugggucccaguuggccuaugcugagccaguucccuaucagauggugucuaugaacugauaguuuuguaucuccuugucaagugagguggagggugaucccugcuccauggugccucccaacuauacugacuacaaauccugccucuaaaagcuaugcugugaugcacagcacuaacugugcuagcuaggcuaaggccacugucggugacaauaccccaggcuccaaacccucugggucugagggccguucccuuccacgguuacacagauucccaccccucccugcccaucuacccaccaugcggggaaggugccaaggaguagacacauggacagucguucuggugucuccugguggggccagacugggcaccauggcugcaagcacagacagggcagagaagaggccagggccacgugguggagcugggucuaaaacaggacucccaagggcaaaggcccugcccagacuuggcacccacagucuucugcugaaugcuaugagcccgcuucagugaaagagggaagguggaaacuucaauguagagaggacaagugggauccccaggaggaagggucuguggucugauaguggaccgcuucuucuguuuuguuuguuccaaaacaagguagguggccaugggauaacugaauaauuuuucuuugauugccacagauagguucucagccuggaaucccauggccaccaaaagcuggguuguuuugggauucaggugguccaggauuuguucuucauguugucagaggcaacuccugaccacuguucacccacgggucccucauaacuucuucuaguguggucugcucccuggggucuacuguuaauaguuuuuuaaugaggcuuuuaagaccucaggaaaaguagacuggggaaaaauagcuuccacuuuaaauuuuugcugagaggacccuaaugcugcaugagcagaagggcagaaccccagccaccaugugguauaaaauuacucugaggcucugaauauccaugguggcacauugguagcccuggccuaggaaacguuccagggccauguagggguuaagugcuacaaagggcugucagcuucugcccaucauggaaugugguaccaaagccgaagucugcgaucuuaacguuaccguccucaucaaggaugauguuuucuggguucaggucucugcgcaauuugcuauggcacuacugcauggccgacagaaucugccugaacauggucuaggccuucuccucccucaugaggccauggugguguauugguugcguggguguccuccucuugcauacuccguuacuaaauaaauaacugguguugggggugucaaucacuugauacaaccguacaauauugaagugacagaguaacuuuaaaauacuuaucacucucuggagagugaugccaagggagccagccuuggggaugauuuugauggccauuugggucccaaucagcaugugauccuggaccucacugaacgugccacggccaaugguguccaggauuuuacaguucuggagcuccuggucaggugugguggaggcugaucccugcugcauggugccaccugucuacacugacuauaaaacuacucuaaguguagugacuaugguaacaauauugaccccaccaacuugauuuuugucuucagccgugcaacuauguuggggucaucuuauuccuccuuuucggcgguggacacaggcaaaaacauuuuaauacaauggaagugcauccccuggcagcccugcggcagucacagccuccuuauuggcaaggcugaagucaaagccuugggcugcccagccugaaugacacuggcuuccugggaugguuguugcugugucagggacauuucugggucucugccacugcuacuggugcucuugguggagaaggccacaggguguugcuggggagguggugagccagagguuucugggucugcaccacugcugcuguugcucuggguauagggguaggccacagggucaugcugggcggcuuguugagccugggauguuucugggucuccaccacugcugcuggugcucuggguggagaagaaggccacaggcugauacuggaaggcuuguugagccagggacauuucugggacuccaccacugcuacaggugcucuggguggaggggaaggccauggggucaugcugggggccuuguugagccagggagguuucugggucugcacuacuguugcuggugcucugcguggagggggaagacacagggucaugcuggaaggcuuguugagccagggacauuucuggguguauccaguugugcaggucuccuccucuugcauacucuguuacuaaauaaauaacagggugaugcucaggggcuuguugagccagggauguuucugggucuucaccacugcugcuguugcucuggguggagggggaggccacagggucuuuauguauuuaagcauaaaggcaaggcuuggcgcgguggcucaugccugucauccuaacacuuugggaggcugaggcggguggauugcuugaucccaggaguucaagaccagccuggguaacauggcaaaaccucaucucuauagaaaauacagaaauuagccagcugcagugcaugccuguggucccaucuacucggaaggcugaggugggaggaucaccugaaccuggaaggucaaggcugcagugagccaagauugugucacuguacucuagccuguguuagagagccagacacuaucucaaaauaaaauaaaauaaaauaaaauaaaaaaagaaacugcugaaaaaaauuaaagacauaaauaaauggaaagagcuauugucuucauggauuggaagacacucaauauucuuaaugugacaauaccauucaaagugauucaaugcaauccuuaucaaagucccacaacauaguuugcagaaauagaaagauccauaccaaaauucacauggaauuucaagggacccccaaauugccaaaaccuugaaaaagagcaaaguuggagggcucacacuuccugauuucaauauauauauauguauuuuuucaagauggagucuuacucugucacccaggcuggagugcaguggcgugaucucggcucacugcaagcuccaccuccuggguucaugcaauucuccugccucagccuccugaguagccgggacuacaggcacccgccaccacgccuggcuaacuuuuuuuguauuuucaguagagaugggguuucaucguguuagccaggauggucucagucuccugaacucgugaucugcccgccucggucucucauagugcuggaauuacaggcguuagccacagcacccagcccugauuucaauacuaauacaaagcuacaguagucaaaacagugugguacuggcagaaggacagacacauagaccaaugaaacugaauacagaguucaaagauaagccuucauauaugugacaaauuguuuuuuuuuuugagacggagucuugcucugucauccaggcuggagugcaguggcacaaucucggcucacugcaagcuccaccucccagguucacgccauucuccugccucagacuccugaguagcugggacuacaggcgcccaccaccacacccggcuaauuuuuuuuuuuuuuuuuuuuuuuguauuuuuagcagagacaggguuucacuguguuagccaggauggucucgaucuccugaccucgugauccgcccaccucggccccccaaagugcugggaauacaggcgugagccaccaugcccggccgacaaauugauuuuugacaagggugccaaaauaauuucaguggugaaaggaccaucuuuucaacaaauggaacuggaaaaacuggauauccauaugcaaaagaaugaagcuaaauccuuaaaauacacuauacacaaacauuaacucaaaguggaucaaagaccuaaauuuaagaaaauaagagaaaaccuucaugaccuuggauucggcaaugguaucuuaagcauaacaaccaaaaggacaagcaacaacaacaaaaaaaguaaagaguggguuguccggcuuuggaguggcaaccuucguggccccagggacuaaaaagagaauuaaauacaagugauguugagaaaagcaagauuuuuguucagaagugugcccagugccacaccguggaaaagggaggcaagcacaagacuaggccuaaucuccaaggucucuucgggcggaagacaggucaggcuguuggauucucuuacacagacaccaauaagaacaaaggcaucaccuggggagaggauacacugguggaguauuuggagaaucccaaggguauggaagaaaaaugaucuuugccggcauuaagaagaaggcagaaagggcaggcuugauagcuuaucuuaaaaaagcuacuaaugaguaauaauuggccacugccuuauuuauuacaaaacaaaugucucaugacuguuuuauguguaccauacuuuaauagaucucauacaccagaaaucagaucauaaaugacagaauauuuuguugggcaguugugauuuaaaacuaagacuagcuugugguuaaauguucaguuuuugaauuuuaauaguaauuccaauucagaacaugguaucacuguuuaccccuucuaaaaauaugauuagacuuuguuaguaauguucaacuucucacaaagauggugagugccaucuuaaaacuuaauagaggccgggcgcaguagcucaugccuguaauccuagcacuuugggaggccgaggcgggugguucacuugaguucaggaguucgagaccagccuggccaacauggugaaacccccgucucuacuaaaaauacaaaaauuagccaggcgugguggugggcaccuguaaucccagcuacuugggaggcugagagagaacugcuugaacccggaaggcagaggugcauugcagugaaccaagaucgcgccacugcacuccagccagaaugacuaagcaagacuccaucucaaaaaaaaccccaaaaaauaaaaacaacaacaacaacaaaaacuuaauggagauugguuuuauauuuagauuuauuuaacugguuaugugaauauauuuaaauacuggggaaauuuccucacugucuuagaaccaagcaagauucaacuguguuugguguucauuugccucuuaaaggcuaggauugaaggaaaauaagguagcaaugucuaguuuauuauuuaacacuucucacauuuuauacaugaucuauaaggucacaugcuuuuaaaauaguaacaaguuaaacuucacucuugaauucuuuacacucuaacucaaacuaaguuaugauucaggauugucuuuaaagaaccauucgaaaacauaaaacugcugcguauuugugauugggaauggugcuuuugccaacuuaaaaugauuagaauacacacuuuaaaacuaugugugaucauacgacucaaaauaauuaagaaaaucacagaucaaaaaaauaauaaaauaacauaaaaaauaaggccagaugugguggcucaugccuguaaucacagcacuuugggaggcugagguaggcagaucacgaggucaagagaucaagaccauccuggccaacaugugaaaaccugucucuacuaaaaauacaaaaauuaguugggcguuguggcacaggcccauagucccagcuacacgggaggcugaggcaggagaauugucugaacccgcaagguagagauugcagagagucgagaucguaccacugcacuccagccuggugacagagcuagacuccaucuccaaaaaaaaaaaaaaagauaaauuugacuuuaucgaaacuaaauacuuuuguacaucaaaggacacuaucaagggagugaaaacccauagaaugggagaacauguuugcaaaucauaugucugauaagggaucaauauccagaauauauaaauaacuccuauaccucaacaaugacaaaaacccaauuuaaaaacgggcaaagggcugagcacaguggcucgugccuguaacaccagcacuuucagaggcagaggugguuagaucuccuaagcucaaaaguucgagaccagucuggguaacaugacgaaaccuuaugucuaccaaaauugcaaaaaauuagcggggcaccauggugcgcaccuguggucccagcuacucagaaggcugacaugagaggaucgcuugagccucggaaguggagguugcagugagccaggaucauaccacugcacuccaacuugugugacagagugagaccucaucucugaaaaacaaaacaaacaaaaauggguaaaggacuugaauagacaugucuacaaaaauauagaaauggccaagaaguaugugaaaagaugcuuaacaucauuagucauuagggaaaugcaaaucaaaccacaaugagguaucacuccguacucaucaggauaauuauaauuaaaaaauagggccaggagagguggcagguaccuguagacccagguacucaagaggcugaggagggaagacugcuugagcccaggaguuucaggcugcagugaacuaugaucacgccacugcacugcagccugggugacagagcaagauccuauacauaaaaaaaaaaauuaaauuauuaauucauuaaaagcaaaauuauuauuauuauuauuauuauuauuauuauuauuauuauuugagacagagucucgcucuguugccccggcuggagugcaguggcgcaaucucggcucacugcaagcucugccucccggguucauaccacucuccugccucagccucccaaguagcugguacuacaggcgcacaccaccacgccuagcuaauuuuuuguauuuuuaguagagacgggguuucaccauguuagccaggauggucucaaucuccugaccucgugaucugcccgccucggccucccaaaguccugggauuacaggugugagccacugcgcccggccauaaaacauuuuuuaagaaaggaaaauaaauguuagcaagaauauggagaaauuggagaccacgugcauuggugguaggaauguaaaauuaugcagcugcuauggaaagcgguggugguuccucaaaaugguaaacauauguucaucacaugauccagcaauuccacucuuauauacccuaaagaaccgaaaacagggacucaaacaaauauuuguaaaccaauacucauagcaacauuauucaaauggccaaaagguggaaacaacucaaguguccaucaauggaugaauggauaaaaaaaaugugguauaaacaaagaaugggggccgggcgcaguggcucacgccuguagucccagcacuuugggaggccgaggaggguggauuaccugaggucagccguuugagaccagccuggccaacaugaugaaaccccaacucgacuaaaaauacaaaaauuagcugggugugguggugcacgccuguaaucacagcuacucaggaggcugaggcaagagaauugcuugaacccaggaggcagagguugcgguaagcugauaucgugccacugcgcuccagcgugggggccagagugagacuccgucucaacaaaacaaaacaaaacaacaaaaacaaagaauggaauuacuaaagcuguaguagggaaugaaguucugaugcaugcuacaacauacaugaaccuugaaaauaugcuggcugggcguggcggcacacgccuguaaucccaggacuuugggagggcgaggcggguagaucacgaggucaggagaucgagaccauccuggcuaacacggugaaaccccgucucuacuaacaaaaaaaaaaaaagaaagaaggaaaagaaaauaauaugcuaagugaaauaagcaagacacaaggauacauauuguuaugauuccauuuauaugaggcaucuagaaugaacaaauccauagauagaaugugauuagugauuauuaggggcuggggagaggaagauggcaaauuauugccuaauggguacaaaguuuguuugggaugaucagaaguucuagaaauggauagugguaaugguuguauaacauuaugaauauacuuaaugcuacuaaauguacccuuaaaaacaguuuaaaugguauauuuuacguuauaucaaaauuaaaaauuaaauaaugaagaaacuuuauauuacugauuuaaggcaaucuccaaaauaaacugcuaaaugcaaaagguaugauauagaacaagaggggaaaggaaacuacagguaaacacaaauuuguaaauucucagaacaucucagaagguuauaaagugauugucccugugggagacaaaccaggugccuagaggacugagaagaagugaguuauuuuucacuggauacucuucuauauguuuugaauuuugacacauguauauuaccuaguccaaaauuuuuuuuaauuaaaaaaauguguugacuggggauccaagaaagggcaggggggaagauaaaaaauauacuaguuguucaaagucacaguccaguaugaauuacugccauaagguagcacuaaagauacaaaugaguuacaaguuaugauuccaaucuaaucucuucuuuuuguuuuauuuuuauuuaugugucuauuuuugagauagagucucacucuguugcccaggcuggagagcaguggcacaaucauggcucacuguagccucaacucccuggguucaauggauccucccaccuccgccuccugaguagcuaggauuacaggugugugccaccacaccuggcuaauuuuuguauguuuuuguagagaugggguuucaccauggugcccaggcuggucucaaacuccagggcacaugugauucuccugccuuggccucccaaagugcugggauuacagccuggcuuuuucagugaauggcauccacaaacaaaagcaagcccacgugaaguucacauuagauggagauguuucuuagaaaacaaggcaauucuguguccccacugcacucagaaccugaacaguuucaugguuagcugaccacagacccaucucuacccuaauagacagagcuuuuugagggcagaggaucuaauguaucagugccuggcacagaauaggcacuuaauguuugugguaagaauaaaaaaaugcucgaacuauggcuauguacuccauuuccacuauuuuacacagcaaaucuaucauuugcuuuuuuuuuuuccagcaaauuucaaguaaagagguuuaaaaacacaaaauacuaaaaauacaaaaaucagccgauuguggugacacgugccuguagucccagguacuuggaagggugaggcaggagaaucgcuagaacccgggaggcagagguugcacugaacugagacagcgccaacugcacuccagucuaggugacagagcuagacuccgucucaaaaaacagaaucuuucccaacauauugcuucuuaccuggauguggcugcuggcuucauucuguuugccacuggauggccauucuaaggggauucaccaccgaggccucuccaaucucuacuucguuaaaaucacaaucaacccagucccaucaucuauuaucuaguaaugcuggcuucaggagauuuaggaauaugccaguguaacuugaccaucccgucuugaccuauuucccauauuuuaucagugagcucuaccuaagcccuccugauuuugcuccugggcguaguuuuccucuuucuuuuucccauauggguuaaauuuuacccuuuagguugagguuguacaagaucaguugaaauuccucaaaaagaugccacucaaggagcuaaaagcuuuaaagguuuucuccauauaguacaggcuagauuugcauguuuccaagcaaacauggaucaugacagugucucuaagacauuaagaggguccagaaaugucuuagaugccauucucccuuuauaccgucacuccauaagucauaacagaauucucaauuacaacagcuaccucaugucagcugcaacuacugcucuauuuuaaauguuuacaauuuuuuuuacaaaucuucauuuuaaaaguuccauucagaugcguuuuaacauugcuaauaggaagaauauauguacaaauacaaaauaagacacugugcuuuacuugcuuucauaaacauuuuccacaaauacaguccucucucucuggauauaugcuauuaaaaugugucucggccaggcacgguggcucaugccuguaauugcagcacuuugggagggcgaggcaggugaaucaccugagcucaggaguucgagaccaggauggccaacauggugaaacccugucucuacuaaaaacacaaaaaauuagcugggcauaguggcacgcgccuguaaucccagccacucaggaggcugagacaggaaaacugcuugaauccgggaggcgaagguugcagugagccgagauugcgccacuguacuccagccugggcaacaagaacgaaacucugucuugaaaaaaaaaaagugucucauguuuugaaauagaccaaaucuguaucuuaauuucagacaagagaauuuuagaguucagaacacagaguuagauccaccagucaaaucucuucauuucaucaaggcugggaguaaaauugagcuuuccugagacccaguucagagcuacuuucccuucaguaaguuccaaccaacaaaaaauaagcauuagaugauucuuccuuccucuguucccuccuugccaaaauaaguauuucaacauaccugcuggcaguaugugucaaaaaacauaaacacauuauuuguauaggagacugccaaaugaaauucuacucuagucuagagagugaagcaaacucugagccagcgacauaauggaugaacacauauccuuaagaaccuugaguggggaagaguagagagagaaaagaagcuguaggaaacaguacacaaccuaagaguugcuuauccuuuuggaaugucagaucagacuucucuuccccaacucucauuuuaacuuaagaaaucuuaaucuuuguuuuacacagaauaauccuucaccauucugaguuuucucucaggaucaaugggaguccacauuuggauauuaauugacuguuaagcucaaagaaguuaaguuauaagccuaauaguacauuccuaucugcucgauuugggauuggaggccagaucuucuaaaucccgguuuccucaugcaaucacacgaccccccagggauguuccaccuugguuauaauuugaaguuggucuauaagguucaaugcuaacuaaacugacuuuuuuaaaagaagugaucaugcucuaucaauaaugcaauauauagacauuaauggacccagaguaaauaaccaguuaauaaacauagcuuccuuauugauaccauaauuuuaaaaaaucuuacauuuaguaguaagcuggguauaaugcuuuauuggggaaaaugcaaugaaaaauuacauaugguuuccgugucuagaaaauuacagcccaaaacacauauaacuggcagaaauaaacacagaaaagaacugcuagaugaaauaagacaaacauuaaaucuauuccuaaauauaaaauguaagauccaaugagguauucucauuagcuccuaacccaaaccccaaacuacuggcccauccaguuuucuaaguucuauacuguuaauauacugaacguucagccagcaaaacauuauucccaguuuauaaauuccaguuugaauaauuuacauuuccagaggaauuaucaccuaaaauccaguuuugaauggccaaagagugauaguucaaauagguccauauuuacguuucuacuaguuucuacagccugguccuauuccccucaagguuuuuauaagcuacuuagaauaggauacgaaaggcuaguuugucauaauugcaaacugcauugagauagacaauuaaaauguuaaugcaaaaauaaaauucaaaaauuucaauggguuugaacaauggacugaaauaagaugaaauuuuacaugagagcuguaaagcuuucuguuuuagauuaaaaaucaauagucucugacacuuacuaaguaaugaacagagaauguacucuggagcagcuguucuugaaugcagccugaucgaaucuuauuucuuagcacccuuucaauguacuucuuugucugaguauuggugcuauagaugaugaaaagcaucaccaggucaauaaauaugcaauaauagaaaaacaguuaaccaaucaguacauuugcuacaaugaaacagcagcuuuuccucuaauuaaaacacacaauggaugaugcucauuuguuccacacacuccccugguaguaucuacacuuuucacaaaacccagaaauauuuuuuaaagaaauaaagugccacaacuauuaaccacugguaucucuuaggaauacauuccaauauacauuaaagugauacuacuacagaaguaacuuugaacaucuucacauuuauuaaaagauucaaucacuugccaacuccaguauguauuuucacuauuacuagaaaaauuacuuugugaaaaguuggaaagacuauaaaugcccaucaaucuggaaaggguucaguaaauuaugauggaguaauuuuaauuuuugaaauauuauagucaucaaaaaggauaagccaggcugggcgugggggcucacaccuguaaucccaguacuuugggaggcugagguacacauaucaccugagguuaggaguucgagaccagccuggccaacacggugaaaccccauuucuacuaaaaaauacaaaaaaaaauuggccagucgugguggcaacugccugcaaucccagcuacucaggaggcugaggcaggucaacgacucgaacccgggaggugcagguugcaaugagccgagauugugccacugcacuccagccugggugacacagcgagacucugucuaaaaaagacuuuuuaauuacaaaauuuaaaaaaaaaagaaaaagguagaucagggguccccaacuccuggaucacggagucuguggucugcuaggaaccaagcugcacagcaggaggugagggguggucaaguggucauuaccacugagauccgccuccugucagauuagcggcugcauuagauucucacgggagcgcaaaccccauugugaacugcacaugcgcaggaucuaggcugcacauuccuuaugagaaucuaaguagugccugaugaucuaaaguugaacaguuucauccugaaaucaugccccgaaacggucuguggaaaaacugucuuccaugaaaccagucccuggugccaaaaagguuagggacugcugagccauacucuauuuuuugacagaggaaagacauuccugauaugaaguggaaaaaacagcagccugcaaaaggauaaucaggcugggcaugaaggcucaugccuauaaucccacugcuuugggaggcugaggagggaggaucauugagcccaggagguggaggcaacagugagcuacgauugugccacugcacuccagccuggcgacagagugagacccugucucuuuaaacaccaccaccaccacccauaaucauaguuaagauucugcuuuuguaaaaacaauauauaaacauauauauguguaggcauaagaguauaccuguacuugcacacaauuacagcuuguauaugaagagaaaaaauuuggaaggaugauuaccccugaggaaugggaaagagagcagagaaaaacuguauuuuuuacaucuguagauuccuuguggauuuuucuccacaauuagcuuguuuaccuaaguuuaaaaaagaaaaauaugagggcugggugcaguggcucaugccuauaaucccagcacuuugggaggcccaagcaggaggaucacuugaagcuaaaaauuugagaccagccugggaaacacagcaagaccucaucucuauaaaaaauaaaagaauggccgggcgcgguggcucacaccuguaaucccagcacuuugggaggccaaggcgggcagaucacgaggucaggagaucgagaccauccuggcuaacauggugaaaccccgucucuacuaaaaauacaaaaaauuagccaggcgagguggugggcgccuauagucccaacuacucaggaggccgaggcaggagaauggcgugaacccgggaggcggagcuugcagugagccgagaucgugccacugcacuacagccugggcgacagcgagacuccgucucaaaaaauaaauaaauaaauaaauaaauaaaagaauuggccaggcgugguggcucacaccuguaauccuagcacuuugggaggcugaggcagguggguggaucaccugagucaggaguuugagacuagccuggccaauauggugaaaucccaucucugcuaaaaauacaaaaauuagccaggcaugguggcaggcaccuauaaucccagcuacuagggaggcugaggcaggagauuugcuucaacccaggggccagagguugcagugaaccgagauuguggcacuucacuauagccuaggcaaaagagcgaaacucucucaaaauaacuaacuaacuaacuaacagaauuagccaggccugguggugcuugccuguagucccagcuacuccaaagacugagguggggggaucgcuugaacccggguguuugagacugcaaugaacuaugaugcugucaccgcacuccaccuucggugacagagcaagacuuagucucuuaaaaaaaaaaaaaaaaaaaaaaaaagagaaaggcccggcacgguggcucacaccuguaaucccaggacuuugggaggcugagguggaucauaaggucaggagauccagaccauccuggcuaacaacgugaaaccccaucucuacuaaaaauacaaaaaauuagccgggcgugguggcaggcgccuguagucccagcuacucgggaggcugagguagaagaauggcaugaacccaggagguggagcuugcagugagcugagauugcgccacugccugcacuccagccugggugacagagcaagacucugucucaaaaaaaaaagagaaaacacugggaguguauucagggcaaucugagucuaugcuuccaggaaaaaaaaaaaaaaaaaguuaaaaaggcaagcaggacaaaaaagaaaaaacaaauuuuacuacuucucuuaacugaaugcuccacuucuuaggacaccaaaauuuagagucauuagaccagaauacagucauuaaagauaacaaugaagacaaagcagaagcacauggagaagaaaauguugagaaaaaagaauacaaauuauauuuauauuuauaaaaugauuacaaauacguaaaaauagguaugcaggcagucaagguguuaaauuuguguuuaucuaaaaccaaaaacaguguguuuggaguacuuugauauuucucaccacaaaaaguuauucauuuuuuucauugcuuuauucaucaucaugaaagcuuuuaagauagucaucccaaaauuggauaacaaaacuaacaaaaaucccacaaaacagauuccaaccaaagaaaaaucuuuaaaggcaaccaaucagcaccuaaggaacucaaucaucuggcuuuuuaucuuuugagauggagucuugcacugucgcccaggcuggagugcaguggcgugugccaccaggccaggcuaauuuuuuuuuuguauuuuuaguagagacgggguuucgcuacauuggccaggcuggucucaaacuccugaccucagaugauccgccugccucagccucccaaagugcugggauuauaggcgugagccaccgugcccggccaaucaucuggcuuuuugauggaagguauuucuagaauuaauagagacauaagauccaguaccacugcuuugacaguggacagacugauuuacucuagucaggucuacaugagcaaaguaaaguaaaacauggaaugccauuaucuugacaguggugcuggguggaaggaagggcaauuaggcagauauagggaccugagacuuaggugguuauuuucuucaucucaucaguggggaccuggcuucuuugacugcaccuugaugugcuuguuuacacuguuaguauuuccccuuguggauacuguaggcuuauuuuauagccagagugaguaggggcaggcuaucuggccagucgccaccucagauuaucuuccccagacagcuaauguuuauuagagcaacuagggaagagagagaagagugacuggagggaggagaaagaaagacagugggaaggcaagcuagccaaugucauuacuuuuaagucugcaauacugaaaaugcauaguacaugaacauuaccuuguguucagauacugaggcaguguuuucaauugccugaaaaaacaggagagucacaaaaauauuaugacacaucagcgaaacacguuacaccuuauucagcaugcccuguuaucucaucuaagagccaauguguccauauggcaaccaucagcuaucauuuccacuugaaugaguuuugagauuuuuauuucaaucuaccucaguuauacaucugucacuaauugccacucauuuccuccuugauaaucaaaguuccaaagaucccaccuuaauccaggcuucugaaaugguuuucucauaucuaauagcugacuuuauuacaucaaagagaauaauacgguucugaccgcugcuuucuugauuuccugaggaauuacaaguagcagagaggaaaaaaauuacucuucuaccuaccagaaaagaacuuacaagaugugaauuccugcuuaguagccauguacccuggaguaaaugacaaccucauguauaagauggcuaauaaacuugcacuguagucugccugggauugaucugaauggcuaagaaaacauaugaacacauacauagccacauacauauacguaauuugaaaaacgauauaauacuagauguaaauaucauaauaguaccauuauuuguaguuguaaguauuaagcuccaacucugacugugggaugucagagaacugugacauccuaugugaggaaaaggguggcaauuauccaugagcucuuuaccuugcuuguccuuuacuuuuuaacuuuacuuggaaagccugcaacagugauggcaaaacacaaugcugcaggauccaacuucucccgaagcucagagauuaccugcagaaaguuaauauuagcuaugguguucugcucauucauaguggguagguacaguccagucucucaaccaugacaaucuccugaaagacugaggaagaaaaaauuuuaaacguuggacauuuugaaaaauagaguugugagaauagcuaaaugcaaugucguagaaugucauauccaaaauuucagaauucugugagguacuacacagaaagaguaaauguaacuuauagcagcuuauauagaucaaugaaucuguugaauagcuccauuuccucuucucaaugcuauccggauuagucaacauucucaguuagucaggacuuucggcuuccagacacccgccuuuaacacgugcgauaccauuuggcuucccgagaagcccaacagacgugagaugaggccgacugccuggacuaguucaucgggaagggggugaggguaaaagccuuucucauuuccucauuuuaacgacgcagaaagguaccuguggggacuaucccaucucagggcagaugaggaagccgaggcuuggggcgcggagccccagagaagaacgccgaccgcggcccggacuuaagagauuaggucgcaggggagcggggccucgagagacuacgaccacugcuccauuuacucaccgagaagccguccccgccuguaguuuucuuucuuuuuuuuuuuuuuuuuuugagacggagucuuccucugucgcccaggcuggagugcagugcagcaaucucggcucacugcaggcuccgccuccuggguucacgccauucuccugccucagccucccgaguagcugcgacuacaggcgccuccaccacgccuggcuaauuuuuuuguauuuuuaguagagacaggguuucaccuguuagccaggauggucucgauccccugaccucgugauccccccaccuuggccucccaaagugcugggauuccaggagugagccaccgagccugggccaccgccgauaguuuuccacuuucccgccaggcccgacgccgcucugacgccacugaggugcgccacgacgugacgucaacguucgcgccggaaguggaagaccaggcagcccagcugaaggcaguaagcucggcucacagucgcaggagaguucugggguacacgggcaaaggggcuugagaaggcccggaggcgaagccgaagagaagcaacugugccccggagaagagaagcucgcccauuccagacugggaaccagcuuucagugaagauggcagggccagaacuguugcucgacuccaacauccgccucugggugguccuacccaucguuaucaucacuuucuucguaggcaugauccgccacuacguguccauccugcugcagagcgacaagaagcucacccaggaacaaguaucugacaggucagcgcccucccuucuccagccuaccucacaccgccgugaccuugggcaaaaaagugcaggaguugugucaauuugccuagguucacgucgcgcccccucugacagggugaccuuacccguuaccucuguguuucacuuuuguccucugugaaauggggaugauaacaguaccugcuucauagacagguaggaaucaaauuaggugaugucuguaagucccuuagcacaggaucuaggacguauugaguguugaaaaaaacaguacuguuaauccuuuagguuagucgccgacccucgguggguuuaccuaugaacuauuccaucccacccuuccguugagaagagugccaggugcguuacagcguuuagucuuuguaacauccagucaagugagugugauaaucugcauucuaccaaauuacuguuccaggcgucgggccuggugggacugucagcugagaugccaaguaccaaagcgcuuugcagucuguaaaacugccauuagagauguaaggaauuguaauuauuuccccccacuagaguggaggcaacuuccucacauauuucauugcaguauuuauuuauuuaucuauuuauuugcuuauuuuugagacggaguuucgcucucguugcccaggcuggagugcgguggcgucaucucagcucacugcagucuacgccucccggguucaagcgauucucuugccucagccccccgaguagcugggauuacaggcccgcaccaccacaccugacuaauuuuuguauuuuuaguagagacaggguuucaccaucuuggccaggcuguucucgaacucgaccucaggugauccaccugccuuggccucccaaagugcugggauuacaggugugagccauggcaaccagccccucguugcaauauuuauauacagauaaaggaauuugagaugauuauaggugguuaucuagacauguagccccucauauuaaaguaauaguuuucucccagcaacuugggaugcugaggcaggaggauugugggagaccagccugggcaacauaacgagaccuugucucuuagaaaaacaagcaauuuucagucaguucugauuacuuucagaaaucaucucagguaagugcuacuauaucuuuagcaccucucucucacauuaauuucucguuuuaauaaagagaguaagccucaggcuaagaacuuuucacagguaacagugucuaguuaaaauuuaauaauguuguuuuguuucuacuguacuuaaguuacuuucuuuuuugugacaauacuggauuuccauuugcugguaauuuaaagauuccuuuaaaaucauauagaugggaaaaaaguugauauauaaaaaguauuaaauauguaaugauacaagcguuggacaaaaauucuaacauggcaugagagugacugaaguuuaggaagcacuacuguaacauuuucaguuaguucuucccaauuaugccaagaagaauaauaaccauuuacucuauaucagguacuaugugaaguacuuacauucauuaacuuauuuaaaacuucaaagcaacucuaugagguacauauugucucauuuuauagaaacagaggcuuuaacaaguuccaucccacccguucguugagaagagugccaggugcguuacagcgucacacagggugacauuuaggacuucacaccaagccuucuggguauugggcuuuuuccacuauacuacagcgaucacuuuaucuuucuguagcauuaguuucagaacugaccagagccagcaccccacccuggagcgaaccuuaagaagucagcuuacuggccgggcaugguggcucaugccuguacucccagcacuuugggaggccgaggcggacggaucacgaggucaggagaucgagaccauccuggcuaacauggugaaaccccgucucuacuaaaaauacaaaaaauuagcugagcgugguaugcugggcgccuguagucccagcuacucgggaggcugaggcaguggaauugcuugaacccaggaggcggagcuugcagugagccaagaucgcgccacugcacuucaaccugggugacagagcaagacucugucucaaaaaaacagaaaagaagucaacuuacuggccgggugugguggcuuacgccuguaaucccaacacuuugagaggccgaggcaggcagaucaugaggucaagagauugagaccauccuggccaacauggugaaaccccaucucuacuaaaaauacaaaaauuagcugggcgugauggcacgugccuguagucccagcuacucgggaggcugaggcaggagaaucgcuugaauccgggaggcagagguugcggugagccgagaucaugccacugcacuccagccuggcgacagagcgagacuccaucucauuuaaaaaaaaaaaaaaaaguguauuuaccacagaaagaagggcuguagaaaagugcgaaguggggaaagcucagacauuuagcauuuucuggcaccuguaaaauuucuuauuuuagccuuacauuagcacugaagcagauacuccuuaacccauuuuuacaauuccagggagccuggaaaaguuaaguagucuucccaaaguagggaaauauugugccuguacuugaacucagaucagucucacucccagguuaaacccucuucaaccaugauuccugcugucguagauucucugccaugauuuucugcccaugguucacuauuagagcaaugguucugaauuauaucagauccaaagcucucuuuuguaaccacaaaaugaaauucacaguuaguguagucuguuuacaagaaccuuuuuuuuuuuggagaccagagucucacucuugcccaggcuggagugcaguggcgcaaucuuggcucacugcaaccucugccuccccagcugaagugauucuccugccucaaccucucgaguggcugcgauuagcggcaugcgccagcaugccuggcuaauuuuuguauuuuaguagagacagggugugagccauugcacccagccaagaacgcuuccuuaagaaggaauguaacagccggacacaguagcacaugcuuguaaucccagcacuuagggaggcugaggugggcagaucucuuaaagucagggguucaagaccagccuggccaacauggugaaaccccaucucugcuaaaaauacaaaaauuaaccagacacgguggcaugugccuguaaucccagcuacuagggagccugaggcaggagaaucacaugaaccuaaggaguagagguuacagagagccgagauggcugcacugcacuucagccugggccacagaaggaggcucugucucaaaaaaaaaaaaaaaauuccacagauuaccauuacgcccccuacagggcaguaacacccccaugaagaaccaaccacugcucuagagaaaaugucucugcucauaauugcugcaucccuuaagugagguaguuggauuauaccagcucugacauggaguggcucagucucaucaggucaucauuugacuugagcaaaaugcuguacaugcugaaccagccuaaguccaagaaaaagguguguuuuaguuguaaaacuuuuuuuuucuuuuuuuuuuuuuaagugacaagucuugcugugucacccaggcuggagagcacuggcacagucaaggcuuacugcagccucaacaucucaggcucaaggauccucccaccucagccucucgaguagcugggauuauaagcgugugccaccacgcucagcuaaucuuuaaauuuuuugcaaagauggggucuccuccguugcccaggccggucucaaacuccugagcucaagugauccuuccaucucggccuuccacaauauugggauuauaggcaugagccacuggguauaggcauacccagcgauauaaaacauuuuaauaaauauacuauaaauguccauuagcagcagggcacgguggcucacaccuguaauucuagcacuuuugggaggcugaggcaggcagaucacgaggucaggagauugagaccauccuggcuaacaaggugaaaccccgucucuacuagaaauacaaaaaauaacccgagcauggugggacgcgccuguaaucccagcuacucgggaggcugaggcaggagaaucgcuugaacugggaggcagauguugcagugagccgagaucaugccacuguacuccagccuaggcggcagagcaagacuaugucucaaaaaaaagaaaauuuccauuugcaccagguaugguggcucaagccuguaaucccagcacuuugggaggcugagacagguggaucacgugaggucaggaguucgagacaaggcuggccagcauggcgaaaccccaucucuacuaaaaauacaaaaauuagcuggggugguggugcacgccuguagucccagcuacucugcgggcugaggcaggagaaucucuugaacccaggaggcagagguuucagugagccgagaucacgccacuguacuccagccugggugacagagcaagaugagacaaugucucaaaaaaaaaaaaaauuuuuuuuaacagguauuaaaccaaagcuguaaaauacaugaaugaaauauauuagacuagguuuggggauagauuauguguaaaaaaugguucucagacuugacaaauauacuacugacauuuuggaaaggaagaaacacugauucuuaagaauuuggaacucugguuugagaaguacugacuuuaaaguuuuauuccaagaaaauaucuuucaggccuggugcaauggcucacaccuauaaucccagcacuuuggggggcugagaugggaggaucccuugagcccaggaauuugagaccaaccuuggcagcaugguaagacccugucucugcaaaaaauaaauaaauaaauaaauaaaagauguccuucaguugcaaauuacaaagcuuuauaacaguacagagacuuauuuuuagauauucaugaaaauaaaaauacaaaauuaaaaauuucuuuuagaauuugcaaacuucagagaacacagcuauggaucucagcuuaagaaagugaguguuagaaaauacaggauaauuuaagauugcuuauuuaggucuugaaauaccucagggucacaauacucaacuucauuuuuacaaaauuguucagcaguguaauuguaggagauuuagaugaauuucucuugauuacacugccugggaaagucuugaguuaucguagacuggacaaguguuuuuucguuuguuuuucuggggacagggucuugcuuugucacccaggcuggacuaaagagguugaggcugcagugauugaggcugcgaucgcaguggugcgaucauggcucacuucagccucgaucucccgggcucaagugauccucccacagccucccgaguagcugggacuacaggcacacgccacugcaccuggcuaauguuuaaauuuuuuuguggagacaguggucucauuauguugacuaggcuguucuugaacuccagggcuccagggcucaagcaauccucccaccucagccucccaaaguauugagauuacaggcgagagccaccacgccuggcugugaacaauggccuuuugauggccuaucaugugccuugcacucugcugcaugcugugggguacaguguaagacaaggucacgacccugcucucagaguuucuguucaaguaauaaaauaugcaaaggaaaaaauaacagauacuauuaaucuagugcuuaggaugugccagguacagucauauaagaucauauaugugaagaacucagccuaaaauucuccacuuggcugggugugguggcucacgccuguaaucccagcacuuugggaggcugaggcaaguggaucacuagaguccaggaguuagagaccagccugggcagcauagugagacccugucucuacaaaaaaaaaaaaaacaaaaaaaacaaaacacaaaaguuugccaggugucauggugugugccuguaguccuagcuacucgggagacuaagaugggaggaucacuugagcuccagaggucaagguugccaugagccaagauuguaccacugcacuccagccuggacaacagaguaagacccugucucaaaaaaaaaaaaaaauccuucauuaguuuccuuuugcucuuaagacagugaucaaaauacagugggaccuggcugggcaugguuuuucaugccuguaaucccagcacuuugagaggcugaggcaggcggaucaucugaugucaggaauucgagaccagccuggccaacauggugaaaccccaucucuacuaaaaauacaaaaauuagcugggcaugguggugcgcgccuguaaccccagcuacucugaaggcugaggcgggagaauugcuugaacucgugaggcagagguugcacugagcugggauugcgccauugcaguucagccugggagacagagugagauuccaucucaaaaaaaaaaaaaaaaauacagugagaccacaugauuuuguauagucuggcucuugcacaccucucaagucuuguuuucaucacauuuucuauaguucuccuuuuuccagucauguggccuuuucucagguccucagaggcagaguguuuacuucuacgaggcuuuugcccauuuuguuuacaccagcacuuugccaagguaauccucacucauccugaagaguccagcuuaauccuacauccucagcaaacucucagaccuugacuuuccagacuccaucaccuccugguuaugcacucuugcaauaccauccaucucucucuaggacaugauaauugaauuucacauuuauuccucugguuauuugguuaaugucuuucccccucacuagacuuugaccaucguaagauauuuguauuuugaucaccguucuucaugucaccuggcacuuagaaguucaagaaauauuuguucaaugaaagaauaaaucuacccuuguacagaauaugaauagagacuuagggaauuuaagugacuugcucaagaucacauggcuaauaaguggcagaggugggauugaacccauguguucaacuccagagcuuaaguuuuuacccauuacucuagacccagugcuucuuauacugucaauggugaaggaccaguuuugggguuuuuuguuuuuuaaauuucuaaucucuuauaggcuaauacuuuuguaaaauauuuugaucauguaucuggauguugugacaaugucaaauuauuauaaaagucucuaaauccuuacucucagugucugugcuuaucacagacuagcauucaccacacuuugaguaucuuuagacuagcauccagggagcagaauguauuacauguugcgcccuguagauaaaguagagaacuguauagcauaaugagcucaggaggaggaagcagagagaauuccacgagggcuccaggcauugggaaaagcuucguggagaugcugagacuugaagauguuaaggcaugauggaguagaacucggaaaggaaagggcacuggaacauucccagcauguggagaaacuagaauauguguagugugacaggggaaaccccgggguacugacuguuuaaaacaagugguuuguauugaguagagacaggaagccaagcacaguuuuuuuguuuguuuguuuguuuuuuguuguuguuguuuuuuugagauggagucccaccccaggcuggagugcaauggcgucgucucggcucacugcaacccccuaccuuccugguucaagugauucuccuaccucagccuccugaguagcugggauuacaggcacaggccaccacacccggcuaauuuuuauauuuuuaguagagacaggguuucaucauguuggcaaggcuggucucaaacuccugaccucgugauccgcccaccucggccucccaaagugcugggauuacagaugugagccacugcgccuggccccuaccaagcacagguuuuacuauguucauuucuguucauaauuuuuuuucacguuucaagacuauuuccauuacuuuaagggccuuuuccucuuuuccuccuuuaaugaacuuuugaguaccuagaaaaaaauuaauauuuugaucucuguuuugucauuugcaucuuagcaacacccauuuguugcauaacacuguauucuuuuuuuguuguuagagacagggucuuaacuguugcccaggcuggagagcaguggcgccaucucagcucauugcaaccucugccucuugggcucaggugauccuucuacugcagccuccugaguagcugggacuacaggcacgugccaccagccuggcuaauuuuuuuuuuuuuuuuuuuuuuuuuuuuuuuuuuuuuuuuuagagacagggucuugcuauguugcccaggcuagucucagacuccugggcuuaagugauccaccugccuuugccuuccaaauugcugggauuagaggcgugagccacugcaccuggccuagcaugauauuuauugaucaacuauggcucuaauaguugauuuaagaucaccuaguaauuucauuuauuuauucaauaaauguuuacugagagcuuucuaacagucugacuucuggguagauuuucuauuuguccaucagauagcaacccucucaaggccuguucucauuucucuguagguaauaagaaauuccuucuuuuauccucacucuucucccuuucuccugaccccagaucuccugagcaguguucaacuauucuuuucacucagagaaagugucuuccuagcuuauuaucaaauaagaaaaagcugaguguaaugucccaaauguaccuaacucugaaauauuuauguguucagaaacacagucacuuuugaaaaauacuuuucugaaaaccuaguaguuagguuaaauaaguuuacguugguuuuaaagauacuuguauuuugggaaguuuccacacagagcuguugccaaauaggcccucucuuguguuuaaauaggucuucuacuugacucucccauuuucuucuaguguuucacuuuuuaaaaucucauuguguugguuguauuuuucagucaaguccuaauucgaagcagaguccucagggaaaauggaaaauacauucccaaacagguacucauuuaucuuuuauuaaaaagcuccacgauucacuguugggcaguagauaucugaauguuuuauaagggggcucuggggaaagcuaaagguuggcaacuuaguaauuaagcuguggccuggugguguuugcucucauggugaccucacccuucuuaggaaauuguuuuuaaaugugacucagcuaaagugucaggucgccugccaaguaggcugacagcucugagcggaacagcauauccuaaaggccuucugacuaagccacuggggaguaauuuaacaguuugcugugucauaguucuuagacuuaaaacacuuuuuuuuuuuuuuacuagucuuucuugacacgaaaauauuauuucaacaacccagaggauggauuuuucaaaaaaacuaaacggaagguagugccaccuucuccuaugacugguauguuuguucccuucacucaucuuuaaggaagauuuuuaacauggguauuugaguggggugggguaggcagggagggugucauuuuauuuaaauguuaaauugcaaaagauaguaaucuuagaccuuagaaaucaucugauacagggaucuauggaaguggaauucucuuuuucaguuagauuuucugagaaccccaauguauaaaguggauuaaaaaaaauaguucucagcugauggaguggggaggccagagcuauugucccugggucucuccuuauugcuguucucaggacccaggauucuagggagcacaguugguaaagcauuccagccuggcugucacccagugccuggauccccuuccaauagauggcugcccagcuucugccuaaaugaggaagagugcaguacuuccaagaugugccauuuuguugacuuuguuguuagacgugauuguuuggucuacccuacaguuuuggcucuaacauuuucuacuuccacugauaccagucaugugaaaaauauagcauguuaaaaguaaaacaggccaggugugguggcucacgccuauaauccuugcauuuugggaggcugagucagguggauugauugccugaggucaggaguucaaaccagccugguuuacaugaugaaaccccgucucuacuaaaaauacaaaaauuagccuagcgugguggugggugccuguagucccagcuaccccggaggcugaggcaggaaauugcuugaaccugggagguggagguugcagugagcugaggucacgucacugcacuccagccugggcgacagagcaagacuccaucuccgaaaaauaaaaauaaaaauaacuaaaaguaaaacaaaguaauuuguuguucuguguugacuccucucauuuuaguacuauucacuucuuuaggugagauaaccagcuauuuuaaacccauacggaagguauuauaauuaauuuuuuuugagagugacuaagguuguauggaguuaauuuuuuaacaaauuuuuaagaaaauuuacaagaaacaaaagaccauuaaauauaugaaaaguuacuugaccucacuaauaauccauggaauaucaauuaaaacaagauaucuuuuuuuuuuuuuuuuuuuuucuucagaaaggagucucgcucucucacccaggcuggagugcaguggugcgaucucggcucacugcaggcuccgccucccggguucacgcgauucuccugccucagccuccagaguagcugagauuacaggcaccugccaccaugcccggcuaauuuuuuguauuuuuaauagagacgggguuucauuguguuagccaggauggucuccaucuccugaccucgugauccgcccgccuuggccucccaaagugcugggauuacaggugugagccaccgugccuggccaagauaucucuuuuuuuuuuuuuuagcccaguaagcugucaaaagauugaaaagauugucaggauccacuauugucaaggucgaggaaguuaggcucccucaccauuggcgggaguggcaagagguggggccuugcugacagucugacaauaucuaucaauuuuaaauguacaaauccuuggaccuagaaauucuaagaaauucucuuacggaaacacauaaacaugcagauguaugugcaagauaauugucggcagcaucauuuaucguuuauuggcaaaaacaauggaaacaaucgauaggucuacucaaaagugauuggugugaccacaccauggaauccuaugcagacauuaaaaauauugagacuggguacgguggcugacgccuguaaucccagcacuuugggagaccgaggcaggcagaucacuugaggucagucacgaguucaagaccagccuggccgacauggugaaaccccgucucuacugaaaauacaaaaauuagcugggcauuguagugugugccuguaaucccagcuacuuaggaggcugaggcaagagaaucacuugaaccugggaggcggagguugcagugagcugagaucaugccacugcacuccagccugggcgauagagugagacuccaucucaaaaaaaaaaaaaaaaaaaaacgcugggugcgguggcucccgccuguaaucccagcacuuugggaggccgaagcaggcggaucacgaguucaggagaucaagaccauccuggcugacacggugaaaccccgucucuacuaaaaauacaaaaaauuagccaggcgugguggcaggcaccuguagucccaucuacucgggaggcugaggcaggagaauggugugaaccugggaggcggagcuugcagugagcugagaucgcaccacugcacuccagccugggcgacagagcgggacuccgucucaaaaaaaaacaguuuacagaaaaucaggagaaagucccuggcaacagagguaaaacuuagugguuucuuguuugugcuuuugucuuagauccuacuauguugacagacaugaugaaagggaauguaacaaauguccucccuaugauucuuauugguggauggaucaacaugacauucucaggcuuugucacaaguaaguuacagacccagccgacuucauguuacccagagaaauucaagugcuagugagacacuaauaucacagguccuguguuuucuuuuguaaacugauaauaguccuugaacaaaaaauuuaauaugugaugacuuuuacggcuuuugcccaaaaaugauccuaaguucaugacguggaugcuuuuuagccagauuagauucaagcaagugacuugcuagcuuacuuccaaaacuaauacgguauucucguugagcaggauaaagggaagcguauuucuauuuugacuucauuugcuagauguuagggugaguuuucuguuuguuuguaaguugauucgcuuuuaaucaauuugguuucuuauuaacauaauucuaugcuuauauauuccacuuagaguuugacaguuugcugcaaguuuuuuccaaauuucaggucacagcucaguuugagucccugcuuccucaguaagcuagaggcagauauuauucagggaaacuagagcagaguggcauuuugacugucuuuucuucagaaauugccacagauuuccuuguggaagucguuuuccaaaagcuauguggcacagaguucccaccuccucugagaaagagucacacuuauucuaaaaauaaaacagcucagagugauugugaacuuuuucuucucugcagccaaggucccauuuccacugacccuccguuuuaagccuauguuacagcaaggaaucgagcuacucacauuagaugcauccugguaagaacuuucuuuuguuuaauaaaaacacaaaccacacuuugggaagccaaggcgggaggaucacuugagcccaugaguuugagaccagccugggcaacagaguaagacccugucucaagaaaacgaaaacaggccgggcgcaguggcucacgacuguaaucccagcacuuugggaggccgaggugggcagaugaugagaucaggagaucgagaccauucuggcuaacacugugaaaccccgucuguacuaaaaauacaaaaacuuagccaggcgugguggcgggcgccuguagucccagcuucucgggaggcugaggcaggagaauugcaugaacccaggaggcggagcuugcagugagcugagauugcgccacugcacuccagccugggcgacagagcgagacucugucugaaaacaaacaaacaaacaaacaaaaaacgaaaacaaaaaccucacaaaccaaaaucuaaaaccagugucccuuaaagaugaggauuucuggcugggugcgguggcucacaccuguaauccugcacuuugggaggccgaggcgggcggaucaccaggucagauugagaccauccuggcuaacacugugaaaccccaucucuacuaaaaauacaaaaaguuagcugggcguggugaugggugccuguagucccagcuacucaggaggcugaggcaggagaauggcaugaacccaggaggcggagcuugcagugagcugagauggcgcugcugcacuccagccugggcgacagagugagacuccaucucaaaaaaaaaaaaaagaugaggauuucuaauuugcaauacuucauuggaaucaguuuuuaaaguuuuuuggguuuuuuuuuucaagacggagucucacucugucacccagcuuggagugcagcggugcgauaucacugcaaccuccaccuccuagguucaagcgauucuccugccucagccucccgaguacuuggauuacaggugugcaccaccacauccggguaauuuuuuuauuuuucauggagacaggguuucaccauguuggccaggcuggucucgaacuacugaccucaaguuauccaccugccucagccucccauagugcugggauuacaggcaugagccaccacgccuggccagaguuuuuuuuuuuuuuuuuuuuuucauugaaacuccacugaaaaugccaugggugguuuauggcaacuuuuacaugagucuagcaaaaggaaagaaugugucaccucuuuucuaucacaauugggggcuuaagaaugcagggguggauguaucaacccccagaaaguuacaaguuuaagccaggaauucuggccaggcaaucauuuuuaguaauacccuugagcuuaugggaguggaaguuuguauuuuuuuuuuuccaaaguacauuacuacuaaugauaauaguuuucauuaguucuagucacugggcuuagcguuuuccauauuuuacccucauagcaaccuaugaaaccuguguaggaauugacauuugaugacaaggucuguucaaauccagcacccauguguuacuuaccacucuuuauaauuuuuuaaaagagauuucuccuucugaauaccacuauuuuuuuuugaauggcagaauaagaaaaauuaaaaucugaaaagcucuuagaaaauacugcuacaauaucuggaaccuaguaaugcugcuucauguagccucuccagacucuugccuguggcuucccaaagacuggcauaaacaagaggaaaagaaaaauggacaaaauggggauuacuagugguaaucuugacuacuugguuugagcagagcccucuaggaugugugggaggagcaggaaaggccagaggcugggaaggcugggccaugcacaguucugcuagagaagaaaagcuguacauuauaugaguagcaugagucuauucuacuuuuaccuucagucucauugggcuaaacaaaaacuucauggguuggagaaaagcuuauuuaucuuuucucagcauccagagaggcaugugacugaaaugcagucauggacagacgcgagacuggaaccugaguguacaauuaccacuguggugagaucagcaacauuguauucagacaggccauuuacuuaccugcagccuauggaguaaccagaauagacucuugcccuuaugugacccacuuguuggaaugaguguggaucuuuccauuuaucuaucacuucccauaugcauuuuuguuuuuaguuuuuauuauaugcaagcauauuuauuuuauggagguugaguaggaaaccuaagcuaaaggaagccucagugauauaguucaaaacuuggaauggcucucccaguagcuauaguccucgguacuguauuuccugaaauccaugucucaucccuucuuguaaguauggaacacacccaguggcucacgccuguaaucccagcacuuugggaggcugaggugggcggaucacuugaggucaggaguucgagaccagcuuggccaacauggugagaccccaucucuaauaaaaauauaaaaauuagccaggcaugguggugugugccuguagucccagcuacucaggagguugaggcaggagaaucucuugaacccagguggcagagguugcagugagccaagauugcgccacugcacuccagccuggguaacagggugagacuccgucucaaaaaaaaaaaaaguauggaacacaccaacacuugugauuuccucuagggaauggaauucagaaugggagucaccuuuggauuuuuugaaauauaguucuguauuggugagacugcuuuaacaacuuguauuucuucugugguugugcuuuggaugaauauagcccauccaaggugacuucuuuacaaacacugaacaacuuugggugguagggaagugggaacugcauuacucucugauauaauaacuaaccacaccauuuucauuuugcuuugccagggugaguucugcauccugguacuuccucaauguauuugggcuucggagcauuuacucucugauucugggccaagauaaugguaagaagcaugucagguuuacuaagcaaauacuuccauagaugaaucauccauauuagagccagaaaagucuuguagguugugcuguuuguuaccauagucaaauaaaauguuuccuuccuuaaguuucugagguauucugaaagagucuuaaaaauuccgggggucaaacugaagaucucaauucucucuggcaaugacugggacaguauuuugauuccccagagucugauaccaucaugugagggauccagcaccagcaguguaagccugugaaccuaaagcuuaaagaaggcuugguuugucaguucauugacuagagcccuugccaguacuaauccuugcucucuuguuuacuggcugggaccucagaaaaguuacuuaacaaguuacuuaacuucgaauucucuauuuacuuaucuguaaauaaggacuuuauuaguuaaccugugggguuguuaggaacagaugaggaaaaauaugcaaagcacuuagugaaguacuuggcaugcaguaguugcucaauaacugguggcuguuauuguugaaauuugaaauaaaguuuagagcuuccuuuagugaucucucuuuugcuguuacuguccccauuuuucaggagacacaaagugacuuuccuagagucacauagccagugggugacagggccagccagugaggcuguaguccaguucucuaaucugugugaagcccauucuuccccuugggugcuggggugcuugcugaguccuggcacucauguaagugugucuuaugcuacagccgcugaccaaucacgaaugaugcaggagcagaugacgggagcagccauggccaugcccgcagacacaaacaaagcuuucaagguauacuccuucaccuuucaaagcugcagcaaugcucugaaagguguuaccaagagcuauuuuaaaaauagcuuccuugaagggaguguugugugguuccaucguuuuaauuuaaacuuaguaaaaacauaguuuacacgucucucuuuccugagacagaaucaucuauuaaguaaauggaaauucuuggugcuuuuacugguuuuuaaaugcucacuggaauuuaauccacacuaucaaugaugcuguaaaauaauccaaucggaggugccagguaaacauuuagaauaauuugaaccuuuuugaaccccauagacaucagauauaaauugcauuaaaaaaacaauacuaagagccuuuucacaaaaagguucuagaauuugcaaaauuuaguaugauuuuugugggacaaaaucucacuguguuucaugauagaaacuaaaagagaagggaaguuccggccaggcacaggggcucacacguguaaucccagcacuuugggaggccaaggugggcagaucaccugaguucaggaguucgacaccagccuggacaacauggugaaacccugucucuauuaaaaauacaaaaaugggccaggugcgguggcucacgccuguaaucccagcacuuugggaggccaaggcaggugggucagcugaggucaggaguucaagaccagccuggccaacauggugaaaccucuuuucuacuaaagauacaaaaaaaaaauuugcugggcaugguggugggcaccuguaaucccaguuacuugggaggcugagacagaauugcuugaacucaggagguggaguuugcagugagcugagauugauugcaccauugcacuccagccugggcaacaagagcaaaacucugucucaaaaaaaaaaaaaaaauacaaaaaugagcugggcacgguggcaugugccuauaaucccagccacccaggaggcugaggcaggagaaucacuggaaccugggaggcggaggcuguagugagccaagaucgugccacugcacuccagccuggaugacagaccaagauuccgucucaaaaaaaaaaagagagaaauuucucagccugauaaaggacaucuaugacagacccacagcuaacaucauacucaauggugaaagacugaaagcuuucccuuuaagauuaagaacaagacaaggaugucuguucuugccacuucuauucaucauuguccaggauguacuagccagggcaguuaggcaagaaaaagaaauaaaaaagccauucagauuagaaaggaaguaaaacuaucucuguuugcaaauggcaugguguuguauguagaucauccuaaagaauccacaagaaaacuaacagagcuaauaaauaaguucaacaucaauuguauuucuauacacugguaaugaagaauuggaaaugaaaggaaaacaauuuuauuuauaauaguaucaaaacgaauaaaauauuuaggaacaaaucuaacaaaagaaauggccguggccgggcauggugguuaacgccuguaauccuagcacuuugggaggcugaggugggcagaucacaacgucaagagaucaagaccauccuggccaacguggcgaaacgccaucucuacuaaaaauacaaaaauuagcugugcaugguggugccugccuguagucccagcuacucgggaggcugaggcaggagaaucacuugaacccgggaggcagagguugcagugagucaagaucacgccacuagacuccagccuggugacagagcgagacuucgucucaaaaaaaaagaaauggccuuuuguuagauuuaaaccgacauacugaaaaauuacaaaacauugcugaaagaaauuaaagacuuaaauaaauggaaagacauccauguucauagauuggaagacuuaauauuguuaagauggcaauacuccaaauuuauccacagauugaacacaaucccuauaaaaaucuuacuugccauucuugcagaaauugacaagcugcuugugaaguucauguggaaauucaagggaaucacaauaggcaaaaauguuggcaaaauugaauaacuuacacgccgugguuuuaaagccuauuacaaagcuguaguaaucaaaacugcacaguaauaaaaacuggcauaaggagagauauaggucaauggaauaaaauggagaguucagaaauaaacacaucuauuuaucaucaauugauuuucaaagaggguaccaagacuauucaguggggaaagaauagucuccauucaacgaauggugcugggaaaaggauaucuacaugcaaaagaaugaggcugggcaccuauuucacaccaugcacaaaaguuaaguccaaaugguucaacaggcauguuagugcagaagaaaaaaaaaaauuagguucaaauuagccaaaugugguggugcaugccuauagaugggaggaccacuugagcugaggaguuugaggcugcaaugagcugugauugugccacugcacaccagcuugggugacagagcgagacccugucuugaaaaaagaaaucaaaugggucaaagucccaaaucuuuaauauugcaugauauuacucauauaaaauauuuggaauaggaaaauucacagagacaagaaaguagguuagaguuuacugaggaugggauggggggcaguggggaguaauugcuuacugugcacauuuucuguuuaaggggacauaaaacuuuggaaaugauaguagacauggguacacauugugaaugucauuaaugccacugaauuuuacaucugaaaugguuaaaagugguguauguuauguuacauauauuuuaccacaauaaaaaaauaaaaauuuggcugggcgcaguggcuuacaccuuaaucccagcacuuugggaggcugagacaggcagaucauuugaggucaggagcuugagaccagccuggccaacauggugaaaugccaucuccacuaaaaauacaaaaauuagcugggcauaguggugccugccuguaaucccagcuacucaggaggcugaggcaugagaauugcuugaaccugggaggcagagguugcagugagccgagauccaccauugcagaugcagagguugcagugagccaagauggcgccacugcacuccacccugggugacagagugagaucacucugucucaaaaaaauaaacaacuaaaaaacagugagagggcugggcaugguggcucacgccuguaaucccagcacuuugggaggcugagguggguggaucacaaggucagaaguucaagaucagcuuggucaacauggugaaaccccaucucuacuaaaaauacaaaaauuagccgggcgugguggcgggcgccuguagucccagcugcucaggaggcugaggcaggagaauugccuaaaccugggaggcggagguugcagugagcggagauugcgccacugcacuccagccugggugccagagcgagacuccaucucaaaaaaaaaaaaaaacagauaccacuucaugcccacucagaugguuauaauuaauaaaaaaaaagaucaacaauaacaagugucgguaaggauguggagaaauuggaacccuauuguugaugaugguacagccacuuuggaaaacaguuuuucugccuuuccucaaacaguuaaaacauaguuacuauaugauccaguaauuucacucuuaaguaaauacucaagagaacugaaaauguauguccacacagaaacuuaugugagaauguguucagagcaugauucauaauaaucaaaaaguagacauaacccaaauguccaucaucuaaugaaugaauaaacaauggaauauuuuggaauauaauguacauuguauguacaguagaauauauacaauggaguguuauucagcuauaaauaagaguggaauacugaaucauguuaaacagggaagaaccuugaaaacaugcuaagugaaagaaaauaacaaaaggccacauaugcccagaauaagugaaaaaaagauacggaagauaacguaguaguugccagagguugugggaggugaauaaugggagcugucuacuguuugguaugugguuucuuuuuguuaugauaaaaguguucugcaauuagauagugguggugguugcacauaugaauauacuaaaaaucacuaaauuauacacauuaaagggguaaauuguaugacauguaaauuauaucugaaaaacucacucaugagcuaacauuuguauuucacauuaaauaagcuuguucuaucuaucuaucuaucuaucuaucuaucuaucuaucuaucuaucgagggucucacugugucacccaggcuggagugcagugguacaauccuugcucacugcagccucgaacuccuggacuuaagcauuccucccaccucagccucaguacugguacacgagaagccaguacuacaggcacacaccaccacacccaacuaauuuuuuuuuaaauuuguauagagaugggaucucgcuguguugcccaggcuggucuugaacucccauccucaagugauccuccugccuuggccucccaaagugcuaggauuacaggugugagcuaccacaucucgcaagcuuuuuuuuuuuuuuuuuaauuuauuuuuaaagacgagguauuacuaucucuaggcucaucuaaagauagguuguccagggcagucccaaacuccugggcucaagcuauccuuagccucagccuccagaguagcugggacuguagaugcaugccacugcacccaacucauaaagcauuuuuuagacacucacuaauuuaaggcaaaguagucagauuaauagaauauuugagaaauguaauuucuuggaaaauucugcaaauuuauuucugcucaacauauuacuaguuuacaucuaaaugauuauaugccaaaaacaguuuuuuaguucacaucaucaaagucuuuauuccagugauuaaaaauuacuggacucccacaaacuguaaugaagugccauugugugucuggacauaagguuggaggaaguguucuuaggcccacugaagauacccugggccauuuaugucaaagcauuguggaccaugcaccauuuaaaccagauggcaagucccuugauuaaagagcugagaaucugcacuaauuugucuguuguacaucucucaagaguacuguggggcacaaaggugcuuagugagugugagcugauagacggguuaagcgcuggggacuuugcagucagaccacaauuuaaaucucagcuccauuaguuccuagugccaguggccuugaacaaauuauuugaccucuuagucuuagucuccuuaucuauaaauugagggguggcaggaagagggggaggagaggauugggguagcagcauuucccuuguaggauugaaugagcuuauacaugcagauagcucacuccagcuuuuggcccagaguaaguggucacuaaagguuagccacagcugucaguaacaauucccucucuuccugccuggguguucucuuccauuacagacagagugggaagcuuuggagcugacggaucaccagugggcacuagaugaugucgaagaagagcucauggccaaagaccuccacuucgaaggcauguucaaaaaggaauuacagaccucuauuuuuugaagaccgagcagggauuagcugugucaggaacuuggaguugcacuuaaccuuguaacuuuguuuggagcuggcaccucuugaaauaaaaaggaggaugcacgagcuggcaggcaugcagcaaggcuuguucuugucugggcuggguuccccuuuauguuugaaacuagaggaaauaggaguaugcugggcaacuuguuauuuuuaaaauguuguaaauguuccuucuggugacucuaguaaugaaagucagagaaagggggaaaccucaggcuacugauaauauauaaaaucuuggccaggcgcaguggcucacgccuguaaucccaggauuuugggaggcugaggcgggugggucacgagaucaggaguucaagaucagccuggccaagauggugaaaccccaucucuacuaaaaauacaaaaaaaaauuagccgggcgugguggugggcaccuguaaucccagcuacuugggaggcugaggcagagaacugcuuaaaccuaggaggcggaggaugcagugagcugacaucgugccacugcgcuccagccugggcgacagagcaaaacuccaucugaaaaaaaaaaaaaaauauauauauauauauauauauaucuaucuuagcagaagcccagucuucgaaggaagcauuguuaauuauagcuaaugauuaugugcagucagccugacaucuagccacaguaaacuccuguuuucuugggauccaaacacccuguguuuuaccauuaguuuuguuaguauuguuaacuuucuuuacacaaguaaaccauuuccacuaccaaagguuuagaaacuauggaugaacaaaaugaaucucccuguucauuuugagccuacauagacauagagaccaaauaugucaaaaccuuauucaaauaaacucucuucagagugaauacccagggucaggacagacucagcaaaccuucuauaucacuuaauucugcccagugaaaaucagugacccugaggcacugccagauucuaaagugccuuugggaucaucagagacugucuauaaauaaugcaaaaucuugaucuggaugucaguguaucaaaucuuaucaaauccauugacaaaucaguggugcuauacuggaaauggcuacuccuuuggaugaaggaccucauuucccaguugcuuggaacaaaagagaauuuacauauugcuguaagaagggagagacggcaguuguugguagacacacagauaagggugcccaagaauaauucugucuggauuaaaggucccagggaagugacggugccauuucuguaccaagaggugaauauaauuugcauguugagugcaguaauuaagaacaaacgacucgacuccacaaauuaaaccguccuguuuucucuucuuugccugugaaag

SEQ ID NO: 14852 - RNA, 31170 nt, Homo sapiens
acaugugcuuagacaaguaggcgggugacuuuauucaccaacuacucaaaaacaggcugcagagaacagaauuuggacugccaaacucacuguacccucauaucgcacucuuucuucuuugcugccuacccuggagcauuuuggcugggaggcaaaaucccagugcuauuacaggcaguccccauaccccucauuccaugcccaccccaccccacccaccacccagaagcugaagccuuaugacccgcuuggaggaaaacauccuguccugguuuucuguguuccaaucagcucucuaaacacauccucgaccugagacacagacuucaagccagccuguguucugucaggcugcuggucgcccuggaggguggaagagaaaaagaagaagguuccaaaccaugucacucaaaacaaaucaggcuuaaugcucauacuauguuuauauucuuuacauuaacaaaaugcaacaaaagacuuguccugguuuuuaaaaaauacagaaugugaguuuuacgaccuuuucuaggagacucccgaggacuguaccuucucugcuuaaagacuguagaggcgacugguguucucacgcaaggcagccaaggugagggagaguggcugaucuuugacucuggcaaucucucggaccguaugcaaggccaggcccgggugggcauacuggcaaaggcuuuugggaaccuggaagacaucaaguggucauaacaucauugugccaugugugcacagucauaaucuagaacucccucccugucccuuccccagcaaggaccucuuuggggcugcccuguagagaccccuuuaccugcaggugcagggagaguccuagucaugggggcucugggugagcagggucccacgcuuccuuggacuacccucuacaggguagggcuuugcacugccuggaagagagugguuacccuucagcuucucagcccccuagacuuuugguucugcagaguaacagcaaggaggcaucuacacagcccaggaugggaccuggaagucacuggggcucuggcccugccaaccuuguaagggugaccacccaccuccccacccucucccuccggugccuccacucagccugaagacccccuuaccuggcgagggaggaaauagggagcauccguuuccacgaugauucucuccagugggaucugccucaaggcuucccgggccucccaggcagaggaguaugucagcacugccgugaagcccacagacauguugggaaaguacuucagcaggggcucaaugaccggguagcugccggugaagcaaugccuggagacagaacuccacaucagggcugcucacaguccccucugcagcagcccccagcuccccccacacccaucaccccuuuucaaugauucccagaaauggaaagacugcauccuagggaaggacuccacaguaaacacagacaagggcuggcuccaacacaggaagccccgagauggcacuuggugagugaucagagaucacucagagauaccacgcacaccacagagugcucugcaguccccugagaugaccaccacagagaacacacugggauaggaaaugcuucuaacacugaagaggagcaaaaucaacaacuguggccccuaugaugacaacgacagcauauaaaaacuaugcccaaguagucaaaugaacugaaaggaaaucuaacaaaauacuggggagucgaacuacagguggauuuucuuaaucugauaccuguucauguucuuggugccauauauauaguuaccaaucuguaaauuuagggccuccuccugcaauaccaccucguugggucaccuuagcccuggccuaccagccaccauuacauuuccuucaaaguuagcccaaaaugaaguaaugaaaaaccaaccgacccagaaaagccaacugacugccucaucauuggugugugcagcagccaggggucagaggcuucacucauucugcuuagguacccaaaggcccugacagccccauccuccuuuuucugccaucugacaagacccgauuugggugcuagaguccuuguuauucagccaaccccucucaaccaucuuuaaggagccggccaggcaucaccuccugagucuucuggcugggcuaugauaaugggccccugcuguggcucccacagcaccuaugaccacccagucccacaugcuauguaggcagaagccaccauccaaccugucuccuggcagcaccuccagauguccccagaggcaagccaaagcccaggaccuacacguggcaagaguucagaaguucagagaguuuaccaaacugaacuuaagcacccauagaugccauucugauaaaacaugaccuugauuuucauaacuggggagaaaggagcuuucaaguucaaaagaggaaagaaaauguccuuucaaguacccuaagaugcucugugugcuaagccaccacaccccacagcaaccucucaagaucagcaauccucacugcugagaacugaaacuccauuucugcccauccccaggaugggggcacaaaaggccccuugugcucacuggugauuuaggguuauuaguucaaaccauacgaaguuacuauuuugugagcaaaaaaaaaaaaaaaggucaaauaugagaaauuucaagugguuuaaccuaauaguuaauucuuuagaaaagauaguguauaggccgggcacgguggcucacgccuauaaucccagcacuuugggaggccgaggcaggcagaucacgaggucaggaguucgggaccagccuggccaacauggcaaaaccccgucucuacuuaaaauacaaaaacuagcugggcgugguggcaugugccgguaaucccagcuacucaggaggcugaggcaggagaauuguuugaacccgggaggcagagguugcagugagcugaaauugcacuacuacacuccagccugggcgacagggugagauuccgucucgaaaaaaaaaaaaaagaauagauaguguauaaugacagaauacgaucauugcuguccucaucaacuugacagaggaaguguuucuuucauuugcccgcugaaguuccagucuucuaaccuauggaucuuguagucagggggcacaaacuuuuucaugauuucuagcagaucuucaucagcuucucggcaguggaucaccaagggcuucuuuagagacacagccagcugcagcugucucucaaauaccuaggagaggacacagcgacaaccccuguugguuagcagcacuucagaaguccaucaccucuggaacgcccaguccagcaggcacccccugugucucucuuuuuuuaacuauauaauguaauaauagcuaaugauuauuggucacuuacaauagagccagguagugcccaaagcacugcacgucuaucauaaccugcaguccucacaaccacccugaggcaggugcugcugucugcgcagcaugcagugagggcaaguuaacuugcagccagcagcuauagcaccaggauccaaacuugaacccuggcauuccacacaguaaccacuauaugaugccgaccugggguggcaggggcagggcagggaucaagaacauaaagcgcaaaguuaaugucccucaccucacuguccccaccuccgcucucaagagauaccaacuuccagaccucuccuaugcagagcuguuggggacggcagggcgugguguuugugugcaucuccagcaaggugccuggcucucagaagguacucaaauauuuguuaaagaaacaaauacuacacuuauuuucuacaacuugcuuuguuuuuuuuuguuuuguuuuguuuuguuuuuuugagaccgaaucuugcucugucgcccaggcuggaguguaguggugcaauugcagcucacuucagccuccaccuccuggguucaagcgauucuccugccucagccucccgcguagcugguauuacaggcaggcaccaccuugccuggcuaauuucuguauuuguuuguagagaugggguuucgccauguuggucaggcuggucucaaacuaaccucaacugaucugcccgccucagccucccaaagugcugggauuacaggcaugagccgccaugcccggccaauuugcuuccuuuacucaaucaaaaucgcguauccucgcaggucaauaacuacaaauauacuuuacucuuuauaacacuacccacuuuuaaaucuucacuauuguuaauuuaaaugaaaaaaguagaguuaggaccuguucuuuccucuaacgagcccagguuuagaacaaagaaaaguauuaauucaccaggcgugguggcucacaccuguaaucccagcacuuugggaggccaagucggguuugaggucagguguucaagacaagccuggccaacauggugaaacccugucucuacuaaaaauacaaaaauuagcugggugugguggcaggugccuauaaucccagcuacuuggguggcugaggcaggagaauccccugaaccugggaggcaaaggcugcagugagcugagaucaugccacugcacuccagccuggacagagcaagacugucuccaaaaaaaaaaaaaaaaaauuaauucauuauaagcaaauuaccucauauuaauguuuccaugaguaguuucuacaacuguggaacauaauuuguguuuauguuuucagcaucaaacaaugagauacuuuuuguaauuugagucaggugauauucacuugagaauauuuacaagucuaacaccuguacugccucuucucaaaauagcaacacuaagccaauaccaauucugauguaacuuuuguuuaaucuguguuuucaaagaaaggaaaaugaccacagacaucaaaauuauagacugcuugacagaggcuuuaucuaaagccuggccaguuccacuaucaauagguggcuggagccccuccuauuugcaucugcuaagcuguucaucugcccuccccgaccccuacacacaggcagcagagguuucaagagauuccaauuccaacauuucauuccugccucuaaaaaauuaucccucagaguagugaaauaaacuauuagagcuuuaggauagaauauuacacagcuguuaaacauuuuucaaaguauagcugaugaaugggaaaauuucacgaguagaaaagacacuuaaaacuauuuaauuuccuaauuucuuucuuuaacacaagcacacacauccaaccuacgacaggugcauggaagacaagccacugugcaacuguuccuugcaauuguauuguaccuugcaauuuuccaaggaacaauaacauuacauuuauaauguuucaugaaacacauccagauuucaaaaauguuaagaaggaagaagaacucauuagaaugcaggaacuugugguuggacaggagcuauuugcagcauuuguccucaccaggaacccagcugaaaaacaacaggagugaaggaaguacagaugaguuauuacccaguauaauuacucacuucuaccugcauaagguuggcuuccuaacugauccauuauuuccagggauuccagaguuagucucuccugggaguugccccaggcaucucuugcauauuuauuacuuuaauaauuaauuaauuccucuuuaacacaaguaaagagauacagccuggguagggaaggacagucuacucucccuggcaucccucccagaugcugacaugugcaacuuacacacaaacuauucaggaucuaacucuuaugaguuacauaguuaaucuguaaacaccacagaucaacaaagaaaacguuaacaguaauuugcucuaaccagcagaauaacuauaacuacccauucuuuccccaauuguuuugcuuuucucuauuuuccaauccuuccagaaaauuuuagguacaucaaccaaacucuccuauaaugagcagggucugucacccuaucaucuugcccagauacagaccuuccacaggcucuuuuuuuuuuuuaauguaauaaagauggggucucacuauguugccuuggcucaucuugaacuccuaggcucaagcaaucuccugccucagacucccaaaguguugggauuacaggcgugagccaccucgcccagcccucuauagguucuucuucuucccuucacaagauaaaacauucagcaggacacauccagaacuugcuaacugcucuuuuagguaaaugcaacucagcacugacauccaacuaggugcaguugccagucaccaccauucaccucauuugggugccaaauuuuuuauuuacaucaaaacaguguccauaucccccacccagccuaggagucucugguguugacaaauauuuucuagucuuccuccccuuuacaggcagcuuagcccucucccagccagcaacuccucagacucauuaucuuccagucuugagucaaaucucaccaagccaaaugacaucuucaagacuguguuuaucccccuaugccuaucgcuucuaguucaguuuguugugcaggucgccccauggaccuuuaagugcagaccugagacccugauaauuuugucuugagacagggucucacucugucacccaggcuggagcauaaucaugggucacugcagcucaaccucccaggcucaagcaauccuccugccucagccuccugaguagcugggaccccaggcauguaccaucacacccagcuaauuuuuuuuuuuuuuuuugguagagauaggguuucaccauguuggccaggcuggucuccaacuccuggccucaggugauccgcucgccuuggccucccaaagugcugggauuacaggcaugagucaccacacccagcuauacccagcuaauuuuuguauuuuuaauagagacgggguuucgccacguuggccaggcuggucuccaacuccuggccucaggugauccgccugccucggccucccaaaauacugggauuacaggugugauccuguaaauacaaaaaauuagcugggcgugguggcgggagucuauaaucccagcuacucaggaggcugaggcaagagaaucgcuugaaccugggaacuggaggcugcagugagccaauaucaugcgauugcacuccagccuggccaacaagagugaaacucugccuuaaaaaaaaaaaaaaauuagccgggugugguggcaggcaccuguaaucccagcuacucaggaggcugagccaggagaaucacuugaacuggggagguggagguagcagugagcugagaucguaccgcugcccuccagccugggugacacagcaagacuccaucucaaaaaaauuuuuauuuuuaauuagccaggcgugguggugugcaccugcagucccagcuacuugggaggcugaggugggaggaucacuugagcccaggaggucaaggcugcagugagcuguggcugcaccacugaacuccagugugggcgacaaagaccuuaucucugaaaaaaaaagaaaagaaauucuaaaauacuacaacucuuacccugccaaagcacuaugcucaaaaaauauugggaggaaaaaaaauauuaacagggggcgggcgcaguggcucaggucuguaaucccagcacuuuucggacgccgaggcagguggauuacuugaggucaggagcucgagacuagucuaacaaacauggugaaaccccaccucuacuaaaaauacaaaaauuagccacgcaagguggcacacaccugcagucucagcuacucgggaggcugaggcaggagaaucgcuugaacccaggaggcggaggcggaggcggagguggaggccgcagugagccgagaucgugccacugcccuccagccugggugacagagugagauucugucuccaaaaagaaaaagaaaaaaauauuaacagaguauuagccaugaucucugguugaaugggaaauuaugcauuuuuucauauuuuuucaaauauucugcaauggguauauuuaaaaaaaacaaugcaggccaggcgcaguggcucaugccuguaaucacagcacuuucggaggccaaggcggguggaucaccugaggucaggaguucaauaccaaccuggccaacauggucucuauuaaaaauacaaaaauuagccggguguagugaugcacgccuguaaucccagcuacuugggaggcugaggcaggaaaacaguuugaacccaggaggcggagguugcagcgagcugagaucgcaccacugcacuccaaagccugggcaaaagagcaagacucccucucaaaaaaucaauuaagaaaaccuaaaguuuauugcuucccaagaaagaaagaaaacaaauguuuugacauugauaucauccauaagaagucacaaaguacuucucccucaucuuccauaauaaagcugaacaguaagaaauagcuuguaaagcauuugacaaauggcaucuagauggucuggaugagagcaagcacacugcguuuucagggauucucaauuauuuacuucuaaaauuagauaaacccuuauugucaggcuucaacaacuaaaagaaaaauuaaaacuauaagcagacuaaagagagccuuguuaccuugugcuguucugggacaggcguggugcacuuguaagaguaauccaagcccauuucuccaaaugccacagccuuagggugccuuaaggcuugcaaaagauuucuuucuugacucucacuguaguaacgugcaaaaugagggugacagccaaaggccccccagaccagauccucuuucaacagcuccucccauaggcaaucugucagggugcggggaucacagaagucagagaugcagcccugaaauuccuuagggaaggagcugcuguaaauuuuucugaacuuuguaaaggucccuuggaaagauagcuuggaauagagcauguccaggugacaaugagugucaaugaagcccuccucuaggcuuggcuccagguggcucuuuggcagggagcuggaugcguguccuccacaaggacgcggaggcaucuccucuuggaauguucuuuucuccuucaccucucuuucuucugagcuucuggagaagcgaaaugaacgagaauucugggaccagccuuccucugaggccuccaugucucuggagguguuuuggacacucccuguagaguugggggaauaaucacucaugcggcuccggcugcucuucccaaccugggcugcaucguugcugcugcugccuguggagggguagcuagaaggcuuggggcugcugguccaauagcuggcguagucacaccaaggacuacuguacaaaugaggaggguacaugacauagucgguggugaaggaagaaggcuccggaacggcugaagguuucagggagacagguuccuccugagagaaucugacuguggagaucuccucaacaucagaccagucacuuccagaagaggggugcuccaucaccaccucccuaucuuuaugcugcagaaaagaaggcauacaacaguggguuagccuuccgaugugaagauggccucccaggcugucaucagcugaacauaaacccuggcuuguucuucuggccauggugauggcuuugcauuggcucauuagcucacccugucaccugguuuccuuacaauuuccagaaauguccagaacugagccaaguuacugcugugaacagcuguauuggguucagggaauaggccugugaccauggccucaucaugcuacuccuaaagguggugcucuaccugcaucccuuucucuugagaaaaacugcucucuagaacacacuccggauuggagauuuuagagaaaagcagugcccagcuuuuccucucugacacugucgucaauauauucaaaauguaaaauuacaacagcuguggcaguuguauuuuuuuuucagacagggucuugcucuguugcccaggcuggaaugcgguggugagaucucgacucacugaaaccuugaacuacugggcucaaguaauccucuugccucagccauccaaguagcugggacuacaggcacgcaccaccacaucuggcuaauuucuuguagguagggggucucccuauauugcccaggcuggucucaaacuccuggacucaagcaauccuccugccuuggccucccaaaaugcugaaauuacaggcauaagccaccacaccuggccauugugacaguuuuuaaacguguccccgaauuauuuaacccuucuccccauugagaguggggucuaugaccccuccccuuaaucuggaccuaccuagagacuuacuuauagccaaaagaaugcaacagaagcgaagcuguguaacuuccaaggccaggucagaagggccuuguagcuuccaucugguucacuccacuugcucacucuggagcaagccaagcaccauguaagaaguccggcaacccaaaugacauccugcuagagaggccacauguaggugugccaguuuacagccuggcugacuuacuggcugacagccaacaucuguccaccauguaagugaacaucucggauguccagcccagucacacucucagaugacgacagcccucgccaaaaucugaaaggaacuacauggggcuccccaagaaacaccugccccagucuaggccuuuccaaauuccugacccacaguacugagagcaaaagaaaaguuauuuuaagcuacuaacuaguaauagugacugaaacaaccaucccuugcauuaaaucggcuuaguccuacuagagaagguaagcgccacgagaucaggaauuuuuauuuuuuuuccacugaugucuccccaacaccuagaacagugccuggcagauacugagugcucaugaauaucugcugaauuaauuuuuagaauaaauggugccucaacuuagcaucacaucuccaucaacuggguagcauuuuaaaaacagauuuuuaaggcccauuccacccugagauauugugauucaauagguccaagguggggccaaggaaucugcauuuaacucuccccggaauugugaugcagaccagguuugagaaauacaguaagcacaucaauaucaauucaugcuggaaacaaaauuuaagugccaucauuucuucuuaaagcagccaucuauaccugccaaugacagaaggcuugaugagcaagaggccuuacaaaguucucuuaauacuuuuaugaguauauguaauucacauaauaaaacaaacauucacaaugaaagagcauucuagcugaauuaccugauuaaaauggaacaaaacuguuuauguuggcuguacuaauauuucauaccccuaacuacacucuaacaggaaacaaguauuaguaaccaacacuuaaaugaauuacccauuucccauuuuauacuuuccugccuuagacuucucacagcuacugcuugaauggcagaaauauccaaacaagaaucuuuucuaaaaugcaagcuaacuuaaauguagcacauuuuuaauuuaaucugaacucuugaagcugggugaugggcaucuggugauucaauacacuauucuguuuacuuugaauguuugcaauuuccccuaaaaccuuuaaaaacuuaucuauaagggagaacaauccuucaaaaacuaucucgguuauaacagaaaauuuccaucaacccagacaauaaaaaauuacagucuugccuaaguuugacaaggcuuuuguguucuguuuuguuuuuuuucccugcugaauuuucuagugaaacauauuggaacuacaagucuacuuuuguauaggugcaccugaaaguuaaaauguuuaucauauacaguaacacaucauuaacaugucugcaaaauaauuggagguggucacauuauggcaaucccaaaaacacaccucgaggaaaaacggaaacagacugccucaaugugauaugaugacuauuugcaacuuggaauaaaauuuccaagaacaauacacagauucaaaaaguacuauauucucaucagcaaaaacgagacauaugaccccauuuuuuacaacaaauaaauuacaacauuuuggagggagaaaaggaugaaucuauagagacgaagagacuugacacauuuaaaaauugccacauacaguucucauuuggauccucuuucaaaugaaccaaaacaaucaucaaacaaacagggaaauuuaaucagacuggauaggaaaaugucaaaguaaggaaaaaagcaguuucaaaaaugcacauguaacuagaaacauacaccauaaacagacauaauaauuaugucaucuaaauccuugaaagguuucuagagucaaguuggccaagaaaauguuuucagauuuuuuuuuuuugucggggggugugggggaaauaggaggagacugccgauauucaagacugucucagccgggcaagggggcucacgccuguaaucccagcacuuugggaggccaaagcaggcagaccacuugagcugaggaauuccagaccagccugggcaacauggcaaaaccccaucucuacuaaagauacaaaaaacuagccaaaugcgguugugcacgccuguaaccccagcugcucgggaggcugagacaugagaaucacuugaaccugggaggcagaaguugcagugagccacuguacuccaaccugggugauagagcaagacucugucucaaaaaaaaaaaaaaaaagacugccuuaguuaguuuaagccuguaugguaaaauuuaaaguuacauuuauugagcaccuacuacugggcacugagcaaagaguaaucacguaugaauucagaguuccacaugcugcagcccacaagaacauuucuaggcuaaagauggauugaacaaauucaucuuauuuuacucuuuccugaaaccucacugaacaacaccaugccugaugguguaaauaagguuucauuggaauacagucaggcccauucacuuguacguugucuauggccauuuucaugcagaguugaaaagcugcaacagaggcuguaaacccaaaaaugcaucugacccuguauuagcuuuuuacaagugguaacauuugaagagcuagcccauuuuacacacaggaagaaacugggguucaaagaggcugacuuucucaagauccuaauucgaguggcagggccaggauuuaaacccaaauggucugaucccaacacucacaugcucaccuaccauacugugcugucuccaaauagauacguaagagaaaaccuaauugucguccagucucauaaauagaaguuuggguauaacuuuagaaaauucauccacacaauggaauuagaggcaaccaaguaagaugaucuacauuagacagaaaacacacccauuacauauuugggaggaaaauaucuuacaaaccuacuuuaugugggaauuuccaauuauauauauagcauauaguuuuuguccuucccacccaaaaacccuucuaaaguuacaggaaauauauccgaaaagguauaaaccuacaaggggaaagcacacaaaaugaacagcaaagcaaauuaaauaagcauuggaugcuauucacagauaacagagcauagaaaacagauggguuaaugauuaucagccaagaagaucagauggccaaaaccuaagccuucagugaggaaaaacccagaaccagacuacaggaccccagaaagacucaggaauuggaggugccagacuuccaaagugagggugaagccgcagaugaaaauaggaauuagcugaagucugucaagaucuccagaccccugcucccacccugugcagauggccugcccuuuccccacccagcaaaggacaaaaguugaugcuuggaaaaguuaaaccaaggggaccacagaaaaauaaaggugcaaugagcuaugaccaugccacugcacuccaaccuggaugacaaaaacuuuuuuuuuuuuuuuuuuuuuuuugagacggagucuugcucuguugcccaggcuggagugcaguggugcaaucucagcucacugcaagcuccaccucucagguucacgccauuauccugccucagccuccccagcaccugggacuacaggugcacgccaccauaccuggcuaauuuuuuuggauuuuuaguagagacgggguuucaccguguuagccaggauggucucgaucuccugacuucaugauccaccugccucagccucccaaagugcugggauuacaggcaugagccccacgcccagcuaaaauuuuuaauuuuuaaaguucuggccgggcgugguagcucaugccuguaauccuagcacuuugggaggccgaggcagguggaucaccugaggucaggaguucaagaccagccugaccagcauggugaaauccugucucugcuaaacauacaaaaauuagccaggcauggugguccaugccuguaaucccagcugcucaggaggcugaaacaggagaauugcuugaacccaggaggcagagguggcagugagcugagaucacaccacuguauuucagccugggccacagagugagacucugucucaaaaagacaaaaaagaaaaaaaaauuggcagcaauaaaaaaaaaaaaaaaccacgcacaggaaaaaaaaaaaaaagaccaaaaaaaaaaaaucaacauaaacguuagaagauaaacuugagccaggcgcgguggcucacgccuguaaucccagcacuuugggaggccgaggcggauagaucaccugaggucaggaguucgagaccagccuggccaaaaugaaaccccgucccuucuaaaaauacaaaaauuagacaggcaugguggcaugcgccuauagucccagcaauucaggggucugaggcgggagaaucgcuugaaccugggaggcagggguugcagugaaccaagaccaagccauugcacuccagccuggguggcagagugagacucuaucucaaaaaaaaaaaaagaagauaaaguugaagaaaccauccagaaaaauuuuuuaaaaaggauucacugggaagaaaagaaaauuggaauuuccauccgaaagaccaagcauaaaauagaugguccagaaaaagaagaaacagacaagaaaucaaauaaucaagaaauuuucccagaacuuuucuaggcuaaggauguacugaacaaauucgacuuauuuuacucuuuccugaaaccucacuaaaacuaaagaaucuaaaaaccaaacaaaaaacaaauaaaaccccucuacaauaacaaaaacaccagaacaggaagaacaagagacuacagugaucacgcacuggaggcuagaaagcagauggccaaauaacaccucacuggcagaccaagagaaggcugagaccuaagcuaggcaccaggaaagcuuagaacagagcaggcacucgcgguacugggcaccuugggaacuggaggaacuggaguuacagaagaacauuaaaaggaggaggacagggugaaaucugguuuccaaugaguuagaucccagauucccuccucauacucagagaaggugaguuguuugaagacaguaaaacaagaggaucucuagaauaaggccuggucagcucaguggagggcacugguacugcaccaaaaagacaaagauuaagugaaugcugacgccgcccccgcagccgccccuuucgcuacccagcucccagccaccuuuccuccuaagcaggcugaaaaacacuccucugggcaaggugaccagucucgaggcuuuccuaaaagcagugacauggcaaggggaagaggguuauauucucccgaucaucccaaagcaaagcucaaagucuuuacgcucagagcuuccaaacagcuuuuuaauccucccauucuugaucauaaacagacaaccaaagauuaccagacaugugaaggcagccucuaacacagaagagaucaaaagaaacggaaagaagcaacuuaaagaaaacuaaaaccaagccaaaaaacuaccaugaacucccuaaaagagauaacagaagaugaaacaagaacagagauguuauuaaaaaacaaaagagcucuuggauaauaaaaagcaugacaguagaaaaguaaaacuaaauaaacagcuggguuggaagauaaagaaaaggaaauauccuacaaaguaaagcaagaaauuggcuagaaacaagggagaaaggcaauaaaauuacaggaccaguccugaaaaauccaacauccaaauaagagaaagaagguagagaagcuagagagagaaagagagaagaaaaauacggaaagaaaacaucagcgaaguacaguaauucacgaacuuuucccacagcuaaaguacaaggguuucuagauugaaagggaaugucccaugcuaagcaaaguagacaccaccaccaugaaauuucagagcccugagaucaaaauauauucuacaagauuccacagagggaaaaaaaaaaaaaauacagguugggcacgguggcucacaccuguaaucccagcacuuugggaggcugagccgggcggaucaugaggucaggaguucgacaccagccucaccaaaauggugaaaccccaucucuacuaaaaauacaaaaauuagccgggugugguggcacaugccuguaaucccagcuacucacaaggcugaggcaggagaaucgcuugaaccugggaggugaagauugcagugagcugagaucacgccacuggacuccaaccugggugacagagcaaaacucugucucaaagcaaaagaaaauaaaaaauaaaaaaucauauaccaagguucaggaaccagcauagcuucagacaucaagaaaaccagaagaggccaggcgaaguggcuuacaccuguaaucucaguacuuugggaagccuaggcagguggaucaccucaggucagaaguuugagaccagccuggccaacaugaugaaacucugucucuaccaaaaauacaaaauuagccaggugugguggcgugugccuguaaucccagcuacucgggaggcugagacaggagaaucacuugaacccaggaaguggaggcugcagugagccaagaucacaccagugcacuccagccugggcaagacagaacgagacuccaccucaaaaaaaaaaaaaaaaaaaaaaaagcccagaagaaaaggagcaaugccuucaaaaucccaaacaaaacaauuuccaaccuggaauuccaaaaccaaccaagcuuguaaucaagguuaaagguaaaauaaaggcaaucucagacacauguuuaccaaaaaaaguuucuccauguacccuuucucaagaagcuacuagaaaaaguauuccaccaaaaugugagaguaaaccaaggaagaagaacaugagaagacacagaguauagguagcagaagacucaauccgggagaaaugugaaggaggcuccagagagacagcugccagcuggccugacggcaggcaguccagaccagagcaggacaacagagggcugaggacguauaccuccaagagagaaaaaaaagaaacagauuccuuauuuugacaguauugagaaggauuuuacagcucucgcaguuuggggauuaauuagugaaagguaccaggaaaaccaaaggaaaaacaaaguaaugaugaacuuuaaggaaaaugaaguuuuacaagaaagaaaaugugaucagaguauacaaggcgacucagcugugaacauggcaguaacaaaucuuacacagacuuaacccaaaagguauucaagccacacagggaggcugcagaaaggggaagcuaaugugucccugggugugggugcuucugaaggagguauagagaacuaaauucucaucgcccaagcaagaaguccucagacaucuaaaacugaaaaacugaucaacaguaaagauuauuuagaaacaugggguaaguacuagaagaaagagcuaaagaugagagaagcugccugcagagcaguaguaaaggauggguggagacgaguaagauggaggaauguggccuggcacaguggcucaugccuguaaucccggcacuuugggaggccaaggcagguggaucacgaggucaggaguucgagaccagccuggccaacauggagaaaucccauaucuacuaaaaauacaaaaauuagccgguuugguggcgcacaccuguaaucccagcuacucaggaggcugaggcaggagaauugcuugaacccaggagguggagguugcagugagccaagauugcaccaucgcacuccagccugggcaacagagcaagacucugucccaacaacaaaaaaaaaaaaaaaaagaaaaagauggaggaaugcuuccccucaauuauaagcuauguuaaaaaucacuaguuuccguccaaugacauccuucccuucuucucugguuauccagguacaagucugccuagauaaaggcugauuuuccagacucccuugcagccaggugucagccggguuuccccgcucuugucaacagcagauacaacaugugcaacucuugagccaagcucuuaacagggaaggaaugcacucuccucuucuccccuucccacuggccagaaugcccagauaacaaacccugaguccuaucagaguauccauuucacaccaagagauggacacuguguugaggggugauagagaaucaagacaaaagguaccaguaucucugacaugauggagccauccuucuuaagccaaacuuauauucuguuuaagccacugugauuuuggccuuuuacacagcagcuaaacccauauccuaacauauaaauccuucaaaaaaaaaaaaaagcacuuaguuuagguuuauuaauaacucugaaaaucugaaaaguauguuagaagaaaaccaucaguuuguucccuggaggccugguuaaguaaaguacuauuuuuaauuaguaacacuuaggaucaaacuagaaagauggaacacauuucaucaacagaacuaaaaagucagaugccugguacaagcuuuacucaccuuuuggauuucuaaaugagagucagagucauccaagaacucuagggguggagagcauuugucaaugacaguccuucgguccccaaggggcuccucacuggguuucucuugagggucuauaacuacucuccugucauagaagcugcuccucucuggcacugucuuauccuccuccaugcugaccucugggguugcgucuuucuccuucugagcagcagugacugugacacuccuggcugcuccuucugcagucuuggcugguccuucacuccuggcugguccuucuccauggcugggaugcucugcugcgcuugguuuugcccgaguggcagccucucccuuccuuuuuggcaucgauuuccccaggaugcccuggauagccuucagguagaucauuguggagcccuggucucgaagucuaucccucuuccuuuucuggaccuuguuggguuccucaauuguaucauucugacccucagcuucagcugcaaauucagaguuuguggaguuaugagaacuaucuuuggaaucaaccugggaaaaaaaaaacagaauugaaagggcuguuccaagggcacuuucguacaugaagcauuuggcaaauuauaaaucaguggugguucuaccagucaaagggaaagugacuguggcuaaggcaaagguucucuccggguggugaaguggcacuguaagaggggcugauugcugccauuucuuagcauucgccuucucaugcucagcagaugauauccuuucacugcaaggggacggaaggagcugaaaugaacacucucauuaaaccagacugcaagcuccuggaaggcaaggacuacacuucaggcaaaacagcagcucaagcucuucccacuggaaagggcccuagaaaccagcuagcccaaucccauaucuaaggguaaaggaaaccugaggacccagugaggggaagggcuagccccaggaacuccaaucccccaguucugagugcaguguuuuucccaccauacccaaagccuccugaaaguucucugcaaacacuuccccucaaauaaucaacuugguuuuggaaaauaccucaguuucucagugacugcaccagggucagucaagauagacugcucccaacaacaaaccuccuccaagacggaagugaagccucagcccccucuugcacccacucacuccaggacuccacacagaaaaagcuagacuuuguuugccagacuauuuugaugugaaauucuaauccagucuaaucccugccggguguaagaacucuccacaaauguccuccuaaggccauuccauaagcaguaaaccauuaucccauuugcauuccuaagucauuucuauuaaauuccucucaaaaguaaauacagaccagguacaguggcucaugccuguaauccagcacuuugggaagccgaggcagguggacugcuugaacccaggaggucgagacaagccuggccaacauggcgaaaccccaucucuauaaaacacacggggcgcgguggcucaugccuguaaucccaacacuuugggaggccaagacaggaagaucacuuaggcucaggaguucaagaccagcuugggcaaggugucaaaacucugucucuacuaaaaauuacaaaaauuagcugggccaugguggcacacgccugugaucccagcuacacgggaggcuaaggcacaagaaucgcuugaaccugggaggcagagguuucagugagccgugacggcaccacugcacuccagccuaggcaauacagugagacccuaucucaaaaaaaaaaaggcaaaauugcuuuauauguauauauucgcaaacaagucuaaaaagcuaaacuguuuauaauggaucucuuuggggaaugcagggaaguagaaagagacuuaggcucggcugggagcagugccucacaccuguaaucccagcacuuugggaggccgaggcaaguggaucaccugacaucaggaguucgagaccagccuggccaacauggcaaaacacugugucuacugaaaauacaaaacuuaagccaggcaugguggcgggcaccuguaaucccacuuacucaggaggcugaggcaaagaaucgcuugaaucggaaggcagagguugcagugaggcaagaucgugccacugcccuccagcccaggcaacaagagcaaaacucugucucaaaaaaaaaaaaaagaagcaaaauaaaaauaaaauuacaaaaauuagccaggcgugguggcacaugccuauagucccagcuacucaagaggcugaggcaggagaaucacuugaacccaggaggcggaggaugcaguaagccgagaucaugccacugcacuccagccugggugagagaaugagacucugucucaaacaaacaaacaaacaaaggcuuaggugcuuauauuauaagcuucuuguaucauuugaaauuuuuuuccgaagagcacaucauauuuuuuuuuaaucauuauccugaaucaagggccaaaggaaaauaaaacuuaaaacaaucauaaaccuagcugggcgcgguggcuaaugucuguaaucccagcacuuugggaggccgaggcgggcccaucgagaccauccuggcuaacacagugaaaccccgucucuacuaaaaauacaaaaaauuagccgugcgugguggcgggcgccuguagucccagcuacucgggagggugaggcaggagaauggcgugaacccgggaggcggagcuugcagugagccaagaucgugccacugcacuccagccugggcuacagaguaagacuccaucucccaaaaaaaaaaaaaaaaaaaaaaaaaaaaaaaaaaaucauaaaccuuuagaaaucuauacuuguuaauauagacaucuauuuuccugaaaguacucaaacuguuggcagcugcuaacuucacgaagaugaauaggaaaggugguguuugcuaucauuuugaaccucuguggacuuaguaaauuuucuuacuuucuguauuuucuaacgugucuacagagauuauuuguuaaaggagguuacgggucauuuuuguuuuuuuuuuuuguuuuuuuuuuuuuuggagacaguggugcgaucucagcucacugcaaccuccgucccccagguucaacagauucuccugccucagccucccaaguaccugggauuacaggcaugugcaaucacaccuggcuaauuuuuguauuuuuaguagacgggguuucgccauguuggccaggcuggucuugaacuccugaccucuggugauccacccaccucggccucccaaagugcugggauuacaggugugagccaccgcgcucagccuguuuucuuuguaucuuuuuauauuuaaggaauucauauauauauauauauauaauuuuuuuuugaggcaaaaucucacucuguuguccaggcuggagugcgggguguaaccucagcucgcugcaaccuccgccucugagguucaagcaauucuugugcuuuagccucccucccaaguagcugggauuacaggcaucugccaccacaccuggcuaauuuuuuuuugguauuuuuaguagagaugggguuucaccauguuggccuaaccucaagugaucugcccgccuuggccucccaaagugcugggauuacaggcaugagccaccgugccuggccucuaauacuaauaauaaauuugaugacucccagggccugcccugugagacacagccccaacuucccagcccacuucucuagugcccucuucugccugccaccaaccaccugccacccuuggcccaucacacccucuuacacauuugcuagcacaucuuaucuccucugcuugccauguccuugccuccgucccauuuuguguucccaccugucuguuaaggccccaucuccacugacugcuucuccaccccugcccucugcucccgcuguagccacauauacaacacagagggugagaucugcaacaaacugaggaguaucugcacccucagacgggcagcugcuccucaccucuaacuggugccauuugagaguagagaaucagaguuagagauucuguuucuuucaaguaaaaccagaaauauugaauuuagugcacuuuucaaccauuaagcaagcacuuacuaagcacuuacucugugccagcaggcacgguucuggaccuguggguuuagcguucaauaaaaaaaaaaacaaggcugggugugguggcucaugccugcaauuccagcacuuugggaggccaaggcaggaggaucauuugagccuaggaguucaagaccagucugggcaacauagcaagaccccaucuguacaagaaaaauacaaaaauuagcugggugcagugacccacaccuguagucccagcuacuccaggagcugagacagaaggauugcuugaguguggaaggucaaggucacaguaagccgagcuugugccacugcacuccagccuguggagacgcuccaaacuuuuggagacgcugucucaaaaaaaaaaauaauaguaauaacacacaagaacgucugccuccuggagcucacauuuuagcugguaagggaagggaaaaccaggagaaagguaagacaagugaaauauguauguuagagagugauaacugccaaggagaaaaacaaaauaagaaaagaggacauaaaauggggaggugaugucauucaauucuucaguucaagguagggacuuagacuggagucauaaauucuauuuucugagacagucucacucugucgcccaggccggaguacaguggcgccaucucagcucacuuacaaccuccgccucucagguucaagugauucuccugccucagccuccugaguaguugggauuacaggcaugugcuaccacacccagcuacauuucguauuuuugguagagacgagguuucuccauguuggccaagcugguuuuaaacucccagccucaagugaucagcccaccugagccucccaaagugcugggauuacaggcaugagccaccgcacccagccuggagucauaaauucuuaaugugaauugucucaaaauguaaauacuguuaaggaccuagcaggcuacauccaguccacagaccagcaguuuugccaccucugguugugaagaccaagacuggaguugggggagaaaaaaaaaaauuaggaguauaauaauauaccuuauauuuucauacagauuuacaauuuacagaagugcuacagccgucauacuucuuuuacagaaagugaaacugcuacauggcuuguaaguggcagaaccgggauucaaacucaaguucucccuaacauccuggaagccaagggaaaggaguaaugaaauaugaaagugagaaacacuguuggcugggcaugguggcuccugccuauaaucucagaacuuugggaggcugaggcaggcagaucacucgagcccacaaguucaacaccagccugggcaacauggcaaaaaaaccccucucuacaaaaaauacagaaaaauuagcugggcaugguggugcacgccuguagucccagcuacuugggaggcugaggcaggaagaucaccugagccaggaggucaaggaugcagugagccaauugcaccacugcacuucagccugggugacagacaggaaaggagggagggggagggggagggggagugggaagugggaaggaggaagggggaagggggaaaaaaagagagaaagugagaaacacucuccuaggcuggaggaccuaagauggaucaacgacaccgaggaugaguuucagcaggugacaguuggcucuaaagguaagaaguagguagaccaugggcagaagguaagagacaaaccaccugacuucauaaaggggagaguucguucuuccuggaagcacugcuuggugaacugugcaucuccaaaggaaagaaggaaagauaaguggagauguugcuccagcccuaucaccaguagccugaaggauuucaacagcuccucaccagcucccugucuucucccuccuacccuuucucugcagcgugccagaggagcucuaaaaugcaaaccccaccacuucagccuuaguuuagaacccuuccagggcuccacauuugccuacagaauaaucccuaccccugagcucaucaggaacccuucacagacuggccccagccuuccugucuagccucaucuccugccuuccuccaaacacgcaaguguccagggaacgcaggagagcacggaugagagaagggagggccagcagugccccaagcacuccagacaagcagcauuuccugacauuuugggcauguauugcucccuaugcccgaaauguccugucccccuccuuguccaucaguaagacucagaugucaccucuucugugaggaccuuccugauggucagucgcucauuccccugacccuuggguacuccaaacccaucccuguuacagcucuccacucacugccccguggugagugacuucucagucugugaagcauggcccgauuguccuuggcaacaacagccccaagccugguguuccacgugugcacuagacaugugccaaguggagaugcaggaaaggggaugugcaaaagcucuaucacucaagagccucaauacccagugcuuuacugugccugggcuaacucacccugcagagagcuccgcaagggagggacccuggcaccuucgucuugccaccccuacaucugaugccaggcuagaacagagcaggugcucccagaggcagcagugcagagaacacuggcuuugaaguuggacuaaucugauauuaccccacagcucggccauuuaccagcugcauggccuuggucagcuuauuuaaccuuucugaaucucaucugcccagugccuacacagaguaggugcuuaaauauuuguuaauugauaugaagguauuuacuaauggauauguggagauaauaccaccuacuucacgacacuuuugggauuaugugauagucuauagaucaaacaucgagaaucauaguugaccaagccuuaucauacaugcucaaauuuucccuuccauucuuucaacucuaaauugaauguagacauuuagaugucauaguaaaaauaaucuuuacuacaugaaggugcucgucacacaguuagucuccucugugaagaguaaaugaagaucaucagcuaacaugaaacaucuccaacuguccuggagguaagaagggaacgaugugaggucagccagcagggaucucuaccgauucuaaaaugaccagucuaacaccuuccccucagaauauucugugaccuggcacagagaaagauguguuaaaggcuggugggagaagggaacaaagucaacuguguaacccucaaaguuuacagagcaaggccaggcacaguagcucaugccugugaucccagcacuuugggaggccaaggugggaggacugccugaccccaggagauugagaccagccuggucaacauagggagacucuugucuuuacaaaacacaaaaaauuagccaggcaggccaggcgcggugguucacgccuguaaucccagcacuuugggaggccuaugcaggcggaucacgaggucaagagaucgagaccauccuggcuaacauggugaaaccccaucucuacuaaaaauacaaaaaaauuagccggacaugguggcgugcaccuguagucccagcugcuggggaggcugaggaaggagaauggcgugaacccgggaggcggagcuugcagugagccgagauugcaccacugcacuccagccugggugacagagcaagauucugucucaaaaaaaaaaaaaaaaaaauuagccaggcagguuggcacacgccugaguuccaccuacuugggaggcugaggcaggaggaucgcuugagcccaggagguugagaugcagugagcuaugaucaugccagugcacuccagccugggugacagagcaagacccugucucaaacaaaaaaaaaaaguuuacagagcagacacaggagagcagugagaggacucuagaaggaccugaggaugaacaugccauuuuugugaguaccccucggcugugcuugcugaaggacuuaggaccaggacagauaaguucacagaugaccacagagcaagggaggaagagguacagaugaagguggaagguaagagguguuuuguaauucaucaagaugagucaaguacuguacacuugguuuuuaaacugacaaacauauacuccaggaagagacuucagcaguccuagagauggacaaucaggguaauauaaaaacccucacucgacaagagugaucuuucuacaaugcaauuuccuuuucuguguagagcccuguauaaauucucuaauugcuuagaagacaauccagcuggcacaguggcucaugccucuaaucccagcgcuuugggaggacaaggcaagaggacagcuugagcccaggaguuugagaccagccugggcaacacagugagaucuucaucucuacaaaaaaaaaaauuuuuuuuuuuuuuuuuuuuugagacugagucucacucuguugcccaggcuggagugcagugccuugaucucgguucacugcaagcucugccuccuggguucaugccauucuccugccucagccucccaaguggcugggacuacaggcacccgccaccaugcccggcuaacuuuuuguauuuuuaguagagaaaggguuucaccguguuagccaggguagucucaaucuccugaccucgugaucugcccaccucggccucccaaagugcugggauuacaggcgugagccaccacgcccagcccaaaaaaaaaauuuuuaaucugcagggugugguggcacaugcccauauucucaccuauuuaagaagauugcuugaccccaggaguuugaggcuacagugagacaugauugcgccacugcacuucagccugggaaaucguuucaaaaaaauaaaauaauuuuuuuaaaauaagaauacaauuggccgggcaugguggcucacaccuguaaucccagcacuuugggaggcugaggcggucagaucacuugcagucaggaguuagagaccagccuggccaacaaggcgaaaccccaucuccacuaaaaauacaaagaucagcugggcacgguagcgcacaccuguaguccuagcuacuugggaggcugaggcaggagaauuguuugaacccaggagguggaggcugcagugagcagagaucaugccacugcagucuaccuugggugacacaguaagaaucugucucaaaaaaagagaauacaauucuaagggaauugucccuuagaauaaaauccauuguccuuaggauaaaauccaaauucccuuggcuacuaaaaccuugcugcaauccacccccuaccucgcucuccagccuccauucugggcucacuacuccaucauaccacauugugggcagucaugcgaccacuccuccagcccucccaccagacugcucccuagaagcucaucacucccagacccaacagugcguggcccacaauaacccucaagugcuucuacugaaaccauuaaauuggguucuugcaaaacaaggccccuuuagccuuaaugagagaaagguggguccaccuacaauuagacccacccagauuagagaccacacccucaaaccugaguuccaggucuuuaggacagccagggauucagcacaccugaaagacuauguaaaguaaauuuccugccucucccaguaacagguuucacucuaucuacaaauugucagugaagcuaaauugaaucaacugguauuauuuuaugcuguacccaagucuacugaaauuguaucaaggauuaauggcaagauuaacuuguaugagcaaagucccauacuuaccugauuugagacaaauucagcauuccuacgcuagagacagggcuuuucaacucacuguuauuugugaauuuaaaaagaaaaaauccacgugcccacacaagaguucagacagugagguccacauugaaaaaaccaggggcacuuagccuaugaguccccaagacaaacagucaaauacagccuccuuucucagcuacacaaaagaaaccaccaaggcuaggcuuaaaaacaaacacauauuccuuagggccuguuuuaauugcuuuuguaaaguaauuuucucuagaggcagcccaucugaucccaaauaagacuguuucuccacuccuccacaggcagaacuucucacuucuuaagacucagaccuucaaaaucuaggaugcaaacucuaaggggaaagugaucuguuuuguuaguaaagaaucccaaacaccuagaacauugccuggcacaaacuaaacccucaacacauauuuguucaaagccuugauugaguagaugagcgaaauguaucuucucugugaagcacuccuuggucugcucaaaguacuuaugaaacccucuugcauguuuccauuagggaauuaacaauuuaaccuccaaaaaaaaaagaaaaaaaaaaaaaacuagcaccaccaagcaaaaccccaacaugcuggaaacuaugacuuuggagaaaagcuacaccaagaaccgcaauucuugguucugugauucagagugguucaaaguacaagggcacacaauucuuuaaacugacaacuaaaauaaauacauucuucucuugagcacauaauccaccuucuacugcagugauucuccaacggggcugcacguuuacaauaaccuggggagcacugaaaaaucuggaagcccagaccacaccucagcccaauaaaucaguuucucuggaguaggaggcaggcccaaguauuuuaaagcuuuccaaguaguuccaaagugcugccgaguuugaaaauuaccucucuacuuaacuucaggccacgcgccuggaagacugcuaggucuucgaguuuggggggaguggacuucuagaaagaccuuccagaccuucaaggauguaauguuuuguagucuccuuccaccaaaauucccauccccaaccucucaagccauguggaaggggcuucaccgauugcaaagcguggcagccaccuaccuuaaggcugcaggcuuccuccucuagagaagccauuucuuccaaagaggcguuggcaggacgcagaggggaucccccugaagacaggaacccccgaguguuccgaaucaggcagccuuuggaggcggccccgcccacaccagggcccaagaaauguggggagaaggaggaggaggaguuauuucugcggcgggaugagccccaggauaaccuccgcgagcaagccacaucguccuccuucugggcuuucaggcgcuuggggcugcugggcccuccagaacgcgacgcagaccucugagcuggccggcuggagggggccacaucacagggcucccggaggcagcugcgcuugcggggacacccuuccgacgugcugcuccaguugugcuugaccuugccccgcucggacgccaugggcaccugcaagguacagggggccuggauuccaacaccacccuuccuggcgaccccaccucagauucccgccaccccgggcccaggaggacggcaagacauaagggcagagccaggggcuagccucacugaccuuucccucuucuuuccacugcccaucacaguucucaagguuucagagaugccaaaccguguuggagaagucaaagcgauccaaaauugacuaaaggcugccgucgguuuccaagcccacaacgugcuucugagaucaggaagccuucacuuugcccagcgcuacuucggagaugccuaagcgcuuccggggcuacgaagcgcuuugaucaguuugcaauauaaagcccuuuagaacugucaagcgcuucagaagaccacauggcgcuucaagauccacacauggcugccggauccgcggccccggggccgggcgcuuagcccguaggccagggccagacccgggcgccgcagcccgcccugcuccugcggcccaaccagacccgggccggaaggggcccgagcggccccucgggagcuggcagcgcccucgaccgccaacucaggacgccccccgccggcugccgcagcugucccgccgggcagcccgccgccugccccagcccuacagccccgccuggcccggccuccgcccgaacugcgaccacuccggccuccguggcgcccgcccuccggaacgagcccugcggcccgcaggccggagagcgacaggggcggggccugcgccaaacggaaggcgcccauugcucgaccc

SEQ ID NO: 14853 - RNA, 644 nt, Homo sapiens
caugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaag

SEQ ID NO: 14854 - RNA, 9442 nt, Homo sapiens
ccccgcuccucaccagugcucggcuuuaucucuccacgucaacacggcccucaucacggcuucccuuacggcucgggcuccuccuacccgccucagcgucugucucagcaaccgccucacuaacggucgccacuccacaagccacuuuggcuaccugcguuaccccuggcaacguacaugcgcgguaagcugagugcgagggcgccuugcuccgagcgcgcauguccgaaagggaaagccagaaaagcagcaaaagcaaugguggcacuggagccccuaaggcgccagcgcaaccagagcgcgagcgauuggucggggcgugugggggcggugcgucuuccucgagaauggauuugauugguggagcguggaaauggcggcuguagccgagggggcggccggaaagcagcggcggcgucuggggcgcuuucgcaacauucagaccucgguugcagcccggugccgugagcugaagagguuucacaucuuacuccgccccacacccugggcguugcggcgcugggcucguugcugcagccggacccugcucgaugggcacgacugggcuggagagucugagucugggggaccgcggagcugcccccaccgucaccucuagugagcgccuagucccagacccgccgaaugaccuccgguaaguuacuguccccuuuugggccucaguuucaccaccuguaaaaugguaucgggagaguggacagugugugggccuuucuaaccuuugacagagggucggcagaaaccucgaagcccacggguuuaguuacuagggucuggagcccaggugcucuuccugugcgaucagcccuggggugcgcucgacuuccucaucuaagaugacuagggagacugggggggagccgggagguuuugugaaagagguccccuugggguuggaggauccuaggaagucauuagacuacgugugugauaggagguuaagauuuaccuacuuuuuucaaaauuuaauacuaagaacuacuuugaaagaggcaucaccuucuuuuuacagagucuuuuaccgagacuuugagauguuaaguaacuugcugcuaaacuuacagcugguagagcuggaauuugagccccagucucuuaagaguuugugcugauuccaccaggcuucaguauuuuuaucucuaaaauuguaaacaauaucauuucauaagauccauccagcuccucaaaauuauuuuaccccaaauuacaucagaaaaccuugauucuaauucuaguucuugcaguuucccuauuuguagaaaagaacuuggguuaaaugaucucucuagacccauccaccuuuuacaaucugugguuuagugauuaggauacacuuuacugaaauuuuuuuuuuaauuuuaaaaguauguuuucaucauagaagacacauuggaacuuuaaugaaguuuuaguuuaguggguuuuuuuuugagaugaggucucgcucugucacccaggcuggagugcaguggcacaaucauagcucccugaagccuugaccugccggacuuaagcaguccuccuaccccggccuccuuaguagcugggaccacagguaugcuccaccacgcccgguugcuuguuuuuuuuuguuuuuuuggguuuuuuuuuucauuuuuugcaaagacgaggaucucacugugcucuccaggcuggucucaaacucuugggaucaggugaucuucccacuuccuccucccaaagugcuagcauuacaggaaugagccaccuugccuugccagcuuuuuucaauaacaguaugggggagaaguauuagaccaagauuugguagacuuggguucucgugucuguucugcaaguaauuuaaccugucacucaauuuuaucaauaaauugagaguaaaccuuauuguaccuacaagguuaccaugaggaucaagaaugaagaagauucaaaaauucuguaucaaauuauuuaccuucuggaggauuacaucugaugaaagugauacacacucucucccagaaauuuuacauuauguaaaacuuuuaccucauuuauuugcagagaagacaguguaacucacugauuuauuuaagcauuuucuggugcuuaagagcuuagcuauugguucauauucucaaauuuaugguaagugcccccagaaaucuuuauaauagcccuacucagugauuaauccgaaaaguuucuagcuugacuuuuuuguugugcagagauuuccaacaccuuuuaaccugugcuagaggauaugggaagcuuuuggaagacaggaaaauacucccauagcacaagacugguccacacugacuuuaaucucccucauuuuaauauggauaaucuaugugguuccugcauugucauggauuaaaacugaguaggcaguggaagauaaauuuuaaauaaguuaaucacuuagacuuuguuuuuccagcaaagaagauguugcuauggaauuggaaagagugggagaagaugaggaacaaaugaugauaaaaagaagcagugaauguaaucccuugcuacaagaacccaucgcuucugcucaguuuggugcuacugcaggaacagaaugccguaagucugucccauguggaugggaaagaguugugaagcaaagguuauuugggaagacagcaggaagauuugauguguacuuuaucagguaagcauauaagaugguaaagauaguacagccaaaugauuuugucugggcagguagugggagcauagcaggaaucuuagcuucuuuauauuuuuaccauaaaaccauugcagauucuauucuuucaauguugcuauuaauuacaucaagugauuuggggaaaauuacauacauuuugucccuccuucugugaaugguuaacggguagguugcauuuuaguuauauuuauaaauuuauauugucauagaggaaaccauuuaaaagugccauuuaucacucuuuuucauuuuuaaaugacagauaccuauggcaacauuuggaaauuaauuagaaaucugaaaugugguccaguucuuuuaaaagucccuucuauuuacuagcaguaaguuuccuuuaauaucauuuucuagcccacaaggacugaaguucagauccaaaaguucacuugcuaauuaucuucacaaaaauggagagacuucucuuaagccagaagauuuugauuuuacuguacuuucuaaaagggguaucaagucaagauauaaagacugcagcauggcagcccugacaucccaucuacaaaaccaaaguaacaauucaaacuggaaccucaggacccgaagcaagugcaaaaaggauguguuuaugccgccaaguaguaguucagaguugcaggagagcagaggacucucuaacuuuacuuccacucauuugcuuuugaaagaagaugaggguguugaugauguuaacuucagaaagguuagaaagcccaaaggaaaggugacuauuuugaaaggaaucccaauuaagaaaacuaaaaaaggauguaggaagagcuguucagguuuuguucaaagugauagcaaaagagaaucuguguguaauaaagcagaugcugaaagugaaccuguugcacaaaaaagucagcuugauagaacugucugcauuucugaugcuggagcauguggugagacccucagugugaccagugaagaaaacagccuuguaaaaaaaaaagaaagaucauugaguucaggaucaaauuuuuguucugaacaaaaaacuucuggcaucauaaacaaauuuuguucagccaaagacucagaacacaacgagaaguaugaggauaccuuuuuagaaucugaagaaaucggaacaaaaguagaaguuguggaaaggaaagaacauuugcauacugacauuuuaaaacguggcucugaaauggacaacaacugcucaccaaccaggaaagacuucacuggugagaaaauauuucaagguauccagugcuuucaagcacuauuaaacauuaugugaugagaaauuuauaaugcugcaucuuguauucgugcccauacaugguuaagaugugaaaauagagccaagaaauagggccaaauaugagauaccaguugauccuaauacuuuaucuuaaacugauauucaagcaguuuccuauggcagagagaaaaucggcugacugcugucgugaugccauggcaaaggagaguauuacuauuaacagcugccaucgucucucccuggugcagcagcugggacucuccuccucagcagugcuuucccuucuucccauccucuuuccagccaguaaucuuaaaacuugaaggaaaauuaaaagccuucacuugugaaaaauuuagggaaggcuucuuauauacauaaaugaguggagaauaguuggugucuucacaccccuccugauacuuacuacuaagugugacuuccaauuuaauuuuguauauaucauagucauuuuuaucuucuauuuuaauguaaugcuucucuaaaaugcuuuagagcucuaaauaauucaaaaguauaaucacauaguucaucuauuauuuguaauaugcucuuaauacagaauucagaacuuagcaguuuugucuuuauaauaccucagugaauaagagauaaaagggagaccuuuugagcagcccuguauuaguuauucauuaugccauuaugguauaaugaauaacuccuuuaaagaauaauaauuuuacuuaaacuccuguggggaaacagccuggagaaauuugugaagcaggagauuagguuugauucuuguucccaguucuacccaugauuuuaugucuuuucugugccuggaguuucucugccuuuaacacaagauggccauauauaccuaggaacugcauaagaauucuucaagucuguguccuagacacugagcuucuugaagaaagcuuugagguuuauguagauuuauugcuagcaaaaugggcaaauauuaaaaacuuuuuuuugugguaagagucuaguucucaacaugagaugaaguacucuuaguacgagguguccaugaaauagugaagacacccauuggcuuagcuagaaauugccaaguaaaccuggcauaaaggagacuaguaauuauucauaggagcccacagaaaaaguugucaaaucagagcagucagagcaguuuccuuuguucuuuuuuuuuuuuacucucuacugggcuuuaccuacucaaacuaaaauagcgaaaaaacaguagucuaauuaucuggagaccuggauacuuguuccaguuuauagucaaucccaguaucauuuugggaugauugcuucauuuagaagcuucacuuucuucaucuguaaaauagagguaaccauccugacuaguccuguuuuucacaucaaaaauauuguaaaaugagaagugaaaaagaugcuauacaaaugcaagguauuauuaacugauauucaaauugcgaggguaugguuaaggaguauuacaugugauuuuagaaauuugagaagucugauaacacugguucccaauagauagagguucucaauagguaguugucucagguguucuaggguucaaauuguagguuuuucugcagauucuguuuugucuguaucccuuuuuuugguaagcguaaaaguaaguguucacugcagaaauuuuggaaaauacagaaaaguaaagaaggaaagaaaaauuagcacuuggcaacaaccauuauaucauuuuggcuuauuucauucuuaacuucuguauuguuauuuauauauguuuccccuuuuuuauaaaauugggaucauauguagacucuugcuuuuucauuuagaaguuaauaggaaaauauucacaauagucuaaaaaauacuuuaaugaccacauuauacaaaugcaucguaauuuaaaauauuccauacugccuuuaauuuuucaauacuauaaacucugaacauaagucauaaagaacuagugucacagagugguuaaaggugaggacucaggagccagacugucuggauuugaauuuuagcugggacacuuaguaucugugugaucuugagcaaguuacuuagcuucucugugccucaauguccuuaucuguaaaguggagauaaaaauaguaccaaguucaugggucauuaguuagauuaauuggguauuuauguaaagggcuuagaauagugccuggcaugcuuuguaauaguguugauauuauuauuugcaucccucaauauugcuuuaagcuaaaccauagacuccauaaaguguuuacuuuuccuuuucagaagauaccaucccacgaacacagauagaaagaaggaaaacaagccuguauuuuuccagcaaauauaacaaagaagguaucccuuucccaaucagaacagcaaauucuaauuccauuuuggguuuucaauucugaugcacuauguuuguuuagcucuuagccccccacgacguaaagccuuuaagaaauggacaccuccucggucaccuuuuaaucucguucaagaaacacuuuuucaugauccauggaagcuucucaucgcuacuauauuucucaaucggaccucagguuuggggauuauuaucaucuuugucuuaguagagacagugugguagggagaaagcacugaauugaggccuggguucaaaguccauuuugagugugucaccugggauagggcauucccccuucacccuuaaacucuucaccuaugaggaaaugagacuggaugacauccaacagaccuuuuagaauaaagagguagauuuuauuuauuuuauacuuccaaauucuuuuugaucaucagugaaaaucaguuaacguuucuccacccucuuucauguguguuuaaaaguaucuuuuucacugaauguaccuuguguucuauaugcuucuacucucauuaucugcugaucugaucauuuaaaagcuaaucaugcaaggccaguuuucagcauaauuuggacuauuagcccaauauauuagcaguuuuggcauuugauucugaaagugguugcugguucagauaauggcuucucaccaguguuuuuuuguuuuuuguuuucuuuaaaaaaaaaaacccucuggaugagauuucuaugagaaacuacuugaacaugaaaucagcccaccuggagucuuguaaucauucaguuacuuuuacuucccaggcaaaauggcaauaccugugcuuuggaaguuucuggagaaguauccuucagcugagguagcaagaaccgcagacuggagagaugugucagaacuucuuaaaccucuuggucucuacgaucuucgggcaaaaaccauugucaaguucucagguauuuuccuauacacccaaaggaaaaacauaauacauugugcuuauuuaagagagccacaccuuaaacuuuaauguucucagauacuauauuaauggagguuuuucagcucaagcacccaaggcauuuaaaaaaguccacuuuccccaaaccacagucucccacugaccuaaacaauaaaucuuugcccagcacugggucaggcaugugggcagaauuaggggaagaagucagugaagcagaaagcccaguucuugaccucaaggacaugacuucugucuuguuagcacagcacaaaagagugguuaggaauuggcaaaugauaugggugcugcaggaauucagaaggaagaguaaucacaacugggguugcugggaaagagccuuuccugucccuuucugcuguucucuccauccugccccaucaccacacauuuugggagggugucuuuagaagcugaccugauaaugugggauguuguauucuucagaugaauaccugacaaagcaguggaaguauccaauugagcuucaugggauugguaaauauggcaacgacucuuaccgaauuuuuugugucaaugaguggaagcaggugaggcucacucccauccauaauucagcacauuuggucucugaggcaaaauaaguccaccauuaugguuaagacuauuuauuggauacaaaugcuauuacagucacaaacaauuguguuccuggcugcggggaagcggguggcauguggguuuugggguuuuugaucaguaggcgcucccaaguccacaaagaccaguccagcggcguggccucugacucaucuccagugguuugucaccucuggcccuguuccugucauucccuauuugugugcuaucucuaagccugacgugguuuuccuccugucaaaaguacaccacuacaggaaagcaggaagguuugggccugcaauguaugcauauuggguuucucuuaguggucucagacuacguuuguggugacuggguccugcuucagcccuguugaauaugcccagccuguggcaugcugguggucauccuggcagcugguggguggccugguaugcugcccacucagcuugagacucacccucaugcauucagccaguaggucuggccaagccugaacugaaggaccaugguccuaucccagcuucaucagagcaauccauugugaccugagaauccauuuaaccucucggucuagaaccuccuucuggaaagugagguauuaauacuugacucauguuaucgccaccccacauucuaagucaugguugaguaguaauuuggacaguaccuuguaaauugugugagauuaccuuaauauaagguauaacuuaaaauauucaugaaucccaggagguuaaagguuauaacuuuuagguaugguaucguaauguacugucccccagcaaacauuuaaaaagccaauuuuaaaaaauguauuucugacuaaguuacauuaaggucucugccucuguaucuuauguuucuuccaggugcacccugaagaccacaaauuaaauaaauaucaugacuggcuuugggaaaaucaugaaaaauuaagucuaucuuaaacucugcagcuuucaagcucaucuguuaugcauagcuuugcacuucaaaaaagcuuaauuaaguacaaccaaccaccuuuccagccauagagauuuuaauuagcccaacuagaagccuagugugugugcuuucuuaaugugugugccaaugguggaucuuugcuacugaauguguuugaacauguuuugagauuuuuuuaaaauaaauuauuauuugacaacaauccaaaaaaaauacggcuuuuccaaugaugaaauauaaucagaagaugaaaaauaguucuaaacuaucaauaauacaaagcaaauuucuaucagccuugcuaaagcuaggggcccacuaaauauuuuuaucggcuaggcgugguggugcaugccuguaaucucggaaggcugaggcaggaggaucauuugagcucaugagggcccaggaggucaaggcuucagugagccaugaucaugccacugcacuccagucuggaugacagagagagacccugucucaaaaaauauauauuuaaaaaauaaaaauaaaagcugaccccaaagacaaauaag

SEQ ID NO: 14855 - RNA, 525 nt, Homo sapiens
uuuuucgucugggcugccaacaugccauccagacugaggaagacccggaaacuuaggggccacgugagccaccgccacggccgcauaggcaagcaccggaagcaccccggcggccgcgguaaugcugguggucugcaucaccaccggaucaacuucgacaaauaccacccaggcuacuuugggaaaguugguaugaagcauuaccacuuaaagaggaaccagagcuucugcccaacugucaaccuugacaaauuguggacuuuggucagugaacagacacgggugaaugcugcuaaaaacaagacuggggcugcucccaucauugauguggugcgaucuggcuacuacaaaguucugggaaagggaaagcuccccaagcaggcugucaccgugcaggccaaauucuucagcagaagagcugaggagaagauuaagaguguugggggggccuguguccugguggcuugaagccgcauggagggaguuucauuaaaugcuaacuacuuaaaaaaaaaaaaagaagaa

SEQ ID NO: 14856 - RNA, 11707 nt, Homo sapiens
uuuaaugaaaaagacuuagaacaauguauuauuuacauguaaauaagaaaagagagcagaauccccauauccucuucaaaggaagggagacggcaggccauuuaugagaagaaaguccauauaaaccccauuaaguagaaucuggaucuaaauacuuccaaacaggaguacacagcaggugaacagucucccucaucccacugaucugcugcuucagauaagaucagcaacugaaagugaagaaagaaacagauuaaggaacaacacaaacaaaaugaaaauuuguuaacguaaauuuaacuaaaaccucacaacagacuucucaaaacaaaaaacaggccagacauaguggcucacgccuguaaucccagcacuuugggaggcugaggugggcagaucauuugaggccaggaguucgagaccagccuggccaacauggugaaaccccgucucuacuaaaaauacaaaaauuagcuggcuauggugcacgugucuguaauuccagcuacucaggaggcugaggcaggagaauugcuugaacccaggaggcagagguugcagugagccgaaaucgcgccacugcacuccagccugggugacagagcgaaacuucgucucaaaaacaaaacaaaaaaacccacaacaacaaaaaaacaaacucaggugccccaaacuaagaauagggaaguucccucuacaauuacaguagagcuggacgauuuccuaccguucaucggcaucucaucaaucugaguggaauaguacugcucgauaucucugaggaugcggaugucgucauucuuuacaaaguuaauggccacacccuuccggccguaucgaccugaucucccaauucuucaggaauaaaauaauauuacaguuaguauauauaacaaucaagauuuaguaaaugugucacagaagugaagccaaugagagcuugcaccuuaccuguguauguacaauucucuguuauuagggagaucauaguuaaugaugagggacaccugagggacauccaacccccuggcccagacaucuguagaaauaagcacucggcugcaaaaagaaagaguguuugaggcgauuaaauuacucauacaaguguaagacuggacuugcuuccauugcuaauuuuaaggaauccuggcugcagguccaaaauauacgagauucuccucucucaacagucugucugcaaacgugaagccucagggacagcaccagaaaccccugugcagaggggcuguugguggauuuaguuacuucggucaugugcuccaucagauuaaaaaaauagacaucuuuuacuagacuaucuuuaacuuguuuaaucgguccuaaaccaauaauugggaaaaauacuucacuuuugccuagcaaaaaauuaaaaacgguaacuucagccgggcauggcggcggcuuaugccuguaaucccagcacugccagaggcugaggcagauggaucaccugaggucaggaguucgagaccagccuggccaacauggugaaaccccaucucuacuaaaaaugaaaaaaaaaaaaaaaaauuagccauuccagcuacucgggaggcugagacacaggagucacuugaaaucaggaggcagagguugcagugagccaagauugugccacugcacuccggccuggguaacgaagugagacugucucaaaaacaaacaaacaaaaaaagacacacacagcacauauguuaagcugaccacaaggugggcaaagaaggaagucugaaucaaguucaaaugaaugaaaccacccaauccacgcuuucugaccacuguggaauuaaacuaaucgaaacgaugaacagaaaaccccccuacuuacuggaaaagaagacacacgcuuguaaccaaggugaccaaccuggcuaguuaaggcuaguuaucaccucaaccuaaguauuacaggagcacagcggaccccuccuuaacuggaagguuuucugcucacccagggccucagcuuucagagcagaagcuuggcauccccccggguguggggccugcacuuaggcgguacauaugaagugcuuagacacagucuagcaaacccugaccugcagagccacagcauagcagacccaccuggcgcccgaccggaacuccuucaugauggacucccgcucuuucuggggcaugucuccaugcauugaggauacagugaaguuggcuucccucauuuucuccgucagccaguccaccuacaaauccaaucaacagaugcuacugcaagcuaguauaccaaagcagagaugugcauucgggacuuuaccgcaucauuugcagaaccaguaucaauauucguaagguaacugcucuuaaaacucagaaucauccuaacuggauguaaaaacuuuuucccagaaaauguuggggugcacucacaaaacccucuuacuucauuuucuccauauaaugacucuauggggggagggggccaggugugcucauucucauuugaaauuugaauuccaaucuuguuagaauguagcccaacuccuuuccuuucucaggaaaguggccgacaguucucaggucugccuccacauuaccaucaccuggggaucuaaaacuacucaggccuggguuccaccuucagccaacgaaaucugaaucuuuagggguggcugauaucgcuguucuguaaaugaaguuuuaauggucacagccacgucugaccguuugcauauugucuacagcugcuuuuacaagagaacacauacccugaaagcuuaaaauauggacaaacuggcccuuuacugaaaaaucuugauuuaugucauucagagacucaaucugcaguuucccuucagcacauggaugcugugcagugccucuuaccuuucuuuugguguugcagaagaugaccgccugagugauggucagugugucguagaggucacacagagugucaaauuuccacucuucccucuccacugccacgaaaaauugcuugaugccuuccagagucaauucaucacugaaggacaaagacaaauccuguuacauacucauccuuccuucuaggacuugagggugggccaagccaggauccagggagacccugguggaaaaggucacaccgugauaucuggugcagacccagcagccccagcccuguccuccauccuaucaccacuuccgucacacaggccuccauucuguauccuacuuaacauuucacaaugugcaccacauggaauacgauucuaaacgaaacacugauaaauaaauagucaccuaauuuuuaaauuuagaauuauugguucaaaccacaaugaggauuauaaaagauggguuguuuuguuuuguuugagacagggucuugcucuguugcccuggcugaaguacaguggcacaaucaaagcucacugcagccucagccuccugaccucaagcgauccucccaccacagccuccugaguagcugggacuauaggcaugugccgcccuaccuggcuaauuuuuuauuauugguagagauacggucucuauauguugcccagccuauuugguuuuuuaaaacaggaauuuuaaaagaauuugcaugcuuucaauuccuuuacacucaggcaagaggauagccugagguccggguuuugacacgagcuucagcaacacagccagacucuggcuauaaaaaguuuuugaaauuacgacauaaaauccuuuauaaaugcggcccaguguuuuaguaaacuugacaagaggggcuccuaccguuucaccaagaugcggauugggucggucaugaacuuguuggucaucuccagaaucucguguggcagcguggcacugaugagaaccaccuguguggcuggaggcagguaccuguauacaucguaaaucugcucuuugaaaccugggacagggagcaagacaggugagggauguuuagggcggcacacccagaaauggaaggugcacgcccaguguucccacuggguuagaggcagaguggugauaagguacguuugacaggaaaucucauuuuuacagcaccaggccacauccacgcguucucuccgucccuacuccccgcccaccggaguguuaucugguugagggaaucugguuucccuuuggugcuucuucaaucugaagugaucuagggaucaagaaacccaccccgagaguccuagauaccaaauaaaaagcaauagaggcuggccugagucacccacaaugaacaaauaaauaaaaucaagguaggaauuuuuuguucauaauugccaaggcacaauuguuuuuccacgaugaaaacacuauucacauucagaacagucacuggcuguuucaauuuuacacugugaaaauuuaagaacuaagaauuaugucaguagaagaguaauucuuuuguugcucauaccuuuauucaacauuucaucagcuucauccaaaaccaacauuuugauagcacguguccuuaggcuucugcgacgaaucauaucuauaacaugagauuuugaaauacuuacgacaaaucacaucuaugagauuuugaaauaaucacaccugaggcucccaagaaagagcucaucauuccacuggucucaggguuccagagaccuucccucuaccuccugcaagugacccaggugcaaaagucuaccgugcggccuaccaaaucgaaagcuguccuguaccauuuaagcacuucuuacaaauacuaccggcagcaccauuuuuagcgacaaaagugcuuaccaaaaacacgcccuggagugcccgcgacaacaugcuguccguaauccagcuuccugauguccucgccaacauuggugccuccaaugcaggcauggcacuggacauucauguagucaccgagagcaagcagccccugaaacaaagcacagguucacguccagggugggagagagaaacauccacguuuuccaaaaagaaagacuguuucuccuccgagaugaucaccgauuauuauuuaugccauuauuaucucgaaaccacaaaauucuccugcucuuuucucugacaaaaacaaguuaauuuugcuuuuuuuuuuuuuuuuuugagacggagucucacucuguggcccaugcuggggggcagcagcgcaaucuuagcucacugcaagcuccgccuccaggguucacgccauucucccgccucagcuuccugaguagcugggacuacaggcgcccgccaccacaccaggcuaauuuuguuuuuguauuuuuaguagagaugggguuucaccguguuagcacaccgugcugugugcacccuauauguguauucagagagucguuaucuccugaccucguaauuggccugccucagccucucaaagugcugggauuacaggcgugagccaccacacccggccugcugguuucuuauuacaaaagcuauaucauuaacagaaaagaauauauaaaauucauaaucccauccaccgaagaaaccagcauuaacaucuuaauauacaucuuuuuaaacauacaucuuuauacuacguuaaguauaaaauggguacaauuuauuuuuuuuuugagacagaguuucacucuucuugcccagacuagaguacaacggcacaaucucagcucacugcaaccucugccucccggguucaagugauucuccugcucagccacccaaguagcugggauuacaggcgccugccaccacgcccagcuaauuuuuuguauuuuuaguagagacaggguuucacuauguugaccaggcuggucucaaacuccugaccucaggugauccacccaccucgaccuaauuuauuuuuauuaaaauugauuuuucgcaaaaaaucuacauuucuaaggcuguaaaaaacuaccgagagcacacaagccacaccaaaaaugacuuaauacaaaccagcaauuuauauaaugauuaauggcaaaauguuaaucaggaagaaaauuuugagguaucagaaaacaggauuggauuaaauaaauaagucgguguuucacaacuaaaucacaaaagcaguacuuguuaaucggacaccgcuaucuuuagccaucucaccuucuggaucugcacagccaacucucuugugggagccaagaucaaagcuugaguuucacgaaccuggugaaauaauuuaucagaaaauagagaauccgcaguauuaucaaaguggauuguaguaauucacacucagaucuauaugagaaauacuaucucauauuaaucauacuucucaucucuuacagguuagcaaauauugucauuuaaauugcaaauccaacaauaacuuaaugugucagcauccucgucugcagacaagagcuuccucuaguuaaauagaaaaucaugacagaauauuagugcauauauuaguguacaacuaagacucuguguaaaaauuugcugagucaauacauacuagaaaauuuuaaauuguacuuuuugaacacuguaguuacagaagaaaaagcaaguauuuccuagaauuacauaacaguuuguuuuaagaauggcaaauuaccugaauauccaaacacuggaggacugagauacugaagguggcuguuuuuccugugccggacugagaccuauucaaggaaacaaaagcagugggauuagagggaggacaggccacgccacagcugcacuccaaggccugggcuccagaggcacuuagguaccuucuuccagcaagcccccguaccuaauaacaucuuaacugcgaggaggcaggacucgggcccagugucacagcuuguuaaguguccaugaagaaagagaguagacauggcuucugcacgggggcaauggagccacagacucucuaacuucaagagguguuucauaggugucagaaaaaggaggacuccccuuuaucuaaauacaacucuuuuccuucuaggauuuuggacuaacucucucuuccaaagaaauuuuuguguaaaugagucuuuuuugaaauuaggcaaacgaggaauaaagcuauuaaaagaggauuuguggugcuaggagauauggcuauauacaaguuuucauccauaguuccuggcucacagcucccauagcccuuauuacagucuuauuaaauugauggguuaggccucaggaaacaaucucucugaccuucugcucuccuuucaccugcuccacagcagggcucuaaucuucccugccuuucagauugugagucauaaagacccucaugucacggcgugguggcucaggccuguauucccaacacucugggacgcagaggcagcauuaauugaagccaggaauucgagaccagccugggcaauacagcaagagaccccauuucuaaacaaaacaaaaaacuaaccaggaacgguggcacauucuggcagucccagcuacuugggagguugaggcgggacgauuccuuaauccucgaaguuagagguugcagugagcuaugacugcaccacugcauucccgccugggugacgaagugaggccccauaucuuaacaaaaaaaauguuuaggccgggcacaguggcucacgccuguaaucccaaggcuuugggaagccaaggcagacagauugccaggaguuugagagcagccugggcaacacaacaaaacccugucucuacagaaaauacaaaaauuaauugggcauggugaugugugccuguagucccagcuacuugggagggugaggugggaggaucgcuugaggcugcuaugagcuguaaucacacgacugcacuccagucugggagacagaguaagacccugucucgaaaaauguaaaaaauuuaaauuucaaauuuuuuuuuaaaaagcauuaugguauuaucccagaaaagcuccugcccuauucccuuaugggggaaagaaugcugaccucauggaauuuuccauaaaaacccaagaggacuggguucgaagagcuucuagauggcugaacacagacaguggaacacaaggagguuccgggaggugaccacccgccccuuggaggcugcaccccuccccccauaucuguauccucugcaguacccuuuauaauaaaccacuaaauguguuucccugaguucuuugagcugcuguuccagcaaauuaauccaaccuaaagaggggauccugggaacccaacuugaagcugcuuggucagaaguucuagagauccgaacuuauaacuggugucugaaaagaggguagucauggggacugagccgucaaccugcaggauauggccuaucuccaggcagguggugugaguugaacuggaggacacccagcuggaaaagccccacaccucugcucacagaagucuucuucugugcugaugacuguugugguggugugagagcagaggaaaagcacagucuguuuuuccgaaauuguguuauauacaauuccacaugccagcaaaccacuaagcaaagcuggcuaagaaaaugaaagccuuggccgggcgcaguaacucaugccugaaaucccagcacuuuaggaggccaaggaggguggaucaccugaggucaggaguuugagaccagccugaccaacauggugaaacccccgucucuacuaaaaauaugaaaauuagucgggcaugguggugcaugccuguaaucccagcuacuugggagggugaggcaggagaauagcuugaaacugagaggcaaagguugcagugagccgagauggcaccacugcacuccagccugggcaacagagcgagacuccaucucaaaaagaaaaugaaagcuuuccacaguagagaacacaaauuuaaaaaaguauuaaacccuguggcuaaagucagggaaaguguuggaacugagcguguacaagcugagggaaacagucaucccagagcaucuaacugcacugcgcugcccaaauuuacauccagcccugcgccgcaccccaggacaacuuacugugcgaugacaucucucccuuugaugaucugcuugauugcucguugcuggauugcugaugguuuuucaaaaccugcaaauaaaaacaaaaaauuagcccucaccacaaugacagcauagaaacccuguacugugagcuccucaggggcagacaugguuuguuuuuugaaccuguccuccagccuaacccaguguucaacauagcaagcucucaaaacccaggggcucaaugaauugggcugagugauuucuacacuaacgugggauauuauuuguaaagaccaaucucuauuuuuaaaaaaccaccaaauuguagaauauagacaacaguuuuguuuaaaaaaaaaaaaaaaucugggugugcagcaucuggaaguguaagugccaaaauguuccuggcaguuacugcaguagagggguggaaagaaacuuacuuuuuacucuaauuacucccuuagguuugacuggauuacaaacaaccuauacuacuuuuuaaauuaaaaaaaaaaacaacaaaaaaacaggaaagucacucuagccauuguucucuccuacuagcuagcauuaagucuguguguugcugacaggucuacaacucuguuuaaccugcgugggucacgcugcaggguguccuauguuguucugucuggaugcagcucacuaacuacaacaccaucacaccaucucucuugcaaagcaacuacuacaccaaagggugaggcuauuuugaagaagaaccacguguuuuucaaguaaauaaaauuuuauguacaaaaacucuauuucaauuauuuuuugguagucucuuaaauguagcucugcucaguucuggggcauagcgaaaaauaagaaacaaaagaaaauguagcacaauuucccaucuuaacacaaaugcaaauauagcagaugauuuaaacucuucaugaagagcaagcacauagaugggaaacuaacaacagugucuuagggcagggacugccugagugccaggaaaccagguggggcugucagccucacugugaggcugccugagaugcuuuuucaccacgcauccucagcaacuucgcuucacuuuguccaaacuguuguggcaucaagaacuacaggauacggccaggugggguggcucacaccuguaaugccaucacuuugggaggcugaggcugguggaucacugaggucaggaguucaagaccagccugggcaacauggcaaaauccccucccuacuaaaaauacaaaaauuaguaggacgugguggcccacaccuauaaucccagcuacucgggaggcugaggcaaaggaaucgcuugagccccagaaguggaaguugcaauaagcugagaucaugccacuacacuccagccuuggugacaagagcaggacugucagaaggaaaaggaagaaagaaaaggaagagaacuacaggauaaaaaaugucccugucccaagcauuaaacacaggccauuuaucccagaugcuggucauucccaucuaugugcccaacccaaccucuucuccaggcucucccucaacuuccucacaucuuucaaacauaccaagagacagcuccugauucugacucucuggagugcugccuaccuagccaaauguuugcagcaucaaccaccgguuacucaaaacacuccaacucuccuccuucugucacucacguucaauccaucagccaaugcugucagcucccugguacuccaucuccaaggcagcacaauccucucuucccugaacugcagcaaaagcucccaacucucuuguuuccucuccugccuugccucgccucaccucaaaucuacagacacccagaagaaucuuuaaaacuguaaaugugaucgugucacauagcuacuuaaaaccuuccacuggcuucccacuagauuucuaaaugaaauucaaauuauucgucacccuacacgucuuugcuagaucugccccgacuagcucuccaaaaucccaccacaggggacuucuuucaguuccuggaaugcagcuggcuaagggcugcaaggcccuggcaccagcuguuccuucugccccaacugcucuucccucuucucauaacagucuccuucauccagaacucugcucaaauggcacccccuccugcgaacccccuuaccucucugcuuuacuaauucucuccuccuucccagucccacucuauucaauuaccccgcuucagguucuucagguugccugggcaaccugacaguaugcuuuccccccaaacgaaauucaaaacccguaaaggcgcaaacccuuccgguuuaccgccaaaaccccaguaccuagaaaagcuaauagguagaaaucaguuaucugcugaaugaaggacgcugaggugccucgaagcggcugcagcccccgacagacccagcgccgagcucugcacgggggacacacaccgaaagcgccgacacagccaggcgugagggcgaggacgggggugggggugggggucggacgucacuggcccccgagccucgacccugaccacgaccuccggagcgcagggccggcccgggagucaccagucuggcccucagcccccggcucgcccccgacucgcccccggcuggcccccgcggcccgcgcccgcucaccguaagcguagaugccccgcagcagguccucccgcaggcccauggugucgaacgugggggucacauccaccuccucgcuggucucgaauuccacuuuagucaugucuuccucuuugagcagccgcuuucgcgccgagcccgaggucgccaucguggccguggucgccaugauucagaguccgcggaagagc

SEQ ID NO: 14857 - RNA, 14975 nt, Homo sapiens
uggcucuccccucuaaagcgcccggcgcgcgccucccaccgccgcacuuucacucuccgucagccgcauugcccgcucggcguccggcccccgacccgcgcucguccgcccgcccgcccgcccgcccgcgccaugaacgccaaggucguggucgugcugguccucgugcugaccgcgcucugccucagcgacgguaagugcgcucggcggggaggcccuggcgaggcucugggcuucggcucccgcccggcgcagagccgcggcuccucugccugcgcccgcaguuugcgccgcccgacacaguggggguggaggcagcucgcuuagcugggcgcucuggugcggugucgcguucaaagcccuacuuuugcgccgaggguuugugaccugcagagagcgaccgccugaccucaagcuggcugcagagcgaggucagccgggacaacugggcaggaacgccccaagagagcguucgggacuggcgcgggaaggcgcgaggguggggagccgcggaccccagaccccugccugcccacccuccacccacugccuucccgcugcgggcucgguuuccacaggcgaaugggcuccgagguccugcugcgcacagugcuggaggucgggcggugcauggcgagagcgcgcuuugcaaaguucgccucaugccgcgacuugaggcugugagguccgaugcagccgcgcagccuccgcucccugcgaagccgauccucuccccacacccucgcggggcucuuggccaggcgcgggcgggcugcgcggcgcagcugucgggcuugugccacccgccaggccgcgcuucugcacagcuccgcgguccgcagcgacgcggaccugggcgcgcguccagccgcugucuuccugucucuucucggguucaccugagagaggcccagggacccuccgagccucacacgcccccuccccagcuccccaaacacaccugcagacaggcucuuuugucaccagcuggccaagcgcuuugccccagaaugagagcugcagcaaaguucaaucuccaaggcccugggccacugggaaccguggugucccguuucacugggagagggcuuuuuucuuuucuuucgcugaagagaaacucgcugcgcugucacaggacaccgaugcaaaccaaaauaaacuguugccucugaacacacaaaacaaaacccuguggcucaggccgcugagcuuccuuggcugugaaguuuccugcaaagaguugaaggacacucugagugcucuugcagccgcgggcugugcaggcccagcgcgccucgagcccuuggcuggguuggugcagacguggccccggcguccuagcuggcuuggacugugcgcuggugugagcaggaccagcgcagcugagucgggcuggagaagcugggcagccuggggucguggcggacugccuaaguguuaaggacacagacugaaggcaauugggaauguucgucguugaugaaaagucccugaggcugugucugcacacugacccccccccccccccgcaagucauggggcauguuucuaguuuuuauugcuggauauucuucuguuccuguaaggucucugguuugggcaguuauugacugauuggugggaugagcgcggaggugucacagugcgccgcucugggaaauggugcugcccccuccccggagggcuggagagaggauuggaaugaggaaccucggucuuugaguuaugggugcaacugaccugggggaagcacagagacgugggguucaucccagacuccuccuggccugggaagggugacauggcccucagaguugccccauuggcagccaaguaaccagggcaggagccugggcuccaggcagaucugcuccuuacacacaucgccagaauguuuuguuuuguuuuguuuuccccucaccucacagugccuaugugcccccuauccccacacuuaguccucaagcugcacuacagagagagcuuggccagggguccugccccucccccauuggcugacuuccgucaggcagcugggcccuuggguuucccgggcuuaaacucagggugggcccccuucccaagccugcuuggaggggccagcugggcuccugucucugcauuagacuggagggcuuucugaaaacuccuggagccaagcucacccggucccaaauccgggguaccaucagagccagucaggacucuugccgguacacggauuuacauccagaacgguugggaaaguuagucuuacugacaaaaagcuggaggaaggagcacaugagguacacacgagaccauguucuuuugguaagcacaccugggggcucugucacuuuaaaaagaccuguugaaauucgcugcuugacaggcgggccuuagguccugggaguagaagcaagaauugcuuuugaaggaaauggauaaucccaggggguggagggggagaggagagagagccuguguguugagcucugaauaggcucugauuucuggccucaucaccacugcuugguuggggggccagaggagcuucucuccucugggcgcuggagagucacagccccacccaucccagcgggggcggcugcagcacuugcccuuggcugcauaucuucaagcucacuguugccgggagggggcuugugccucacuaccggccuccuauucuccugcuccacccccaacccacccccugccucagcuuggaagggcccaaaagaaauccagggaaaccuggaggcacaacacucaggagcguuuagcuccucaguuacccaggcugcaggccccggcccuggggguggcuuucccaggugaucugguuacagugcagugcugacuuccccugcagggucccagugcagcugcuggaagcuggccccagaggugccuuucuggaguuagaucagguguaacugugaaggcugccuuaggucucuccagugccaugagucaccagcacccugaugcuuggcuuuuuccugguuuucagggaguugcauuugguccuggggacaaggaaguggggggacaagugguccacuuuuccugcaacuugguggcugaauacacaaugcaauuccuaguccacaucaucccucaauugauugcagucuguagaaaaaauaaaauaaaaugagccccuuacucaagauuuccuccuacuuccccagcauucuuucccaaaggugcagaauuucagaaccacagaggucucucagaacuuuguaaacaggcaaacuuaaaaaaaaagaaaaaagaaaaaaaaucucuggaccaaauauucuuagacauauauuuaaucucugaugaaaggauccacaaguucaaauaauuugggguauuaaguggggcuuggauaaaaucuucaaggaaaaaagaaaaacaaaaagcacacacaaaucccagcccuccagggcuugcaauccuauauuuaaagggugagcaguggguucugcaggagccccuugcuaauuuacacuaaugagugucaauuauggcauuuuguaaauuggugauuuugcaaagaucuuaauacaauuccugaggcuacagcaucccugccuaggcaaugaaaaccacauuuaacuccagcuccacuaaucucuaagccuuggggaaagugcugggcagaagguggguccuuggccugcucucaggggacucacagguaggaagccagccaggauucuuuugugccuuccagagcuuuaggugaaugugaggaggggucucuggggugggggagggcagcauuccugaguacuacugugcuuccuggcuagaggccugugccagaggagagaggccagggagccuggagccucuugucccccuuucuuuucccugaguagggagaucuuucucaguugucccuugaggaauuuuuuuuacaaagaguaacuggaaauuucaguaccuuggacugaaaccguuaucuacuauaauuacuaccuuuaucuugagacacugagcagguggcuucuaauuuaaacucccgccucaucuaggcuccggcucuccccaggccuguugggcuccuugcccuguagaagcugagccugagcucagccagcacucacuguguugccugaggagauggccuuucccaacauacaccaguaaccuggaacuuaccccagugaugccgucucuugauccuuaaucgcugcaccaacugcugcagcccagacacacauuaccaaaaucuggcaggguaguaaagugccuuguuguccuuaccucuucuagggaagcccgucagccugagcuacagaugcccaugccgauucuucgaaagccauguugccagagccaacgucaagcaucucaaaauucucaacacuccaaacugugcccuucagauuguguaagucuugaaauugaacaucaucuaacgaacauaguugcaucuaacgaacauaguaacaucuaacccgagucuuauuaaagguguagaggugacaagccaaguguccaaccuugaacuuggcauaauuaguggcagcuauucuuaucaugaggaccuuuaguaugccaccaggcauuaauuuuaaaagccgcucuuggccugggcacccugcugugcucguaguaguucucucuucuuuccaaaccuguguucuucagcacagcacagcuggaugcuggagaaacuaugggcuucaccaagguuuuggcugaagccuaguaaauuagccagcccuuagcuaauaacagugauaacuggccugccaguuucggggaucugaugcccuacauuaacucacaagacccaaaugcaguuuaaguccucuuuaaccauugggugaaacuucaacauuuucagcucacuugccuguauuuucucaaguacaacauaugagguuuugguguuauuugguguggauggcagccacuaacauuugauuuuauucauuugggaaacaaagaccaaaaucacacauccacaagacaggaagaucucagcuggguacagaagaccgggagaaaugcgggaagaaagccaugugcuugaaagcccucucaugcucaagagguccugugucugaacacggggaagcgagggcucagggagucuccuggagaggauuugauugcucagaaguucuagugcuaaaaaugggguggggagacagcaguuggaaccaaagcuacaacuuucccaagacuuuuccacccaacaccaaauguuuuuacuuuugauuuuagaaaacuguuuuuaguuuugaguuaacccuuuacugccuugaauguguuuguuauuuacaguauguuuuagggcccuagaaaaugaauguuuuuucuguacuuugccuacaacaugauacuuuaucucuugugaagaguauuuuaaagaugcucaauuuagcuaccuuggaccugcuuuacagcacugaucaugcugguuuacuggccuggaaaugcaccuugaaguugaagaugccaaauacaauucucaggucugagcagacacuaaauuaacaaagaauaggccccagauuuggaccccaauguggguugcuccgagccacacccaucucugcaccccucuucaccuaauggacaggcugcuugaagacucccugggugccccugaaccacuguucuggggcuuagcuguccucaagacccuuaaguacuugggcugcaugagauuaccuggcaccaaagggcuuucuggcaagagauucagagagaugaaaucaggccuuccccaggaguuugcauguagggaagcuuuuaagagugugaacuuuuaaaaaacaaaugagaccaagaaacauucagugaacuuguaaaaucuuucuagaaacuauuuucugguaagccaccugcacugccccuccccucccuggcuggucacccucccggucagaccgcggugacuucuggcaggccuccuuccuccaggcuuccucaugcccauccuuaagucggcccuauaucuaucaagaugacccauccaaauaaaccucugcucuguugcucuccauucuccccuccccagguaccuagagcauccugucguccccuuccucaguuuccucuguaugcuuugaugaccccccuggcguauuugcuccugauuuucccuucccguuuauuuacucuccaagcuccuacuuauccuucaaaggcagcucaaaugcucccuuacaugaauuccccugcacugccccggaaagacuucuguucacauuuccaugucucugcaauggaacuuccugcacugccagcgcugagcuuuccccagcacaccgcgagcaccucuggagccugagcguaccaaguggagcacggggugccagcgagggcccuagauggguguugggggagcggaugcacacguugcagccgcgccuuccuccugugcagccgcacacuguugccauucuguuuucacagagcccggcugaagaacaacaacagacaagugugcauugacccgaagcuaaaguggauucaggaguaccuggagaaagcuuuaaacaaguaagcacaacagccaaaaaggacuuuccgcuagacccacucgaggaaaacuaaaaccuugugagagaugaaagggcaaagacgugggggagggggccuuaaccaugaggaccagguguguguguggggugggcacauugaucugggaucgggccugagguuugccagcauuuagacccugcauuuauagcauacgguaugauauugcagcuuauauucauccaugcccuguaccugugcacguuggaacuuuuauuacugggguuuuucuaagaaagaaauuguauuaucaacagcauuuucaagcaguuaguuccuucaugaucaucacaaucaucaucauucucauucucauuuuuuaaaucaacgaguacuucaagaucugaauuuggcuuguuuggagcaucuccucugcuccccuggggagucugggcacagucaggugguggcuuaacagggagcuggaaaaaguguccuuucuucagacacugaggcucccgcagcagcgccccucccaagaggaaggccucuguggcacucagauaccgacuggggcugggcgccgccacugccuucaccuccucuuucaaccucagugauuggcucugugggcuccauguagaagccacuauuacugggacugugcucagagaccccucucccagcuauuccuacucucuccccgacuccgagagcaugcuuaaucuugcuucugcuucucauuucuguagccugaucagcgccgcaccagccgggaagagggugauugcuggggcucgugcccugcaucccucuccucccagggccugccccacagcucgggcccucugugagauccgucuuuggccuccuccagaauggagcuggcccucuccuggggauguguaauggucccccugcuuacccgcaaaagacaagucuuuacagaaucaaaugcaauuuuaaaucugagagcucgcuuugagugacuggguuuugugauugccucugaagccuauguaugccauggaggcacuaacaaacucugagguuuccgaaaucagaagcgaaaaaaucagugaauaaaccaucaucuugccacuacccccuccugaagccacagcaggguuucagguuccaaucagaacuguuggcaaggugacauuuccaugcauaaaugcgauccacagaagguccuggugguauuuguaacuuuuugcaaggcauuuuuuuauauauauuuuugugcacauuuuuuuuuacguuucuuuagaaaacaaauguauuucaaaauauauuuauagucgaacaauucauauauuugaaguggagccauaugaaugucaguaguuuauacuucucuauuaucucaaacuacuggcaauuuguaaagaaauauauaugauauauaaaugugauugcagcuuuucaauguuagccacaguguauuuuuucacuuguacuaaaauuguaucaaaugugacauuauaugcacuagcaauaaaaugcuaauuguuucaugguauaaacguccuacuguaugugggaauuuauuuaccugaaauaaaauucauuaguuguuagugauggagcuuauagacguuucugguuuauauaguuaagccugccugcagucaggugucugagaccccuucucacagcccaugugugacaguguaugggcuuuucucacgagcagauuagaucugcagcucaaguuuuuggaucuuuuuuuuuuuuuuuuaacccgauugaaauagcagugcugguuuucugaagaauaauauuugacucacuaauucgucuucccucccuccuccuccuugguucuccuaacuuccccauguaauccccagagacucaacccuaguaauaucaaccuuuuacauuuucccauguaaaaaucccaugacuccaggccaugguuaauaugaagcuuucacagggacagguggccucaccccauaaaucauuaaauaccauucagcuugaaucauuuuaaugugacagucacgagccaguugcucuaauaaaauucugcuaaccagcucucucccuugcucuccagaacaaucgcauucauucccaggaguguucacaggcgucuagaaaggggaaggugggaccacugccuuuuuucuccucuucugaauggcagucugaaccuggggccugcagccuccaaaacguuauucaauuugaaaugcagacauuucuuagagaaagcuaagaguucagcccugcauugagaagaagaaaaagucccaugagaacagggcaggguggggugacaaggaccacgauggccagccuggcccuggguguacccugagauguggauuccuuguccccagugggaaucagguucagguuggcagauuggcagucgcuguaacccauucacaaagguguucuaggagcccauugaacauuuguuugaauggaaggaaauguccaauuuauuuuaaugaauuacugauaaacagugcuuugaccaggggccuccaggccugagacugaaggcacaguuuaaccaguacacgggccaguguuaaaucuuaugcagacugagacgaacuuuuguuuauuuccacauuauuaaugguucuacuaauuuuaucuaagggggcgcagagaagaaaaaguggggaaaaaagaaaagauaggaaaaaagaagcgacagaagaagagaaaggcugcccagaaaaggaaaaacuaguuaucugccaccucgagauggaccacaguucacuugcucucggcgcuuuguaaauuugcucgauccuccuccaggacagacccccaugcagacugggcaggggcucagacuuccgugggggagcagugcuuugcugcccugccagccacaccggcuucuguauuuaugugcuuuuuaaggcccuuguuggucugcuaaguuaugaagaaaguaguugugcagagacuggggcgggggucugugacgcggagccugugugcucaggacucuguccagaauagccugggagcuccaggaaugcccagguugcugagccccccagcccgcccuccacuuccucucuuagaaggccugcgcucacuggggagcucaccagcuccacacacuugcagucugcauuccuguggagaccaggcuguggccaccuggccagugugcagggcaaccugcuagcagagguggccucgccaggaagggggugugccaccccucuguggcccucaggaaaggugaaaacugacugacccuuaggaaugggcccuggcuuuuuccaaauacccauugccuuucccuccagcacucugccaccugggaaggggcuucuucagccccuccuuccuggguugugggaguggcuuuauccccaagcccggguggguuucugcaaacuguguggggugagcccgagggaaugcugcauucucagagagcagauguggaaacacuucucagggagcuccucuuugggcaauucucuuuagagucuuuaaacgggucccccacguggaggacagaugugcuauggaacuuugcaaggguccugaaucccuggggaucccagccuguccccucccgccuccugcgugauggcgugugcuccagcugcagggcacagcugccucuguccucauucaugggaaauaccuuaucugccuaaagcaaauaccacuuaagcucuaggaacuuuccugcacccuccuucccugcccauguagauguaugugugagauuuuuuggcaaguuucucuaaucuggaccgggaggauggaagagcaaggaccccauuucaguagugcucggaaaaaggaugcguugaauuucucagcccuucuccaccucacauaaacacccgcccacccugcacccggauccugggucauaauuuuaauaaaugcagaaagagaaagugguuggaggauggagcacauggaauucaggagaaaacccacaaagaccccugcaugucagacacacccugucccggagcgugguguccccuugagcuuuaaugagcucccugugaucacagccaugccuucuccucguuggggagguguccuaggaugcuucagccaaagaccuuuguuucccgcugcuaucucuuuuaccuggacaacucuccuggcccacguuccucuugccagcacugggggucacaggccugagcccuggguacaggggugcccuagucuucugcccuccccaccucuuaaggcacagagcuguugggugggcugccuggggcugccauccuucccguggaagccaguagccacucuaguccaugggacucuugacaaaagcgccccgagagggcaaaccugugcccccauacucgccugcauucuucggacuccacaugcagcagggcuuugugccuggggagggguggccagucuguccuggucaguaugaaaagcuguuggcccccuagggacagagggcccagcuaaggcugccugaggauacaaacugcuugcuaucccacuccuggggagcagggucugcagggacugagagugggucccaccuugagaacgcaugcaagguccguccugucuugaugucuugaugugacuguaugugcccugggggcucacugugguuuacaaguggcuugugaagcuccugggagcaggugguacacccagugcugaagacagggucgccguggaagagugaagagccugaccgggauuccugguggguugaaacuaggaagugcucacaccagucagagccaaaugaggggugcgcuauggucacugcucuguccagcaugcguuccuccugggagguccuggccaccugugcacccaccccugugccaccuccagcagucccaccuggggccaccuacgguggcauggccccuggcugagaggccccgagggcgaaggguuacuggaagccacgaaagugccucuugggacagccgaggccaggaugcagggcagcagcauccugagccucagccccacgccggugccggguaagcagugugcccuguccccgucguaugaccacucugaugggccucucugugccuucgugcgucugccacgcccagugcuugccacgugucuguccucugcuuucugccauccaugggucccuccgcuucagccuggcugcgucucgcacuccccucccgucuguugucgcagggccucugaagggagaugcauggccaagguggcaacuuggaaguagggauuggccccagggccuccgcgcaggccgcuguccuucuggagcuggcuggguguggggggaaccugccuuaaugguguuucccucuguucuugucaacaggagguucaagaugugagagggucagacgccugaggaacccuuacaguaggagcccagcucugaaaccaguguuagggaagggccugccacagccuccccugccagggcagggccccaggcauugccaagggcuuuguuuugcacacuuugccauauuuucaccauuugauuauguagcaaaauacaugacauuuauuuuucauuuaguuugauuauucagugucacuggcgacacguagcagcuuagacuaaggccauuauuguacuugccuuauuagagugucuuuccacggagccacuccucugacucagggcuccuggguuuuguauucucugagcugugcagguggggagacugggcugagggagccuggccccauggucagcccuaggguggagagccaccaagagggacgccugggggugccaggaccagucaaccugggcaaagccuagugaaggcuucucucugugggaugggaugguggagggccacaugggaggcucacccccuucuccauccacaugggagccgggucugccucuucugggagggcagcagggcuacccugagcugaggcagcagugugaggccagggcagagugagacccagcccucaucccgagcaccuccacauccuccacguucugcucaucauucucugucucauccaucaucauguguguccacgacugucuccauggcccugcaaaaggacucucaggaccaaagcuuucauguaaacugugcaccaagcaggaaaugaaaaugucuuguguuaccugaaaacacugugcacaucugugucuuguuuggaauauuguccauuguccaauccuauguuuuuguucaaagccagcguccuccucugugaccaaugucuugaugcaugcacuguucccccugugcagccgcugagcgaggagaugcuccuugggcccuuugagugcaguccugaucagagccgugguccuuuggggugaacuaccuugguucccccacugaucacaaaaacaugguggguccaugggcagagcccaagggaauucggugugcaccaggguugaccccagaggauugcugccccaucagugcucccucacaugucaguaccuucaaacuagggccaagcccagcacugcuugaggaaaacaagcauucacaacuuguuuuugguuuuuaaaacccaguccacaaaauaaccaauccuggacaugaagauucuuucccaauucacaucuaaccucaucuucuucaccauuuggcaaugccaucaucuccugccuuccuccugggcccucucugcucugcgugucaccugugcuucgggcccuucccacaggacauuucucuaagagaacaaugugcuaugugaagaguaagucaaccugccugacauuuggaguguuccccuuccacugagggcagucgauagagcuguauuaagccacuuaaaauguucacuuuugacaaaggcaagcacuuguggguuuuuguuuuguuuuucauucagucuuacgaauacuuuugcccuuugauuaaagacuccaguuaaaaaaaauuuuaaugaagaaaguggaaaacaaggaagucaaagcaaggaaacuauguaacauguaggaaguaggaaguaaauuauagugauguaaucuugaauuguaacuguucuugaauuuaauaaucuguaggguaauuaguaacauguguuaaguauuuucauaaguauuucaaauuggagcuucauggcagaaggcaaacccaucaacaaaaauugucccuuaaacaaaaauuaaaauccucaauccagcuauguuauauugaaaaaauagagccugagggaucuuuacuaguuauaaagauacagaacucuuucaaaaccuuuugaaauuaaccucucacuauaccaguauaauugaguuuucaguggggcagucauuauccagguaauccaagauauuuuaaaaucugucacguagaacuuggauguaccugcccccaauccaugaaccaagaccauugaauucuugguugaggaaacaaacaugacccuaaaucuugacuacagucaggaaaggaaucauuucuauuucuccuccaugggagaaaauagauaagaguagaaacugcagggaaaauuauuugcauaacaauuccucuacuaacaaucagcuccuuccuggagacugcccagcuaaagcaauaugcauuuaaauacagucuuccauuugcaagggaaaagucucuuguaauccgaaucucuuuuugcuuucgaacugcuagucaagugcguccacgagcuguuuacuagggaucccucaucugucccuccgggaccuggugcugccucuaccugacacucccuugggcucccuguaaccucuucagaggcccucgcugccagcucuguaucaggacccagaggaaggggccagaggcucguugacuggcuguguguugggauugagucugugccacguguuugugcuguggugugucccccucuguccaggcacugagauaccagcgaggaggcuccagagggcacucugcuuguuauuagagauuaccuccugagaaaaaagguuccgcuuggagcagaggggcugaauagcagaagguugcaccucccccaaccuuagauguucuaagucuuuccauuggaucucauuggacccuuccauggugugaucgucugacugguguuaucaccgugggcucccugacugggaguugaucgccuuucccaggugcuacacccuuuuccagcuggaugagaauuugagugcucugaucccucuacagagcuucccugacucauucugaaggagccccauuccugggaaauauucccuagaaacuuccaaauccccuaagcagaccacugauaaaaccauguagaaaauuuguuauuuugcaaccucgcuggacucucagucucugagcagugaaugauucaguguuaaaugugaugaauacuguauuuuguauuguuucaauugcaucucccagauaaugugaaaaugguccaggagaaggccaauuccuauacgcagcgugcuuuaaaaaauaaauaagaaacaacucuuugagaaacaacaauuucuacuuugaagucauaccaaugaaaaaauguauaugcacuuauaauuuuccuaauaaaguucuguacucaaauguagc

SEQ ID NO: 14858 - RNA, 14975 nt, Homo sapiens
gcuacauuugaguacagaacuuuauuaggaaaauuauaagugcauauacauuuuuucauugguaugacuucaaaguagaaauuguuguuucucaaagaguuguuucuuauuuauuuuuuaaagcacgcugcguauaggaauuggccuucuccuggaccauuuucacauuaucugggagaugcaauugaaacaauacaaaauacaguauucaucacauuuaacacugaaucauucacugcucagagacugagaguccagcgagguugcaaaauaacaaauuuucuacaugguuuuaucaguggucugcuuaggggauuuggaaguuucuagggaauauuucccaggaauggggcuccuucagaaugagucagggaagcucuguagagggaucagagcacucaaauucucauccagcuggaaaaggguguagcaccugggaaaggcgaucaacucccagucagggagcccacggugauaacaccagucagacgaucacaccauggaaggguccaaugagauccaauggaaagacuuagaacaucuaagguugggggaggugcaaccuucugcuauucagccccucugcuccaagcggaaccuuuuuucucaggagguaaucucuaauaacaagcagagugcccucuggagccuccucgcugguaucucagugccuggacagagggggacacaccacagcacaaacacguggcacagacucaaucccaacacacagccagucaacgagccucuggccccuuccucuggguccugauacagagcuggcagcgagggccucugaagagguuacagggagcccaagggagugucagguagaggcagcaccaggucccggagggacagaugagggaucccuaguaaacagcucguggacgcacuugacuagcaguucgaaagcaaaaagagauucggauuacaagagacuuuucccuugcaaauggaagacuguauuuaaaugcauauugcuuuagcugggcagucuccaggaaggagcugauuguuaguagaggaauuguuaugcaaauaauuuucccugcaguuucuacucuuaucuauuuucucccauggaggagaaauagaaaugauuccuuuccugacuguagucaagauuuagggucauguuuguuuccucaaccaagaauucaauggucuugguucauggauugggggcagguacauccaaguucuacgugacagauuuuaaaauaucuuggauuaccuggauaaugacugccccacugaaaacucaauuauacugguauagugagagguuaauuucaaaagguuuugaaagaguucuguaucuuuauaacuaguaaagaucccucaggcucuauuuuuucaauauaacauagcuggauugaggauuuuaauuuuuguuuaagggacaauuuuuguugauggguuugccuucugccaugaagcuccaauuugaaauacuuaugaaaauacuuaacacauguuacuaauuacccuacagauuauuaaauucaagaacaguuacaauucaagauuacaucacuauaauuuacuuccuacuuccuacauguuacauaguuuccuugcuuugacuuccuuguuuuccacuuucuucauuaaaauuuuuuuuaacuggagucuuuaaucaaagggcaaaaguauucguaagacugaaugaaaaacaaaacaaaaacccacaagugcuugccuuugucaaaagugaacauuuuaaguggcuuaauacagcucuaucgacugcccucaguggaaggggaacacuccaaaugucaggcagguugacuuacucuucacauagcacauuguucucuuagagaaauguccugugggaagggcccgaagcacaggugacacgcagagcagagagggcccaggaggaaggcaggagaugauggcauugccaaauggugaagaagaugagguuagaugugaauugggaaagaaucuucauguccaggauugguuauuuuguggacuggguuuuaaaaaccaaaaacaaguugugaaugcuuguuuuccucaagcagugcugggcuuggcccuaguuugaagguacugacaugugagggagcacugauggggcagcaauccucuggggucaacccuggugcacaccgaauucccuugggcucugcccauggacccaccauguuuuugugaucagugggggaaccaagguaguucaccccaaaggaccacggcucugaucaggacugcacucaaagggcccaaggagcaucuccucgcucagcggcugcacagggggaacagugcaugcaucaagacauuggucacagaggaggacgcuggcuuugaacaaaaacauaggauuggacaauggacaauauuccaaacaagacacagaugugcacaguguuuucagguaacacaagacauuuucauuuccugcuuggugcacaguuuacaugaaagcuuugguccugagaguccuuuugcagggccauggagacagucguggacacacaugaugauggaugagacagagaaugaugagcagaacguggaggauguggaggugcucgggaugagggcugggucucacucugcccuggccucacacugcugccucagcucaggguagcccugcugcccucccagaagaggcagacccggcucccauguggauggagaagggggugagccucccauguggcccuccaccaucccaucccacagagagaagccuucacuaggcuuugcccagguugacugguccuggcacccccaggcgucccucuugguggcucuccacccuagggcugaccauggggccaggcucccucagcccagucuccccaccugcacagcucagagaauacaaaacccaggagcccugagucagaggaguggcuccguggaaagacacucuaauaaggcaaguacaauaauggccuuagucuaagcugcuacgugucgccagugacacugaauaaucaaacuaaaugaaaaauaaaugucauguauuuugcuacauaaucaaauggugaaaauauggcaaagugugcaaaacaaagcccuuggcaaugccuggggcccugcccuggcaggggaggcuguggcaggcccuucccuaacacugguuucagagcugggcuccuacuguaaggguuccucaggcgucugacccucucacaucuugaaccuccuguugacaagaacagagggaaacaccauuaaggcagguuccccccacacccagccagcuccagaaggacagcggccugcgcggaggcccuggggccaaucccuacuuccaaguugccaccuuggccaugcaucucccuucagaggcccugcgacaacagacgggaggggagugcgagacgcagccaggcugaagcggagggacccauggauggcagaaagcagaggacagacacguggcaagcacugggcguggcagacgcacgaaggcacagagaggcccaucagaguggucauacgacggggacagggcacacugcuuacccggcaccggcguggggcugaggcucaggaugcugcugcccugcauccuggccucggcugucccaagaggcacuuucguggcuuccaguaacccuucgcccucggggccucucagccaggggccaugccaccguagguggccccaggugggacugcuggagguggcacaggggugggugcacagguggccaggaccucccaggaggaacgcaugcuggacagagcagugaccauagcgcaccccucauuuggcucugacuggugugagcacuuccuaguuucaacccaccaggaaucccggucaggcucuucacucuuccacggcgacccugucuucagcacuggguguaccaccugcucccaggagcuucacaagccacuuguaaaccacagugagcccccagggcacauacagucacaucaagacaucaagacaggacggaccuugcaugcguucucaaggugggacccacucucagucccugcagacccugcuccccaggagugggauagcaagcaguuuguauccucaggcagccuuagcugggcccucugucccuagggggccaacagcuuuucauacugaccaggacagacuggccaccccuccccaggcacaaagcccugcugcauguggaguccgaagaaugcaggcgaguaugggggcacagguuugcccucucggggcgcuuuugucaagagucccauggacuagaguggcuacuggcuuccacgggaaggauggcagccccaggcagcccacccaacagcucugugccuuaagagguggggagggcagaagacuagggcaccccuguacccagggcucaggccugugacccccagugcuggcaagaggaacgugggccaggagaguuguccagguaaaagagauagcagcgggaaacaaaggucuuuggcugaagcauccuaggacaccuccccaacgaggagaaggcauggcugugaucacagggagcucauuaaagcucaaggggacaccacgcuccgggacagggugugucugacaugcaggggucuuuguggguuuucuccugaauuccaugugcuccauccuccaaccacuuucucuuucugcauuuauuaaaauuaugacccaggauccgggugcagggugggcggguguuuaugugagguggagaagggcugagaaauucaacgcauccuuuuuccgagcacuacugaaaugggguccuugcucuuccauccucccgguccagauuagagaaacuugccaaaaaaucucacacauacaucuacaugggcagggaaggagggugcaggaaaguuccuagagcuuaagugguauuugcuuuaggcagauaagguauuucccaugaaugaggacagaggcagcugugcccugcagcuggagcacacgccaucacgcaggaggcgggaggggacaggcugggauccccagggauucaggacccuugcaaaguuccauagcacaucuguccuccacgugggggacccguuuaaagacucuaaagagaauugcccaaagaggagcucccugagaaguguuuccacaucugcucucugagaaugcagcauucccucgggcucaccccacacaguuugcagaaacccacccgggcuuggggauaaagccacucccacaacccaggaaggaggggcugaagaagccccuucccagguggcagagugcuggagggaaaggcaauggguauuuggaaaaagccagggcccauuccuaagggucagucaguuuucaccuuuccugagggccacagagggguggcacacccccuuccuggcgaggccaccucugcuagcagguugcccugcacacuggccagguggccacagccuggucuccacaggaaugcagacugcaaguguguggagcuggugagcuccccagugagcgcaggccuucuaagagaggaaguggagggcgggcuggggggcucagcaaccugggcauuccuggagcucccaggcuauucuggacagaguccugagcacacaggcuccgcgucacagacccccgccccagucucugcacaacuacuuucuucauaacuuagcagaccaacaagggccuuaaaaagcacauaaauacagaagccgguguggcuggcagggcagcaaagcacugcucccccacggaagucugagccccugcccagucugcaugggggucuguccuggaggaggaucgagcaaauuuacaaagcgccgagagcaagugaacugugguccaucucgagguggcagauaacuaguuuuuccuuuucugggcagccuuucucuucuucugucgcuucuuuuuuccuaucuuuucuuuuuuccccacuuuuucuucucugcgcccccuuagauaaaauuaguagaaccauuaauaauguggaaauaaacaaaaguucgucucagucugcauaagauuuaacacuggcccguguacugguuaaacugugccuucagucucaggccuggaggccccuggucaaagcacuguuuaucaguaauucauuaaaauaaauuggacauuuccuuccauucaaacaaauguucaaugggcuccuagaacaccuuugugaauggguuacagcgacugccaaucugccaaccugaaccugauucccacuggggacaaggaauccacaucucaggguacacccagggccaggcuggccaucgugguccuugucaccccacccugcccuguucucaugggacuuuuucuucuucucaaugcagggcugaacucuuagcuuucucuaagaaaugucugcauuucaaauugaauaacguuuuggaggcugcaggccccagguucagacugccauucagaagaggagaaaaaaggcaguggucccaccuuccccuuucuagacgccugugaacacuccugggaaugaaugcgauuguucuggagagcaagggagagagcugguuagcagaauuuuauuagagcaacuggcucgugacugucacauuaaaaugauucaagcugaaugguauuuaaugauuuauggggugaggccaccugucccugugaaagcuucauauuaaccauggccuggagucaugggauuuuuacaugggaaaauguaaaagguugauauuacuaggguugagucucuggggauuacauggggaaguuaggagaaccaaggaggaggagggagggaagacgaauuagugagucaaauauuauucuucagaaaaccagcacugcuauuucaaucggguuaaaaaaaaaaaaaaaagauccaaaaacuugagcugcagaucuaaucugcucgugagaaaagcccauacacugucacacaugggcugugagaaggggucucagacaccugacugcaggcaggcuuaacuauauaaaccagaaacgucuauaagcuccaucacuaacaacuaaugaauuuuauuucagguaaauaaauucccacauacaguaggacguuuauaccaugaaacaauuagcauuuuauugcuagugcauauaaugucacauuugauacaauuuuaguacaagugaaaaaauacacuguggcuaacauugaaaagcugcaaucacauuuauauaucauauauauuucuuuacaaauugccaguaguuugagauaauagagaaguauaaacuacugacauucauauggcuccacuucaaauauaugaauuguucgacuauaaauauauuuugaaauacauuuguuuucuaaagaaacguaaaaaaaaaugugcacaaaaauauauauaaaaaaaugccuugcaaaaaguuacaaauaccaccaggaccuucuguggaucgcauuuaugcauggaaaugucaccuugccaacaguucugauuggaaccugaaacccugcuguggcuucaggaggggguaguggcaagaugaugguuuauucacugauuuuuucgcuucugauuucggaaaccucagaguuuguuagugccuccauggcauacauaggcuucagaggcaaucacaaaacccagucacucaaagcgagcucucagauuuaaaauugcauuugauucuguaaagacuugucuuuugcggguaagcagggggaccauuacacauccccaggagagggccagcuccauucuggaggaggccaaagacggaucucacagagggcccgagcuguggggcaggcccugggaggagagggaugcagggcacgagccccagcaaucacccucuucccggcuggugcggcgcugaucaggcuacagaaaugagaagcagaagcaagauuaagcaugcucucggagucggggagagaguaggaauagcugggagaggggucucugagcacagucccaguaauaguggcuucuacauggagcccacagagccaaucacugagguugaaagaggaggugaaggcaguggcggcgcccagccccagucgguaucugagugccacagaggccuuccucuugggaggggcgcugcugcgggagccucagugucugaagaaaggacacuuuuuccagcucccuguuaagccaccaccugacugugcccagacuccccaggggagcagaggagaugcuccaaacaagccaaauucagaucuugaaguacucguugauuuaaaaaaugagaaugagaaugaugaugauugugaugaucaugaaggaacuaacugcuugaaaaugcuguugauaauacaauuucuuucuuagaaaaaccccaguaauaaaaguuccaacgugcacagguacagggcauggaugaauauaagcugcaauaucauaccguaugcuauaaaugcagggucuaaaugcuggcaaaccucaggcccgaucccagaucaaugugcccaccccacacacacaccugguccucaugguuaaggcccccucccccacgucuuugcccuuucaucucucacaagguuuuaguuuuccucgagugggucuagcggaaaguccuuuuuggcuguugugcuuacuuguuuaaagcuuucuccagguacuccugaauccacuuuagcuucgggucaaugcacacuugucuguuguuguucuucagccgggcucugugaaaacagaauggcaacagugugcggcugcacaggaggaaggcgcggcugcaacgugugcauccgcucccccaacacccaucuagggcccucgcuggcaccccgugcuccacuugguacgcucaggcuccagaggugcucgcggugugcuggggaaagcucagcgcuggcagugcaggaaguuccauugcagagacauggaaaugugaacagaagucuuuccggggcagugcaggggaauucauguaagggagcauuugagcugccuuugaaggauaaguaggagcuuggagaguaaauaaacgggaagggaaaaucaggagcaaauacgccaggggggucaucaaagcauacagaggaaacugaggaaggggacgacaggaugcucuagguaccuggggaggggagaauggagagcaacagagcagagguuuauuuggaugggucaucuugauagauauagggccgacuuaaggaugggcaugaggaagccuggaggaaggaggccugccagaagucaccgcggucugaccgggagggugaccagccagggaggggaggggcagugcagguggcuuaccagaaaauaguuucuagaaagauuuuacaaguucacugaauguuucuuggucucauuuguuuuuuaaaaguucacacucuuaaaagcuucccuacaugcaaacuccuggggaaggccugauuucaucucucugaaucucuugccagaaagcccuuuggugccagguaaucucaugcagcccaaguacuuaagggucuugaggacagcuaagccccagaacagugguucaggggcacccagggagucuucaagcagccuguccauuaggugaagaggggugcagagauggguguggcucggagcaacccacauugggguccaaaucuggggccuauucuuuguuaauuuagugucugcucagaccugagaauuguauuuggcaucuucaacuucaaggugcauuuccaggccaguaaaccagcaugaucagugcuguaaagcagguccaagguagcuaaauugagcaucuuuaaaauacucuucacaagagauaaaguaucauguuguaggcaaaguacagaaaaaacauucauuuucuagggcccuaaaacauacuguaaauaacaaacacauucaaggcaguaaaggguuaacucaaaacuaaaaacaguuuucuaaaaucaaaaguaaaaacauuugguguuggguggaaaagucuugggaaaguuguagcuuugguuccaacugcugucuccccaccccauuuuuagcacuagaacuucugagcaaucaaauccucuccaggagacucccugagcccucgcuuccccguguucagacacaggaccucuugagcaugagagggcuuucaagcacauggcuuucuucccgcauuucucccggucuucuguacccagcugagaucuuccugucuuguggaugugugauuuuggucuuuguuucccaaaugaauaaaaucaaauguuaguggcugccauccacaccaaauaacaccaaaaccucauauguuguacuugagaaaauacaggcaagugagcugaaaauguugaaguuucacccaaugguuaaagaggacuuaaacugcauuugggucuugugaguuaauguagggcaucagauccccgaaacuggcaggccaguuaucacuguuauuagcuaagggcuggcuaauuuacuaggcuucagccaaaaccuuggugaagcccauaguuucuccagcauccagcugugcugugcugaagaacacagguuuggaaagaagagagaacuacuacgagcacagcagggugcccaggccaagagcggcuuuuaaaauuaaugccugguggcauacuaaagguccucaugauaagaauagcugccacuaauuaugccaaguucaagguuggacacuuggcuugucaccucuacaccuuuaauaagacucggguuagauguuacuauguucguuagaugcaacuauguucguuagaugauguucaauuucaagacuuacacaaucugaagggcacaguuuggaguguugagaauuuugagaugcuugacguuggcucuggcaacauggcuuucgaagaaucggcaugggcaucuguagcucaggcugacgggcuucccuagaagagguaaggacaacaaggcacuuuacuacccugccagauuuugguaaugugugucugggcugcagcaguuggugcagcgauuaaggaucaagagacggcaucacugggguaaguuccagguuacugguguauguugggaaaggccaucuccucaggcaacacagugagugcuggcugagcucaggcucagcuucuacagggcaaggagcccaacaggccuggggagagccggagccuagaugaggcgggaguuuaaauuagaagccaccugcucagugucucaagauaaagguaguaauuauaguagauaacgguuucaguccaagguacugaaauuuccaguuacucuuuguaaaaaaaauuccucaagggacaacugagaaagaucucccuacucagggaaaagaaagggggacaagaggcuccaggcucccuggccucucuccucuggcacaggccucuagccaggaagcacaguaguacucaggaaugcugcccucccccaccccagagaccccuccucacauucaccuaaagcucuggaaggcacaaaagaauccuggcuggcuuccuaccugugaguccccugagagcaggccaaggacccaccuucugcccagcacuuuccccaaggcuuagagauuaguggagcuggaguuaaaugugguuuucauugccuaggcagggaugcuguagccucaggaauuguauuaagaucuuugcaaaaucaccaauuuacaaaaugccauaauugacacucauuaguguaaauuagcaaggggcuccugcagaacccacugcucacccuuuaaauauaggauugcaagcccuggagggcugggauuugugugugcuuuuuguuuuucuuuuuuccuugaagauuuuauccaagccccacuuaauaccccaaauuauuugaacuuguggauccuuucaucagagauuaaauauaugucuaagaauauuugguccagagauuuuuuuucuuuuuucuuuuuuuuuaaguuugccuguuuacaaaguucugagagaccucugugguucugaaauucugcaccuuugggaaagaaugcuggggaaguaggaggaaaucuugaguaaggggcucauuuuauuuuauuuuuucuacagacugcaaucaauugagggaugauguggacuaggaauugcauuguguauucagccaccaaguugcaggaaaaguggaccacuuguccccccacuuccuuguccccaggaccaaaugcaacucccugaaaaccaggaaaaagccaagcaucagggugcuggugacucauggcacuggagagaccuaaggcagccuucacaguuacaccugaucuaacuccagaaaggcaccucuggggccagcuuccagcagcugcacugggacccugcaggggaagucagcacugcacuguaaccagaucaccugggaaagccacccccagggccggggccugcagccuggguaacugaggagcuaaacgcuccugaguguugugccuccagguuucccuggauuucuuuugggcccuuccaagcugaggcaggggguggguuggggguggagcaggagaauaggaggccgguagugaggcacaagcccccucccggcaacagugagcuugaagauaugcagccaagggcaagugcugcagccgcccccgcugggauggguggggcugugacucuccagcgcccagaggagagaagcuccucuggccccccaaccaagcaguggugaugaggccagaaaucagagccuauucagagcucaacacacaggcucucucuccucucccccuccacccccugggauuauccauuuccuucaaaagcaauucuugcuucuacucccaggaccuaaggcccgccugucaagcagcgaauuucaacaggucuuuuuaaagugacagagcccccaggugugcuuaccaaaagaacauggucucguguguaccucaugugcuccuuccuccagcuuuuugucaguaagacuaacuuucccaaccguucuggauguaaauccguguaccggcaagaguccugacuggcucugaugguaccccggauuugggaccgggugagcuuggcuccaggaguuuucagaaagcccuccagucuaaugcagagacaggagcccagcuggccccuccaagcaggcuugggaagggggcccacccugaguuuaagcccgggaaacccaagggcccagcugccugacggaagucagccaaugggggaggggcaggaccccuggccaagcucucucuguagugcagcuugaggacuaaguguggggauagggggcacauaggcacugugaggugaggggaaaacaaaacaaaacaaaacauucuggcgauguguguaaggagcagaucugccuggagcccaggcuccugcccugguuacuuggcugccaauggggcaacucugagggccaugucacccuucccaggccaggaggagucugggaugaaccccacgucucugugcuucccccaggucaguugcacccauaacucaaagaccgagguuccucauuccaauccucucuccagcccuccggggagggggcagcaccauuucccagagcggcgcacugugacaccuccgcgcucaucccaccaaucagucaauaacugcccaaaccagagaccuuacaggaacagaagaauauccagcaauaaaaacuagaaacaugccccaugacuugcgggggggggggggggucagugugcagacacagccucagggacuuuucaucaacgacgaacauucccaauugccuucagucuguguccuuaacacuuaggcaguccgccacgaccccaggcugcccagcuucuccagcccgacucagcugcgcugguccugcucacaccagcgcacaguccaagccagcuaggacgccggggccacgucugcaccaacccagccaagggcucgaggcgcgcugggccugcacagcccgcggcugcaagagcacucagaguguccuucaacucuuugcaggaaacuucacagccaaggaagcucagcggccugagccacaggguuuuguuuuguguguucagaggcaacaguuuauuuugguuugcaucgguguccugugacagcgcagcgaguuucucuucagcgaaagaaaagaaaaaagcccucucccagugaaacgggacaccacgguucccaguggcccagggccuuggagauugaacuuugcugcagcucucauucuggggcaaagcgcuuggccagcuggugacaaaagagccugucugcagguguguuuggggagcuggggagggggcgugugaggcucggagggucccugggccucucucaggugaacccgagaagagacaggaagacagcggcuggacgcgcgcccagguccgcgucgcugcggaccgcggagcugugcagaagcgcggccuggcggguggcacaagcccgacagcugcgccgcgcagcccgcccgcgccuggccaagagccccgcgaggguguggggagaggaucggcuucgcagggagcggaggcugcgcggcugcaucggaccucacagccucaagucgcggcaugaggcgaacuuugcaaagcgcgcucucgccaugcaccgcccgaccuccagcacugugcgcagcaggaccucggagcccauucgccuguggaaaccgagcccgcagcgggaaggcaguggguggagggugggcaggcaggggucugggguccgcggcuccccacccucgcgccuucccgcgccagucccgaacgcucucuuggggcguuccugcccaguugucccggcugaccucgcucugcagccagcuugaggucaggcggucgcucucugcaggucacaaacccucggcgcaaaaguagggcuuugaacgcgacaccgcaccagagcgcccagcuaagcgagcugccuccacccccacugugucgggcggcgcaaacugcgggcgcaggcagaggagccgcggcucugcgccgggcgggagccgaagcccagagccucgccagggccuccccgccgagcgcacuuaccgucgcugaggcagagcgcggucagcacgaggaccagcacgaccacgaccuuggcguucauggcgcgggcgggcgggcgggcgggcggacgagcgcgggucgggggccggacgccgagcgggcaaugcggcugacggagagugaaagugcggcggugggaggcgcgcgccgggcgcuuuagaggggagagcca

SEQ ID NO: 14859 - RNA, 3188 nt, Homo sapiens
gaauaccuaucugauuuuugcaggaacuauuuucuguaauuuugccucaaauuaugcaguuuucucuuuggacauuuuuaccuauucugacagcuccugcuuuacucuuuccauucucuuucuuggaacuagcuuuuucuuuuaacaaacuccuuccuucaucacaaucaucccacucaucaucugacacuauuuugagcacuccuuuacuuucucuggugauuuaaaaaauaacguucagccagaugcguggcucaauccaguaaucccaacacucugggaggcguaggugggcggauggcuugaguccaggaguucccgaccagcccgggcaacacagcgaaaccucgccucuacaaaaaauacaaaauuuagccgagagugguggugcuacucaggagguugaggcaggaggaucgcuugagcccaggaggucgaggcugcagugagccgugauuguaccacugcacucccgccugaaugacagggcgauacucagucuggaaauaauaacaauaguaacaauguucagcuuaaccugugaugagugccuugacaucaucucuucaugaagaagauccaccaaaauaaaaugguuacaauuauuagcccuacaauacaucaaaaaaaaaaagaaaagaaagaaaaucugucccuggcuuagccauuagccaccaaaucuguguguucaggugcucugugacugaaaaucuugcccucgaccugggucugaguuacauucugagguuugggggcuucucacaccacggaauuuaucaccugagcaacuucaaccugacaaaucccuccuaacgcccugcucugagaccccuuuaggcggucuccggaguacucaguguaccuuuuuuuuuuuuuuuucuuugagacguagucucgcucugucgcuaggcuggagugcaguggcgcgaucucggcucacgcaagcuccgccucccggguucaagcgauuccccugccucagccacccgaguggcugggacuacaagcgcgcgccaccacgccuggcuaauuuuuuuguauuuuaguagggguuucacuauguuggccaggauggucucgauuucccgaccgccugauccguccgccucggccucccaaaguggugggauuacaggcgugagccaccgcgcccggccuucaguguacuacuuuccuuauuuuauuuuuugagacagcgccucgcucugucgcccaggcuggacgcaauggagcagucacggaucacugcagccucgaccucccgggcucaagcgauucucccgccuuagccucccaaauuacugggaccacaggcuugcgccaccacgcccugccaucggcucucauuuccuuuucccauccuagucuuccaucaggcguccuuucggcgcacauuucaguguccugcggggcucaccaguguccuuccuccagggccucaggggcagucagagggaucuuucccgccgcuccacucccuccuccuccucccccucccccuauccccuccccuccccucccuucuccucuccagaaacguccucgcuuguccgccuccaccgccucccccgccagccgugucggcucugcuccgcgcccagccggccaaccggcggcucagcucuggcgcgucacaaugcgccgucgcggccccgcccccggacgccggacgcagaaacuccgcccugccgcgguccuugcguccuuccggcuccgucguggaagcaggacugcgccgcgucuuccucaaggugggguucggggggccaccgaaucgcugucacgccggcagguagcaggggguggggacgcgggcuccuugggcuucuguuuccugguguccagggcaaagggcugagccgggcaguagggccuagucggggccuggcucgccgggagcaggagggcuuccggcaaagccgcgugcgcucgacgggcaggcgcugaggauuggggccggcagcgcgccugaccccgccccucguaggcuccgccccgugcucgcaggcggggguuuccauggugauggucaacaagccucaacugccucugcuacaacugccaaguuccccgcgucccacccuccucuaggugcuccaagggaccaccggggugccugauaugagagcgggaguguagagacucggaggccgaggugaggggcggccgaagucuccgaggucgaaggccgcacacccgggaccuagcggggaccgggucccccuggggguggggacggggggugggauuugagauuagggagacuauccgaaguccagggccccguacccggacuaccuggggacugggccuauugggguggggaucguugggcuggggcugggauuugggaucagggaagagcgaucugaguuuaagcgccgcaaaccugggaccgagcgaggacugcacauaaugaggggccguggcgcugagauuugggugacgggauucgaggucgaggggcccguacgugggaccggcaagaacuggacccacugggaucgggagacgcagcgucggaggucgagagccgcacgcccagacaguggucccacgcggugagcaccgcgggcugagauuuuggagucaggaaagcgcggggaaggcacggacggccgggugcguuaguccggcccccuggcggggagcuggcgacugccggagggcucugaaagugagaacaggccuggcgcagugggaggcccagccgggaggaucucuugagcccaggaguucccgacaagccugggcaacauagacugucucuacugaaaaguaaagaaaaaaaaauuagccacgugugguggcgcgcgccuguugucccagcuacucgggaggcugaggcgggagggucgcuugcucugaggucgaggcugcagugacagugauugugccacugcauuccagccgggcgacggaaaugagaccuugucucaaaagaaguaauaauaguaauaauaccugaguaaaaugaaagccgcgcgcucacguggcugcaggcgccugagaguugcacaagacuuccuuguggggaguuggcuccgcccuccucccacgcccgguucccguagccuuagcucucggccccgggcccuuuuuccuccucggcugcgccgcguguccucggagcgcggucccuguauuggucuccugcuccuagagguaucguguuuguauuuggggug

SEQ ID NO: 14860 - RNA, 1315 nt, Homo sapiens
uuuuucaaagauuuuuuuucaaaaucuuuacguguguccauggucaaauguacaaaccaagguacguccgcuaguuccauuuuagaggcggccucccagagaggggcugugucuaacuugcuggcuucucuuccacucugcacugcccgcccuuccccguggcuggcacucuggacuuuccccaggucgcgcucgcgccuggcucccuucgggagaacucggagaaaugucuucccgccgcccugacucucuccuucccccacuuccugccugggcccagcgcgcgggccacggggccgcaccugcaggcacgcguuucccauuggugacaucuuggcgggcccggcaauggcacuuccuccucugcaccccgugacccacguccggcugccggucuuggaucacgaggccuccgcuucccggacuccggaccccgcgccuccucggggccgacgggccagucccuggcguggugagccgccgcgcgggcgccccggccccgccacuccagucccggccgccccccccaggucccuuuccgccgccccggucgcucggagacggacgcagaccuacgagcgccucuucccuucccucccuucagccgcgcucggcccgcggguccccgagcucccgccuaggcagcgcuagcuuggcgggccggggagcagcccccaccccaccuugccgucgcccucgcucucgcccucagggccccggaagcccgccaggggcccccuccccuccccuccccuccccucccccucccgcgaggcgcccuucccuccgggaacccucccgucccugcccccacucuccccgcugcgccgcucgcuccgccccccgcccggaagcucccgcccgagcccgcgcaggcccuggggccgaccuuccugccgggccgggcgguccgaggcugcuggagugccgugagcaggccgcgggaacgucgccgucaccuugucucggggccucggcgcugcuucccgccaaaacacguuuaccgcgcgcccgggccucccaccuugcggaagggaccccaccaccacuuggauuucuguugcagguugagaacaaaaacaugcaccuggaguuuccccggagcccucugcgugguugagcuucgguggaauuucggggcucuuggcugccagccgcgcuugccugguagcaacagaaaccaguccugcucgccuccgugguaagucuagagcaugaaaguccgcgggcccggccggguggacuuugguuugagaguggaacuaagugaguaaugggggcggcgcggccagacgcgcucccagccuccuggcga

SEQ ID NO: 14861 - RNA, 1315 nt, Homo sapiens
ucgccaggaggcugggagcgcgucuggccgcgccgcccccauuacucacuuaguuccacucucaaaccaaaguccacccggccgggcccgcggacuuucaugcucuagacuuaccacggaggcgagcaggacugguuucuguugcuaccaggcaagcgcggcuggcagccaagagccccgaaauuccaccgaagcucaaccacgcagagggcuccggggaaacuccaggugcauguuuuuguucucaaccugcaacagaaauccaaguggugguggggucccuuccgcaaggugggaggcccgggcgcgcgguaaacguguuuuggcgggaagcagcgccgaggccccgagacaaggugacggcgacguucccgcggccugcucacggcacuccagcagccucggaccgcccggcccggcaggaaggucggccccagggccugcgcgggcucgggcgggagcuuccgggcggggggcggagcgagcggcgcagcggggagagugggggcagggacgggaggguucccggagggaagggcgccucgcgggagggggaggggaggggaggggaggggagggggccccuggcgggcuuccggggcccugagggcgagagcgagggcgacggcaagguggggugggggcugcuccccggcccgccaagcuagcgcugccuaggcgggagcucggggacccgcgggccgagcgcggcugaagggagggaagggaagaggcgcucguaggucugcguccgucuccgagcgaccggggcggcggaaagggaccuggggggggcggccgggacuggaguggcggggccggggcgcccgcgcggcggcucaccacgccagggacuggcccgucggccccgaggaggcgcgggguccggaguccgggaagcggaggccucgugauccaagaccggcagccggacgugggucacggggugcagaggaggaagugccauugccgggcccgccaagaugucaccaaugggaaacgcgugccugcaggugcggccccguggcccgcgcgcugggcccaggcaggaagugggggaaggagagagucagggcggcgggaagacauuucuccgaguucucccgaagggagccaggcgcgagcgcgaccuggggaaaguccagagugccagccacggggaagggcgggcagugcagaguggaagagaagccagcaaguuagacacagccccucucugggaggccgccucuaaaauggaacuagcggacguaccuugguuuguacauuugaccauggacacacguaaagauuuugaaaaaaaaucuuugaaaaa

SEQ ID NO: 14862 - RNA, 4778 nt, Homo sapiens
gggggugguggggcgaguuuaauucauaaagaagccuccugaucagaaaggggccuaacagccugcccuuggagagaaguccuuccuugaggauaaggccucccaggggaggaggugcugggggccaguguuaggcuucaggccaucccuggaggccaguccugugcucagcaaguaguggcagagccugcggagaguggcgggcaggccaucagacacaguccuuacacagacacccccucagcccacagaagcccgucucaccuggagugaugagugggauggccuucucagguacaggacuagagaaaggaccacaucagaguaguaucagguuagccuggaggaccuucuccccuauaucccagacucuugcugcccggccccaggagugcaaguccuugcucuccuuccauggucacuucccacaauaccgaggucagagcuuuccugacuggggcccuucaggguugacuaucugaauaacaaagccagcugcaagcccagcgaguggccaggaugcuguccacucuccaggucaggacuguccccccguaguucugccccgaaggaggagggcaccauagggucaggcucaccugugcugcuucuggcugcucuugcauuugcauuugccaccugggagagagagaggggucagcgccagggucagugcuggaaugagagcacucucucuuucugccccacccuguccgccagccccacccuguccuccagccccaccuguccugccacucacucagaacugccgcgaucccagcaauggccaggagcccuccgcagaucaguccgcucagcugcagguuuuuccagucugggguggguacagagagugagcuugcaccagccuggggccucagucauucauucaaaagacacuccugagccccugcuugugccagccgcugccauauacauaaagacaagccagcaacagaggcaucauucugcgucucguggggaaacacuaagaagaaaaaaagugaggcugggugcgguggcucacaucuguaaucccaucacuuugggaggccgaggcgggcagaucaccugaggucagaaguucgagaccagcaugaccaauauggugaaaccccaucucuacuaaaaauacaaaaauuagcuaggcguggcggcaggcgccuguagucccagcuacucgagaggcugagacaggagaauugcuugaacccgggagauggagguugcagugacccgagaucaugccacuguacuccagccuaggcgacagagucagaaucugucucaaaaaaaaaaaaaaaaaaaaaaagaaguggacaugcgcaaagaaagggcuuugaaggaugaucaaggaaagcuguccuggagcugaggcccaggggagaggaggagaggaggacugccugagggcuggggacuagggaaagggagggugagggugagugaaggcaagaggguaggggugauuuaucggggugccuaaccacccaggcaccagcccuucuccaggaggguuccuaagcauccuguggccacccuccccuuguuggagcgacgcucucacagagaccagguuuaaucccccaucccacuuugucuacacuagguccacacuaccccucaccaacuugucuagcaaagagguccaggauaggcaaggguagggugggggugggaauaucagcucuuaccauaguagaagggaucgucuuuauuggcuagaaaaaguggggcaaaaagacuucagaaccagaaccaggagacaggaugugggugucagaggggagaugugggcagagugggcaggcuguuugggggccucacucaccaaaugggucauuggcuuccaaggcagucaggccugugugggaggagcagagaaaaugugugggaauucaugacacugguguccaaguaagccagacagcaggaccccagcccggagguuguggggugacccuggagccaccaguucccuuccucacgcccuccccagccccacacagccucaggguguggccccgcccaagcccugcugucccaggcuuccugaugcuccugugugcaugcugacugggaugguuuguuaugucucugcccccugaagaaacagggaaugcuugucuuuuuuaugagucggaaccucucucugucacccaggcuggagugcaauggugcaauccuagcucacugcaaccucgaccucccaggcucaagugauccucccaggcucaagugauccucccaccuuggccucccaaaacacugggauuacaggccugagccgcugugccacccugcuuuugucuucaagccacaggugguuaauguuuuccaugguucaauuccucuggagcuauuaggaccuuuuugcaauauucucauccuaccuguacugucauuuccuucauguuucucucuaaauuggcaguuuaaauaaagcaugcugauugaacaccagacucccaaaggagauguugucuggcuuuugcugccuuuguggguggggugaaugcaagagggucccaggagacugggaggacucaccugccaguaggagaagggccagggucacucucuccaugucacaguucgaggggcagggcugcagggggagaggcacuggggcgggggucugcagcccacggaucugcuccaggcucacagcucaauuggucagcgagaggaggcaggggcgggggcaggcagagccccauggugaaaguagguguacaaaccccaaggauacacuugcuuguggggagaucuugggaaaguaacuacuuucugucuucccaucuagagauggugguggccugggggaguuguguggauugaguaagcacaagcuaagagcucaaaacugugccugcacagaguaagugcuguagaaggcguuguuaaaauccaugcgacaaacccacccccuacuccuccccaugaggaagauacuauuauugucucuauuucagagaagaaaaaaaaaaauggagcuuagagagguguaaucagaugcccagggucagguggcugcuauucuaagucagggucuggagccugccuuccuaaccccacacaaagggcauuguuaucaggccccaggcuauuguucccaaaggucugggccugggguggccagaguccagcacccucagucugaauucccagagagccuccacaaaagcaaggguguggaggagggagggagugcugaguccugggaugagaugacugcagcagccaggaccuccccugccagcccuggcaggggacccuacuccagcagacccagauucugcucucagaguauagaccuccugugguaugacauuucccccucagguuggaaguagccaggaccccauuuacuuguccuuagggaggcugagucuuugagcgcaggcccccucccagcccucugcauauuguuagccuaguguggucaaguuuucaauacugaagccauugucaucaucugcuguacccagcucuggccuccugaugagaucacagauccagggccagcugucugggcugggucccuucuuagcaacuuaccaacugugugacucugcagguuccucacugcuccuucaccaguguccuguaaaaggaggaucaucagaauaguagcaaccucauaagguuauagcgauggaauuacgugaacuacuauuugucaagccuaagaacuaugccuagcacacaguaagcacuaaaaaccuguuacaauaaauacauccauaggccgggcgcaguggcucacaccuauaaucccagcacuuugggaggcugaggcggguggaucaccugaggucaggaguucaagaucagccuggccaacauggcaaaaccccaucuauacuaaaaauacaaaaauuagcugaguguggugacaggcgccuguauucccagcuacuugggaagcugaggcaggagaaucacuuaaaccuggaagguggagguugcagugagccgagauccuggcacugcacuccagccugggcaacagagggagacuccaucucaaaauaaauaaauaaauacauccauaaauaaacacaugguccuucugcagugggagggaggcacuggagggagagacuguuaggcacugcuucugaacaucgguucuugggcuaggagcagucuccaaagcuggcuucccccagccuucacuggucucucuaccuucaccaaccuggaguuccuggaauacgagggucucaacucuaggucacauuuuuuauuuuauuauuauuauuauuacuauuuuuuuuuuuuuugagacagggucuugcucuguuacccaggauggagagcaguggcgugaucucggcucacugcagccuugaacucucuuggcucaggugaucuccucaccugaguaucucaagcaguugggaccagagguauaccccaccagcucauauauucuuuagccaagggcuggcuucuguuuccuccaacccccaacccaccauccauaugauagugggugcaaagcaggaggccuucaagcggcugcugcagccauaucuguccucagaccccucaacaggcuccucauuacucagaauucuugggcacccacccccuucacccagcagccccaaaguggacgccugcucaccugcgaggucaccuuggcgagggcucaccugagcuggcagcgcagagaacggaucugaggaggcugcugggcacgugggucggcucuuuaaacccugcagccacgcccagggcuccaugacgcaggcuggagggaacugguc

SEQ ID NO: 14863 - RNA, 4778 nt, Homo sapiens
gaccaguucccuccagccugcgucauggagcccugggcguggcugcaggguuuaaagagccgacccacgugcccagcagccuccucagauccguucucugcgcugccagcucaggugagcccucgccaaggugaccucgcaggugagcaggcguccacuuuggggcugcugggugaagggggugggugcccaagaauucugaguaaugaggagccuguugaggggucugaggacagauauggcugcagcagccgcuugaaggccuccugcuuugcacccacuaucauauggaugguggguuggggguuggaggaaacagaagccagcccuuggcuaaagaauauaugagcuggugggguauaccucuggucccaacugcuugagauacucaggugaggagaucaccugagccaagagaguucaaggcugcagugagccgagaucacgccacugcucuccauccuggguaacagagcaagacccugucucaaaaaaaaaaaaaauaguaauaauaauaauaauaaaauaaaaaaugugaccuagaguugagacccucguauuccaggaacuccagguuggugaagguagagagaccagugaaggcugggggaagccagcuuuggagacugcuccuagcccaagaaccgauguucagaagcagugccuaacagucucucccuccagugccucccucccacugcagaaggaccauguguuuauuuauggauguauuuauuuauuuauuuugagauggagucucccucuguugcccaggcuggagugcagugccaggaucucggcucacugcaaccuccaccuuccagguuuaagugauucuccugccucagcuucccaaguagcugggaauacaggcgccugucaccacacucagcuaauuuuuguauuuuuaguauagaugggguuuugccauguuggccaggcugaucuugaacuccugaccucaggugauccacccgccucagccucccaaagugcugggauuauaggugugagccacugcgcccggccuauggauguauuuauuguaacagguuuuuagugcuuacugugugcuaggcauaguucuuaggcuugacaaauaguaguucacguaauuccaucgcuauaaccuuaugagguugcuacuauucugaugauccuccuuuuacaggacacuggugaaggagcagugaggaaccugcagagucacacaguugguaaguugcuaagaagggacccagcccagacagcuggcccuggaucugugaucucaucaggaggccagagcuggguacagcagaugaugacaauggcuucaguauugaaaacuugaccacacuaggcuaacaauaugcagagggcugggagggggccugcgcucaaagacucagccucccuaaggacaaguaaaugggguccuggcuacuuccaaccugagggggaaaugucauaccacaggaggucuauacucugagagcagaaucugggucugcuggaguaggguccccugccagggcuggcaggggagguccuggcugcugcagucaucucaucccaggacucagcacucccucccuccuccacacccuugcuuuuguggaggcucucugggaauucagacugagggugcuggacucuggccaccccaggcccagaccuuugggaacaauagccuggggccugauaacaaugcccuuugugugggguuaggaaggcaggcuccagacccugacuuagaauagcagccaccugacccugggcaucugauuacaccucucuaagcuccauuuuuuuuuuucuucucugaaauagagacaauaauaguaucuuccucauggggaggaguaggggguggguuugucgcauggauuuuaacaacgccuucuacagcacuuacucugugcaggcacaguuuugagcucuuagcuugugcuuacucaauccacacaacucccccaggccaccaccaucucuagaugggaagacagaaaguaguuacuuucccaagaucuccccacaagcaaguguauccuugggguuuguacaccuacuuucaccauggggcucugccugcccccgccccugccuccucucgcugaccaauugagcugugagccuggagcagauccgugggcugcagacccccgccccagugccucucccccugcagcccugccccucgaacugugacauggagagagugacccuggcccuucuccuacuggcaggugaguccucccagucuccugggacccucuugcauucaccccacccacaaaggcagcaaaagccagacaacaucuccuuugggagucugguguucaaucagcaugcuuuauuuaaacugccaauuuagagagaaacaugaaggaaaugacaguacagguaggaugagaauauugcaaaaagguccuaauagcuccagaggaauugaaccauggaaaacauuaaccaccuguggcuugaagacaaaagcaggguggcacagcggcucaggccuguaaucccaguguuuugggaggccaaggugggaggaucacuugagccugggaggaucacuugagccugggaggucgagguugcagugagcuaggauugcaccauugcacuccagccugggugacagagagagguuccgacucauaaaaaagacaagcauucccuguuucuucagggggcagagacauaacaaaccaucccagucagcaugcacacaggagcaucaggaagccugggacagcagggcuugggcggggccacacccugaggcuguguggggcuggggagggcgugaggaagggaacugguggcuccagggucaccccacaaccuccgggcugggguccugcugucuggcuuacuuggacaccagugucaugaauucccacacauuuucucugcuccucccacacaggccugacugccuuggaagccaaugacccauuuggugagugaggcccccaaacagccugcccacucugcccacaucuccccucugacacccacauccugucuccugguucugguucugaagucuuuuugccccacuuuuucuagccaauaaagacgaucccuucuacuaugguaagagcugauauucccacccccacccuacccuugccuauccuggaccucuuugcuagacaaguuggugagggguaguguggaccuaguguagacaaagugggaugggggauuaaaccuggucucugugagagcgucgcuccaacaaggggaggguggccacaggaugcuuaggaacccuccuggagaagggcuggugccugggugguuaggcaccccgauaaaucaccccuacccucuugccuucacucacccucacccucccuuucccuaguccccagcccucaggcaguccuccucuccuccucuccccugggccucagcuccaggacagcuuuccuugaucauccuucaaagcccuuucuuugcgcauguccacuucuuuuuuuuuuuuuuuuuuuuuuugagacagauucugacucugucgccuaggcuggaguacaguggcaugaucucgggucacugcaaccuccaucucccggguucaagcaauucuccugucucagccucucgaguagcugggacuacaggcgccugccgccacgccuagcuaauuuuuguauuuuuaguagagaugggguuucaccauauuggucaugcuggucucgaacuucugaccucaggugaucugcccgccucggccucccaaagugaugggauuacagaugugagccaccgcacccagccucacuuuuuuucuucuuaguguuuccccacgagacgcagaaugaugccucuguugcuggcuugucuuuauguauauggcagcggcuggcacaagcaggggcucaggagugucuuuugaaugaaugacugaggccccaggcuggugcaagcucacucucuguacccaccccagacuggaaaaaccugcagcugagcggacugaucugcggagggcuccuggccauugcugggaucgcggcaguucugagugaguggcaggacagguggggcuggaggacaggguggggcuggcggacaggguggggcagaaagagagagugcucucauuccagcacugacccuggcgcugaccccucucucucucccagguggcaaaugcaaaugcaagagcagccagaagcagcacaggugagccugacccuauggugcccuccuccuucggggcagaacuacggggggacaguccugaccuggagaguggacagcauccuggccacucgcugggcuugcagcuggcuuuguuauucagauagucaacccugaagggccccagucaggaaagcucugaccucgguauugugggaagugaccauggaaggagagcaaggacuugcacuccuggggccgggcagcaagagucugggauauaggggagaagguccuccaggcuaaccugauacuacucugaugugguccuuucucuaguccuguaccugagaaggccaucccacucaucacuccaggugagacgggcuucugugggcugagggggugucuguguaaggacugugucugauggccugcccgccacucuccgcaggcucugccacuacuugcugagcacaggacuggccuccagggauggccugaagccuaacacuggcccccagcaccuccuccccugggaggccuuauccucaaggaaggacuucucuccaagggcaggcuguuaggccccuuucugaucaggaggcuucuuuaugaauuaaacucgccccaccaccccc

SEQ ID NO: 14864 - RNA, 65362 nt, Homo sapiens
agaguggcuuccaagagccccgugccuaugucugggagggagggaagauggcagccguggcggcaggcggccuggugggaaaggggcgcgacaucagccuagcggcccugcagcgccacgaccccuauaucaaccgcaucguggacguggccagccagguggcucuguacaccuucggccaucgggccaacgagugggugcgugcggacgcggcggagcagugcagcccaggguugggguggaggcggggggcgucagacucaggacuugaggacccggugagggggaggagacguugacgcccuggaaguggguggaucuggggacugaggccgaaguuguggagauggggucucggggguuugggggaaggaaggcggaucuguggagcuaccuggaguuggggaaaagacuuaaaucucuaacguacccaacgcugggagaccagaccgaucggguacggcaccauaagagccgaaggaaaggaaggaccugauaccuuauggccggaagaccgaugugcucgagaaaguagagcagaguucuguuacagugaaucuguggcuaugggggaggcagggacagcagacgaauaaaagugcagaguucugauuuuggaaugucagucuuagauggggcaaagagaaaucaaaacuugauagaaggggagaaaucugcaaguuguaaacuuaaggggaaacaccaagaaaagagccaaccucgucaaauaaaagacaaaauggggcagggucuaacacuuagaaggaagcugaugcucuugggaagauuauuacacggcagcacaccaaguucgauauuggaggucauuugggagccaaauuauuuuagugcucuucucaaagcagagucccaguaaaugguaauggaaugaaauuucauuuuccucauaguuagaaugggguagaagccuagaacacuggaauccuguugcagggauugcugcuuguaauuuuguaacccacccacucgaauguagagacauguaauuuuguuucuuuacucauaaugaguuuuguccaaauaauauucaucauccauuauguaucacauacaugauauccaucauuuuaaaauaaguuacaaaacaguauggagaacuuagccuugaugaauggauuucagauaaacuuuuuguguucuucaagucgguuguauaaacaucaaaacuuaaucuaggaaaacauccauguugaacaacucuguauuuuuuuuaacacccacauucauaagccuacuuaucugcaguauaguucagcagccuguaguaaaaaacucaccugaaaaucauuaacauaaaaauaaaaagacaagcaagaaugggguagacaaacaguuuugcccaaaguucuuaacggaggaaauuugccggaauggggcaaagaauuuaggucugcucuccuaguagccaaacacaaaaggagaacaggaagagcucuuuaauauucguucuucuguaauagaaaguguaccucuugaucaggagaaagagguuauuucccccuaguuuccaggggaauuugucaccuacuuuuuuuguuuguuuuuguuuguuuguuuuuucgaggugucaccuucguuuuuacauaaagaacauugagcaacauagacaguuuccuccaugguaauuaaaaauauauaaaaagauauucuacauauggcuauuuugcugcucuguagaaaaaugcuaaagguauaauguuauaauccuguaaaaguaauuccguaguagagagaugaggaccagggauguauaguucuguaaguugacuugacacugggauucgagucuggagaaucccaagaaacugucaguauaaagagaguagagcauuucucuugaauaauaguuguuuccuauaggcuuuugacccuuaucaaugugauagauaccuuuuuaagauaguuacagauguuuauuagauaccuaaagccucaucaaaaagcagaugugucacaaugcauuaauuacaggaguuauguuuuccugcuugcuggauauguugccuucagacagggcauaauucauucaggaaaaggucauucuuucaaaguucuaaucuucaaggcugugguagccagaaaaacagagagaccuaguucaacugcagagcaguugcuggaggcaaacuaauuaugaccacugucuccaugugcugucacuguggaugggagccguuugaauguaaaccuaauaagaauaugagaacauuguugagaauagaggagaaaguauuuacaagaaggcaggggggaucuuaaggaggggaauucuuauugcccugaaaauggaugaagaaugacuucagccuuucaaaggaggagaaauuaggaaggaaaggugucuagaaaaugaacugcuuuaaagaaggauuaagaaagauuaugugaugacuggaauaggaauuuuagaguuagaccuacucccuguugccaggaaagacugccccccgccuccaaaauauuaauaccuaugugucaauugaagaccauaacccugguauuuuccagcugucaguccuuagaccaguggcucucagcuggaguugauuuugcccccaggugacauuuggcagugucuggagacguuuuugguugucacacugaagggaagaguguugugacaucuauagaguagaggccagggaaugcugagccugaaaacugcccuaaagugacuaacguuguguuccuagcuagugguuuucuaaguuuuugguguauccaaauaagucagaguuuuuuaaaagugaaaaaugccaaacuaaaaccucuggauaaugagacccaggcauuucauauuguugaaagccucauaggugacucacgugcuacaugcaugaugaagagagauuugggaggauaaguugagaccuacuuuuugauuauuuuaacugagaauaaucaaguuaaaauagagauugcguugagcuaguuugugucagacagugugcagaguccccaaaauuugcaaaacagcacuauuuuauauuccauuuuggguuuuuuaguauuuugaauucugaauugcuuauuucuuuagcacuuguuagauuuuauaauacaguauaauauuaaauccucaaauuguacuuuuaaaauuuaagcuaaaauaccccaggacugguaacuaauacuuucacauaaaaguccuccuuaaaggaucuaaggaacaucuaaucuuguuuuagcuauucuccacaucccuaacccuggacuuugcucagaaagaaaaaaaaaaucugguugcccuuggauaacuauggaggggccaggaaaaugcgugaauuugggcagcuguaauagaacagaaauguauauuuucaaagucucuuuuauccaggugucauagagcgccugacguuuuuucaucaaaagaucugaguaguguaagcugauuaucucucuuuuuuuuuuuuuuuugagacgaagucucgcucuuguuccccaggcuggagugcaauggcgugaccauggcucacugcaaccucugccuccuggguucaagcuauucuccugccucagccuccagaguauccaggauuacaggcgccugccaccacuccuggcuaauuuuugcauuuuuaguagagacgggguuucaccauguuggccaggcuggucuugaacuccugaccucaggugauccacccgccucggccucccaaagugcugggguuacaggcgugagccccugugcccggccugguuaucucuuuucaauggagaaacugagacauauaauaauaaacuaauuagcccagcaugaucuggcaagaaccccacuacaggucccagguugugauuacugaaacacaacuccuuccuaugaacaaacucauauucuuuguguguaaugcuaaauaaaaaucuuaguuuuaagaauuacuuguuauaaguuagagauuaauuuuaggagaagcaugccuuuuacauuuuugaccuuggaauuuaaaaacuaaaauguggcauuaaagguuuuuuuuuuuuaauuaagaaaagagaauuucuguuacaucaaggaagaaaggaaacaagucagaagcuauuuaguuuuaugugugcugauauauauagauauccuuauucagaucucuaagaugaaacaguccaaggucagauacuggaagaccaggagaguguuuugaucuuguggggagugauccugacuacauagagguucugcaaaguccuaguucuaucaccuguaucuuggcucaguuuccuaacaauguaauggauaauaccaaauacuuucuacaaauuuauuuuuaaaugcuuuguggacuugugaauacuugcugacugaaucaguuaaacuuuagggacagccaaaaauuuguauacuguucagguagcauuuacuguacuguaggggccauuuuccugauuaauacuuuggugguuuggguguaaguaauucuuagugcuucagguacacucaggauauacauuugucagcagauaggaauuaaccauguuuguuuucaaagaaagauaaguaauguuucuguauauauauuuuuucauuuugacuuggauauuuuucaaaguacaggggcaaacgagccacauuucagaaauaaggauauguuucacaguauguuguggugauuuauacaaacuucauagugaaucuaguuuaaggaugaacucccugacuuaccuaugcuuuuauguuagggaaaaaacuggcuaaaguuguuuuaauuguuauuuauuuauuuauuuauaagaaacagggucucccucuguugcccaggcuggaaugcagagguacaaucauagcucacuguagccucaaacuccugggcugaagcaauccucccuccucagccuccugaguagcugagacuaccggcaugugccaccacaccuggcuaauuaaaaaaauuuuuguuuuguagaggcaaggucucacuauguugcccaggcuggucucaaacugaacuccuggccacaagcgauccuccugccugccucagccucccagagugcugggauuacagacaugagccacugugccuggucuaaauucuuuauuuauaauuucauauuccauaauaauaaacaucuugagauuaaauauuuuguuacuagguaaugauuuuuuauagccauuuacucuugauaauagcuugauaugauuugugccauaauggauuuuguuuucaggacuuguaauauaauuucaugggcagagaguauguuguugaacuaaggcagugaguggcucucaaacuagcauacaucagaaucaccuggacaguuuaauaaaacccagauugcugagcaccauccccagaguuucugauucaguagguuugggcaggagcccaagagcuugcauuucuaauaaguucccaggugacgcugaugccgcugaucuggggauaacacuuugagacccacugaacuaaagugaaugagaaauuugcugaaauugccugagcaugugaaaggaucaugccuugugugccuuuuaaaaacugcuguuuugacauuacgcuuuuuuuaaaagggcguauuuuucaccagaauuacagaguacuuaaauuuugaaugauuauggugaugaauauuaauaauaaaauaucagggguuuaaauagaaugcugaaauuaaaccauguaaauugcaaaaguacauuuuaaauucugaauuacaguaggucugguucgugguuagucaaacaccuggauacuuacauguguguuuuuuaguaugcauuauauggaugaauauuauaauggccuagcuuccugccuuuggagaaauggaaaagaaaugugaagugaccuaguuaaaccaucauuuuaacuuuaccaccucucccagauuuucucaggcagauuucuugaguccuaacuugguaauacuuguguaacuuuacuucagugaucucgggucagaccuugacuguaaauauacuacacuaaguaggugauugauucaucugagaacucuguggcaucauugcccucucugucuagcagucaaaguaaaguuauugacagaucaucugcucuccuaagucacuggauauggcaggagaaaaugaacccagaaaacaaaaugaaggauagugaaaugcagacaccagugaugucugcagcuuucucuauacccagugugguggaaggagaaaaaggcagcacucuucuuucuaauuaaauccgcauagcacacuuauuuucucauuguuucagcuaaggguaugcugcuaucccuguauuugguaaagagagauaaugaugauuuguuuuauaaaugacaaaagaaagacugcuuccugcugccuaaucugcagaggcacaaugaugacauagaacuugcuuucuccuuuuccugagaauaacuccucauguuggguauauuuggcccauugaaguuauauauaauuccuauucuaugagaauuuguuuuauaccuuugugaauugaagagaacauacaugucuuguguguuuuguuuuuauuguuuaggagaaaacugauguggaaggaaccuuauuuguuuauacaagguaagaguguuucacuuuuauaaagaaacuaaucuucaaaauaauauuuuagcuccguugugucacucuucuucaagugcaugcaguuuuauuucaaaaagaaguaaaagaauuaaaucucaguuuugaaauuauuaguugacacgaagaagggaauaccaaauaaugucaccugguauaucgugaugaauacuaauuucagaauauaauuuaaacuucaauguagaugaacuuaaaucauugacugggcacuguuuaaaauagauuaaauauucuuugauucaagugaauggcacaaaguucuugaauauaaugcauuggcaaggagcuagaagaacacuaucagaaauacuagauuguucaguuaauauuuggaaaaggguuucauugaucauuuuucuuuuuuuugagauggagucucgcucugucaccaaggcuggagugcaguggcacgaucacagcucuuggcuugcugcaaccucugccuccugaguucaagugauucuccugccucagccuucugaguagcugggauuacaggcaugcgccaccacgcccagcuaauuuuuaguagcaacggagguuucaccauguuggucaggcuggucucaaacuccugaccucgugauccacccgccuuggccuccuaaagugcugggauuacaggcgugagccaccgcaccuggcuguugaucacuuuucucccaccccugacucuuuaaaaaagcaugauccaaaauugaagaugucuuucaguccuccauugucuagucaauagaauauguuucaggauagauuuaauaaacucauguuuuuagucauuucuuguuaucagauauuaauaucaaauuacgagugcauauagagacauacauuauguauauuggcucaauaaauaaacuuuucauucacauaaacauucacauaaaaugucauagccaaaggucaucaccuucaaugaggguacaaagaugaaauuaaaagaccuaauauaaaccuuucuagggguaucuguuucacuggggagacaggaaauacacacacacaaguguauuuucuuuccacauauauucauguuuaugguaagccacaauacaggauagaguauccuaagugccaguggauagauucugagcaaugaaugggcugcugugaucauggaaggcuuuaucgcaagcuuguccaacccacggcccauaggacacguggcccaagauggcuuugaauguagccugacagaaauucguaaacuucuuuaaaacauuagaagaguuuguuguuuuuuuuuuuuuuuuuuuuuuuuuuuuuuuuuuuuuuuagcucaucagcuauuauuaguguauuuuauguguggcccaagacaauucuucccuuuccaaggugucccaggaaggccaaaagauuggacaccccugcuuuauagagugaugugucuugaauugggccucaggaauaugguggaacuuagcuugcauagaggagagggaaggcagucucaacaggaagaauggcaaaagcaggggcggagaaccugguguguuaaagggacagugagggagauguggugcagagggcuuauacugguuuauaguaguuagcaaguguaaagagauuugcuagcuuggaauggcagacucuggauuuugagauuauuuucuuagcaguaggaaguuauugaaggcuuaugaacaggagaguaauagagaaaauguauggggaaagucaguguauucacuucauggggacgcacuaguucuggaagaaauuggagucaggacagugagaagauuauugcagugggguagauaugaaaugaugagaguugggauuagaauaauagaaauugaaauggaaaggguauugcaauggugaaauuuuaaaaaugacaauauuuugaacauggaagauugagaaugacagaagcauugguggaaaagaaagacaggaggucaagaauguggcuugaggaucagcccucauuuuacuuugaaguaaugauuuggaacugguagcaggacacuuggguggagguggccagccccucagaguaagggcagggcuggagaugguuuagaguugucugaaguaauuugguaguugaaaccaugaaauaaaagcuguucccugaaggagugaguauaaagaggaaccgaugaggguuuaugguuagguuugagggccagcaaggauacagaugagucagcuggaaagauaaaagcaggacuagaacagcacagagaggcccauuuggggcaaagugugggcaugauggaggucuguguaugcugggcaggagggagcucagcugcaggggaggaaggucuguuccaguggaggcaacaaugggagguggaaggaaggaaugggaggcaaggccagcacacuuggugacaaggaggucagguucuucacagucucagaagagcaguggaguacccaagaaccguugguauaugagucuacauuaugcucccaaacauccagagcaccagagcaugcccccaggcaaguuuauuggguagaguaugagcacucuugaggauucugaaguuuacaacaaaagccauaggguugcacuguacuaugugccaugcacacagggugcguucucacucaucucucacaacacgcauuaugauucuuuggagaagugacagaaaagauguauuaguaaguauuaaugauugauuuggggaauuuuuaguaggguuuuuuuuuaacuauggaagaggaacaaaucauacaaauauuuucuuuuguacauccagaccaaauauaaguuuguauuuucaaggauuucuuacuauacucuaagucucuaauggaacucucaauuaaacaaaacauuaaauugagaaaaaaauccuuugcuguuuuuuagucuuuucuccaaaucuaacuccucaagaaugggaugccucccuuauccccugcaaaacaaaaaccucccagauccuagaauguugaaggcuuucuucaguagcgaauuacaaaaagcauguaaaacucaugguggguggggggugggaggcuuguuacagggaauggagcuggcagugauuuauuuugacuucucuuacagaaguugcuuuagagcaguuggcacauuuauccccugggccuauuuucuaaauuaugagaugcuauaguagcuguacuauuaaagaggugagauccuguugugauaaugaaauacaugcagaaucaaauucucauucuuguaugaaaacacuuaaucccauuuaaaaaaucauuuauuuccucccaugccuuccuuucuguaauagagaguucauagagacacccacuggugauuucugaacuugacaguuccagaagaccccuaacagagcucuuugggaguacauuuucauucuuccucugaauuuaaguugaagugaugaucaugauuauuucugguauugauuguaugcuuaccaccacuuuaccccuuuguaaaauaagcuaggcaaggauugccucccaucaauuuuaaaauuggagguuucagaagaaaauccugguagugguuauguagcuguguuccuugaucaguaucaaauagagguaaaauaaaacuaagacauaaacaacuugucuuccuguugcucauaacauuucuguggguuuguuaauaacagcccuagcacccucauuuaaaguaaauaaaugaauucugcuugcuucagcuucaguguguaaguaugugguguuucauuugucaccggaaguugcgcaguugaauuacuauauggcugucacccaaggguagaugaaugcacauguaguuguuagaguuuauacucaguauaauuuggauucuuucugccuggcagagcaggcauucaagguuuauugagugaaaugaaaauaaaacaucacuaaaugucacauuuuuauagagaaaaacuuauagugguuuaucugugaagcuguuugcuuugcauugaagaaaacaaaguaucugcccuuugcacuguuauguaaacuucuaguucaggcuguguccucacaaguucauuguucagaguugcuucauaucacuaagagauuuugcaggcuucaauuucagacuaacacuuaaaauuuucuaugaaaauuuucuucauauaauugugauguacacucuaauauuaacuaccaagauuguuuaaaauaucuuuaauuaauuuaacuuuuaaaaaguauucuuuaaaagucaguaauguuuuaaaaaguaguuacucugccuuaaaggaauuuacaacguuagguuaagaaauaaacaacaucuguauacacacacacacacacacacacacacacaccacaaaugaaguaugacucaauuuuaccaaaugaaucaucaugccagugcugcugcauuacaugggaauuaguccauaaugaugccaguggugaagaaguacguguacaggcugcuuauauaaagcugcauauacaaacaaagguugagagacacaucagaauguacuuauacugaaaauauagcauacuaagcaauuugucuauugauuucccccugacuccuugugauuuuuaggucugcuucuccaaagcauggauucaccauuaugaauaggcugagcauggaaaauaggacagaaccuauuacuaaagacuuggauuuccaacuccaggacccuuuccuucucuacagaaaugccagaugugagucuuucuuacuacaguggguuguuuuacuucugaaguuuggccaaguguuuaaaauuguacaguguuugccauuguguuugcauuugguaucaguggcuauggggggugucagcauuuuaacaaauguuaauguuuaggaaaugcaugcccuaaugauggaauagauucuuccuuggaagaguuuaagugaauauaaauaugaugauauaaaccuaaacccugucuuuugaagcuuuauggauuuguagugugaacccauugcugaucuuaagccugagcagggcugggugaggcaaguucuuagugaggagacugcagagacacacacauagguggcucccugaacgaagaauuaacgagucugcuauggcacuuuuucuuuauguaucacuuuuggccgagugagcugacaaaguguuugagggccuguauuguaggagugccaucuucugaauacaaguaaauaaaaaaucaaaguccaaaaaguuucuuucagucauuaagaauuuaauaacccuuuguaauguggaagucguaguagguaacuaaauaguccuugucagauuugaaaugaaguagccaucgccuuucucauacuacauuuuacucucguaucguuucugaccacuuguguugcacugcuggucagcccagaggaagauugcugaaaauaugccaguugcagggacaucucuacacacagaaaacaagaacauaauacucaauauauaaauacauaugugugcacacacaugcaccuuaugcuuuguggacagcuuucauaaagaccuugcagugaagaaauguuuucuguauauuuuucauccuacucuuugaacucaagauacaugaauuugccuaccauauacuauucaguguaauuuuaaugaguauaauguaaauaauauuugacauuuuaaccccaaugcaucauuaagaugcauuaaaaugaugcuguauauaauugucauaauaggugguuauccuauuauuuagagaauaaauuuuuaugagagaaaaaaauaaagcuauugaaacuauaauaugacuuacuaauggcagguccugugaaaugaaaaguuuugcaauauagaaaaauauuguguuuucuccucauguuucuuugccgaaagguacacuuuaucaauuguaguuuauuacuaaagacuuggaauuccaacuccaggacccuuuccuucucuacagaaaugccaguuugaauuguuuauaguuugaauuguuuugugugcuuauaguuaugucaggguuuuuuuugagauuauuagauuuuaugucaaauuaauauauaauuuaaguccuaauaaaauaacuacaaaguuaccuguaaucaucacuuuugguugcuuuuauuuuggauaaauacauggucugaucaguuauagguaauauuuuauuuuaaauucuuauuauagaucacauauuaacuacuauaccaaaaauauaaaaacacaaacucucuuuaaugcaucaauuuaaaaaauaaccuucuuaagucccacaggguuuaucugauagaaaauacuauuuagaucuaauaaacauacaccuugguucuaagcgugugcuguccacuaugauagucacuaacuacuguggccguuuaguaccugaaguguggcuagucuaaacggagcugcacugugaguguccaacaggcaccaacugucagacagugcaaaaaaaaaaggaaaaaaccucaauuauuaauuauuuuauauuaacauguugaaaugacaauauuuuggauaaauugggcaaaauaaaauauauuauuaauuucacuugcuucuuuguauuuuuuaauuuaaaauaacagauguggcucacguucgugguuccccucauauuucuauugaauggcacuguucuauuuuaauuuguuuuucauauuuuauuuuauguuuccguauuuuauaaugauuuucauuuauuuuaccauguuuaauaaucacaauuuuguggaguagacauuuucauugccauuuugcagaugaggaaacugagacuccagugaggaggcagacuguguaaaaacccacagauucugauuucacuuccguugcuuuuuccacaccaccuguacugcucuacuauuaaacauggaugcaaauuaaagguagccuuugggaugcauauuaaaauguuucuaaugaauuuccauacaaaagaaauagaaucaguugaacaacaaagagugaaagggaauggaucuauuuacuuuucuggauucauuuugccuuuuuuuuuuuuuuguccuuucuaucugauacugauugccuuugcacccagagucauuugguuuuauguuguuugcaaaagccuuuucaaucccgggcaucaaagguacacagaaggguuuaccacaggugcugucagagugucagauaccucuuaaacguuuuaauagaauucaaauauguuauauaauaauuauguaugguuuacauguucuuugguggcauauagauugguuggccuuucuuugggcaaggaacucagcuuuacucaggauuguuuuuguaagacuauuuccucaagauauucuguauagucaagaaucucucugucuggucuuugcauuucacauuggcuuauguaugucauaggccauauuugggcauuucaaauagacaaagguagaauugauagagguuuguggugagguuuuuuagauucauuaggagagaaaaaaaaaaucccuuucuugaauuggaugaauguagaagagcaaaauaaagaaaugaaaaucccaaacucucuucauuuaaucagccaaaaaaagaugcuugauaaauagaguaacuucauucaaacacaaaauagauuacuuuauuacagaaaaggguuuauacauuguuuaaaggguuuaaacauuguuaaaaugggguuugaccuguaugaacuuuaaaaguaaguaagauagcuguuaaaguuagggcaaacauuucauucauucauuuauucaacaaacauuuacugucugccaaacacuauguucagguuuuauauggguuaucccauaacuuuuucuugaaaauacuguuauuccuguuuuauaaaugagaauacuaagguuaaagggauuaagugauacgcugugguccaugacuauuuugagauggaaacaccacuugaaccaagaaaccuuaacuucgagacccaaggcccaagcagugaaguacuagcaguaaauaaugcauuugagccaaguuuaucauuuacaaacacuuaguuauuuuagaguacgcuccaagguuuaaaaagcaaguuuuuuuagccuugagauucaagcauauaucaguuauuagagagauuaguuuuuaccagauuaaaaacuaauuuaacaaaaagcugaauuagaccacuucuuuuguaauauucccauauaguaaucacuuacuguguuuuucauuucgcaacuaaauaagauauuagcauauggaaauauauuuucccaaauauaauacuuaaguuauagacagcaaugacauggggauuccuuucuuuucuugcuuuuucaauugagacggagucuugcucuauuuguccaggcuggagugcaguggcacaaucucggcuuauugcagccuccaccucccaaguucaagcaauucuccugccucagccucugaguagcugggauuauagguguauggcaccaugccuggcugauuuuuguguuuuuaguagagacaggguuucaccguguuggccaggauggucucaaacuccugacuucaagugaucacccaccuuggccucccaaagggcugggauuauaggcgugagccaccacgcccagccccuuuccuuucccuuucccuuucccuuuucuuuccucuuuccuuuuucucuuugcucugcuccugcuccugcuccugcuccugcucugcucuuuagagacaaguucuugcucugucacccaggcuggagugccauggcauuggucauagccucauugcaaccuugaacuccugggcuaaaccgccauauccagauaauuuaaaacaaccuuuuuagagacaggaucuugcuguguuucccaggcugguuucaaauuccuggccucaagugaucuucccaccucagccuccugaguaguuggcauuacaggcgggagccaccaugcccagcugacagggauauuucagagcuaggccaacaaguugaauauaggauauaauccacaguuauaggauugcaaugaaauucuuuuuagaugcuggauuuuauugcagauguaaaccugaaguuuagaucaaaucagaaaagaaaaacuuaagauauuuaggaccaaaacuauuuuagaaaacuccuccuaagucuuaaagugaauuuaccauuuuggguaguuuuguaugaaaaaagaaaugacaguuuaaauccuugauuaacauucauaggaucugggaaaaacugcuauaaauaacggaaauaguacccugaaugaaaaggaaaauuacagguagcccccaucuucuaaauaggccaucuucauaaaaguugccuucuaaagugagugguugguagacuuuuggguaaacgauggcagagugagcacacuccuaguuuuccugaaauucucuugaaaugacaguaaaaaaauuaaaaagacauaaacccaaaggaugaaggauccauuuuacgaaagagauagaauaaacaagaaauaggaagcgugcuguaauagcuuuauuguucacaaacaugagcguugccuccucacagaggguuauuuaucuuugcucuguuggcuauaccacgcauugacccacccugcagaaugguaauauguacucaccuuguuguacucaaguauggcuauacuaauugcuuuggccagugaaauguggcugaaagugauauguaucacuucugagcaaauauuuuaagaacuagcuuaagauuuacugccuuuuuuccuucugccaugaugaccagcaauauuccaggcagaggcugcuuugugagccuagguucugaaaugaagauaacauggcacagagguaacaaugacccaugauggacacguagcuuguagaaauaaaccugugucauuguaagcuaagccauugagauuuuggugucauuuguuacuguagcauaacuuggccuauugugacugauauacaaaucauccaggaagaagggaaucucccagagcaaaggugaagagucccguaaugaccccugugcaacuggaggggauuuaaauuaaagucaaagggugaauugcuucaggaaugguauccaagaaaaaauuuacaacugauaguuugaaucuauugggacauuuacagcuacuuuuuaagaguuuggugaugauaugaggagcauugaaaacuaagggggagggagacagaagaaacccuuuuuaauuccugggaaaacaaaauauugaacaaaaaaggaaauguaaucauaguacaccauguagcucugcaaaucauaauacauaguuaaagacacugaauaugaaagcauuauauuggaaggaugggguuguauguguguguaucugugugugaauuuguguguauuguaagaaaacugaauccucuucagucaauuuuugaaaaucaagaaaugguacauacaugauauaugggaaagggauuuaaauaccauaagaaaaauuggaugagaaauaaauggagagcagaaagaacugucguagauguaauuuaaauugcuuucagggagcaguaaucaagaauggagugacuagagaaggguucuauuugcuaugaaguucacaguauuauuuaacuucuaaaauuauguacauguauuauuuuuauggaaauaaaaaccaaaaauauaauuggauaucaaaauacauucucucauaaaaaacauaauuuuaguugugguuagcuuuccaagucaacucacaaaagccuuucuagcccagugugcaccuguuuaagaguagcauacuaguauuauaaugauguacauaugaaauacagcacuagcauauguaggauuauuucuguaggaaaauccauucaagaauaaaacuguauagaggccaagaauauaauuuccuuagcagcagggcagaguacuucuaaugcccauuuguauuaacaaaucguuuguaaagcugggaguuccuguaaguucuuuuuuuuaagcaugcgugguaauaguaaaccuuuugaagccuucacagccauguuucuuaauucuggagugguucuguagcuucucuccuucguucuauccccacuucuauuccaguucaggcuuucauuauguguuacuugggauguuucauaaccccccauagcaaaaagggauugaacuucuggcaucauccaaaauagaauaaguucacuacaguauaucucucccacuguuuacaacuaaaaguucugggcagauuacaaaagcaacuaacuggggccucugaaaguaaaugacaacagacacacugaggagagcaaucagaacuugaagaaaaacugcuaugguggugaguuccuggcuuuauucuuuccucuuuuaucaacuggcuuugacccaagaaugcgccaagucacagaacgcuaggaaaaaaaaaauaacaaaaccugagagaaacuccucuuucuaaaaacuucccccuuuucuuucccuaccucccuuuuacucuucuaccccuaccgugaagccaguugcagggaaagcugaacugccacugugguggucauggugguagcacaggcaccugacaucccaagaaagacccugucucugccccuguggucugaagaguggaggaaaaucccauuauguauuuuuauuuuuauuuucuuuugcugcacagacugucugacagugugagagucuaaaacccugagauaaacccugacuuuguagucggaagacuggggaaaaaggccccugacagcuggcgagugggagcaauucuagaggagggagcuggaugaggagaucuccuaauucugucuaggaacucaugcaaauccuggguccaccugugagcuacauacauguaacagaacccaggaaauaacaacagcuuugagaauuaacuuacaauauaaaccauuauuccaaauucagacuaguauauguauagggcagacauaaacaccuuugaaaauagaacugacggcugggcgcaguggcucacgccuguaaucccagcacuuugggaggccaaggcgggcagaucacgaggucaggagaucgagaccauccuggcuaacacggugaaacuccaucucuacuaaaaauacaaaacaaaauuagccaagugugguggcaggcaccugcagucccagcuacuugggaggcugaggcaggagaauggcgugaacccaggagguggagcuugcagugagccaagaucgcaccacugcacuccagccugggcgacagagggagacucgucucaaaaaaaaagaaaaaagaaaauggaacugauaugggaagcaucauccacaggcagcaagacagagcuucuuaucuaaaccuaacugaauugauugcuuucucaaauauacaaagugaacauucucuggaggguuucaagaggacucugagucucacaaaauaauaaaaauguccagggugcaauccaaaauuacuagccaggaaaauaugccaaacugucaaggaaaaaaucaguagccacccugagaugaucuggauguuagaauuauaagauagugacauuaagauaguuauuaccaugcucugugagguaaaacuggauacucuugaaaagaauggaaagauagaaauucuuggcacaaaaauagguauaaaaaauaaccaaauggaaaauuuggaacugaauaauauacuauuucuuggauggucuuaauagcaaaaugcagaugacaguggaaagaagaguuagugaacucauagauaggucaauagaaauuuucaaaccugaagaauauagagccaagauguuuuuuaaaaaugaacagggccuucagaaauccguggggcaauaucagaaggucuaauuugugccauugaagucuaauaaagaggagagacucauaaauauuugaaaaaauaauguccaaaaccuuucccagucuaaugaaggagacaaauguauagauucaaggaacucagugaauccccaaacagaauaaacccaaagaaaaccaugcccaugacaugacagucacaaucaaacugcugaaaaacaaagauuuuuuuuuuuuuuuaaucuugaaagcaaaccagagaaaaccauuguguuacaucuaggauaauaauguuuugaaugacugcagauuucuuaucagaaauuauguaggccagaagacaguggagcaacauuuucaaguuuggaaauaaaagagcuauuaaccuagaauucuauuuccagcaaaaauaucauucaggaaugaaggugaaauaaagacauauacucugauaaaggaaacauaaaaagaaccuuuuuuuuuuuuuuuuuuuuuuuaccagaagacccacuguagaauaaaugcuaaaagaaauucuucaggcuggaaggaauaauaucaaagggaaagcuggaauugcaggaugaaguaggaacaacagaaauaguaaauauacggguaauuacaaaagauuuauuuuuucuccucucaaauucuuuaaaauacaugugacuguugaaagcaaaaguuauaacauugucaggaaggagguucaguguauacggaugugauacaugugacaacuauaacauaaaaagagaggguaaauggaccuguacacuuauagagccuuuacauucuguuugaagugguaaaagaaaaacucuaaguauagacuggguaaaguuagauauguauauuguauuucuuagagcaaccacuaaaaagaaauauagagauaucaccaagagauaaaauagaauacuaaaaaauucaaauaacccaaaagaagacaagaaagaggguaacaggagagcaaaaaacaugacaaacauuaaacaaaaaauaaaacgguagaccuacccaaguucaaccauaucgguaguuacguuacauguaaaugggcuaacauagugauuaaaagagauugccagauuggauuaaaaaagcauggccuaacuauaugcuuucuacacaaaacccauuuuaaauguaacaauauagauagguuaaagguaaaaggaugaagaaagauauaccaugcaaauacuaaugaaaagaaaacuggggugucuagauuaacaucagacaaaguagaugucagaacaaugaaaauuaccagggauaaaaaacgacauugcauaaugauauagggauaaagucauccaaaaggcauaauaauuauuaauguguaugcaccuaaauacagagcuucaaagugugugaagcaaaaagugauagaaccgaaaggagaaguuuuuguuuuuuuuuuaauucugcaguuacuuggagaauuuagugcuccacuuucuacaaucaauagagcaagaggacagaaaacagcaaguauauggaagacuugaacaacacuaucaacuaaacacagcugucauuuauauuauauucuaucgaaugacagcagaauggacguucuucucaagugcacgugaaacauuccccaagauaaaccuuaucguaggucauaaagcaaaccuuaaaaauuuuuaaagaguugaaaucauacaaaguauauucuugggaccacaauagaauuaaauuagacaucaacaacagaaagguaucuggaauauccccaaauauuuggaaauuaaacagcauacuucugaaaaagucaugucaaagaagaaagaaaauuagagaacauuugaacugaauaacaaugaaaauuauaauauuucaguugcaaccaaaguuggacuuacagggaaauuuauagcaucaaauacuuguauuggaaaagaagaaaguucuuaagucaguaauucaaacguucacuuaaagaaaauaggagaagaguauauuaaauccaaagcaaacagaaggaaagaaauaaaaagaagagaaaucaaugagauaaaaaacaaaaaaacuguuuagagaaaauuagugaaaccaaaaccugauuaucuuugaaaagaaucaguaaaacugguaaacaccuggccagacugaugaaggaaaaaaaaaaagaagacacaaauuagcaguaucagaaaugaaagaaaggcuaucuacagacauuaaaaggauaauaagggaguacuauaauucagcaacuuagaugaaauggacuaauucacugagaaauacaaaucaucagaauuaacucaagaaaaauagguaagcugaauagucccauaauaaggaauugaauuuguaauuaaaaaucuaacaaaacuccaaguucagauaguuuaacuggugaauucuaccaaauguucaagggaggaauaauaccaauucuauacaaucucuuucagaaaguagaagagguauuauuuuccaacucauuuuaugagggcagcauuauccugauaccaaaacaaggcaaagacauuucaagaaaagaaaauuauugaucaaugucucuugugaauauagguauaaaaauccucagcaaaaugcgaacaaaaaaauguuuauaguagcauuauucacaguagccaaauggugggaauaacccaaacauccaucagugaaugaauggauaaacaaaauauuauauacacauacaauggaauauuauucaaccucaaaagagaauaaaauuauauauauaguacaacgugaaugaaccuugaagacauuaugcuaaguuaaaccagacacaaaagaacaaauauuguaugauuccacuucugugagguaccuagaguagucaaauucauacagacagaaaguaaaauagugguuuucaggggcuucagggaauggagaguggggaguuaucuucuaauggguacagaguuuuaguuugggaugaugaaaaaguucuggagauggauagcggugaugguugcacaauauuguggaugugcuuaaugccacugaacugcauauuuuaaacuguaaauuuaauguuuuuaauauuuuaacacaauaaaaaaggaaaaaauacuagcaaauugaauccagcaauucauaaaaaggauaugucguuagccuuauaauucacaucuggcuuauccccuccauccaaaaccacagcuggauuuaucuuccuguagcacaagccuaauuaauuugcuuuccuucucaaaaucugaaaugccuuccaaguaaaacuuuucaccuaacauuuaaagcuggcuguagucaggucaguuacccuuucagaucacaucugcugcuacucuugcacgcuugccuaaugcuccaagcaaacaacuacauauacacuuucccagaacacucuuaccugcaugcuuuuaaauauucuuuuuucuccuuaaauucucucccucauucugaccaaucucuaccagauaaauucuacucauauuucaaaacccagcuggaacuuuaccucccuggauguuuuugugaguccccuguguagcugugaugucucacugcagcauauaugucuuuuauguuguacuuauauuugcuuugcucauuuguuauugagcacuugucuguugaaacugauucuguguuggguuuuggcaguaacgaauaagcuauaucccuucccccuuacaguuuaccauccuagcacgaaagacagacauguaaacauauauguucaaaauaacaugcuaaaucugagcuagaaauaaaggcaauuacuaguugugcuuauaguuuaccuuauguauaauauuuuguccuggcuucucuguuagagugcaggcaccuucagggcaaaggugucuuuccagucccccauagcacugaauuccuugcauuaaaugugcacaauuaaauauuugcaaugaguacugaauuguuuuuauuggauuucuuuauucaaagcuauggcugaaacuuaaccuaaaaguucacaacuauuucuuuaguuuuucuuuuggagcauuagccauuaggcauuaaggagccucugugguuccuguguagaaacccgaagcagugagugauuuuagcagcuuaccuaggagccgcucagcuucucaagguuacuuuaauauguguagugguaacauuuaccuacaaguuccuagaggugauugugaguugugagaaugccauacauccucaucaugggaaauuuaauaguucaaggaagagauauguaaugugggaaaauguuaguuuuaucuaugugaacaagaugauguauaaugcauauauauaauauaaauuuucuuuauagaacuuuauuuaaauucuaaaaagcacuguuauggaugucuccuucaacuuguuuuaugcuuauugagauauugugauuugauauuuaagaaguuuauucacuguguuaaacuugauaucuuaauuaugauacaugaaaacaggccacaucucuguuuccuccuggcccuguuaaaccauggccgugugguuuaaacagaaaagcuuaugcuaucgauguuuuaucugcaaaugaaauaagaacuuuuuuucauuuuuauagaagcaacgaaauaaauaacucuuuauuaaaaauaguuaaagguaguauuaccaaacacuggauuuaaaaugacacuuauaagcauuuacuauaaaacaaaaaaugauaaauuuuaccucaucaaaaguaaaaauuucaucaaauuaaaaacuucuguucuuaagauaccuuugggauaaugaaaagaaaaaccacagacugggaaaacauauugagaacauguacauauaucugacucagcacuauauugagaauauguaaauaacacuuagaaauuaacaacagaaagacaagccaacuuaaaaauuagcaaaagauuugaaaagacgcuuuuaaaaagaagauauacaaauaccaauagucacaugaaaagauucuuaacaugauuccucagguacuuugaagugaaugcauguagccguaguuucuugcuuuuuauucuguguaguacuccacugcaucauuauauugcagucuauuuauucuccuaucgauagauacuugaauuauuuccaaauuugagcuauucugaauaaaguugccaugaacauuccuguccauguuuuuuagguggauauguaugccuaucuaucuuggguuuauaccuaggagugaaauugauggggacauaguguauggguuuguuuagcuuuagagauacugcugaacaguuaugugccuauuuguacucucuccaauaaugucuaagacuucccauuugcuccacauccuugucaaaacuugauauuguuuguuuuuuuuaauuuucugggaauucugaagugauaucucauugugauuuuaauuugcauuuuaccauaacaacagacuguauugagcauuucuucauaugcuuauuggacauuggaaaccuaugcagauuaaagcccaaauaagaauaucacauacuccuuagaauggcuaaaauuaaaaagacaaguguuaaugaggauguggagcaauggaaacuuugauacauugcuugugaaagaguaauaugcuacaacuacuuuggagaacuauuuggcaauuucucauaaacuuaaacauauaacuagcguaugauccaacaaguuccguucguaguuauuuacuuaagagaaaugggcugggcacgguggcucacgccuguaaucccaacacuaugggaggcugaggcgggcggaucacuugaggucaggaguucgagacgagccuggccaacauggugaaacccccucucuacuaaaaauacaaaaauuagccaggcaugguggcaggccccugugaucccagcuacuggggaggccaaggcaggaucacuugaacccugaagguggagguuguagugagccaagauggcaccacugcacuccagccugggcgaugaagccagacuccgucucaaagacaaacaaacaaaaaauccaggcgcuguggcucacgcuuguaaucccaacacuuugggaggccgaagcaggcggaucaccugaggucaggaguuugagaccagccuggccaacauggcgaaaccccaucucuacuaaaaauaaaaaaaauuagccaggcucgauggcgggcacguguaaucccagccacuugggagccugaggcaggagaauuucuugaacgcgggaggcggagguugcagcagugagccaagaucgcgccauugcacuccagccugggugacagagugagacuccgaaagcacauguccacacaaagacuuuuacacaaaugcucaaagcaguuuuauucauaauagcaaaaaacucugguaauaaccuggauacccauuaauaguuacauagaugaacaaauuuugguauauaauaauagaacacuacucagcgauaagaagaaaugaacuacugauauauucaacaacaugaauuaauuucagaaacauguugagcaaagcaagccaucuacaaaagaggauauacuguacgaccccauuuauaugaaguuuauaugaaguugaagaacaggcaaaacuaaucuagggugauagaaguaaaaaauugguugucucugcuggggcuggugguggaaguggggugugguuguugacuggaaaagagugauaaaaauauuuuauaucuuguuuucaguguugguuacauaagaguguuuuauugccaacucacugagcagaacacuuuaagaucugugcauuuucuuguacauaaaugauucuucaauguaagaaaguagaaauaauugaaccuuauaaaagaaguauuuaaauaaaugaaaauuuaaggauaauuuuuuacccuucuuuauuuuccugacauuuauuaaccaguguuucugcuaacccugaucucugcuguguugguuagaauauuacacuaacucuuuauuacuuugcgucuuggcuuuuucaaccuggaaauaaagcaguccuuguucuaaaacacaucuucaguacuuuaaaccaacauaauaccaaaagcuugaugucaacugaaagccccaaguaaugugagguaauagaaauaguugagucugcauuucuaguuuccagaucagugagaaggcuaugcccccuuucucuggguugcgacaucugcuuucuccccauggucagagaagcaagauuucucuuugccaaaaauauggaaaccguauaacuuaauauuuuuccugaguggaaggaauuaaccuuccacuucucucuugagagucaauuuuuuuaaaugucaauuuccuagcaaagaggagccuuagcauuauucugcagugcuuucucuagaaugaaacauauaaaaacaauacaguuuaaaaauauaauaguagauauuuucuugguggcuauuauagaacaucuuaugaaguauaaacuugauugucuuccaaagcuccaaaguuaaaguguaccuguauauacccauaguaaauaauagcaguaagaaagucaaauuuagagaacaaugaugagucauaauuuggaaacaauauugcucacuauacuuagaaugcauuuuguaaaacguuuucucugccacuauguuaccauuaauuaauugguugcuaauuaucuaggcuauugagaaggcagugguauggauaauaaauuacaggccccuuaugggcaaagaccauaucuuauauuuuacuuauauucuguggugccaaauaaacacaggaaauaaacagauuuagauaagaaauagacauguacaguguacuuaacaaaauucgcaaaucacuuauauucuagaauuguuauauguguauauguguaucugaugauuuuguguggcaucuggaacaucagaaugcauaagacaaagcuuugaagauacgcugcuuggagugaucaagcaggagucacaaaguugucgagcuuuccaaaaugucuuccuguuucccacuucaugguagagacggagaaugacaccucuccaacgaaggcaaaccaguagccacagcugaacugugugauucacccucaucauggccgagcaugcuaacagaucugugcuuuuuaagcuuucuccuaggcuucaggcuacauggaggaauaaaagcucuuccaacuuaacaaauucuaagacuuggagacuuuguuacgucuuuucuuaaccuugcaaucaguuuaggcagugauuacaaaagcaaucuggaaaguuaaaagugaacucuguguaaauuuauuaccaaguaaaugaaagacacauuaucugcccagagauaacugaggguuguuuuccauucuaggauauuuauuggcauauugauagucgcaaauaguaguuccuaaucuucugugagucacaaaccccuaugagaaucugaagacuuuucuucuucccuuuuuuccuucauuucuuccuucuuuacuuccuacuuuccuuccucccccucccucccucccucucccccuuuccucaaauauauuugcuugacugcugugugccagacauuguuuuagagggucuaugcuuugcacuuuuucaccucccaaaauuugcauauauacaugacauuuugcauauaguuuuagggauuuuauugaaccccuaaagcucucuagggucaagaaacuaauauuuaaaguaacuauauggcuaaaaauacuugacauucuuacuaggcaaaaacuuaguauuugcaggaauaacagaauacauuucucuucgggaucugcccaggaagacaagaccuuaaaguagacucauucacaucaugagcagugaggaaugggagccgaggaauuugacauuucauauuuagucagaauagguaaccuauacagucuugaggcucuuuuacuguaugugagaggagugguugguugaauuagaaacuuucaaggacuccuuuuaagccugcauuuaaugagaaagaaagaagagccaccaaaauuuaaaaaucauaauguggucacugaaucuuacuuugugucucuaagucuccuuugccauuccgacugaaaaauugaucuauuuauuaugcaccauugcuuagagagcuaacauguuaauauaugauaaaggguuauacgucuacugugacuugagugaugaaacuugucacugugaccuuuaauccaaaaugacuuuuuuguucucugucaguacuccacuuaggcugaaaggaagggaucuaaacucuaaagaaaacuauccaucuaaagaaaggcucugaaaaaucucaaguaaagcagaauuucacucuugagccuugugguaucucuggauuucguauuucuauuuuucuguguguugaguugugacaccagauaguuccuugaaacacacacauaagcagauacacagugugaguaaacaacccuucucuucacccugaccauccaauuaacacaguuucuacuucuccaucauaacugccaggggacucacggagagaaccuucaugugaauauauacauuucuuauguaacuuaacaaucugacaugcugaggugaggaaaaacccauguggcaaagucauauauggugauuuacagcugcuacaaaguaaagucacuuguuuuauccuaaaccauaaagacuauuaagguucucagcuugaccaagaaaacauaguaaugcuauucagauugauacgcugcaucuguggcuuggacaugcaguguauuuuauguuuuguguuuaagagagcccaguuuagcaugguggaagucuaaauucuuggcagagaaaagcuggguuccaaaacauuuucuuaaaugcuuaauaaggaaagcaucuuuuaguuucccuacccuuuaucuauaguaaguggucauuauggcuauauaauguguauucuuuuagauucuguguuuuauauuacuaauuuuuguccaaaaaucauuuaguaaauaguuucaaauaaucaaguucuggaaucaaaguaaauuuacugcuuaacccacagaaggaaaaauuauggguuuugaagaaggaaaacaauuuuggccaagaacuuguauuagaauuaccuuauguauagccuuagagcucuuauuucauaguagaaccaaaacacaauuuaacuguuuaaacauaaaggguuuuuggaaagagucuuuuggaaaguaguaucuccuaugucuauauucacagauuaagguaaaaaugaaaaaauaaagaaacucugacuuuucuuuaaucaggaaguagcacuaggcuccuuuggcuagacuacugcuaugucaaauuguagaaauauuucugugaucauguguuuuauaguuaggcuauuuucagcagagcuauuccuaucauuguuaaacacucaauuaaaucaucuggcucaaauaugaagaagucuguucuucauuggaacaaauuuuugaccuguagaaauauucuguuuuaaaaauaagcuuaagcauaaauagacauguuuaaacauagcuuucucaaaaacugcgauuauaggagacuggacuuauuuauguacauugagauucacuuauggugauaguugucaguguguugcuggaaugacugacaugcaucuaaaucuuacauuuuucaggucauucaggugcuuauauauguaagcuugggauugccauuaucaaacgcgacuagaauaugaauagcuuggauuuucugguagaccaaaguacuauuaguuauuauuuguccuuuguuuuuccauaaugaagagaaaugcaugugauuuugcagaauuguugcauccuuugagcucuuaguugccagugccuaacaaguagucaaucaggaagaaugguauaugguagaguuguaauaguaaauacacauuaaacgaguacauuagugucuacauagugcuggaucaaucgaaauauacagucuucgggagcucauauccuaaugacagaaucccaucaacacuacuuaagcauaagaagguaaaguguuugaagcaaaauaaacucucagugaagguugaaggagaacaaaagcggugauaugaggagacuguccaugcugaaauuucugguagaagguguaaucaauugauagagaauucuagcauaucuaguccacauguugaauuauuccaggaagugauaauuauugauauuagcaauuacaaggguuauugaugguagaagagcuugaagucuuagauuucauuucaacucagcaaguauuuguugaaugucugcacaugcuguuugcuguacuggguguuuuaacaaaguccuccccuccaggagcuuauagucuaguggagggaacagauuuauaaaugcuuaauuuauuaccuuuuuuacuacaaggauauacaaaacuacaggagcaaagaaaaaguugggacuguuuauuccuagaggagugagaaagccugggucuucaaggacgaguagagagaaggaaaagauguauuagggacucccugcaugauauuuguggccaaggagauuuugaaauuuuucagcaagauuaugaacaaaugaaaauauaaauuuaaguggccaacaaagcagaauaaguuguuucuauuuauauuuguuguaaacuauggacuuuucugcuuccuaauuuuuaaaaguuuauuuacucuguuauaucucuuagauuaaaggaacaaauaaaacuaggaaauuaguauacgaugaaaaagauuccauaugaccuuugguaaaccugaggguaguagaugaccucaagguucccaguuuaggaagaugaugaucucugggaagauuaggaagauugaaugauauaacaugaauccauuauaaauuaaaacuuucuaaaagauuaaaucugucuuuuacugggaaaguaauaaauucucauuuauaguuggagaguacauauuaauuuaauccaaauuaguauaaugcuuuaauucagagaguuuuguuuguuuuuaauggcauuaacuuucuaauaacauuaauuuauuuagaaaggggagguuuguuucuacuguuucccccaaaauguucaugaguauuagucacccauaaaauagaaacugcuucucaucugcuuugaaccuuccauuauucucaggucaugggaucgcugauuugugaggugcaguaaaaccaugucauaugaaaagaagcagaccaggggccaaagauaacagugcuauguagacucucaguggccagugaagauuuuguuuuacaagauuguguccguguuuggucaguaaagcuaacgcagaaggugaauggaagaacauuacuuuaaaggcauuagagaacaugccggaggaaagcauuuugagugcaaacauuccaaauggggaagaaguacagaauccgcacagagccggccaaacgcagccuguguuucccaucuauggaugccagcacacaggcagcgucauugcugcucgaguguuuacugcugugaaaacacugccacuaccagaaagcuuaauucccuuccucuuucuuuucucucuuuuucucccucucccucccucccuuccucacugaucuccccccucccuucauuccauccuucuuuuuuuccuuuugagaguccauaugaacuuugguuuaaaaagacuaauuccagucuuuuauaaccaagccuagaacucaauccaauauguaaaaacaaauuugaaugcuucauguauuucauuugaaaggcugggagaagggcauguuuuaggggaaacagauuaaaccaagaaaaaugacuuuggcuagcuuauuuaaccuuguuagaccacagauuccucauuggugaaauagguucuugaacugcaugcuucuuaccugacuucuggcucuaaaauuucaugguucuauuuuucuguuuuuuuuaaauaucuugggaucuuucaaaugccuaguagcugugugugcauguguacuaccauaugcuaguaacgagucaucaucaauguggucagauuuauuaaagcuugaucuagauaaaugcuauaguaaaucaagaaacauuauauuugaaugaagucucagaaacaaguguuuacacaaauauaugauuagauauucuccauccuuacauugaaaauauuauucuacucuugugaggaagacuucaugaaaggaguggaguuugaaggaauuuuaaauuuugguuuauccuuagaugcccagaagagguuuguguaaugucacacuaccacguuuccguggcuuuccaaguaaaaagagggaacuuaaaugccuuccuugcugaaugcuaagaaaaacauauuucccugucuuuuugagaggaauuagugaaguuauauuagaaagaacauuaccaaaucagauguccugccuauuuaaauuuuacccauguaauuauguguuuaucauccacuuccuaauugaauggauauauaucuucuuuuaaaaauuuacacaaacauuaucacauguccucauuagacgauuacaagcuaucauucaugauuuggaguuguaugguauuuggguaaaaauauaaaacaaauuauaaauaucuuaaaagaacagaucaaacagaaauauuuauuaggaacauaaaugagauaaggcaaauccccaaagaacaugcaaaaugaacuaaugcaccaugcuaauaagaaucaaaggguuacaaaugaaaauguacauuugaaugacgcugacaugacacugccuuuaauggccccuuaacuagccucuuaaaauuugaccagcuuuugguuuuuccacugaagaaauuuaaaaagaaaauaccacuacugaauauaaucagcuugcucucugccuugucuuuguggaccuaaaaaauccagacaugaagucuauauggaaauuuugaucuccuugaucuuacugacggaguuaaaaggaaaguaaaagauugguguuucauuauguaaaggcaguauugcauugccuguugccucaaacaucacuuuuuuucaauugagaauuuccaaagaacggcauaaaccaggauagugcaguuacaggcaaaauuuuacaacggugugugguaaauccugauuaaauauggagagaugaguucuuagagugaggaagucacauucuagguaucauuaggauauuuagaguaaauuucaacauguucuuccuacucuuuauuucacuuuaggguuucuuaccuccaggagagauguagaaauaguugaguugagcuucaugcaccaaaguacccuuaaacuugaccuccguguuggcagacagguggcugggaagcggcugguaugcaggcguaccaggcugaacaaaggcucgaagcauugugaauuuccagauguauauuaauugguugauuuuuaaagcuaaauaauuauccugcucaugaucucuuauaauuuuuuaaaacccagaagcuauuccugcaguaacauuucagugccacaaaaguugacauggccguaucguaucgcugcaaguuuaaguuacaguaaaauuccuuuuaaguuuuagaauucuaaaaaacaaaacaaaacaccuucuuacuugauucuuuucaaccuuguauuuucgucuucccugcucugcucccugccuauguagggaugggccucucagccaguggcuuuacgggaaaacuuggauugaaaugugaacuucaugguuucugucagccugucagcucaucaccucccuaaggcauggugaucucugguuuuuauauaucuccacagacugcuuugauagacccucuuguguggaagagugauagguuuguccagggguugguagaccuuagggcuaagaggcaggaaacuuggaaugcauacuuccauggaauucacagccucuuucccaggggaaugcacucaaguugcaaaacuauuuuagggagaagaaaguuaggcccaguucugcauuuuaucuuggugccucuuuucgguagccagaacucuugguuaaugguuuuuuuuuccccuuuggcuauuuaaauuuucuguccagacuaaacugggaucaaaagaguuaucucaaaaugaucucauuuuaauuuuuaaagccauguugcuuuggagauaaaugguuggguccuaaagaagucuucacgaugucuuaaauaauuacugcaaacucaaucuuuccuucauuuugcuuugacauuugaaagauguuccguagcauuuucgcucccuaaaucugcauuucaguuaucucauggugaugacacugucaaacugcuuuucuauuuguaucaacaguuuucuuggcaucccacccuuacgaaagccuaauuccuuaugucaaaugccgcaaauguauaacaucaaacgaaagauacccagaauauucuuauuaauagagccuauucaugagacaacaacggccauuuuuuccucugccauugggccucguguuucugaguuaugcucuguuuuucucccuuacugccaucuuucuccuuugauaguuuuggaaaagucagucuucaaggaaagaaaacuuacacuauaaccaaaaaaauaggccaggcuccuaguuuuguaacuaagguuaaagucaccaagacacgcaaacauacucagauuuauuaagugguugaacgucagugauccaaucugcuuugacuucaagaacgugaggguaugcagguuaguguaggaaucuguguagggaauuagaguagggaauuauuguugauggacuggaagcaaccuugaauaugaaguuucaagauacacauucaaugaucuugagaugaaagaauuuuguuuugauguaaaagcucucauagcacaugggcuucagaacucagacguucuuaaaaaaaaaaaaaaaaaaaagucaguguaccaaggaggaaaauguguauguauuuccaucuaagagaguaaaaugguccuguucaaggaaaagcugggauuuuuuccccuacuucccccccacuucacgugcagguagguaagauaaaagauuucugguacacugauaauugcaaaaccaaaguuuaaagcccuauugccaccuuuuggcaagugaguaauucagauucauagguuccucuuuaagauaccugcuuaaaauagcacuauaaagacauuucuuguaccuuuugauauaugaaucauuacugacaagaagcagaaauuccaugcccagacauuggucagguaagaggggaaaaaagauguaguuagaauaucauagcuguuuuaacagcaaaauacuauuaauauaauuacguguuuagaaaguuugaauuuaaagucuuuuuucccuuguaaaaacauguuuuguugguuuucauugcccuaucguaauauugcugcuguuuucagugaagauguuuuaaauguguguguaguuaaugcauuacuuagaugauuaaugccaucagauccucaacuagauauuuauaaaugucuucuggagcugcuucagccuuugcuauaaaaaugauauagauaggcacauacuaaaguauacaacuuauuugaacauuauugaaugaaucaauagcagguauauuaugucacaguuucuuucauuacuaaaugaggaaaucauagucauaucuaaucuuucagcaguuauacauuuucuguaccauuuugaagccagaaguuuauuauuaaauuuuauuuuuuccaguggccucucccuaacuuacagcuuacaaagccacuuucucaguuaacauguuccugagagaaggagaaggggagggaggcuucuaggcauaauuugaguaucagguuucugaauauuuaaaaauaaacaugaaauguguuuaugaaaugugcaaauggaguguagaaacaaugcuaucucgcagccaggaaguauagaaauugugauuucauuuuccgucuguauucauuugcuucagaggauuuugccgagugccuguuguguucaggugccauguuuucacgcggagcacaguuucuucaaugugugugggugcgcgucuuugcacaaaaccaccacggauuucucuguggacuuaaauuuugaugcuuuuuuuuuuuuuuuugagacagaguuucccucuuuucauccaggcuggcguccaauggcgcgauccuggcucacagcaaccuccaccucccagguucaagcgauucuccugccucugcaucccgaguagcugggauuauggacgcccgccaccaggccuggcuaauuuuuuuuguauuuuuaguagagaugggguuucaccauguuggccaggcuggucuugaacacuugaccucaagugaucccaaaguacugggauuacaagugugagccacugugccuggcuugaugcuguauuuuuaagcuuuaaccccaaugauugcuuuuauuuauucaauaauuauugaauaaaucaauuuaacacauagauuauuauguauuuaagauggaaaggagauuuuuuucuauuuuguaguuuugaagaugcucauaauuuguuugauguguguuuuuugcaguguccaucuauggaauuugguuuuaugauaaggaagaaugccaaagaauugcagagcuuaugaaaaaguaaguacuaaaaggcuaaauauuuuucaggaccuggugcuuuuguuuguauuucuaaguguguguaacuauacuacagucuuaacagaauauaucucccauagcaguccuuuucacugguuaggcagacauuuaguauuaauuaauaaaugaaaauuagacguaagaacaacuugccgcaguuucacugcauaauauuuaucaucuagaaugauucauuuuuuccugugugugaaauauauaugaauuguuccagauggcaguuuucuuuaauauuuucauauguaaauuagcaauuuuuugcuuugaaaaguuaucaauaugccuguugguaaaaagaacauucagagccauccuaaaagucugcucccgauucuguaaaaucuuucauuuccuucaucccccagaugcuuuccuuuaacuguguauacauguuugugggagcucagaauuuccucccaugucucagacacugaguuaagguagucuuuauuuucugucuccuuagaaauugcugaguuacuauuagcuuagugaucagucgacugucucucucuuccuuguuacuggucucuuucuuuuaaucuuaugauaccuugugauuugucccauucugcauuuugggcaacuuuaaaauugcugucugacuuucccacucuuggcuucccugauugcguugaaagaggagggcuuguucucugcucugcaguugguugacugaucaauuuuugagcccagggcugcucacugugaggcaguuauuucccugccauuuauggggaugggaagagucucagagugagaugaguuuccugcacgugcugugucacagccugggacuggacucagccaagcacauaggauggcugcugccacauggguaugacacuguagcucugugugcaaaagaaucaguccccacuuuuaaauccuggggcaaugaaaugacuagaaagugaccucacggaaaugaaaaacagggagcaccuuuuaagagaugagauagauuccugaaagucuagcuagagguagcuaauuuuagguaacuagcucaaggugcagauggugauuaaguguauucaaacugguauuuaccaccauaacaacuaguuccuagaacauucauguuacuguaaauugugcaguggauaauaauaacaggauuucauacagauuaaaaaauacccuguagcucagccaagaggccauguuauaauugucagcauucugcaguaauuaccuaacagcucgggcaggaaauugauuauuuacuagcaauaagcagcugauuguguggauuccgacccccuccccaguuagaauuaagucucucaguaaguacucagaucuuuguuaccguaaacuucauggcaauaauaagaaugugagcugaaaguuacagcacauaaagggaaaguauauuuuccucgacaucaccuagcagcauauaggagcaaucuggucuaucuuuguauuguuuuccaggcaacagaagaacuccucguugcucuaagugguuuuuuaaauggccccucuucuccgaguuagaauggaaucuuuaccauguuuugaaacugccagagagcugcaggauuugaguugccagaaucaaccuugccuugacuucaaggcagucuguaaaguaggggguucuuuccucaguauuucagaacucuaaauuggguuuccuuagcaacuaaugagagcauccuuuagaaugcacugugugaggaguuggcaaacucuucucaaagggaccagagagugaguauuuuaggcuuugcaguccauaggauuuguguuccgacuauagaauucugcccuuguaaugugaaagcagccauaaacaacauguaaacaaaggagcauggcuguguugagcuuggcuguguuugugacuuucuuuacaaaaaacagguggugggcuggacuuggcccacagauuugcugaccccuauccuagauucauuuguguagucagugaauucaggaccucaacucucauuuuucuccuuuaaauuccuaagcaagcuuauuucuaauaugguuguaacaggaugaaaacaacuaggugagaauugggaugguuuuaaacauuguuuguguugaauuggcuuuucuuguguggauuuuccccucuguuuuucuagccuaacucaguaugaacaguugaaagcccaucagggaacuggagcaggaauuuccccagugauccucaauucaggagagggcaaagaaguagacauuuuacgaaugcucaucaaggccaaagacgaauacacaaaggugaguguuugcccuuccuugugauacauacacacuucaguuccgcagugggaauauucuuguuuagcaagacuagguacuguggaugcuguuccuuccaccaaacaaaauuauauuacaaauaaaaaaucuuuauuuguaauauagauuuuuuauaagcugaagaaaacuguuugccuuuaaguggguuaaaaaauagccugagaaaucaguagccuucauauauacaauagccuucauguauacaauaaccuucauauacacaacugguaguaagucuuguuagacuuacugcaagaccccaacuuacaguagcaacaaaugaauauaaaauuguuugcaauaaaauucacgagaaaugggcaaaaccuauauaaagaaaauguuuaaaaacuccugaaaggcauaaaaauagacucaaacaaauggaaauauacacccuguuguuggauaagaagauucaacauaaagcucuuagaaaaaaaaucucuacauuuaaggugaccacuaaauaaauaccacugguuucuuuuccccuccccuccccacuucucccuuacucucugaucuagacaaguugaguguaaggcucauggaaagaaauaugcaagaaagaauagcugggaaaauccuggcaaagaagugugauauuaguagggguuggaggugggggagaugaguggggggauggagcgagcucucccugauuuuaaaacauugaagucaacauuucaaacaguaugguguugaugguauugauaccuaacagcccaauagaccaaugggacagauuuaagauucuaagucuaggauuaaauccaauuguauaugaaaucuaggauaugauaaagaugauaaucucaagucagcuauuugagugaauuccuaaauaaaugguguuggggcaacugguagccauuuggaaaaauacaaaacugagucuguaccuuacagcauacaccaggauaaauuccaaauguauuagaaauuuaaauguaaaaauauaaugauucaaguaccagaagaaaauuuguauggauuucuuuauaaucuaggaaaagagaaaucuuucaauuaugccuaaaaacccaaaagcaauuaauuaaacuacauaaaaauaaaaaacauuuuacaagguuuaaauacaacacaagcaaauagaaagauacaaaaacaacucagaaaaaaauuguugacaccagaaugacaggaagguuauuuuaugaagagcuccuaaaaauuaagaaguacaagauuaacacuagaaaaaugggcaaaaaauaaaaauuuuuaaaaauuauagaauuuggaaacuagcugaaauaaauguauguaauugaauaucauauugucacauaauuacuuagaaaaaaaauuagagugacuucaaagcccgcugcuugaacugaacacucuuaguggguuauauuuuaaggacaaaaagaacugcaagacauuauaaacuucauucauugguuuuauuguuuguaguaauguuggcauuuuaauuuuucuacuguuggcauuguaauuuuucuacuguuguggauauaauaaauaugaaauuagauaaacgugguuggaaccaaaaccuuaguguaaggggaaaaaaaucaaaucuaauaaguuaaaacuacauaagauuaaguggaaauaucagaauuaguucauguuuuguuucuuagguauaaaaacaaaaaauagaguuucucacucuugcccugaaaggacauaaaaauaaaagugacuaacucaguagcaguaagcaucuauaucacccagauuguuguuucgaaauauuacuuccuuccagaaggugucagggcucuucaaagaaauuucugauuccaggucuggaauaguaaaaccaauagggucaugugaaaggacacagaaaucagcuucaaggacacugaccagagcaccacauucuaacaucaacaggagugacuacaauggauuaaaccacauugaauguauaaaaaucuaugaguuccugguaaugagaaagagaacaagcaaaccaaacauauaaaaccaagcaaaauaauuauuaguuauccguuugaaggugcuaaggcaccaacuccuuccucugaaaauugauaauuaaugggaaugaaauaagcuuuuauccugccugcccuaaagggacuauaucucagaguaaucaaacagcccuggucaaugagggagagcuguucucuaccagagaauuccagcuaguacguguggagagaauaauagaacuuaaagacacucugcuuaaaauaauugacucaggcagugaucaucaguaauauuaauguuaugggaaagguugauagaaacuugacaguggaaggaucaggcugccuccuccugaaccccgcugauuaucaucauuaaaaguuagauaaccagauucucuggcuuccuaaugugauaagaugucaaauguacagcaccaucuugaaauauucuugcccaaagaguugauccugaaucucauuaagccuugagcucuaacuuuuuaguuuacagaaagugaaaguggguggggagugaggggagacaagguagaaaaacaaauuaaaugaugcuaugaggaagcaaucagaaaaauccugaaugaaguggcacauauaggcaguuagacaaguuucuuuaacaugcuuugccuugacugugagcuucuugaguacgaagaacauccuuuauucacuuuuauaucccuuauugucuucaaaguacuuagcacauggugaguguuaaauaauggcuauugagugaaggaaggaauaugaaugugaaugagccacaguuuaauuauccuucuauuguauggccuggacagagaugccuuaaucucagcuucagacaguaacuauucuguauucauuuuguguuuuuuuaauucuucaaaagucauuaaaaaaaauuaugaugacuuggcaacuaguugaauaauuaguuauacuuuauuaauuauacuauauuaugcacacuaaagauuaaucuucaaaaggugacauuucugcccuccaggaacuuaauguucugugaagacaguguaacaaugguaaauaaauacaaauauugaaaaaaauuauuuuccuuucuuucccucccuccucucaacacacacauaccuuguauuguuucuguuuuuuaucuucuauauguuauaauguuuugacaucuuaaaauccuuucuggcuggggagacugccccuccugugaccagccaguguucagagauagcaaagggcuuggccaggagcacgccuuuaauaugcacacuaaccaauccugagccauacguaucuccucgucucuggccuguacaauauuccucugccuuaaucaucccagggccagguacccagcaacuggggaccacucauacaguuuagagccugcuggaguuauucaaacuggccaaucuuaaccuguuuaccaugcccugccuugccuuccuugaggaaauucaguaaaugcucuagccuacgccuuccccuugcugcugacacccugaggcuuccacacguggcccugugcagcguggcaugccucuugucuccaggaccugugaguauaauaaacuuuguuuuccugagacucuccugugucuccucucuggccucacuugagugaccaucacauaaaagaacagcacaagcacacacauucucugucucucucagaaacacucauauacgguucuggagauuuaauuuaggccaucacuuuauacugugccuaugucuuggaauauuuuuccccuuacuuuauuuacccuucagaauuuacauauccuuuaaggcuuaguaaaaaugacacuuuuuacguggaguuuucccaggucucuucagucaaauuaauuauucuuccaugugaacucagucuauuacuauuuaaaacuuauuuuguucuuccucauuuauuacauuaagucaacuucucccaguacacuguaaacugguugaaguuaaaacaauguucuguucaucuuuaugcccucacagauuuguuauaauguugacaugaagugcagacacuuaauucguguauagaaggugcuuuucuguaaaaaucaaauacauguuguuuuaugcguaaugucaguugcuccaacugugagauaaauaauagaggaaauuauuucuucuuccauuaacagccagauguugugauacagugugccaggacaccugcaugaucacgcuacuuuccuagucuccguuuuucuugguuugucauugcccaguacaggaacccuuggagucuucaagccuucccuaagacggccucaguuuguucuucuaacccuacuacccucuacaaauauuugaaacuccugccaaacagaauacucauuuugcuuccugagagugcuuucaugacuuuucucauacuguucccaccccuucuucacccaucaaaauaugauccagcuuucagggccuguuucagauguucuuuuuccaucaccuuauuuuuggccggccuaacuaggugugcaugcacccugcuagcugccagugccuuauguuuggaaagagcauuccaucgccuucuuacauuguguugucucugcacucacacacagauauuucagaaaauguggagacccugaguaaagugguucugagacagaagaaagggggugaaauggaaagguagcgagagagaaggaaaacagaauguuccuucagaguucuuguugggaagugagucuccguuacuuaaaguguucaagaagagauugaacaguuacauauuggugaugugauaaaagaauuuggcuuguguuggauaaguauuaaacuaaaagacuucugagaugguuuucagugcuagacuuacuuuuauugaaguuuucuuuuuaaaauuauuuucaaugaaaaauuaaaauuguauauauuuauguaugguauacaacaugauauuuugauaugcauguauauuauagggugccuaaaucaagcuaauuaacacauguauuaccucacauauuuaucauuuuuguguggcaaaaauaauuaaaaucuacucuuuuagcaacuuucaguauacaauauauuaguacuaacuguagucaucaugauguacaauaaaucuccugaacuuauuccuccugucuaauugaaaguuuguauccuuugaccaacaucuccaaaauccuccuacccccagccuccggcaacuaccagccuacugugcuucaguggguucagcuucucuggauuucauguaggagugaaaucaugcaguacuugccuuucugugccugguuuauuucaccuaauguaauguccuccagguucauccauguuguugcaaaugacagaauuuccuucuuuuuugaggcugaauaguauuccauuguguuuauacaccacauuuucuuuauccauucauucauugaugaacacuuagguuuauuccauauauuggcuauuguaauguuguggugaacacaggaaugcagcuaucucuucaacauacugauuucauuuucccuggauauauacccagaaaugggauucuucgaucaugugguaguucuauuucuaauuuuuugaggagccaacauaaauuuuuuuuuuuuuuuuugagacggagucuugcucugucacccaagcuggagugcaguggagcaaucuuggcucauggcaagcucuaccuccuggguucacgccauucuccuaccucagccucccaaguagcugggacuacaggcgcccuccaccaugcccggauaauuuuuuuguauuuuuaguagagacgggguuucaccguguuagccaggauggucucgaucugcugaccucgugauccgcccgccucagccucacaaagugcugggauuacaggcgugagccacugcaccuggcccaacaugcuauuuuccauaauagcuaugcuaacuaauauucccaccaacaguauacaaggauuuccuuuucuguacauccuugccaccacuuauguuuugccuuuuugaugguagacauucuaccagguuugaggugauauuucacugugguuuuaauuugcauuucccugaugauuagcgaugucgagcauuuuucacauaccuauuggccacauguaugucuucuuuugaaaaauguccacucaggcccuuugucuauauuuugaucagaacauuuguuuucuuuucuuacuguugaguuguuugaguuccuuaucuacuuuggacaugaaucucuuaucguauguauguugugcagguaucuuccuccacuccauaggucaucucuucacucugcuguuuccuuugcuaugcaacagccuuggguuggauguaauccugugugucucuugcuuuuguugccuguccuuagggucacaucgaaaaagccauugcccagagcaacguuagggagcuuuuccccuguuuccuuccaggagguuuauagaaaaagucauugcccagagcgacguuggggagcuuucccccuguuuccuuccaggagguuuauagaaaaagucauugcccagagcaacguuggggagcuuucccccuguuuccuuccaggagguuuauagaaaaagucauugcccagagcgacguuggggagcuuuuccccuguuuccuuccaggagguuuauagaaaaagucauugcccagagcgacguuggggagcuuuuccccuguuuccuuccaggagguuuauagaaaaagucauugcccaaagcgacguuggggagcuuuuccccuguuuccuuccaggagguuuauagaaaaagccauugcccagagcgacguuggggagcuuuuccccuguuuccuuccgggagguuuauagaaaaagucauugcccagagcgacguuggggagcuuuuccccugucuccuuccgggagguuuauggaaaaagucauugcccagagcgacguuggggagcuuuuccccugucuccuuccaggagguuuauagaaaaagucauugcccagagcgacguuagggagcuuuuccccugucuucuuccaggagguuuauagaaaaagccauugcgcagagcgacguuagggagcuuuuccccugucuucuuccaggagguuuauagaaaaagccauugcccagagcgacguuagggagcuuuuccccuguuuccuuccaggagguuuauagaaaaagccauugcccagagcgacguuagggagcuuuuccccugucuucuuccaggagguuuauagaagaagccauugcccagagcgacguuagggagcuuuuccccugucuucuuccaguagguuuauagaaaaagucauuacccagagcaacguuggggagcuuuuccccuguuuccuuccaggagguuuauagaaaaagucauugcccagagcaacguuagggagcuuuuccccuguuuccuuccaggagguuuauagaaaaagucauugcccagagcgacguuagggagcuuuuccccuguuuccuuccaggagguucauagaaaaagccauugcccagagcgacguuggggagcuuuuccccuguuuccuuccaggagguuuauagaaaaagucugcccagagcgacguuggggagcuuuuccccuguuuccuuccaggagguuuauagucucaggccuuacgcuuaagucucucuagaauucuuaaauuugugaacaucccaagaaguggaaguaggaaaaauguugagcuaucaguauauaugauauggguaaagugaagucugucuaguuuacaggagguuaauaaaauaauuugaaaacuuauuuuggcugaaauuuugugcauucucuuuugagaaauaacuuucugugaaucugcuuuaaaguagaaaagauguuaauuugcauuucaucucuuuuuaucuccgcccuauucaauuucuaguugagaugcaagugaacaguaaaauaaccaaauuuuaguaagaacaagaggcaggaccagaaaugaucuacaggcugcauaguuaagcuuggaguauucagaaguggacuauuuguguuuugugguuuaagacaagaauuauuggcucuuuucuggauauagcugugaguuauuuaugaaauuauagaaauuuuuuuguugaaugauagaauucaaaagaauauaaaaagaaaaaucaccaauaauccuauaaacugaagauagaaacuuuuuauacuuuuauuguauuuuguuucaaacaucucucuuggcauaaauacauauguuuauguauguauguguuugugugugauuaaaacuggauuauaugacauacuuuuugagguuuuauuguauuuuaaccucagcauccaacagaggaaguuuuugaaguuuuaaagaaaugccucagguucucugugaagaauccauuauaugcuuuuucaaaaacuguuuuuccccccaggauuuuaaagauauuuaggucgggaaaagcauacaaaauuaaacaacuggaaaaugagcuacaaacuacugagguggaugauuaauucugagcacucugauaagagggagcaauuguuacauaaaagcaagguuuuguagguaggcaguuguagugacacagaaaacagcuucuggagauaacauuuuaacuaggaaaagcuaucaggcuuauucauaucaacagacaaagcauccuguuagcccauauggauaugggcauagggaagcugggaaaaaucugccuuucuuugccggaaauucaguguuucugaacauagaaaaagaagaaauacagaaagcgucauucaaagaaaggaagcauucacguucuuuuaaauagcaaggcuuuucaugccaaaauuguguaagggauuaaauguuagccuguauucuugucuugucuugguuauccaugacuugggaaagccaugccaguugguccaugccgccauacccucauucaccuaagaagaauuggaaguaacacuuuaugacuuauaaggugauuuugcaucccacguaauacuugugcuaaauauacaaauuauugauagaaugccuggaggaagagaaucuuuuguaugguuaaccucacauacagugcauacagugguaauagaugccacacccccagaucguuggauuagagaauacacauugauaacuguaaaacacauugggaaugcuggguuccugagggacaagauuguguuuauauuucauuucaugucagguguggaauauuuuggggccugaggccuuggcuguacaguggaaacaaaugaugcuucagagagucuguaguacagaaagcagcauuuuauauuguuuuauuuaguguuuuagcaaacuagacaccaguaucauugccaugcucuuuuuguuaugaauccuacuguguuagcaauugcaugguugguuagauuaauguauaauaaugagucaguguuggaaaugaugagauuugucucuugucucuuucucuacaaaauucuaauuuguaguaaguagcucagaacgcucagauuugaauuacucuguuuaugcaagaagucauuuauuaaauaaagaugauguuaguaauuuuuaaaucagugguuugagucagcuuuuugguuuguagaccaaaaaagauuuaguuacuuugaugaaauguacucaacuacucuccaauuuuaagucaacugcuuaaauuguccagacauguuauuuaaggaaugguuucuauauuuguuuaucauugaaagacauuagacuauauauauuuaaacguauagucaauauauuaagcacagaaccuuucaauuauacaggugucuuaagaaccccugguccuggaggcugguguuguuaguaauauuuagagcacugaauuguccaacuaagaaaaauuaaauuuuaacuugauuuauacucaaacauagcucuuagagaaauuuaagggauuuuccuuugugcaugaaaaucuaucaaaaacacagccgucuaccaauuagauaagaaguaaaaagguagucuuuuaaaaagacuaaagcuuuucuaagccaaaaaugaggggauuuucuuuucuauuucaguguaaaaccuguucugagccaaaaaagauaaccaguuccucugccaucuaugacaauccaaaucucaucaaaccaauuccagugaaacccagugaaaaccagcaacagcguauaccucagcccaaccagguacggaguucucugcuugucauauucagugugucucuagaauucuuaaagaacuuugacccagaauauagucaggggagggccugguguuguugaagaaugcuuucagguaaacccaagaaagcgggauuucagaauacagauuuuuucauuauuaauaacuuacucuuccuagaagaggguuaaaguuuuuacuuuuggcauauaccacauucugugcuaaucucuugugaacuugaacuccuuaaaagauaauguauuuuuuaaaaaacaacaagccagcacaguggcucaagccuguaaucccagcacuuugagaggcugaggcgagaggaucauuugaggccagaaguuugagagcagccugggcaacacagugagacuccaucucuacaggaaaauuagccaggcaugauggcgugcaccuguagugcuagcugcucuggaggcugaggcgggaggaucccuugagcuuaggaguuugagguuacggugagcuauggaaugcgccacugcacuccagccugggcaagaaagcaagaccaugucucagaaaacaaaaacaaacaaacaagcacccuagaaaacuaauaacauugucagagaugacagaaacauuacccauuggguccauauucuucugggguggguggcuucccaaggccaccugggagaaccaccaaggacacagaguugauuugagcacuucugagcaccuccucugugccagaugcagagcuagcacuguagacugggguagcugccgccgagagcucagaguccaaaggaaugguauaaaacuccucuucagauaugaugacuugucacugucuuugcaaucuaaauuagaaauauuacagcagcuuuuguguuaguguauauauauauauauauacacuucagaauaguacagcaaugacaaaaauugucaaucuguaggucccauuaaugauuguaaauauaauauugcugugucauuuuaucaugacuaugacuaauuaaaaagauuuucuuaaaggaauuaguuuauaucaauuuugaaaaugaacauggagccaaaagacauaaagacuaguaaugaaaaucuuauauugaauuuuuaaagaaaagaagucuucuaauuuuuuagcuuucuuuuuauugcuuguuuuauggaaaguuuuuauuauauuuuaauagcgagaccugaauauguugacuuuaaaaugaagcuugugguuuuuuuucuuuccucuuuuauuuuuuuuuuugagacagauuucauuccuguuacccgggcuggagugcaguggcaccaucucagcucacugcaacuugugucuccugggcucaagcaauccucccaccucagccucccaaguagcugggacuacaggcgugugcugccacaucuggcaauuucuguauuuuuuguagagaugggguuuugccauguugcccaggcuggucuugaacuccuuagcucaagcagucugccugccuuggccucccaaagugcaggaauuacaggcaugagccacugugccuagccucauguuuucucagugcaacaaugcagaaagcaacagaaguaaagagcaagaaggaaguagcuuuguaacuggcugggccaagguagauuuuauguauccaaggacuuuuuaaauccuaccaguauauauuugaaaggaucaaguuagauuuaaagucuuccguuucuuuccagcccuugauuuccauaauucugugaaaaacuacuagaaauucugaaaugcuuauauuccuuuguauucucauauuacucugcaggcuuagaugggcuuccuauugaacagauuguuuauuuuuuuagugcauauaauuuccuaccaaggugguucccaaucugugaaaccccaggcccuugaagaucuuauaccuguuuuaucggucaacagauauuaaaauauaauaacuguuuugggggugcaaggggagcaugcugugaaaauuuuugacauuaaaaaggggaucucauuuuucaaguuuauuauuauuauuuuucauucucucuaaucaauccuuuguaaauagaauaagucaucagauaaguuauguuucauagcacuuccucauauaaccaaauuguuuguagacucaugucagauaucuuuauuuuuuccagaccuuagacccugaaccccaacacuuauccuugacagcucuguuugggaagcaggacaaagcuacaugucaggaaacuguggagccuccgcagacucuccaccagcagcagcagcagcagcagcagcagcaagagaagcuuccaauuaggcaggggguuguacgcucccuguccuaugaggaacccagaagacacucaccccccauugagaagcagcucuguccagccauucagaaacucauggucaggagcgcagaccuccacccauugucagagcugccugaaaaccggccuugugaaaauggcaguacccauucugcgggagaauuuuuuacaggaccuguccagccagggucuccucacaacauuggaacuucucgugguguacaaaaugcuuccagaacucagaaccuguucgagaaacuucagaguaccccaggggcagcaaacaagugugacccuaguacaccagcaccugccagcucagcugcccugaaccgcagcagagcucccacuucugucaccccuguggcuccaggaaagggucuggcucagccaccacaggccuauuucaauggcucccuuccaccucagacaguaggacaucaggcucauggaagagaacaguccacacucccaagacaaacacuccccaucucugguagucagacuggcagcucuggagugaucuccccucaagaguuacugaagaagcuucagauuguacagcaggagcagcagcugcaugccucuaaccggccagccuuggccgcuaaguuuccugugcucgcucagagcucuggaacagggaaacccuuggaauccuggaucaacaagacacccaacacagaacagcagacuccucuuuuccagguaaauauguaccaggggcaaaauaaaacagccugggcagcauagcaagauccugucccuaaaaaaaaaaaaaaaguagccaggcuuggugucacacgccuauagcaccagcuacugaggaggcugaggugggaggaucccuugagcucaagaggcggagguuacagugaaccaugaucgugccacugcacuccagccugggugacagagcgagacccugucuguuaagaaaaaaaaagacagacaaagaaaaagguauuacuauaaugcagugaaauguagaguccacuuccaugcucuagggaccaaugugucacguacauuucuguuuggagcagggugcaccuccgugcaucuugauugccugaacuuucuaccuggaaggagaaucuucacuuugguuaacaaucugagaacuucccccaaccuuuuugagagcauuacuuguagaguuaaaucuucguuauauuaggaggucugaagaccaacacagacaugggagaaaaccguaauuuuugacuguaggaacuuaguauggucugccuugaaaucaaucuggaaugccaagcaacugaccuccucuuguuuuucaguccacaguaaauuauucacuuauuuaguaaauauuuuugagcacuuacuacaugucaggcauugucuacauguggguacauaaugaugaagaaaacagacuccuuacccacagcccaugcuguagguucuugaaauaaacaaaaaacagccuauuuccuccugaaaggugcagccaguuuuuaucuuucucuguaucgucaguauagccuacuguagaucaggagagguaugcaugccacccaccuccaccccccacacaaacugccagagagggaaaauaugacaguuuuuagaaagauucucuccuuuagagaagaugcuuuuccauguccaucacugacuugggacagugaggaaaccacaagcuauugaucaucugccuguggguaacaucuggagaucugacauugaauuguuuucccuuuggauuggaacacauucauugaaaguacauuggguuuaaaaauuggaaaguucucccuguguaucacauauaucaucacuggcccuuugucauguuuuguuauguaccuuuuuuuguuuuuugagacagaguuucacucuugucgcccaggcuggaguacaauggugcgaucucggcucacugcaaccuccaccucccggguucaggcgauucugcugccucagccuccugaguagcagggauuacaggcaccugccaccacaccuggcuaauuuuuuguauuuuuuuaguagagacgaggugucacgauguuggccuggcuggucucgaacuucugaccucaggugauccacccaccucgggcucucagagugcugggauuacagucgugagccacugcaccuggccuguuauguaacuuauaacaguuucucaaaaaucuugaacuuuuggcugggcauggugacucgugccuguaaucccagcacuuuggagguuaagauaggagaaucgcuugaaccuaggaguuucagaccagccugggcaacauagacccugucucuacaagaauuuuuuguuuuuaauuagccggguaugguggcaugccacuguggucccagcuacuugggaggcugaagugggaagauugcuugagcccaagaaguugaggcugcagucagccauguuugcaccacugcacuccagccugggcaguagagugagaccuugucucaaaacaaaaaauucaguuuuuugaaaacaaagaccuuaggcaugugccaaaagucuuugugagccccugagucaaaguguucucauuuauuauuuauuaacaucccaaaucugaguaccgacugcuauagaaacaauauuuauaacucccacucccccucauuucaguguuauugucccuuuuuuaaaaaugucugcuuuuuuccucuuugaugauuuagaauuagaagcaugcgaugaauauagucugacuuaaauuucugauguacaacucccuugacuuuucaguacucacaaauaucaagagccgagugagaaaggcaagcauuucagcagcccacgcugugcucagaaugcuugacuccaccuccgggagcaucacugcucagcaccgcuccucgaaaugucauguagggacaaguuaaaagaaacagccugccuuccucuaggccaacuuuugcucaaagagacgcuaagggauugauuauaaaauuacagcaacuucuagcuugcuggccuccuugccucccucuuaggaguucuuucggggaguucggaggcugauaaauaacauucuuuuucuucccugaguuagaagcaaaugauagcuguaggagucagucagauaaggaucaaaaugucacuugcauaacugaaagggcuguuagaaaacuugguuucaggucuguuugccaagggaguuagacucagcagacaggcucuggcagggcugagcaacaggccgcccgggucagcccaaacacaucagcugcggaagcugaagaugagggcucucugcaggcaggcagauccugucagggaaggacccagaagggguggacccacacaucacucucccuccccacgagaagugagugaggccgcaggaggggcggggaguugcucucacagcgccuccugugcuccggggucaggaggggaaauggggaggccccuaacaaggguggcagcucacauagguugugagaccuuuaggucagggucauggacaaccaggucuaaggaaaaggucaguaguccuaaaugcacuugccaaauacugguagccugaaaaauaagcugucacccagaggccaagcugcauaugcaguggaaagaauaguccccacagcagacgauaccagagcugcucagugaugcugaaggaaggugcauggagcaguggagcaagaaucaguuucccauaaacuuuucucagcuaggaaagcuguggacagggaaugcuuagaccacccguaucugccgcugcaagcuaucaugccgugagcugcuccugaaccccgcucucuguguguauuugcugugagcaggucaucucaccucagcgcaucccugcuacagcagcuccgucucugcuuaugucccccaugguguucgcacaacccaccuccgucccgccaaaggaaagggagagcggccucuugccugugggaggccaggagccaccugcugcugccaccagccuccuccugcccauacagagcccggagcccuccgugaucaccagcagcccacucaccaagcuccagcuccaggaggcacugcuguaccucauucagguaagcaagcacgucaucucccuucgcaccugaccacgccuguuggccuccuggcugcaacuaugagauaaagacucagccaaggccugcuuagcuuccgugagaauaacagguguguguaacaacucauccugaccccagcggcuucugugcucaguuagcuagguguuauuuauaauaccaaguguggcuugggugucucagcucuucaaggauuuuguaauuugaaggacugucuaaggccuccaagcugucaccugucagaagagaaggaagcauaugcuggggauuaagcagucccugagaggacccugggugcuggaggcccagacagaaaacucaccauugggagguagaggugggagcaguccugggcaaggggccaucuguugaguggggaagaggccacugagcgaguggaaaacagggagggaagcaaauaauggccauggcugcuacagguauguuuuacaagucauuuugaaaccugcucauuaggacgggauggagugacaggacuccuugugagcugcuagccucacuugccuaugaaauuaugaaauaauaaugagugcuauaauagcuaacacuccacagagcuggcgccgggcccuauuuucagugcuacacacaagcauauaacucauucacuccuuacauaacaacccuguuauuuuucccauucuacagacaaggaaacugaggcugagcaacuggccugaggcacggagcucguacauaagcagggcugggaugcacccagccuggcccccgagugccacuucccacguacucucccgugggccacguucaccacaugaauguuggcagggaccagccucgggagaacauucagcacaggugcccuagcaaagcacacccaagaaaucaacggcaguccuugaaaaguggaacauuuguagccagacagacuucagacaccccaguuaacauauuuaggugucuuuuugguagauaaucuuuaagaaaacuugugugguacuuugcuuaagcaucagacggccuuuagagagcaggccagcccuucugcgguugucuuauccuacuuaaaaagacaguggucucaauuaguacaacauuuuuaaaaagguuccauguuggccgggcacaguggcugcucacgccuguaaucccagcacuuugggaagccaaggugggagcauugcuugaggccaggaguucaagaccagccugagcaacauagcgagacuacaaaagaaggaaacauguuugaggaagaaugaaaggaauggggcuagaagucagcagaagcauaauaacaaucagagauaaauaaggucaacagcaaaugauugagcccuacuaauucauaaguaaauaucaggauaaaaauauuugccaccuuuuaaagcuauucauaguaagcucaggaggaauuagacaucugugaaccucuuuacuuugagccaguuucuuaaguuguaauuuaaaagauccauauguuuucuggcugauucccuucacauugucuugagacucuacuccagaguaguggcugaacauggcggauuagaaauuacauuccccugcccuccacucugcgugcauuuuacuucuucccguguaccacaccucauauucccagucacucaagcagucuguuuuuaguuucugccucuuguuaggacacaaucucaugcagaggaacuuugugacuacuuugcaggaaaaagagggauaacaucacucucuucauugcaugagaaugaugcuaaaucuguguggggugccaagagggaaugaagggggaaugugaagugugggugaauuacuaacacuguaaagaauuugggugggagggagaagucucuagaauuaaaacaugaggaaaaccacugauuagaccgugauucucacuccuuagccaggcaaaagagcccagagauuaccagucuuacuccugcccacuugccaaggcuagaaacuuuccauaacuuaugggaagacuuauauuagcuuugaugaaguacugaugaagcauauugcaaguaaaauccuaaguaaugcccaaaacaaagcagacacauuguaggugacuuggagggccuuuaagaaccacaguggcucaugccuguaauccaacacuuggggaggccaaagugggaggcucacuugagcccaggaguucaagaccacccugagcaacauagugagacccugucuuaacaaaaaacuuaaaagccaggcaugguagcacgcaccuguagcccuagcuacucuggaggcugaggugggaggaucgcuugaacccaugagguugaggcugcagugagcuaugauggcacuacugcacuuuagcuugggugacagagugagacccagucucaaaaacccaaaaaacaagaaacaaaaaaacacaccacagcaaucucuuaaccaaacuuugagaccacugacuuggaucauguccuccuaacuccucugucugcuggggcuucaugucuuuucaugcagcagacccaggcuguucuugaguaaaccuugcuccaugcugccaugugucugggcugcccaucugugcugcauguaaugagcucuugcugcugugcauacugaccauggaaaaccaucagcucuguccggccuugccgucaaccccacuuaacauucacacaugcaauuaaaaaccaccagcuguuagacagggagagaugagugucucaguauccaaaggccaguucagcucuaagacagaggaagccuuuugugucugccaaccaaguaacauucucuugggucuuucgauuuguuuuccagaaugaugacaacuucuuaaauauaaucuaugaagccuaucucuucagcaugacucaagcagccaugaaaaagacuaugugacagcaaggccuuuuaaaacugauuuucaagguccuucuagaacuccggcacaagguucuuucauguugaguguuguuuccuucaauguuucugccuuuuuuaaaaaaaaaguauguguaauaugaaguaaaauguuucagacuuuuuuuuauacucaaguguuuuuuaauuauuauuauacuuuaaguucugggguacauguacagaacaugcagguuuguuacauagguauacacaugccauggugguuugcugcacccaucaacccaucaucuacauuaguauuucuccuaacgcgcuuccuccccuagucccccaccccgcgacagaccccagugugugauguuccccucccuauguccguguguucucauuguucaauucccaccugugagugagaacaugugguguuugguuuucuguuacuuuguuaguuugcugagaaugaugguuuccagcuucauccaugccccugcaaaggacaagaacucauucuuuuuuauggcugcauaguauucccuggguguauauaugccguauuuucuuuauccagucuaucauuaauggacauuuggguugguuccaagucuuugcuauugugaauagugcugcaauaaacauacgugugcaugugucuugauaguggaaugauaauccuuugauuauaguagaguuacaauccuuuggguauauacccaguaauaaguagaguuauaauccuucggguauauaccuaguuauggguaauaauuagaguuauaauccuuuggguauauacccaguaaugggauugcugggucaaaugguauuucugguucuagauccuugaggaaucaccacacugucuuccacaaugguugaacuaauuuacacucccaacaacaauguaaaagcguuccuguuucuccacauccucuccagcaucuguuguuuccugacuuuuuaaugaucaccauuguaacuggugugagaugguaucucauuguggcuuugauuugcauuucucuaaugaccagugaugaugagcuuuuuuucauguuuguuggccacauaaaugucuucuuuugagaagugucuguucauauacuuugcccacuuuuugaugggauuguuuuuuucuuguaaauuuguuuaaguucuuuguagauucuggauauuagcccuuugucagaugggcagauugcaaaaaauuucucccauucuguagguugccuguucauucugauauaguuucuuuugaugugcagaaacucuuuaguuuaaucagaucccauuugucaauuuuggcuuuuguugccauugcuuuugguguuuuagucaugaagucuuugcacaugccuauguccugaacgguauugccuagguuuucuucuaggguuuuuaugguuuuaggucuuacauuuaagucuuuaauccaucuugaguuaauuuuuguauaagguguaaggaagggguccaguuucagcuuucugcauauggcuagccaguuuucccaacaccacuuauuaaauagggaauccuuuccccauugcuuguuuuugucagguuugucaaaagucagaugguuguagauguguggcauuauuucugagggccucuguucuguuccuuggucuguauaucuguuuugguaccaguaccaugcuguuuugguuacuguagccuuguaguauaguuugaagucagguaacaugaugccugcagcuuuguucuuuuuacuuaggauugucuuggcuauacgggcucuuuuuugguuccauaugaaauuuaaaguaguuuuuucuaauucugugaagaaagucaaugguagcuugauggggauagcauugaaucuauaaauuacuuugggcaguguggccauuuugaucauacugauucuuccuagccaugagcauggaauguuuuuccauuucuuuguguccucucuuauuuccuugaguugugguuuguaggucuccuugaagagauccuucacaucccuuguaaguuguauuccuagguauuuuauuaucuuuguagcaauugugaaugggaguucacuuaugauuuggcucucuguuugucuauuauugguguauaggaaugcuugugauuuuugcacauugauuuuguauccugagacuuugcugaaauugcuuaugaguuuaagauuuugggcugagacgaugggguuuucuaaauauacagucaugucaucugcaaacagagacaauuugacuuccucuguuccuauuugaauauuauuucuuucucuugccugauugcccuggccagaacuuccaauacuauguugaauaggaguauugagagagggcauccuugucuugugccaguuuucaaagggaaugcuuucaacuuuugcccauucaguaugauauuggcuguggguuugucauaaauagcucuuauuauuuugagauacauuccaucaauaccuaguuuauugagaguuuuuagcgugaagggguguugaauuuuaucgaaggccuuuucugcaucuauugagauaaucaugugguuuuugucauugguucuguuuaugugauggaugacguuuauugguuuguguauguugaaccagccuugcauccgagggaugaagcugacaugaucgugguggauaagcuuuuugaugugcugcuggauucgguuugccaguauuuuauuaaggauuuucgcuuugauguucaucagggauauugaccugaaauuuucuuuuuuuguugugugucucugccagguuuugguaucaagaugaugcuggccucauaaaaugaguuagggaggagucucucuuuuucuacuguuuggaauaguuucagaaggaaugguaccagcuccucuuuguaccucugguagaauucagcugugaauccaucugguccuggguugauaggcuauuaauuacugccucaauuucagaacuuguuauuggccuauucagggcuucgacuucuuccugguuuagucuugggaggguguaugugucaaggaauuuauccauuucuccuagauuuucuuguuuauuugcauagagguguuuaugguauucucugaugguaguuuguauuucugugggaucuguggugauauccccuuugucauuuuuuauugugucuauuugacucuucucucuuuucuucuuuauuauucuggcuagcagucuaucuauuuuguuaaucuuuucaaaaaaccagguccuggauucauugauuuuuugaaggguuuuucguguuucugucuccuucaguucugcucugauuuuaguuauuucuugucuucuguuagcuuuugaauuuguuugcccuugcuucucuaguucuuuuaauugugauguuagggugucaauuuuagaucauucccgcuuucuucugcaggcauuuuagugcuauaaauuucccucuaaacacuccuuuagauagaugugucccagagauucuggugcgauaugucuuuguuuucccugguuucaaagaacuuacuuauuucugccuuaauuucguuauuuacccaguagucauucaggagcagguuguucaguuuccguguaguugugcgguuuugagugaguuucuuaauccugaguucuaauuugauugcacaguggucugagagacuguuuguuaugauuuccauucuuuugcauuugcuaaggagugcuuuacuuccgauuauguggucaauuuuagaauaagugugaugugguacugagaagaauguauauucuguugauuuggagagaagaguucuguagaugucuguuagguucauuugguccagagcugaguucaaguccugaauauccuuguuaauuuuccgucucauugaucugucuaauauugacagaggggcguuaaagucucccacuauuauuauguaggagucuaagucucuuuguauguuucugggaacuugcuuuaugaaucugggugcuccuguguugggugcauauauauuuaggauaguuagcucuucuuguugcauugaucccuuuaccauuauguaaugcccuucuuugucuuuuuugaucuuuguugguuuaaagucuguuuuaucagagacuaggauugcaacuucugcuuuuuuucuucuuuccauuugcuugguaaauauuccuccaucccuuuauuuugagccuaugugugucuuugcacgugagaugggucuccugaauacagcacaccgaugggucuugccucuuuauccaauuugccacucugugucuuuuaauuggggcauuuagcccauuuacauuuaagguuaauauuguuguguguaaacuugauccugucauuaugaugcuagcugguuauuuugcccguuaguugaugcaguuucuucauaaugucgauggucuuuacaauuugguauguuuuugcaguggcugguaccaguuuuuccuuuccauauuuagugcagaguggaccuccagcaaacuccagcagaccugcagcagaggggccugacuguuagaaggaaaacuaacaaacagaaaggaauaccaucaacauuaacaaaaaggacguccacgcaaaaaccccauccgaaggucaucagugucaaagauaaauccacgaagauggggaaaaaacagugcaaaaaggcuaaaaauuccaaaaaccagaaugccucuucuccuccaaaggaucacaacuccucgccagcaggggaacaaaacuggauggagaaugaauugacagaaguaggcuucagaaggugggucguuacagacuccuccaagcuaaaggagcauguucuaacccaaugcaaggaagcuaagaaccuugaaaaaagguuacaggaacugcuaacuagaauaaccaguuuagagaagaacauauaugaccugauggagcugaaaaacacagcacgagaacuucgugaugcauacauaaguaucaguagccgaauugaucaagcagaaaaaaggauaucagagauugaagaucaacuuaaugaaauaaagcgugaagacaagauuagagaaaaaaaugaaaaggaugaacaaggccuccaagaaauaugggacuaugugaaaagaccaaaccuacauuugauugguguaccuguaagugauggggagaauggaaccaaguuggaaaacacucuucaggauauuauccaggagaacuuccccaaccuggcaaggcaggccaacauucaaauucaggaaauacagagaacaccacaaagauacuccucgagaagagcaaccccaagacacauaauuuucagauucaccaagguugaaaugaaggaaaaaauguuaagggaggccagaaaggucaaguuacccacaaagggaagcccaucagacuaacaguggauaucucugcagaaacccuacaagccagaagagagugggggccaacauucaacauucuuaaagaauagaauuuucaggggccaggcgcgguggcucacaccuguaagcccagcacuuugggaggcugagacagguggaucacgaggucaggagaucgagaccauccuggcuaacacggugaaacccugucucuacuaaaaauacaaaaaauuagccgggcaugauggagggcgccuguagucccagcuacucgggcgacagagcgagacuccguuucaaaaaaaaaaaaagaauagaauuuucaacccagaauuucauauccagccaaacuaagcuucauaagcgaaggagaaauaaaauccuuuacacacaagcaaaugcugagagauuuugucaccaccaggccugccuuucaaguguuuuuguuuuguuuugcuuuuagaaaucacguccuucaguacaccugguacuaagaauugagcggguaggaaaauucuuugcuuaggucacucaguaaaugccaagcuuaguauguuuccuuaaauguauggagccacuucagaagaaucagugucucugugagaagggcuguucucagagcuuaguucuuuauuaauaagucuggugguucuuugagcaguguguaacuuccauuggggagcuccgugcgcacagugcacgccgaccaccagguggcagugucgucccacaaguuaaccuacaaaggcuuuaaugagccuuuggaaguaacgacgguuuucuuuuaccagacaaaguaaaccuuucauuuguaaaaacccaguuggcauguuuuacccaauccuuugaaggaaguuauuucuaaagguauuuauagcuaguuucuagaggauagauguucuaggaguugacaaauggcccagauuuccagcaacacuucauccaucccagcccaugaagcagcaggaugugcccgccuaagcuuccgaauggauaguauaucacccuuagcagaacacgcugaggcggagggcacaggagauugucacugugauguucagggcgucaugaucugcaagcuguguagcagaucgaguuuuauguucgcagagaugaggagcuuaaucuuggaaggagucagaagagccccugccaaguuguuaagaguaucuaugggaauucgucccugcugaguauuuguaauaaauaaagcuuugcguuucaauagcacuucuuauucucggauaauaaaaagaucuucgauuacugcacagccgacagguguuuuauucucauuuuauaguucauaaaauggaagcgugaggaaaacagguuucccuaccguuucugagaccugggcuuggacuuuaagcucuagaccuuuguucagccacagcaucgagugaaagcauuguuagaacaccaccuccccuacucucccgcaggagggugcuuuuucuugugaagagaaaggguggguggaaaagggauugacuguuacugaaccccuguuaugugccagaccuuggcgaggagucugcuguguuacccuccaacauuuaggaaggggugaguucuuuuguuucguugguaucuccuacaacaucuaacauagugauaaaccaugcaaaguuuucacaaaacacuugaaauuaauaauugcauauaugguaucucaauauucuuauaaggagaacagggcgaggacagagacacacuuggaucuguuauucaaagucagugaucauagugcuugccucagcgauacaugcacaaaaauggga

SEQ ID NO: 14865 - RNA, 1391 nt, Homo sapiens
ccccacuaccucguccgcggcuucacuaguccuaagccucccccccuccgcuccccaagugcccagagccccaguccccacucccccaccucccgccccaggauccccacaucuaccgccucggcucccgcccgaucccggagcccggcuggguggagcccgcgggugggcgccgguggucuggguggggcccgccccuccccaccccccgggcugccgaggagggggagggggucgcgaagccucaccuacagcuccgccccuccccgggggcgcguugcccugcccagcccagcccgggccgugagcaagaagcuggguaggaaaggcgaaagccucagcacuagcgacaggggggaagcucugggucccgcgcgacuuccgcgcugucgccgccgccgcggccgucucaccguccucagggcugccgcuacugcugcugcugccgcccaggcaccgccgccgccgccacuaccgccgccgccgccgccacagcacggcccaggcgcccgcgacgucaccgcgccccgcccccugcgcgagacaccuagccccgcccccagccccgccgcggggcgcagcgcgccuccccgggcucccggcucggcugccucccuuucccucagccucccgggagcgugacgcggcggcccgggggccuccgggcgccuuccggggcacgcgggugaggaacugggaagcgggggaaaucggcgccacggcggucgauuagcaccgaaacagagugaugggcgcggagcgucccugcacacacacacacacucacacacacacacacacgaccccugcggccacgggaggggagagccggggucggcuccgcgagcgcaggguggcgcuugucuccuccugcuugccguaggaaguggacgcuggaagcccgaggagccgcuucgugucuucccaaaccuaagcggcgccccacccccuacuucucguggcccguuacgcccggggcagccaagcgccgcgggagcagcgccgggaucgacccuggcugcuggggggacgcuuugucccaagaaagcugguuuuuugccccuuagcuucguggaacgcggccgcgaaauuaguggucuucugaccugagacucgcggggcugcgcacacgggcaucgccgaggaccccagcaauggacgucgugucuguggugaucccgccaggacgcggggagcgugggcggaaauuaguguccacguuccgacccugcgcugugccaaacgcugcuucgggagcuguuuauuuagccuccgacagcuaagcgaaucggcgggcggcuggggccuggugcaacccgauuuucucgugcagacucgcagccggcuuugguuuuguuuuuuguuuuuuguuuuuuuuuuggagccaugca

SEQ ID NO: 14866 - RNA, 1391 nt, Homo sapiens
ugcauggcuccaaaaaaaaaacaaaaaacaaaaaacaaaaccaaagccggcugcgagucugcacgagaaaaucggguugcaccaggccccagccgcccgccgauucgcuuagcugucggaggcuaaauaaacagcucccgaagcagcguuuggcacagcgcagggucggaacguggacacuaauuuccgcccacgcuccccgcguccuggcgggaucaccacagacacgacguccauugcugggguccucggcgaugcccgugugcgcagccccgcgagucucaggucagaagaccacuaauuucgcggccgcguuccacgaagcuaaggggcaaaaaaccagcuuucuugggacaaagcguccccccagcagccagggucgaucccggcgcugcucccgcggcgcuuggcugccccgggcguaacgggccacgagaaguaggggguggggcgccgcuuagguuugggaagacacgaagcggcuccucgggcuuccagcguccacuuccuacggcaagcaggaggagacaagcgccacccugcgcucgcggagccgaccccggcucuccccucccguggccgcaggggucgugugugugugugugugagugugugugugugugcagggacgcuccgcgcccaucacucuguuucggugcuaaucgaccgccguggcgccgauuucccccgcuucccaguuccucacccgcgugccccggaaggcgcccggaggcccccgggccgccgcgucacgcucccgggaggcugagggaaagggaggcagccgagccgggagcccggggaggcgcgcugcgccccgcggcggggcugggggcggggcuaggugucucgcgcagggggcggggcgcggugacgucgcgggcgccugggccgugcuguggcggcggcggcggcgguaguggcggcggcggcggugccugggcggcagcagcagcaguagcggcagcccugaggacggugagacggccgcggcggcggcgacagcgcggaagucgcgcgggacccagagcuuccccccugucgcuagugcugaggcuuucgccuuuccuacccagcuucuugcucacggcccgggcugggcugggcagggcaacgcgcccccggggaggggcggagcuguaggugaggcuucgcgacccccucccccuccucggcagcccgggggguggggaggggcgggccccacccagaccaccggcgcccacccgcgggcuccacccagccgggcuccgggaucgggcgggagccgaggcgguagauguggggauccuggggcgggaggugggggaguggggacuggggcucugggcacuuggggagcggagggggggaggcuuaggacuagugaagccgcggacgagguagugggg

SEQ ID NO: 14867 - RNA, 1211 nt, Homo sapiens
uaaaauucuuuuucggaacccucaaacaccuacucucuucaaacagccauuccagcccagucuggggaaaacugcuugcugggguucaccgugggggcuguacgacuuccccagcgccucucggagaugugguucaggcugggaagaaaggucuucaaaucucaacuggaaaacgaagcuaugucugcguuaagcguccaguggcucccgugauauuucacgccuacugguuucgucaagcagggagucgggucguugcuguuggcgacgaaaggcucugaggcuaaagccuugggcgucgcccaaaccagccucuacuucgcuucugccuaaaaccacaccguuaggcgccuggguggugacucgguuucccucggucacccagaguccgcaucaucacucgcccccuccucaucccacccguucccagucgggggaggcaccaggcaccaguucucuggccccaccucucgcuccccuagggaagccgaauggccucuucgcgucccuggcuucucgggggcggagcccaccugugcccggggcgggggcgggggcggggccgggggcgggccagguuccgcgagcaggagagcccagagcccggagcccgguccggggcuggcgggggcgcgggcggaggcaggcgggcgggcgccggggaagccuccuucugggcagcgagugagggcgggcgcgcagggagggagggcggcagcgagccugcgacgggagaggcguggggaggagagcccggcgcggaacacacgcgcggaggaggagccgggcucggcucccggagagaccugcugggcgcccgcgcagcccggagaccccucgcgcccggagcaugagcccgagccccgccggagagcggccgggagagacggccucggcgcagcccugagacgcugggccgggacgcggggcgcccugggcgcggggcccggccggggggcggcggcucgggggguuggagcccgcgcuggcggcggccgccucggcgcagcgccauggggagcccccgggccgcgcggcccccgcugcuccugcgcccggugaagcugcugcggaggcgcuuccggcugcugcuggcgcucgccguggugucuguggggcucuggacucuguaucuggaacugguggcgucggcccaggucggcgggaacccccugaaccggaguaaguagcacccaggggaggcgaagggc

SEQ ID NO: 14868 - RNA, 30386 nt, Homo sapiens
ugggcccgggcuggaagccggaagcgagcaaaguggagccgacucgaacuccaccgcggaaaagaaagccucagaacguucguucgcugcguccccagccggggccgagcccuccgcgacgccagccgggccaugggggccgcacgcagcccgccguccgcugucccggggccccugcuggggcugcuccugcugcuccugggcgugcuggccccggguggcgccucccugcgacuccuggaccaccgggcgcuggucugcucccagccggugagacucgacguggggagcgguagccgccaggaugcugcggacgcggggcaaggucgcggagggccggacggucgggacuacgcgcccgggcuggggaggcaggaaguccgcgccgcgggcuuagaggggcucagagccuugggcacagauaucgcggcgccuggggaggacccucggagcggugggaguugcgguguggaauacgggggggguggguggcacaucgcgcggcgcguguugcacaaccuggcccgccgucgugacuggaggcgggagugacaccuccgcccgggccgcggaguucggggaaggagggcgcggcgcugggccaggccggaggggcggccagggcugauagaaaggggcuguggagaaggggcccggggaggagccaggacgggucuggacccagcuccacgccuugcgccccucacguaccccggcggggcacggucggcccucgggaggcccaucgcgcccucgggagcuucccucaagccgugcccuucaugccgccgacggagccgggcgagcccacgucguccgugcggaagguggagucccucacccgcggcccccagagggaccccgcugucguagagccacgcgggggccggagcgcugagacgcggcaccauguuucggggagagcucugccgagggcggcugagggccaccuccccagaggcgcgaagcccugaggaugggcagaugguucuuaagacggcgcccuucccgccacucccacccccgacuaccaccaccugggucugggaacccggugagagcgcagucggagggucgaacguuuguagcugucaagucguagccccgcugcgcccacaggaagugacccacccgccugccggguaguggccuuucugugagccaggaccaucuuaaggaaaaaaacaaaaaaagagcaaaacgccgugccccuccacaauauacucuccucuuccccgcauccccgaggggaucuuuccuccccuccaccuccaccuccaccuccaccgcugaccccaaggaauaaugcucaguaucugagucagaggauguaaaacaaagggauauuucuccuuauguaguuuuauggaggauuuaccgaaagaagguggagggugagugacuaugucgcagaaaaaaaaaaaaagauguuuuuaucgugaaugauguugagaaauguccugugacuuccacuauugggcaaagcaggucccucugcccugcuagucccuccugcaggcuguguaugaagcguucugauauggaggguuggugcgccuggguugacagccauuggucaggugccugcagaguacagggcgccauacugggaacuggaacuauaaauaaauacucuggggacccuaauauccagagaccuaacccaucuacgggaggaacaaggcuugaaguuagggaacugucuagcaaagcugcuugcacaacugcuaaguguacggaauuccaggaaaaagaaaaauugcuuccaguugggguguccuucauggaaaaggcauuugggcagcccuguggggguagcaggagcauuccaggugguggaaagggccugagccaagguccuuaagugggacaggguacgguguguggccggaauggagggucuguguaauaggacagugagaaaagaugccagaagcggggaugggacucugcugugcguggcgugggagccaagcucugacuuucacugcacagugaagcaacuguaagucaggagcagaagcacggccuggcuccagggagggcugaagagagacacuugcuguucauauuugucugcagucucucguucucuuccuuccucucucucucuucuguauacaccugccucacagacagcucuucuccagagauagacagcucugggcuccauugacuaguucuuuuaaaaagaaagaaaacacauccuucaaauuucugucccucacugguguuuuaguggaugcaaugugguauagugaggggagggaaggccacagagguggccagaggaccuggauuugcaggcagcaucgcacuuacugucucugcagucgggcuuugaggcugccugggccuggguucccucauuuccacaaaggcaggacugggugagccuucucaaaguaaguccaugccaccuuccagaauguaagugucuguccaaagcccaguucgauuuagccuuccauaacuauccucagacagggaggaggcuucugcacaccuggccuguuccuagcucagugcuggagcacaggaugcgggggcuauuugauacauauguguugacugaacaaaagaaugcaugaaugaaggaaagaacggucagcucugcuuggaagguaguggcaagcugagaccaaccauagcaaugguuccagaugcuugggguuagcaccucaaaacccagaugacugauuuccccacagaaaucauuacacgagaaaccaucaauaauugcauuucccugggaguuuccuuuugguuagccguucucgcugccuaggcuucaugcagguuucccaugaccgccagccuggaggaaugcccauaggaaagacagcagcaacuuaagaguuggucaggguaaauguuaacacguaauuucauagacaggauguguauuucauuacagagucuuuuuuccugagcguuugcgguuuugacuugugguuguagaacagcugcucaguuuaaccccuuuaucuuuugcuugccagaagccacuuucaucaugccacucuuccagaggcuacaaaguuguguucuuugugccaggcacugugccgguggcucacaaguauuccuucaucccauacucaacgacagcuuacaagguuggcaggaugaaccugcuuuugagaggcuggguuauuggcccaaggucgcacagcuaaugagugcuaaggugagauugaaagcaggcugugcuuguaaguucaaagcccacuuucucugucaggcacucaguaguguucacugaggcacagaauugaauacaaucuuccauuucuuccucuuaaccuucaccuuguggguagagaauaguggccuauuggagguaucccuuauuuauuuauuuauuuauuuauauuuugagagaguuuugcucugucgcccaggcuggagugcaguggugcgaucucagcucacugcaaccuccgccucccgaguucaagcaauucuugugccucagccucccgagucauugggauuacaggcgcccaccacuacacccagccgauuuuuguuuuuuguuuuuuugacacagaaagacacugucgcccaggcuacagugcaguggcaugaucucggcucacugcaacauccaccucccagguuugagcgauucuucugccucagccucccaaguagcugggacuagcaggcaugcaccaugaugcccagcuaauuuuuguuauuuuuaguagagaugggguuucaccauauuggccaggcugaucuggaacuccugaccucaaguguucugcccaccucggccucccaaagugcugggauuacaggugugagccaccgcaccuggccaauuuuuuuauuuuuauuuuuauuuugagacaaggucucacucugucauccagauuggagugcaguggugcgaucucagcucacugcaaccuccacuucccaggcucaagcgauucuccugccucaaccucccaaguagcugggauuacaggugcgcaccaccacucccagcuaauuuuuguauuuuuaguagagucgggguuucaccauguuggccaggcuggucucgaauuccugacuucaaaugaucuaccugccucggccucccaaaaugcugggauuacaagcgugagccaaugcgccuggccaauuuuuuaauuuuuuuaguagagacaggguuucaccagguuggccagacuggucucgaacucuuuaucugcccaccucggccuccaaaaauguugggauuacaggugugagcaaccacaccuggccccuuuuguuauuuagagagacaaggcagcagagauuaagaucauguauucuggagcaaaacuucgucaugcaaaugccagcucugugggaccuugagccacuuacccaaccucccugggucuuaguuuuuucaucaguacaauugggauaagggugcuuagcucauaggauuguugucaagaucaaaugagauauauguacaaagugcuuagcaugaugccagacacaaaagaggagcucaauaaacaucagcugccaucaccuucauugucaugacaauccccccucugauuucugcaagaugccucacguaaugccauucacaagcagguagcucauagauaauauucugauucugcuaguuuuaaagaaugggcaguggccccacgccuguaauccuagcauuuugggaggcugaggcaagggaaucacuuaagcccaggaguucaagaccagucugggcaacauggcaaaacccugucucuacaaaaaauacaaaaauuagccaggugugguggcgcaugucucuagucugagcuacugaggaggccgaagugggaggaucucuugcgcccaagaggucaacacugcacugagcccugagcaugcugcugcaugacagagugagacccugucucaaaaaacaaacaaacaaaaaaaaaaacgaaugagagguuugaaauuagggaugacuauuggagaggaauuuguuggacaagacaagauaugucuuaguaauauccuaagaagaucccgaacacuuuuuuuuuuugcuuuauuuaaaauguuauguaauucuauaaauuuuuuuuuucuuagagacggagucucgcucugucacccaggcuggagugcaggggcgcaaucucugcucacugcagcuucugccuccuggguucuagcagcucuccugucucagccucccgaguagcugggacuacaggcgcacgccuccaugccuggcuaauuuuuuguauuuuaguagagaugggguuucaccguuguuggccaggccagucucgaacuccugagcucaggcaauccaccugccucggccucccaaagugcuaggauuacaggcgugagccaugaaauuaaauuauaaggaaaaaaaugucuacucuuucuuccacuaaacaaauuaauguuuucauucauuuaucuuacuuuucaguccuuucauuuguuuggcauuacaucauagauaaacuucuaucuuuuaauuaauuuuugucaaguuacguauggugauccuccuuuaaaaaugguacuaagauguuuaaaacaaaaaacaguagaucccugcgccaccccuaaaccugcuccccaaauaugauuccuuuaguuaauucuucugagauauaccuccauauuucuaaacaugcuuauaguguuaauucaugauuuguuaauuuuagauauuaucuauugacuucuaauagaugaaaauuacauuaucuuucugccaccacuucucccuguuuuuuauuacaguuaaaucaugauuuuaguuaaauuaauagucagcauuuauauaacaauuaaguaaucuucacugcugaggcaaguaaguguacuuugauuauauauuuuuucugguacaauuccccuccccuccugccccagagauaauaauugcuuuaauucuucacuugcauaauguuucauguaacuagucuuaguuuuguucuaucagacuugucauaucauuucccuccaaaucaucagauauuccaucaauuccaucccccgcuuuccccagagaacuuccuccuagagcacacuguucuccagccccagcaaggucugugcucucuagaccuguggcacaacaggucuagaccagaacagacauccugucauggucuaaucucccauguccuggauccugugucuucuuccucagggguuacucccucauuuugcuggagaauaucauccuguaauuuccuaagcauauguaugagggauggauauagacauauauaucaggaacauauauguuaagucuuuucaugucaacauaucuuuauucuacccucauaccuuuuucugauaauuuggcugggugugaaaauuauguguuaaagauaauuuucccucagaauugugaaagcauugcuuuauugccuucuagcaaacaguacagaugcuaagaaagucaauguuauuggccgggcgccguagcuuacgccuauaaucccagcacuuugggaggccgaggcgggcggaucacgaggucaggagauugagaccauccugucuaacgcagugaaaccccgucucuacuaaaaauacaaaaaaaaauuagccaggcguggugguggcgccuguagucccagcuacuugggaggcugaggcagaagaauggggggaaccugggaggcggggcuugcagugagcugagaucgcaccacugcacuccagccugggugacagagcgagacucugucucaaaaaaaaaaaagucaauguuauuaugugucuuauugguuuauaugacacuuauuuuuuucucucuggaaacuuuuaggaucuucuuuuuauuccugauauuacaacaguuucaagauuuggggccuuggucugggucuucguuguuguuuuugugcaggccauuuaguaaccuuuuuaauuuggcaacgugauacugugaaauauguauuuagucuucaaccccuuuuucuggcauagaacuccuaaaauccuuagaaucuccaaaauuguaucuuuuauauacuaaugauucauugguggcuggcagccucuaggcagcuucaggaugggggcuggucccgggaagcaaguuaggauuagagggcugggacguuuagccccaccccuuuacccaucacaucugggaaggggagagggaacugaaggcccccugaaguugcaauggccagugguuuaaucagucaugcucacaugaagccuccauaaaaacgggguucagagagcuuccagguaguggaacauguggagguuccuggaggguggcacaccugaggagggcauggaagcuuuguacuccuucuccuauaccucaccuuuucuucuguauuauuugugauauccuuaaaauaaacugggaaauguguuucccugaguucucugagcagcuuuagcaaauuaauugaacugaaagagaggagcaugagaaucucacguugaacccgguuggucuuagaaguucuggaggcccagacuuaccacuggugucuagggggugggcggucuuggggacugagcacucaaccugugggaucugaugcuaucuccaaauagugucagaauuaaauuggaggauacccagcuggugucugcugccgaauugauugcuugcuugguggugggaagaaaccaccccccgccaauauguagucacagaagucuucugugacuucuguugauuguuguggugaugugagggcagaggaaaaauacagcuugaguuuuuccacacucucggggaauauguguccuucucuuccagaauauuuucuuucuuuccuuuuuuaaaaaauaacuucuuccuucuguuuuuuuguuaaucuccuucuagaaaucuagucaaucauauuuuguuuccuaaauugaaucucuaaugaucauauauuuuuuccuauucuauuugugcuuucagagaaauguccucaauuucauagacuaacccuucuauugaauuuuuauuuaguagaacuucuauugaguuucaagguucaguuuucauucucugccugcucauuuguccaugguguccugccccugucuuacagaugcaguguuguaucucuucggggcuauaauaauuuuacuuguuugguuuaauuguguuaacagcauuguuuuuuuuuuccuuccaggagcauuuuuuaauuguuuugaucuauuuuucauacagaaaaccuaucucaaauaucugguacuccuuggcugucugagaauauuuuaagaaugaaguccuaaaagcugauuaaaugcucuguguaguuaagguuuauugaacauuggacuucacuguauaggaggucaagcuaaucgugaaccuggccuauugggugaccuccaaaugcugaaaucuggagguguuuuuuuugggccuggcugccagcauucugagaucagagcacggaaagagaggauaagguucccaacacuccauauguagaccuucacuuaauucucccugccccuaagcccugaacguuauaagguucugaggggccccuggccuccuuaucaauaacucccuuuuguagcauucagacagaaguuccuccacucagcacaagccagcugccuacucugcugccacuuggacaguuauuuauuuauucauucauuuguucauuuuugagguuuuauaauuuuauuugacaucaacaguuuguucucauccacaaugucugacugucaguuucugaaagugguaauggguacacagguaaccaaaguauagagcuugcuuggugaaucuucauccucaugcuuucuggacagcugcacauggacacaguauggaacguuccuuauuccuuugguccagacagcuuuguugagccugguguuagcauaucuggaguccccaucuccuucauggcaaaguucugggacuuuuugagugaccaaggggcacacugcuugacguccccuccaugggugugcuuguggaugcugauggcauauucuggugucaccaccucauugguggcaggugacagaauagcccuuuuauuuuauuuuaucuuacuuuauuuuauuuuauuuuauuuuauuuagacagagucucgcucugucgcccaggauagaguacaguggcacagucuuggcucacugaagccucugccucccagguucaagcaauucucccaccucagccucucaaauagcugggacuacaggcacaugccaccacacccagcuaauuuuuguauuuuuaguagagacaggguuucaccaucucuuggccaggcuggucuuaaacuccugacuucaggugauccaccuaccucagccucccaaaagugcugggauuacacgcaugagccacugcgcccagccaacacucuucuuuacaggagcuaugcugcuggggccaaguuggaaaggacuuuuaaaauuuuguucacaucuuuuguccacugaguuuggcucuuugaguuugagaauuuacaaaaaaaaauguucuuuccuauaauuguuauauuguuuggagagagggagaaaauauguguauauggucaaugcgcuauuaccucuaauagaauuguuauucuauauuucaccuauauguauauuuuucaguuuugauuaaaucuuuuuuccccuuaucuucccucaugccaucuccucugcuugugugcccuuugcccccagcaaacuguguuaacaccuguuaacauguuucuauucucauuuagucauacacacacucucucucucucucucucucucucucucucucucuauauauauauauauauauauauauauucagggagaucuuuuucaugacuuauuuccauagaaauugggaucauacuauaaaaaguuauuugaaacuuauuuuccucucucaucaacacauuccagccaucugcaggucaacagaugucuaugcaacuaauucucauucucuuuaauauuugcauaauauuccauaguagauagcaaucuauucaaccauuucuaguuugauggacauuuagauuuaaacuagaucucaccuuaauucagccauucucuauugaugaccauucaguaccacagaaaaagagggaaagcuguccauuuuuuuuaaagcuaguauaagcuuaauucuaaaacuugacaaaucuuauacaaaaagaaaaacuauggaccaaucucauuuaugaacauaaauccaugcaauucuaaauaaaauauuagcaaauguaaucuagcagaauaucaaaagaacaaugcaccauaaucuaguggugcauuaacaaacuuuguuuguuaaucagugcuggagagguauaugaugagguucagagcuguuuugaaugaaaacuauaaaccuaauaguaacugaaggaaaagacuuauaugcaaccacaacuaucagaaaccaagaccaaaaacaguauuccauagggcauaccaaacuauuucccuccaucucgggaaugagaggacaccugccugcaccacugggaaucaaccaaguguguugucagacccuuccacuuuccuuguggucuucaugaagacaagagcuuuucaucaugggcaucauccugcaguguuauugaguagcucccaguggcuaguaggaaguuacuccaaaugauguaucuguuugccuucucuagaagaguuccccaucucaaggugaaauaaccgcuuuuuuuuuauccuccacauccuaggaauuuuaagggagaggaaaaaugagaggacucaggggaguuaaucuucucgccauuuaggaaagagugacauuuauuagugugagccuaggcagccagauggauuuuguugggaacaugugcggagcccccuagugggguggugaugcuagcccgggaccuguaggggagaauucaggagcugaacagggcgagaagcacuuaugaacuggggucccagagaaggaggguccaggugaaauagcuugcuagagucaauccuaggugcgugcagaugucauccugugugugaccacucuguaaaugaacccugguggcacggggucuucuccugugcuuagcccuaccucucuguucccucucaagagagaggagggugucagcccuggcacccuacucacaccagucacuuuguuggccuugagauuguguuucuggucugccucagcaucugacuuuccaccccgggaugcguuuggucuguuuugccaguuagagaacuggagacaccugagccugagcuccuuccuaaugguuacauuucccugguagcauuugucacuagggcuucuaaauuuggccaucaggauuuccucaggcuuggaagguuaacacauacugcccaagagggaggcaauauaauguaacaugggugccucagcuuccucaucugcagaaugggcugaggauaauaccucgucacgaucacccggaacagggccuggcauacuuuaccuagcgacuuuguagggacuuagugaauguuccccaacagaucugucacagaaacuguaaauauugcccuucaccccuuccgcaccucuugcagcaguguuauccaggaagguuggaaaccuuaggagaugaaggggcccuuuucucagggcacuccaagagaacccucucagugucuuuuaaaauugucaaggucccagcucauagcaguuccucauaaaauaccauuccugugccgggcgcgguggcucacgcuuguaaucccagcacuuugggaggccgaggcaggcggaucacgaggucaggagaucgagaucauccuggcuaacacagugaaaucccgucucuacuaaaaacacaaaaaaguagccgggcgugguggcgggcgccuguagucccagcuaccugggaggccgaggcaggagaauggcgugaacccgggaggcggagcuugcagugagcugagaucgcgccacugcacuccagccugggcgacagagcaagacuccaucucaaaaaaaaaaaaaaaaaagcaccauucccuuugccauccccuggacucacuccucauccuauuccccaaaaagugagaagggcaggcuguguagauggcauuccugagaaugagccaguggagagcaucuggcccuggcaugugaauucaagccuuuucccagcuguaauaaccacccucuuuuuuccacaggggcuaaacugcacggucaagaauaguaagucaucuuuuucuguucuucuucuuguugccuucuuaaucaagugagagccugcugccaacuucugacagaagucuugccaugccacuccagguucaggcugugagcuacagccauccgcaggaggguucccggagaauuguggaugcgugcaccugcgcuuccugucgagaacauucauuaugcaaaagucaggaaaggagaaacagaacugucauuuggauugugaaaguauucucuggggagcugcccuacuguaucuauaauauaauuugauuugccacagcuugucacuguaaagugagagacaucugugcuguugauuuuguuuuguuuuaauucaaagaggcacauauucaagugucugagccaauuagagaccccugacauauaacaauaaagcagcucuuacuacaacugcaucccuccugugcccuuauucccaaucacaacuucuucucaaaaucaacuuguguacuuugucuucucuccuaaaauucccuuuagacuugagagguuugcagugaccccaguaaacauuagagaagagggagcagggcaguaaagcugaggacgcggccaagggccacaggcuggaaggccgcgggccccugagcuguuugcugucuagcugucuguaccugcugcuggggcaucucagggucucggcuauaagucucugaauguugcuuuucccuggcugccagguaccugccuggaugacagcuggauucacccucgaaaccugacccccuccuccccaaaggaccugcagauccagcugcacuuugcccacacccaacaaggagaccuguuccccguggcucacaucgaauggacacugcagacagacggugagugggcaugccagcagggcccugggggauucucccugccuccaaguggcucucccagucaggcucaggauugggcucccaguccugugcucagacauggggguucaaauuuagugcuauaaggauccgucauuucaugcagucaaauacuuguucagcauuuuagauauuaacccacagugauaccuucucaucacaccauucuucaugaaaggacuuccuucaaccuaauauuuuuagcacccugaggggaaaaaaaagcaagcaguuaauuuugugacuacaguaccaaaaaugaaguggaaaaugguaacacauuugucaaccuguucccugaauuuaggggccagcacuuuuaaaacgucccccaagccuauucaggaauggagaguuuauguuacagaauugggacgauuggggcuuaugagcacuagccccagauuugugaacggggcaugggggaaguucuuuuuggaaguccccgcccucagugcuccugcugacagccacaaccucgugaggaugguggggauggcuguguuugacacccaugccagauugucaaagcccucaccacaaguuugcaaagccuuuacuucuagcccaguguaaagugucauuuuuccuugcccagcugggaaauaacugucugcaaggcgguaggcugaggccagagagugaacugaaaggaacaggauguggagaguuggguaagacggcagauuuucuuuuaggagugaacaaccgcaacagauagggaagugacacacccagcacuugucuuggcugaucugcaucuguuugucuucucuucucccucuccugcagccagcauccuguaccucgagggugcagaguuaucuguccugcagcugaacaccaaugaacguuugugcgucagguuugaguuucuguccaaacugaggcaucaccacaggcggguaagaacacagcuccugaguggauuauguuccacugaugacaccaguacagacuucuuguccccaaauucagacccugauuuagagugggggagacccagaggugcugagggagucuguggaauucagaauggcagccugagaugggcagaagucaaaagagaagugguguggccgccgugagcaauagugagggacagagcguauuuuugaaagcgucccucaccugcucaccccugguuuuucuucccacuuuaccuagcuauucguucggaaaggaaguugaauuggaaggcagcuuccacagcccuaccuccugccaucuuuguguaacuuuguguaacaucuuuuauguguaacuuggauucagcuggggccuaccuucaggaagaaaaaaccgcccagaccaaagaacugcuguaggugggcaaaugagcacuacaacagcuuagucucauuuugcugcucacagcuaaauggugaaauguugauucuuguuuaaguuuguuuaaagcagugggucucaaagugugguccguagaccagcagccucagccucaccugggaacgugguagagauguuuggccccaccccagacuucccaggccagaaacucuuagggugggguccagcaacuggugcuuaacccuuaagucaucacgaugcgagccuuaguuugaagacuacugguuuaaaucugcaaauggucacuugaaaacaaguuagaucucccacaaacucaagcagcaaaggcagaaccccucuccgauguuaaauuaggacccccaaacuugacugcuaugcgaauggugagaaccagguuccuccguccacuuagaagcaaaggaccccggccccuccaccaggguaacuagaauggggguuggagucgaugucuguaaucucuaacacccagaaaauaacuuagcacaaauucaaauaucauugcaacugaggugccugcuggcccagggugagugggggucucuagcuuguccuuugcaccuuuuuacuccauaauggucucaagagguuccuggcuuuuccguuugaggaggaagaaucauuugacaaauaguuuuuaccugccuggcgugugccagaucuccauagccccaaguccccuggcuccgcccucucauacccauuguccuagaauuugagagggcaggugggaggggugggacuacuuccacuuuccccaaauucuuuugccuuauucacugucuacugaugaggccagauccagguuuaaaaaaaaaaaaaaaaaaaacaggcagaaaggaccagaggaaacaaaaaacaaagauacugauuucccugaccuuggauuuugcugugguuguugcuuuguucuuauuuuuggcugaauauucgggagugggugggaacgggggucuuugggcauagaugggugacagagguguguguaauccauccaccuucccuuccucccuucucuucaguggcguuuuaccuucagccacuuugugguugacccugaccaggaauaugaggugaccguucaccaccugcccaagcccaucccugauggggacccaaaccaccaguccaagaauuuccuugugccugguaagagcauccucccaagacauucccuccccaauggccucugugagaaggaagcaccagguggcacagaugccagccccccugcucagcaagacauuggcuggcauugccagcaccugggacccacagaacaaacagaggccaagacugggagugcuuuggugugugcugcaaccuccauucccugaggcagaggccauucucuguuggcacaacaguggacgguggcccaagaucccaggaguuuuaugggaaccagagcaccucccucuaucuagagaagcacccagccugcccagaaaauagcauaaaggcaagccacaagccacucguggggaaguugcagccucugcccccagccuggucccagccuccguggcuugcucuucuccuuccaccuuacauucugccugcaucauccaacguucaucccaugcauggcgcucuacuccccaugccuauccacacugccugugauuaccgccaggcuuuucuucucaggcauccuuugauguacauguaccuucuacuucucuguccuccccagaagcucagcuauuaccuacauuucucucuuuuuguuuuuaauagagauagggucuugcuuugucacccaggcuauagugcaauuuugcuauccuagcucaaugcagccucgaacuccugggcucaugcgauucuccugccucagucucucuacaauucucuguccauagccagcuaugucaggaagcccacuugaaaacaaagccugggucuucugcccauuuuuauaaucuccagaaccucacgaauugccuugcauauaguagguuggucaagaaaugcuuguuaaggaugguguugaccuucuucauccugggaccacccugcacacacgcgugcacacacacucugugcuuacccugcuuuaugucaccgcguguggcucaucacucccugacugguacugcaugcuguguguuugcuuuuauuggucucuucuacuggguugcaaucuccagggggcagggcuuugucuuguuuaccacuguaccuccagugccaagaacagggccuggugcauaguuggugcucaauauguauuuguugaaggagugaaucuccucaguucucgcuucuguuccuaaaguugacugacucagucccugucccuccauggugauucacaccugucacaugucuucucagccugugcaaagacaggggcagccggggacaagaagcugugggugggcagagaaggaacuggaggggaccaagauugcuuggucacccacagcaagcucaggaggaaugcacuugcaucaggaggguuccccgagagaugaggaucagacaggcaggcuggcacccaugccaagguggguccagcccuggagcucacucugaaggggccaccugcggacaggcucccaguggggaaaagauuguuguucuuggugucaggagucuggaagaacagauuucugaaggcagaggcuuaaugaguuuccuuuuuucugggucgacagacugugagcacgccaggaugaagguaaccacgccaugcaugagcucagguaacagcuggcccgggagagcuuuauuuggaugcauacacaugcacaugugcgugccccuccucacucccagccugcgugugugaccuuggcaggcagccugugggaccccaacaucaccguggagacccuggaggcccaccagcugcgugugagcuucacccuguggaacgaaucuacccauuaccagauccugcugaccaguuuuccgcacauggagaaccacaguugcuuugagcacaugcaccacauaccugcgguaacucugcucuuuuugaccccucuagcauagcucaggaccaccccuccaagcccugagucucuucucugcuggucugacagaaccgcguugcuagaagcucgcgacucagggcugugcuuaguccauagugaucauggcgccuugcccuuuuucuuccccagugaucuuaugcuugauagaaaggcaguugacuguguccugcccaugacucaguccuuuuuguucuuuccucccccacacgcccccuuguucucuuuuuguuuugcuuuguuuauuacaaaaaggauuugaggauuuaaaaaaaagaagaaaugugaaaauagagacaaaggggaacuaaagauaaggaaauaaggccaggugcaguggcucccaccuguaaucccaauacuuugggaggccaaggcaggagaauggcuugaaguuggaguucgagacuacaguaagccaugauggcaccacugcacccacucugggggacagagcgagacccugucucuaaaaaagaaaauaaaaauugaaaaauaaauaaaguacauuaaugacauaaaauaugccaggcacagugguucacgccuauaaucccagcaguuugggaggccaaggcagguggaucacuugaggucaggaguucgagaccagccugaccaacaugaugaaaccccaucucuacuaaaaguacaaaaauuagccaggugugcuggcacacgccuguaaucccagcaauuugggaaacugaggcagaagaaucacuugaaccugggaggcagagguuguagugagcugagauugugccacugcacuccagccugggugacaagagugauacuccaucucuaaaaaaaaagaaauaaagguaauacgaugaagccagcucagugcaggaaacgugugcugugugguucuguacaacugguguccaugaacacagauuuguugccccaauucccagcagccaaagcaaagagagacuuaccaguuacuacacguacuuaaggauuuacaauaaaccagcuuccaugcagaaacggaguuuuuuucuggaauagaaaccugaaaagcauuucuccccuggccuuccuaaggggugcucuggacagccucuccauggcagugccacagcguguucuuacccaacuagccuuacccaucccaacuagccuuacccauccucgccucucuccucagcccagaccagaagaguuccaccagcgauccaacgucacacucacucuacgcaaccuuaaagggugcugucgccaccaagugcaggugggugagugugguguggacaggugcagggagcaaaacagguggcaauuauagaguggacaggagugaggagugugcacaggugaagagugguguggacgggaguggggagugugcacagguggagagagugguguggacgggaguggggagcgugcacagguggagaguguggugugucugggaguggggagugugcacagguggagagugguguggacgggaguggggagcgugcacagguggagagagugguguggacgggaguggggaacgugcacagguggagagagugguguggcugggaguggggagcgugcacagguggagagagugguguggcugagaguggggagcgugcacagguggagagugugguguggcugggaguggggagcgugcacagguggagagagugguguggcugggaguggggagcgugcacagguggagagugugguguggcugggaguggggagcgugcacagguggggagagugguguggcugggaguggggagcgugcacagguggagagguguggcugggaguggggagcgugcacagguggagagagugguguggcugggaguggggagcgugcacagguggagagagugguguggcugggaguggggagcgugcacagguggagagugugguguggcugggaguggggagcgugcacagguggagagugugguguggcuggaguggggagcgugcacagguggagagagugguguggcugggaguggggagcgugcacagguggagagagugguguggcugggaguggggagcgugcacagguggagagugugguguggacgggaguggggagcgugcacagucuggcauucuugcugguggacaggggaaagcuuguccucucuguggcaccaagcaccacuaccagucaggauuccuugccugguaaggcacugccccugccuuucuccugucugguucucccacccucaccugggcagggguucgcugacccgcccuugcuggagggagaugauggucaccuggagaucgugguguagccagccaggauccccuccucucacauugccgcugcuggcuggaaggcaugggcgcucuacaguucuggagcccuuuuccugcccucucugcccgcagauccagcccuucuucagcagcugccucaaugacugccucagacacuccgcgacuguuuccugcccagaaaugccagacacuccagguaggggacaugcggcuguccuaggccauacugggagaacaaguggcugaaggcccccagccugugcugcguccuuaccugguucugaggggugauuagggaggagaguuuaguuuaacuuggaguccuucaggccugaaguguggaguggggcuuuagagugucacucccuggggcuggacuccuggcugucuuucauuagcuauguagccuuaggcaaauuacuuaaucuuuuugauucucaacuuccuugacuggaaaaugaggugguuuuuauccuagagcccuaguucugugccaugcacugagcgcagugcuccaacaugccguccauuuuuucauccucacucauugugagucacgguacuaugcaguagaggauccccccaccccaaaccccagguuccuggauaaggaaacugaggcacagagauguugaauaacuuguccaagaucacacagcagggacgcuguuuucaaaagucgcaugcccuaaugcacgggaggcugcagccacgugcucaccagaaggcaaggcgcaggcauggagccaggcuggaaggagaacccagccucccaaggaggaggcaaggugucucuucuuagaccagcaacucaagugucucuuguagaugguuucauuaaguucaaccuggaucuagagugccuggugcagggccaacaucauuaaagcccucaagggacgucaguuguguuucuugugaugacugggaaggguuaagaaugcuauuuucccuuuuuccucuguucucauugcagaaccaauuccggguaagcuuggaucucucuccgacagcacugcagcccucaggggacauuccccaguggccacuugagaagucccugccucagccaggcagacaaggcugaaccgaggccagcccgggguggggggugagaccaugguuugucgugguggggccagagaggacagagccuggggcuggggagcagggcugggggccucagggugggcagggcaggccccgccgcaucacucacgcuguucugcucaccgcagacuacaugccccuguggguguacugguucaucacgggcaucuccauccugcuggugggcuccgucauccugcucaucgucugcaugaccuggaggcuagcugguaagcgcuggggcucuggcuguccuggagucaggcucuaauaccagcaccaccacucacuaccaaggcaaaucgcuuuauucucagagccucagcuucuugcuugagaaccacgucauaaagcuguuguaaggacugagugaaauaagacacaugaauucuuagcacagaaccuggcaugugcuauuugcacaguaucuguuagccacgauuauauuuguuguuaucaaauguaguauuauuaaaaucaauaguuuggaaggagccggaguaaaguuucccugugucaggaaugaucauccaggcagguggagcagccugaacaaccccauccugcagccgccagacguggacgccuggggucagggagaauagugagggucagcaucgggugauagagaaggcuccggcugcccugagccacagggguggaccccagccccaccucauuagccuuguagucacaggccaguuacuuaauacaccauggauucacuuuucuguaaaauguacugauaaugccucccucuaagggugugacgaagguuaaaugaguagcugaggaaggugcuugcugguggggauuaguacauaccagugucuucucccaccugcagcccucugcuggccaaguccuaagccgggagaacacaggccuuccgguuggggcuucagcccuugccugccccaccaugacccuaggcugcuccuuccgucaucugggaagcuguuuccacccuucccuaggcucgucaggauuagguguuaaucauuauuaauuauuaugugguagaaagaaaaccagccaggcaugggaggaccuaugggagguuccaauaacauucaguagcaucucggccagugcuccacaggcggugcagcucucuaaagguuuggggcugggcggcggcggcgcuuuugguuuccuuucugcuguugcgcuucuguuuuccgaaguguccugcaccacagggugaaggcaagaggagccucgcuguuauuuggcugucuugugacaguucuggggaagagcugaaaggguuaggauugagauuaagguucuaagucguuugcucagucaucuguggaucucaauccucccagcugucacuaaggaguuaacccccgcagagcaguuuuuucaucacaucucugaggggaacaauugcuuaaguauguggguuccccuuccucaccucaaaaauaccaggaggaaauguugcaagcagccugguggggcugcuucuggaaagaagugugguaagaugcaugucuucuguaaagacacuucuggggaagagcuuuuccucauguggagucaguuugggguggccaaauuucagggagacagggcagaccaggaccguaaugaggaaccagaauggacaccacccccugccccccggcacugggggucccagcuggaucagugcuacaaaauaacugugaucccaauugauuauguacaacgugccaggcacgucacauacacacacucauuuaauacccauuaaacaagagcaaauacagacccaccucacagaggaagaagcugcauuucagaggcacuaguaacugcuccaggucauagugcucguaguggcagacccaggacucaugccugugcgaccaccuagcacggccucgcugcucagucucggggcugcccccuuacccuucacccuuugucagggauggggcagacacccugugagcugguuucuauuucucuucccaaagaaccacuccaguguauuucuuuuccuuuccagggccuggaagugaaaaauacagugaugacaccaaauacaccggucaguauuuccugguuugcauguuugcuuauuuuuaaagcaguggaggguucuccugggauaagugcgugggucgccuccugugcucuaacucccaagucccuucaggagaccccaccuuagaaacccccuuccaguaccccacucagaagggcccccaauaacaaggccugggugccauuuuuugaaucacucagacaaggaaagaaagguaaguauuuugugaacagagguccucccuggagcagaccaacagagcuuggugccucuuuuucuuuucuuaauuaaaguauaggcuaaagaccagcuaggaacguugagagauucuuuuucccacaaggcagcagacugauuuuuuucaggcagccaaagguggaauaguaacaucuggguuuuuccaacaggccucaguuggguuucucagcuuagggagggagccaagcucuguguccugguccaggccccuccugggcuggcaggcacagagcugcccugggcccuggggugagggucagcauguguggucuuguuuccuuagauggccugccugcggcugaccugauccccccaccgcugaagcccaggaaggucuggaucaucuacucagccgaccacccccucuacguggacgugguccugaaauucgcccaguuccugcucaccgccugcggcacggaaguggcccuggaccugcuggaagagcaggccaucucggaggcaggagucaugaccugggugggccgucagaagcaggagaugguggagagcaacucuaagaucaucguccugugcucccgcggcacgcgcgccaaguggcaggcgcuccugggccggggggcgccugugcggcugcgcugcgaccacggaaagcccgugggggaccuguucacugcagccaugaacaugauccucccggacuucaagaggccagccugcuucggcaccuacguagucugcuacuucagcgaggucagcugugacggcgacguccccgaccuguucggcgcggcgccgcgguacccgcucauggacagguucgaggagguguacuuccgcauccaggaccuggagauguuccagccgggccgcaugcaccgcguaggggagcugucgggggacaacuaccugcggagcccgggcggcaggcagcuccgcgccgcccuggacagguuccgggacuggcagguccgcugucccgacugguucgaaugugagaaccucuacucagcagaugaccaggaugccccgucccuggacgaagagguguuugaggagccacugcugccuccgggaaccggcaucgugaagcgggcgccccuggugcgcgagccuggcucccaggccugccuggccauagacccgcuggucggggaggaaggaggagcagcaguggcaaagcuggaaccucaccugcagccccggggucagccagcgccgcagccccuccacacccuggugcucgccgcagaggagggggcccugguggccgcgguggagccugggccccuggcugacggugccgcaguccggcuggcacuggcgggggagggcgaggccugcccgcugcugggcagcccgggcgcugggcgaaauagcguccucuuccuccccguggaccccgaggacucgccccuuggcagcagcacccccauggcgucuccugaccuccuuccagaggacgugagggagcaccucgaaggcuugaugcucucgcucuucgagcagagucugagcugccaggcccaggggggcugcaguagacccgccaugguccucacagacccacacacgcccuacgaggaggagcagcggcagucagugcagucugaccagggcuacaucuccaggagcuccccgcagccccccgagggacucacggaaauggaggaagaggaggaagaggagcaggacccagggaagccggcccugccacucucucccgaggaccuggagagccugaggagccuccagcggcagcugcuuuuccgccagcugcagaagaacucgggcugggacacgauggggucagagucagaggggcccagugcaugagggcggcuccccagggaccgcccagaucccagcuuugagagaggagugugugugcacguauucaucuguguguacaugucugcauguguauauguucgugugugaaauguaggcuuuaaaauguaaaugucuggauuuuaaucccaggcaucccuccuaacuuuucuuugugcagcggucugguuaucgucuauccccaggggaauccacacagcccgcucccaggagcuaaugguagagcguccuugaggcuccauuauucguucauucagcauuuauugugcaccuacuauguggcgggcauuugggauaccaagauaaauugcaugcggcauggccccagccaugaaggaacuuaaccgcuagugccgaggacacguuaaacgaacaggaugggccgggcacgguggcucacgccuguaaucccagcacacugggaggccgaggcagguggaucacucugaggucaggaguuugagccagccuggccaacauggugaaaccccaucuccacuaaaaauagaaaaauuagccgggcauggugacacaugccuguaguccuagcuacuugggaggcugaggcaggagaauugcuugaaucugggaggcagagguugcagugagccgagauugugccauugcacugcagccuggaugacagagcgagacucuaucucaaaaaaaaaaaaaaaaaaagauggucacgcgggauguaaacgcugaaugggccaggugcaguggcucaugcuuguaaucccagcacuuugggaaggcgaggcagguggauugcuugagcucaggaguucaagaccagccugggcgacauagugagaccucaucucuaccuaaauuuuuuuuuagucagucaugguggcacaugccuguagucccagcuacucgggaggcugaugccagaugaucacuugagcccaggagguagaggcugcagugagcuauaaugguaccauugcaauccagccugggcagcagagugagacccugucucaaaaaaaauaaaaaaguagaaagauggaguggaagccugcccaggguugugagcaugcacgggaaaggcacccaggucaggggggauccccgaggagaugccugagcugaaggauugugguuggggaaagcguagucccagcaaggaagcaguuuguggguaagugcugggaggugaguggagugagcuugucagggagcugcugguggagccuggaggggaaggagggaggcagugagagagaucggggugggggguggggggaugucgccagagcucagggguggggacagccuugugcgcaucaguccugaggccuggggcaccuuucgucugaugagccucugcauggagagaggcugagggcuaaacacagcuggaugucaccugaguucauuuauaggaagagagaaaugucgaggugaaacguaaaagcaucuggcaggaaggugagucugaagcccugcacccgcguuccgacuaucaguggggagcuguuagcacguaggauucuucagagcagcugggcuggagcuccccugagcucaggaagccccagggugcaagggcaaggaaaugagggguggugggucagugaagaucugggcagaccuuguguggggaaggggugcugcugugacuucagggucugagguccaaagacagcauuugaaaagaggcucugaagccaguguuugaagaauuuguuccugaaguaccuccuggggguaggcuagaggcuucuggcuucaggguccugaagaacacauugaggugccgucugacacuggaauagggugcccuucauuccuaugccugaguccuuaacuauauuuccaaccuccagugaggaggagaagauucggaaaugugacaggagagcaaacaggacaguuugcaugugugugugcgcacacauacaugugcgugaaagauuaucaauaaaagugcauaaauuuguugaucugguaagaguuucuagcaggaaggucgagccacuuacuguaggucaagaaguugcuaguugcggaguuuuuucuugcaguuagacuuuaccuagugguagcagggccaccaaagcucugugucccagaugguguauggcccauaauccacccaacagcagcaaaggaccaggcaaaggagaacaggagcagaagccucccagccacuagccuuuugggcucagucucuccaauaauccuggagaggggcuucguugggucuggacaccuaccaugcauucugugaccuuucccuagcuuccaauaaauaacuguuugacgcccagaguacaggauaccacaaugcacucuuccugcguagagcacauguucccaucugcucccauuccucaggaaccuugaauucuagcucugcuggccuuugagcccaugccaguaaauguccugaugggcauugccuacuaucuccagggcagcugccuuuguccuccuaacagcuuuauuggaguacaguucacuuaccauacaauccacaauugacccugcacaauuugaugccgguuuaguauagucacaguucagcagccaucagcacagucagucuuagaguuuacuacccccaaaagaaauccagccccccuuagucaccaccccaaccuccccaucccuaggcaccccuaggcuacuuugaucucuguagacuugccucuucuggacaugacauagagaaaggagucauaaauucuccaaggugucuguuucuucuuuaaugucauucccuguuucuccucacauucccuccccauuuccugggcccagucucacacugguccuugcuuacccuaaaugcuauuaauuccaucacucugaguaugguguuugcuguccgcugaaugccaagagcuucaagaguguguguaaauaaagccacaccuuuauuuuuguauuauucugaaccauggcuaauaaauuguuucaccaagaaaugucucucuaagaacaggugcccuccacgcugugccccucccaccucuucagcucgucuccugagugugcagaggugguuccgguugggaaagaagcagcggagcaucuaaccaugccuguguccaggccgauuaugcacgcagccaccaacaagcucccaacucccgcguagaguuucaugacuuuuuccugccuacuaucuugauccuaguuuuuuuuuuguuuuuuuuuuuuuuaaggaauaauuacuuugauucaaaaccaguuucucuuuucugcauaggaagguccuugaagguguuuagggucuaaaaagggugguguucggucucugaaacauccauucagcaguuugagcugggaucucugaaugcaaggguaugauggauauacuucuuucuugcuuuuguuguguuuugguuuuuuguuuguuuuuaagucagggucucucugucaccaggcuguauuacaguggugcaaucauggcucacugcagccucgaccucccaggcucaagccaucuuuccaccucagccugccaguggcuagaacuacaggcgugcaccacugugcccggcuaauuuguguguauauauuuuguagaaaugggguuucaccauguuguccaggcuggucacgaacuccugggcucaagccaucugcccgccucauccucccaaagugcugggauuauaggccugagcccaccgugccuggccuuuccuguuuaucuuugaaaauuaaauagggcauaagagagaagaagauguacuuacaaugcagugggugguuuuaacucuauagccuuugggcucugugguuggugcuccccuuccuaaauaaaugagguguaugcagggcccucuucugccuuagcgcccugccagcugggacuccagcaaggcccggggcaccugaggacagagugagauggagggccgcugcuccagcagccgggccugcaucccacaagucaacugugucggacagaggauccuuacaaagaagaggcagcaggguugggggcuggccagcugcucguccgcccuagguagcuugcucaucuguaaaguggguggggcaggaguucccaccucaugggguccuggcaagccugcaguauccccgaguggcaccagccugcuucuggggcagagcaguuugugcccccugagguaccacugauccucuuucccugcuauuagguauugcucucuuccuccgguguuugccuuuucagauuauagaaguaauauguguucccauauuuggcgucucucaggagcucaggaaguacuuggcugagugaacauguccauuguggaaaaauggcaacaauauggauuccauggguauauuuuauagaagaauaugaagaaaagcagcuaccccuaaacccauugcacaagcuguucauguuaauucuguacccgacgcuuuccccacggggccuccccucacucugaaauggcauccagguccaucuugcccuccaccucugcauggcucuccaugccccaucgccucucccagauccuagcacuggguccacacucucgcccuguccauuuagguugaugaaagcaggcagucacccgggugggccagucuugccugugggaggaacaugcagucuccugucucaugguuugaagugugccaggaagccuggcccagcccaccucccccuggaguccuucccaggaggaauaaccccuuaggucauugacuauaagaugaguucgcucacuggauccuuccucucugaugagacaggaagaagguacacagugaccagguaggaggaggagagggaguagaaaggagggaugcggguggcuggucccugcauuugccugcuucccugcacgggugucccacuggccgccucugcucaccagugucaugggauucucucagaagaugaaaacagccccugcuuuuuugcuagaauggcugagcuuucauggaaaggaagcuggacccaagcaacagccgacuaccgaagguugccuggagcagugcagaugugggaggaagaagggccuuggugcacacuggcuuuucuuccugacugcaauguggcauugugccagcuaccuccucuuucucggccucaggaaaauggagagaaagcagcccugaagguggcugugacgagggaaggggcagagggccugacagucaaccacgcgcuauauuuuccuguucuuccuuagggcaagaacugcauggccagacucaggcaaggccuaggugugggcugggcauugccuacacgugaagagaucacuccgcgucccuacugcaccugucacaaagugccuucugauaugccuggcaaaccaaaaucggugagcgccagcuugcuucccuagaagacauuucuaaauauucauaacaugcuugcucaaaucaaucaccuuauuuuacauccgcuccagggagaaaugaagacaugguccuacguuguucuguaauuauuuucuauguaaauuuuguuccuuguuacaauuauauaugucuuaggggaaaggaccauuucacaugugucaccucaugugauu

SEQ ID NO: 14869 - RNA, 483 nt, Homo sapiens
gauucaaguaaacaaacauccauuaauacaaguuaaguauguuccaggcgcuguguguuccagguacuguuaacaaaagcggguuacuaguuaagacuuccuucaugcccuggcgccucugcucagccaguucccuucgccuaggaggaccucucuacaccaccccgcuauauucccuccccggaauuccuucccaaccuucaaggaccaucugccccaacuaguggcgaacaucgaggcugucgugacuguguagauacuuauuugaccugcucccuuggcaaacacuugaaacgcaauacauguuuguggaacugaacauagccugugcaugcagcaaggcuucuuucccuggaaucgccugcccuuccuccaacacagcgaccagccggucagaaucccaaccccucgacuccggaaaugaucugagagacggaacuuccgaacgucgcaaucagauuugggcgggcuaggaggguuugg

SEQ ID NO: 14870 - RNA, 2826 nt, Homo sapiens
acauuuccccaaaauuguccuggcucagaauuugaaggagcgcaggugugagcguccuggaggcccgucaccggauggcgugcugcccccacagacucagaggccccuccuugcccugcacuugucaaggccagcuuugccucaggcacauaccuguggugacaucuuagaggauuccacgugggucugggaggugaccccagguugucaccugcaagccuggaagccauguuggccacuuauugaaugcagucugucucagagccaggcagaccuauccaggggcuuugaggagggggcccaaggccccaaaggccccgguaugacaacccagaugccacugcccuccugauaaggaguagaggcaggagggcccuguggcccgagugcugccaucauuguguagggaacacaucaucccucuuggaggaauccacacuguggcucuggccccccgcccccucugugaugcugccagagcuggaucugcucucguucaguuccgugcugaaaaaaggacuuaauucauuuguagacuuuguuucccuuguuucugcuucuccauuucuuguauuauuuucuuuuccuccuguuguuccuuucucacuuuuuaugcuuuuuguccucugcuuguuuuuauuccaccuucucccugucccucuccacuuccaaauuccugcuccucuccuccucuuccuuuuuugucuuucuccgucuccuccucuuccuugcuuggucccuuuugaaguugagcccaguggcgggacuccacgacguagaccucucuccuucugcccuugcuguguccaggaagguaacguaaccucgccaaccccauccccacugccucggaggggguguagcaacacuagucaaacacagagccagaacccaccuaccucucucucuuucuuucucucugacccucaauaguccuguuacaaaaugucaugagucuguggcaguuucuaaagguacaguaucccuuugacugucuauggggaggaccagggugcagaguaaagccagagagccuccaggucuggguccuucagggcugcagcauuggcuggcccuucguggcuggggcuuuaagucucagauccaucagauagaggggcaggcaugcaggugaggagccucccgccugcgugcagcgauuuggaugggagagucaaggaauacuguccuuacaaagacugaucuacaccagugcccucgggccccuuuccaaacaaccacugaaagcaaaccucucuaccucgugucuugcugagugugcguguuuuaaguuugucugauuugaagucuguuguggugauaagauugucguugaaaggcaugugggggguguggccgugacuaacccugcuaacucuuaccugccguccacagcgcucacccgacucucgcucacacaccacagccccugccuggcggccgugggcgagcucuccauagcuagugagcgcuguccgcacgucuccgguggcauuuucuguaucuucguggggaggugggcagcgggagagacucccuggugccgccguggccgggcgcacuggacagcuugcaugccucgggccccuccuccacggccaugugggcacauugugcagagacgcuccgaaagcaaugcauggaacugagugggggcuggcuuaaaggccaaaacccaagccuauuggauugggugaggagagcgcugguccccugacccucaggcacacacuccacaguugcaggcuggacaggcugggggguuuccguccuucagaggaggcucaggggcaggaacccccuugggagcagaaccgcaugugcacuagggcacaguacagacacuaaccccugcuuguugaacauggugcauuucugccuccuugguguggccacuggguagagacuaacugucuagcagacaccacugcagauaagaggugugucuguguaccgugugccagaaaggcagguggagaaaggcagcuagcagugagggaggacucgggcuguggcuggcccuucugaggcuguguuccucacacuccugggcuugucuuaacuggccuagaacgcccccugccaagggacgcagagagugcaagggccucugaaagauguccccgucuagugccccuuaaccugaggcccauggauggaccccaggaagcccaggagcagcuuggaacucugcaucaaaugguuugcucugcacacauaagcauuuuucuaggaagagagucccuagcuuuuaugagauucucaaagugguuuguaauccaaaaauauugaagagccacugacacagcauguauuuuaggcaggaccacacuuuugccaugaacuucugugcuccaaggaaaaggaccuuguucucucguuggguggcuuggucccuuggagacuucuuccuucuguccuccugccacagugaagcccaguggucaggccgucccugggggagguuugguaucggcaccuguugguucaggcagccugagcuagcaggcagccaccagacacaggcauucuguuggauuggaccagggcagggcguggccaccuccuuccauccccaggggcugcuaguguuucucugcucuuggugagaaacccugcggccauccugagaugcccugcaucgaccaugcgggauccagcgggagagcauccggaagcuugauaggccacaaguuaaggggugguaucuucucuuccuggucaggagguaaacaaauggacaaggcaucuauucugguggccccuggagaggggcaguagcccaagaaagagcugaguuaaaugagcaugaccugagggcagggu

SEQ ID NO: 14871 - RNA, 1513 nt, Homo sapiens
accucugaccucuucccacaaaaaucccaggccuaucagaggcugaggggccacaaauggacuccuggugacaguccucacaauugaaugaggugacuuacaaugauuauucuacaacaagggauucgggaaacucaaugcaggguucuuccuuuuuuuuuuuauuuuuauuuuuaugagauggaggcucgcccucucacccaggcuggagugcaauggugcaaucuaggcucacugaaaucuccaccuccuggguucaagcgauucucgugccucagccucccaaauagcugggauuacaggggcccgccacuaugccuggcuauuuuuuuuuuuuuuuuuuuuuuuuuugagacagagucucucugugucgccuaggcuggggugcaguggcacaaucucggcucacugcaagcuccacuugcuggguucaugccauucuccugccucagccacccgaguagcugggacuacaggcacuugccaccacgccuggcuaauuuuuuguauuuuuaguagagacggggguuucaccguguuagccaggauggucucaaucuccugaccuugugauccgcccgccuuggccucccaaagugcugagauuauaggcaugagccaccgcacccagccaauuuuuguuuuuuuaguagagacgggguuuugccauguuggccaggcuggucucgaacuccugaccugaagugauccgccugccucagccucccaaagugcugggauuacaggcauugagccaccacgcccagccugcucuucccuuuugacugacagcuccaccaaggcagggccucuguggcugcaccagccaaaggugaccuggguggcagggaggcccgucuaccucugcucugcucugcacugugcuuguguggcagggagcagcuggguggauagggagaugcugcccaacccucccaugcaugugcccuggucccauccuccaugguuuuaccugggcucgaugcagccgcuuaagcuccuccugcuuggccugucuccgagcugccuuuugcacacgccgggucagcuuggcauucaguuccuccuccguguagguucuuggcuggagagaacaagagaaacuuccucagucaggugcacggaggccugggacaggggugggcagcaggccaacaggggccuggagaggucugucccccaugucggagcugguacccgggcagauaggacaagcuguccucuguagaguagagugcuagcaggacgggggugcugauaggcagaaggcaugaggucugcagaguccccagccugcagcagcccucagugccacgggcacaccuaagauccacagagugagacauuuccccaccucugcacagggacaggaggcugaguggggaccgacuguuaggcaguuaaaacaauaaagggacacacgcuccuuuaucacugagaucaccugcuucccaaauaaggaugucuggucauuuuaaaacuuugugggaguaaaaacauugguaggcuguuu

SEQ ID NO: 14872 - RNA, 6013 nt, Homo sapiens
ugagauugacugacaguccccauuuauuugaaaacuugucggaucauauagggaauugcaggagagauguggcaugcacgcuuauaaaaguuuaugacagagggcaagaaaaaguaagagagggcauaguuaauacauuugaauccaccagguaaggcaccguuuggggaggggcacagguguuggaagcagcccacccuuagcaaagcaguucucccugcuuugucgcucacugugugugaacuuccugaaccuuaauuuaguugccugauuucuacagugagguaacauuauacucauaauguugcucggaagauaaaaugagauaaugcaggugaaucaugucacaguguuuggccaugagugguagcuggguguauguacuuagccagagcuaaguguucaguuacguuaguuggauucuuguuaaucuuugagaaaucuuguuauauuuauuuauuuauuuucgagauaauuucucacucugucacccaggcuugagugcaguggcacgaucuuggcucacuacaaccgccaccuccugggcucaagccauccucccaccucagccuccugaguagcugagacuacaggcacaugccaccauguauggcuaauuuuuguauuuuuagcagagaugggguuucaccauguugggcagguuggucucgaacuucagaccucaagugauccauccgccuuggccucccaaagggcugggauuacaggcacgacccaccgugcuggccaauuuuuuuuuuuuuugaggcagcaucucacuuugucacccaggcuggagugcaguggcacgaucuuggcucacuacaacugccaccuccugggcucaagcuauccucccaccucagccucccaaguagcugggacuacaggcacaugccaccaugugggcacagcucauuuuuguauuuuuuugugaagacggggucucacucaccauguugcccaggcugguaucuggaacuccugggcucugagauccaccagccucagccucccaaaguacuaggacugcagguaugagaaaucuuguuuuuaaaagggacaaaauagacaacuuucugagacucauauucugucuuccccuguauuguuccuugauuuccacgaugagcccaagauucugaggagcagggucugugucuuguggaugccuggugucaaaugcucugcagcugguaugugaggacuggggaggggaggagcaggagcugggcagggagagcacugccaccuuggcacaccccgccucgggacaccaucauggccccccgguauccaugcugcacaaaacaagcuaccaagagguggaguccaccaaagugaccguucugggagcucuugggauuccagcuggagagccagcaagauuguggcggcacuguggaaacauccuccccagcucuugcgcauccuccugcgggggcacuugcagauugcuguggagggaguaaggccacgccggagcagggcaggcagugggaguggggacuugccagacugcagugugauuucuuuuccaguggcagggaugggagggagguggaugacacaggcaucugguagaucagcucuggagcuuucaagcucucgugccuugcuuuacaggagcagaggcuugagaacccaguaccuuagaguugguauccuggaucuguacuggcaguuuuguggguuuuuuuuuuuuaaacuuuugcuauuaaacacauaaugucugucugguaggagacacgguauguguggaugaauucauaacuguauuugaagcgguuugaagaugagcauuguuaaguuaggccagauacaguagcucauuaccuuuaaucccagcacauugggaggcugaagugggagaaucacuugagcccaggaaguuucaccugggugacauagcaagaugccaucucuacaaaaaauuuaagaaaauaucagccgggugugguggugcacaccaucgccuguggucccagcuacucgggaggcugacgugggaggaucacuugagcucagaaguuggagguuaacagugagcuaugauggcaccacugcacuccagccuggacaacagagcaaauaaaaauaagauaaaaauuugaucuugaggggauugaggcaucuuuucuuucauacuuugauuuuacaaugauagguugaugcaaaaccagaaugagcagaauucacuguucaguucauguugguaauucuaucucaguggugcgcacagaacacggugaaggugagagaaagcuggacugcaaauuggaguuuggagcaaggcagacaccgaggucuuuuccucuuuccuuaagggauuuccuugucccaguuaccucuucaugaagggaaaacauugucucauuggcaguuuggccaugcuggggggcccacuguccucuggguguguagaggcugucuuggcgggcacagucuugcuggcagggcccaggcugcaagaugaacgcgugcagcggcuguaggcuggccugggagaacgaaguggggagagggggccaauccagccauguggccuugcagcccggcucugaucuuagauggacagcagauauuugaugugcugcguuucucuucugaagucucacuccuccuuucuuugugauuuaaacaauuucuucccucccacuuuuuguccaaauuccucaguccauacucuuugaaaucugaaguauggagaggcgauagcagggcccuccccacccaucuuccggcuuggaagggguaucaugugguucagcugggcccuuugcuggagagcagagggagggguguuccccagggaagagggcaggaaagaccagagguuaaaaauaggcagcuuguaggaacuugcccaccacucccucagguccuccugugaugugcacacuuggaguagaauggcuuuggagcagagaaggggaaaauagaucagcccucacuuaaacaucacauuagccauuggcuuuuccucuaucuuccacauaagaggaacuuuccccaaucaccuggugguuuuggauuuguguccccugguacuuuggggauguguccacaugugugugcagugccucugucugcauguguguggcgcuaagaugacucagugucgcaugugcugagacauuccggggcugcagguggguguucucacagaggcucgccugagggaucuuuugcacauacaaagaugugucccauuuauaaguuaguucccuacacuaaaugaaagaacucuccggggccgugugugugcagugaauacacaugugggucguuguuucacacaggcgguguccugguugcaggcagagugugagaaugcaagcugugcuggcugcucugauaugguccacaagguaugaggcagcuuuuguucucuuuuuguucuuuucggaaguaggggugccugcccacccccgaagccagggaaagugcagucuucucuggccuccuggucagguagagcugcuccgguuaaaacugucaagagcauccugucucuguucccugagacagccacaggggacucccaggaauacccagccaaggacuugagaugcugccugcuuugucaucuguaccugcuugccacacucuccuccacuuaauacccuguuguuacuagcgaggauuuccgguccugacuuucaaucuggauuuugaauaacuugauaaggugauugcuuucggaucccucugggccugugucugccccucccuguaagcugagagagcagcugggcccuucaguuucuauggcccuuccgccaccgagugaacaugcuccuguggggcuuggccugugugacccaccucaucccuuuugucucagucuuccugcuaaauacagccucuucucucccucaucccuucuuucucugcucucugggcagaagagaagcuuuggcuguagucuuugaugugggaggcuagacuggaaggcauucugggugggggagggaggugccugguggaauuggggcguaugggggcuguguggagaggggcccgcugccuuuacugagccccuccccucccugggcaguagggcgcguguuaccccuugcucuccacaucucagggagaagaacccagguccucaugugaauccugcuguuuuacuuggggacacccgggaaugugaaugggugaaggucuuccuggcuggugccuuuguuucggguuguuuuucuuugaggugccucuccuacucccacagggccugugcaggggugcucagagcccacagcggauguuggcagcgcgugugcagggagcuggccaaggacccugcuuucucucugggccagcgcccaaggugcccuauuaauuuagauuuucaugugcauuaguggacgagggugaaggagacgcaggcccucggcuggcagucguuuuacaccaccaccggcuaggcugaaauggggaaagaaauauggggauugggggcuuccuuauggagaaagguaaaggcugaaauggugugugagagaggacuugaggcuuuuuuccugggggucagggagaguuggaguugacagcacucagcccuaauagguauagacugaguccagccugagguauuagacccuauauuuauuggcuugaucuuaauuuuacaccuggucauacuguugaaaaaaaaaaaaaaaaaggucccccagugccugagugcgaacuucauauuuaguggcauuugauaguauauuuauuauuucuaguaaguuugaugaucucagaggugugcagugauguuccuggaagugaauaguacagcgguccccaggaacuguggggagaacccugcuccgccucagccucuucucccaucugcugccguggccugcuccacccucagauagcuguuggaggacccagcagccugugcuucucuuaacauguccaguuguacccuauuuucaguuaaaaaugcgguuucucccaccugcuuuccccuggagcggcacgugaaaggguguagugcccuucucuugacaccugccuguccccacaguccuaucgucagugggugcgugugcucacugcugccuggcacugcuggguucucaggaggccugcacaccgaaacuuugcauggaauguugcccuugugccauuagcaaagcggaggcugggucggcucugcucucccugccuccgacuucauuguucgggacuuaauguaauaauaugcuugaacaggcgggagaucacauuagcuuggcucugcaguuguaaacaauauuugcucugugagcauucuccuucacccccugcucuccuggaacccugcgcccucuccuacugccacccccucucuccuugcauauucuaaccuuggcuaaacagcuucauucaugagauggccaguguuuucugggaggaaaguggcugaaaauaaugaagucccgagaaccucuagcuaugacgcacaaguaaacacugguuaguuaguuucuggauagagguuuuaacugauguccaugucaaccaaagucuuuuucucucucuccacuggaguggaacccuguuugaaaacacacacacacaugcacucagguaccaaaaacagcuuuccuaaggcccugacucuguccuuggcggggagcacugggcagaugggacagaggcuuccacugucaguguuggcaggggugggagguggagaggggcaggagugcaggugcaucccuggggugccuguuuuuuuccauagaaagguuuuuguccucugcuucucacucucuucuauaguuugauguagaaaaagguaaaagaaaaacuccaucucucaccugcacugccuuuuccaauuuaacaauugcagugguugguuucacagacaaaaccugcuccaccuucucugugcugauugguggcugaugaugucauggcauaaagcucaaacugauuguuuucucuaugggacaggucccaaaacagcagacagcaaagcuauuauugcucuuuuguuuccuccaguuuacgcuaucaaaca

SEQ ID NO: 14873 - RNA, 3868 nt, Homo sapiens
cccaaaucuacucaccugaaguacagugcuuuugguguucaugauuugguucaauuugccuaacguuaguuuuguuuuuuuuuuuuuuuuugagacggagucucacucugucacccaggcuggagugcaguggcaccaucugggcucacugcaagcuccaccucucagguucacgccauucuccugccucagccucccaaguagcugggacuacaggcgcccgccgccacgcccagcuaauuuuuuguauguuuaguagagaugggguuucaccguguuagccaggauggucucgaucuccugaccucgugauccgcccgccuuggccucccaaagugcugggauuacaggcgugagccacugugcccggacuuuuuuuuuuuuuuuuuuuuugugaaacggagugucgcucugucaccaaggcuggagugcaguggcgcgaucuaggcucacugcaagcuccaccuccuggguucacgccauucuccugccucagccucccgaguaacugggacuacaggcgccugcuaccacacccggcuaauuuuuuguauuuuuaguagagacgggguuucaccguguuagccaggauggucuugaucuccuaaccuugugaucugcccgucucggcugggauuacaggcaggagccaccgcgccuggccuccaaccuaaaguuaguuuuaauggauauuuuacacuucuuuguacagcaugauuuuguggccauuuuaauuuuagaguuaaccaaauuauuccaguugccagaggaguaugaugccucucucuaacaaaaagcuguguucucccaauuuauuuugaaaacuuaaaauaucuauccugcacaucuuaaucaauuuggaguaauaagauacuuuuauaguuguucuaugauugcuauuuuccauugccauuaaccaggaguaagcaaaaaccagcaagccguguggcuggugguaaccaagugcccgcagucuggaaaaugccaggcucagagagucaguggggagauacaaaauagcgaggguagacccuggggccccaggaccaggaaugcugaaugguagaagucaccccucugagcuggaccggcaggcaagcagccuggcugugcacaugaacagcucagccacuccacccauggucuuuugucagauucugccaucauaacagcuaccacauucacauuaacuacugcccuguagucaggauuucuuuuuuuauuuuuuauuguauuuuuccccugagauggagucuugcucuguugcccgggcuggagugcaguggugcaaucuuggcucacugcaaacuuugccucccggguucaagugauucuccugccuuagccucccagguagcugggauuacaggcaugcaccaccacgccuggcuaauuuuuguauuuuuaguagagaugggguuucaccauguuggccaggcuggucucgaacuccugaccucaggugauccaccugccucagccucucaaagcauugggauuacaggcgugagccaccaagccuggccccuagucaugcuuucaaucauucagagguuuuacugguaccuauugugugucaggguuugucucaguugcuggaggugaagagaugagcaugccucaguuuucuuggcgggaguuacaagugugaggcaccagcugcgugcuggccucauagcugcccugcaugggucugaggcuuugaccuggcuguucugcugagugaggaguguagcauuccuuuucacugcuauccuucuagcuacauauauaauuuccccccaagacuaugccuauuuuuuaugugacaguucuaaucauccuggcaaaaccagucaaggucuuccaaaaaaugaaauucuuuuuucuuuuucaaauggaaacaaacaaccagcuaguaggagaaugaauggggaaaaaagagaaugaaugagagacauggugggugauggggaaauuaacaaagcggaaauguccccucauucucucuccuuaaagcagaagcucuggaguuauguccugaaggaucauuaugguagcauuagcauaagcuaagaaaaguauguucccuggagaggaugcugcuaaacuucaucuucuugcauucucuccaacaguacuuguccccacuugacucaggucaagagauguuagcacuuagaggagaacagguuggcccaggcacaagguuuauggcagucggcucaguucuagcaauguaugugauguggccaaauucauauacauugccuuucccuuccccacuuugccccucucccaguaucaccuccaccuccaagaugccaccugugccuaagaggaaugacggcugcuguggguccaguggcugccuggcuacccauguugccacacagcuggcugccauucccacaccagccccucaggaggaugugcauuuuaaagcuauggauuuaagagacuggcgauuaaaaugugguggucucagugggagagguggcugaggacaucacuauaguucucauaaguaaugucacgguuugccacauuagacuugucccaguuucccaugguuccugggguuggcuuugguuugggacguguguugggaagaagagagauuuccaggauagcagcaccacuguaagacgggucugggcugagccugggagaccugccaugcugccagaacuuggcaagaccuucaacaaccuucuuggauuggagacccugcuuuucuucuaagaagccccaauucccaaaaaccuagagccugguuaacgccaacaccaucccggggccuuucggcucucuuuauuuauugcucuggaauaucccugugaccucuuccaacaguuuucacucuuggcagggaaacuuccuuaaauuuacucgcaacacaacuaagaggaacuucagaugaccacuugggagagaguacacuuuugaacagcuuugaaucuagaaugcguuucccuguuacacauacacauguaccagacaccucccacccgcuccuaaugucgcucgugacucucauuugccuacuugcugagcccccuauaccagcccuguccuccuucucuagccuuugauugcccagcccuuccccaucuacuuuuuuuuuuguuuugcuuuuaagagacagggucuugcugugucccugccacuggagugcaguggaaccacuguagcucacugcagccuugaccucaugggcucaagugauccuuccaccucagccucccugaguagcugggacuaguaggcauagccaccgggccuggcuaauuuuuuuuuuuuuuuugguagagauggguuuuugcucuguugcccugccugcuuccacuuucucuucagcuucucccuugccaccugcuggcuuccccagucccaucccgccuguugcaucccauagccccacucccacgccccugaccaugacuugaagccaugccaagugaccaagaugucccauccugaguuauccucuggcugacuuguaucuucuucuguggcuccuccucuuucugugucccucaggugggcaucaacuaccagcccccgaccgugguccccgggggagaccuggccaaggugcagcgggccgucugcaugcucagcaacaccacggccauugcggaggccugggcccgccucgaccacaaguucgaccucauguacgccaagcgggccuuugugcauugguaugugggagaggggauggaagaaggagaauuuucugaggccagggaagacuuagcugcccuggagaaggauuaugaagaaguggggacugauucguuugaagaagaaaaugaaggggaggaauuuuaaauauauaccuuccccuuggcugugucucuuuauuuaugcugugccauucaaa

SEQ ID NO: 14874 - RNA, 3868 nt, Homo sapiens
uuugaauggcacagcauaaauaaagagacacagccaaggggaagguauauauuuaaaauuccuccccuucauuuucuucuucaaacgaaucaguccccacuucuucauaauccuucuccagggcagcuaagucuucccuggccucagaaaauucuccuucuuccauccccucucccacauaccaaugcacaaaggcccgcuuggcguacaugaggucgaacuuguggucgaggcgggcccaggccuccgcaauggccgugguguugcugagcaugcagacggcccgcugcaccuuggccaggucucccccggggaccacggucgggggcugguaguugaugcccaccugagggacacagaaagaggaggagccacagaagaagauacaagucagccagaggauaacucaggaugggacaucuuggucacuuggcauggcuucaagucauggucaggggcgugggaguggggcuaugggaugcaacaggcgggaugggacuggggaagccagcagguggcaagggagaagcugaagagaaaguggaagcaggcagggcaacagagcaaaaacccaucucuaccaaaaaaaaaaaaaaaauuagccaggcccgguggcuaugccuacuagucccagcuacucagggaggcugagguggaaggaucacuugagcccaugaggucaaggcugcagugagcuacagugguuccacugcacuccaguggcagggacacagcaagacccugucucuuaaaagcaaaacaaaaaaaaaaguagauggggaagggcugggcaaucaaaggcuagagaaggaggacagggcugguauagggggcucagcaaguaggcaaaugagagucacgagcgacauuaggagcgggugggaggugucugguacauguguauguguaacagggaaacgcauucuagauucaaagcuguucaaaaguguacucucucccaaguggucaucugaaguuccucuuaguuguguugcgaguaaauuuaaggaaguuucccugccaagagugaaaacuguuggaagaggucacagggauauuccagagcaauaaauaaagagagccgaaaggccccgggaugguguuggcguuaaccaggcucuagguuuuugggaauuggggcuucuuagaagaaaagcagggucuccaauccaagaagguuguugaaggucuugccaaguucuggcagcauggcaggucucccaggcucagcccagacccgucuuacaguggugcugcuauccuggaaaucucucuucuucccaacacacgucccaaaccaaagccaaccccaggaaccaugggaaacugggacaagucuaauguggcaaaccgugacauuacuuaugagaacuauagugauguccucagccaccucucccacugagaccaccacauuuuaaucgccagucucuuaaauccauagcuuuaaaaugcacauccuccugaggggcuggugugggaauggcagccagcuguguggcaacauggguagccaggcagccacuggacccacagcagccgucauuccucuuaggcacagguggcaucuuggagguggaggugauacugggagaggggcaaaguggggaagggaaaggcaauguauaugaauuuggccacaucacauacauugcuagaacugagccgacugccauaaaccuugugccugggccaaccuguucuccucuaagugcuaacaucucuugaccugagucaaguggggacaaguacuguuggagagaaugcaagaagaugaaguuuagcagcauccucuccagggaacauacuuuucuuagcuuaugcuaaugcuaccauaaugauccuucaggacauaacuccagagcuucugcuuuaaggagagagaaugaggggacauuuccgcuuuguuaauuuccccaucacccaccaugucucucauucauucucuuuuuuccccauucauucuccuacuagcugguuguuuguuuccauuugaaaaagaaaaaagaauuucauuuuuuggaagaccuugacugguuuugccaggaugauuagaacugucacauaaaaaauaggcauagucuuggggggaaauuauauauguagcuagaaggauagcagugaaaaggaaugcuacacuccucacucagcagaacagccaggucaaagccucagacccaugcagggcagcuaugaggccagcacgcagcuggugccucacacuuguaacucccgccaagaaaacugaggcaugcucaucucuucaccuccagcaacugagacaaacccugacacacaauagguaccaguaaaaccucugaaugauugaaagcaugacuaggggccaggcuugguggcucacgccuguaaucccaaugcuuugagaggcugaggcagguggaucaccugaggucaggaguucgagaccagccuggccaacauggugaaaccccaucucuacuaaaaauacaaaaauuagccaggcgugguggugcaugccuguaaucccagcuaccugggaggcuaaggcaggagaaucacuugaacccgggaggcaaaguuugcagugagccaagauugcaccacugcacuccagcccgggcaacagagcaagacuccaucucaggggaaaaauacaauaaaaaauaaaaaaagaaauccugacuacagggcaguaguuaaugugaaugugguagcuguuaugauggcagaaucugacaaaagaccauggguggaguggcugagcuguucaugugcacagccaggcugcuugccugccgguccagcucagaggggugacuucuaccauucagcauuccugguccuggggccccagggucuacccucgcuauuuuguaucuccccacugacucucugagccuggcauuuuccagacugcgggcacuugguuaccaccagccacacggcuugcugguuuuugcuuacuccugguuaauggcaauggaaaauagcaaucauagaacaacuauaaaaguaucuuauuacuccaaauugauuaagaugugcaggauagauauuuuaaguuuucaaaauaaauugggagaacacagcuuuuuguuagagagaggcaucauacuccucuggcaacuggaauaauuugguuaacucuaaaauuaaaauggccacaaaaucaugcuguacaaagaaguguaaaauauccauuaaaacuaacuuuagguuggaggccaggcgcgguggcuccugccuguaaucccagccgagacgggcagaucacaagguuaggagaucaagaccauccuggcuaacacggugaaaccccgucucuacuaaaaauacaaaaaauuagccgggugugguagcaggcgccuguagucccaguuacucgggaggcugaggcaggagaauggcgugaacccaggagguggagcuugcagugagccuagaucgcgccacugcacuccagccuuggugacagagcgacacuccguuucacaaaaaaaaaaaaaaaaaaaaaguccgggcacaguggcucacgccuguaaucccagcacuuugggaggccaaggcgggcggaucacgaggucaggagaucgagaccauccuggcuaacacggugaaaccccaucucuacuaaacauacaaaaaauuagcugggcguggcggcgggcgccuguagucccagcuacuugggaggcugaggcaggagaauggcgugaaccugagagguggagcuugcagugagcccagauggugccacugcacuccagccugggugacagagugagacuccgucucaaaaaaaaaaaaaaaaacaaaacuaacguuaggcaaauugaaccaaaucaugaacaccaaaagcacuguacuucaggugaguagauuuggg

SEQ ID NO: 14875 - RNA, 49038 nt, Homo sapiens
uacaaagcaacugaauagcuacaugaauagauggaugaauaaaugcauggguggauggauggauuaaugaaaucauuuauaugacuuaaaguuugcagaggaguaucauauuuggaaggcaguaaggaagucuguguagucgaugguaaaggcaauugggaaguuuguuaggcacaauaggucaaaauuuguuuuugaaguccuguuacuucacguuucuuuguuucacuuucuuaaaacaggaaacucuuuucuaugaucauucuuccagggccuggcucuucaucugcaacccaguaauaucccuaaugucaaaaagcuacugguuuaauucgugccauuuucaaagaggacuacugaauucugauguggcuucaaacauuuagguuaggcauaucuaauggagaacuugcagccacacugacuuguagugaaauaucuauuuugagccugcccaguguugcuuaaauuguaguuuuccuugccagcuauucauacaagagaugugagaagcaccauaaaaggcguugugaggaguugugggggagugagggagagaagagguugaaaagcuuauuagcugcuguacgguaaaagugagcucuuacgggaaugggaauguaguuuuagcccuccagggauucuauuuagcccgccaggaauuaaccuugacuauaaauaggccaucaaugaccuuuccagagaauguucagagaccucaacuuuguuuagagaucuuguguggguggaacuuccuguuugcacacagagcagcauaaagcccaguugcuuugggaaguguuugggaccagauggauuguagggaguaggguacaauacagucuguucuccuccagcuccuucuuucugcaacauggggaagaacaaacuccuucauccaagucugguucuucuccucuugguccuccugcccacagacgccucagucucuggaaaaccgugaguuccacacagagagcgugaagcaugaaccuagaguccuucauuuauugcagauuuuucuuuauaucauuccuuuuucuuuccuaugauacugucaucuucuuaucucuaagauuccuuccagauuuuacaaaucuaguuuacucauuacuugcuuacuuuuaaucauucuuccccaacucucugaagcucuaauaugcaaagccuuccuaaggggugucagaaauuuuuagcuuuuuaaaagaauaaauuuuagauauucacauucauauugaucuacuugagaccaugcuauuuaucuuuucuuauuuccucuuucucaaggguccauuuucuauuuuauaaaaauaaagacaauucucucccacaaccaaacauggaacaaugcccuggaguauaaaaaucuauagagugccaaauaaaggaacaauuugaaauacugguguugauauugaaaaagcaagggacucuaaugucagaagagaaauccuuuugcagaugagguggugaugaauucuuuguuucaacacaacugaaggaggaacugaaggaaauaccagcugaugagugaugagaagggauucuugauaauagaguacuaggugauuuuuggcauguaaugcagaaguugcaagaagugguaacaaugaugcaauuguuuuaccugccauuuauuuacuuuuaugugagccauucuucuuagcacuuauagcuacacaaaacaaaaauaguaacagaauuaauguuguuuaauucuugcaauccauggaugcauaaauucacugggggaaaaaacagcucaucauucucauuaaagaugugcuucaaaaguauuuuaauuuuauaucuaauauguaugaaucauacuuuguauuuauuuuguuuugaucaguuauauacaaguauuuuugaacauagcucagucagaaggaaauguuuaauauuuauaaauuuaugguuacauucuauuuaaaagaggaguuaaaguuaaauuuaccuacccacauauguuacauauauauguauuuauguauauguauucauauauguauauaugugaacauaaguauacauacguauauguauagaugcuugacaauaaagaaguaagaauaauucacaacauuuuuugaaauauaaaaauuuaggauaaauuucuguaugguaauuggcauggaaauucaaauucaaaaaggaaaaaagaagagaaagauauuaaauaucagaccauuaaaagaauuuuuuaauguacuuuuaaauagugauaguagguaucuuauacuacaguguuuauuauucaugagaaaauuguaaaaguaaucuaaguauuaauuuaaaauaucaucaaaaauaauaucuuuugcuauuacuuaaaaucaugauaaaaauauguuuacuugaaaauauguaaggagugcacagaguccaaaaauuauuuuaggaguucugugagcaaaaauguauaaaaacuacaggguugaucuuaaauuacaugucaggguacugagaaaguuucuguacugcacaugaguuaccaaggucuaaagucaaucaccagaggaccauuuuuggauggagccauugucuaaucaugagcugaaaggcaaauauuuaaaaugcaaacauccaugguuagguaacacucuuaagaccuuauuagcugcuuaccacaacugagacugugaaguaauggcucacuuucuuugaggcucagauuccauaucuguggaguggaagcgagugcuuaccauacaauuuucacagggcugcugaauguguguauguauguauguguguauauauauuuuaaugaaaauucuauaauuugauuaguuuuuguaauguccgcaugacugagagcuugcuuacuuuuuacagcaacuugaagguaaaaauagauuuuacaacaugaacaaauguaacuacauauuuuuauuugaauucagauguucacaaauuguuccuuaaagugaagcaugccuacaaguuuuaaucuguuuaagaccuaccucaaguaaaauguucacugccauggcaugugagggaaaagggaaauaauucuuaugcauggccuucaacggccaaauuucaugcucaucaguacaucuucucuugguguagaacugaugaugauaauuaugaugauggaaaaaagugcuguugauagcaaugccucucuuccuucacuuuccucuaacugaaccgucucauucccaggcaguauaugguucugguccccucccugcuccacacugagaccacugagaagggcuguguccuucugagcuaccugaaugagacagugacuguaagugcuuccuuggagucugucaggggaaacaggagccucuucacugaccuggaggcggagaaugacguacuccacugugucgccuucgcugugaguguggcuguuugacuuaauauacuugguucuuuuagucagggucauagggaucuaguauucugucagaugaggcuuugggagguugguaagaacugcaggaaggaauccaaauguagcaaacuaaguauagaaauuaaggagcaaugcaugacucuccagccaugggagacaaauauuuacaggcaaacuaaaagucagcuuaauaaucacauagaaacccuauuagccagaaaggaaaaaaaaaaaaagaaaaugugacuucuuaaaauuaagauggaaaaaauauuaauaaagcaaacuagaccaaggcucaacaugagccacccgugguggacugacaggaacacaucacuccacacuacuucuaagaguaaaaauuguagaaauuacccugagcaaagguguaauaucucuucagaguuguccacaugugagaugcuuacagccuagugucaguaaaauacgggguuuuuuuccauagccuguaaaacaugcuucgaccaugcccuuuuagcauguaauaucagccugguaaagcucagcguauaauugaaucaagacuguuucugugagcuguaugaaggugugaaucucacuuacaaccucucuuacugauuuauuuuccuccaccuuguguccugucuccccauuuguaaaauggcagaagugauuccuguccaugccaacuuucccugcugagaacaagggagugaaguuaaguaagaagggcaagaucuccagggaagagugcaacagcaaauaggggaggagaccugcgggugcugaaugggguuucaggaucgguccuguauuucaggucccaaagucuucauccaaugaggagguaauguuccucacuguccaagugaaaggaccaacccaagaauuuaagaagcggaccacagugaugguuaagaacgaggacagucuggucuuuguccagacagacaaaucaaucuacaaaccagggcagacagguaugaagaagccuacagacaggacaacuucaaaaaggaaagaucuucuuccccuggauguuccccaggcaaaguuccuauaaucuugguuccuuaauagcuugucuuaccagccuacaggccuacuuuggguuugggggcucaugaaaaauauuucuguuucagugaaauuucguguugucuccauggaugaaaacuuucacccccugaaugaguuggugaguuuucuauuaucuacauaaaaugauugucuguauaaacaggcugggaaccuguuuuuugugcugagggaagaccagggagaggaagaaucugguaucauuaacaguaacuucuggcauuacaacagcacaagauccuaaucuaaaacaucauuccagguaaagaaaguagguaauucuuucugucuuggugcugguacucagucaguugucacacaauuaaauuuacuuuucggaugguucuuaauuaggacaauuagaaagauacauucaauagcagacacagaaaaauccucaaagaaccuaagcucaaaaaacauuuuaaagauuuagauuuuuucuauacacaucuaccaaaaucuucacuauaaaggaaagucaggguaauuaauuuguuccucaagacuaacucuugguaucugugauaagaaacaguucuuucuauuguaaugcagacaucaacccaaagucuucauuuuucucucccaaauuaacuucuucacauuuucuuaucucaaaaagaggcaacucuucucuucuagcuccaaagacaaaagauuauggccuaguucuuguuucucuuucucucauacccacauccacuucacuggaaaaucauguuggcuuaaaauauauucagacuauuucuuaucaucugaacuacugcugcaagcuaguccuagucaaugucaucucuaaauaagaucauuacaauaaccuucaaaguggucucccagcuucuacuuucacuccucugucuaaaaugaggcaccacacccaucacucugucagccuaacuuggcuuuguuuuucuauuugcacuuaccaccauucuauacguauugauuuuuaaaaaucugccuauuucuauuauaacauaagcuccauuaaaacaugguuuauuguucuuuugugcgugguuauauucucaauaccuagaaugauacacagcgcaugagaagguacuuaauaaagauuaguuuuuaaaaaugaauaaacauucauaguagcuucuuaucaauguuuauucauuuuuaaaaguaauauuuauuaaacuaaauuuauuaaugaaauauguccauuccuccucauucuuagaacuacguaagaauucuaugacccaucuuaaugauuacaucugaacauauuuacuuauaguuacauaaguguuuauuucucaaccuguaaaauugcauagcaaaggauugaucuucacuaggaugcuauaagcacuuaagacauguuaauccauuuuuaguaaauggcacuuuacauguauauuuguugcugaaggccuaguaaguucuuaacauuauuuauuaauugcuuaaaauagauuaaugaaaaguucuauaaaauuuaaucuggaauauuucuguauuucacuauagagggaauuauucuauaugaaacuaauuuagauuuuuuaaacuuuuuauuguuuuuaauuuuuguggaaacauagcagguauauauauuuauggguuacaugagauauuuugauacaggcaugcagugcaugauaaugauuauggaugauaaucauuaucauuauccauaucauuauccaaucauggauaaugauuauuaucaugcauugcaugccuguaucaauaaauggaguacccauccccucaaacauuuauucuuuguguuacgaacaaauccaauuauacuuuuaguuauuuuuaaauguacaauuaaauuauuuuuuacuauacucacccuguuaugcuagcaaauacuagcugcuuugcuuauaaaugagauuuaagaauauuugaaaauaauuauaaacuucuuuuuucuuuugucuuucagauuccacuaguauacauucagguaagcaacaugaaacauuccauauuaaaaggaaagcaauacauauagggaaaauguucuuauuucagagguuuuuacaauaucucagaaacuugucauuaaaggagaagccuucaaacucccauagagcuagauggcuauaacucaucuccucuacucacccuuuacuacuaccccauuugaccuuuuuguagauaacuuaggguuuccauagauaucuuuuauuagcuccaaugcuccaggugcuuuuguaaguuauaauuaauuuacucauauaggaucccaaaggaaaucgcaucgcacaauggcagaguuuccaguuagaggguggccucaagcaauuuucuuuuccccucucaucagagcccuuccagggcuccuacaagguggugguacagaagaaaucagguggaaggacagagcacccuuucaccguggaggaauuugguauggaucaugaaaagucaucaagcauuauuuuucuucauauuuaaacucuuagguccuggaauuuaaguucauuuggagucuuuccauuucccaugggugacauugggcuuggaguagaauuaauuacaccuaaguccaaugaggacaucagugaucugugaauaggacuucacauagcuucguuauuuucuguagcaauauuuaauaccaacccccaaaauuaaaacauucuuguuuuaauggaguuuuccauaauuaauuaagcacacagugaucucucauagucccucaacugaaaucuucauuugagaggaggauagauaagaauagauuggagagcagagcuaccuuuucagagcccuaaaauauuauuagggaacuguuacagggaaccugaaaauaggaauucccccaaaguugaaaaccaaucaccaaccuucuuuaucaccaaucaacaguucuucccaaguuugaaguacaaguaacagugccaaagauaaucaccaucuuggaagaagagaugaauguaucaguguguggccugugaguucauuuuuuaaaaaucuuuugugggggauuauuuaaaagagacucaccauuugggauauuuuaacuacucucuccgggagcaguggcaacacaaaaauuuuaagugcuuugacagcauccucaucuguagaauguuauucuccuguugcuuuucuauuuuuauuuucuuucacguucuuaucaguauuauucuaucaugagguaagaaacuguuucuagagagguuaugcuaauaggauugauucugaaagugacaaaacugcacacacacacacacacaaaaugggaaggguggauaguguugaaggguauugguucugccuuaaccaaaaauaaccaaacguauauuagggagauaauuaacacauggcuauaggggaaauucaaucaucaacagaucauuuaccugaccuugcaugcuuacuggaaaaaucacuuagauucagaauuuguagagauaggcauacaacugaaaucucaucuaacucacuaguccaccuaaggcgggucuacauaccugucugcacugacauuuuuacgaagagacugaacgugauuucucaagacagucuguuccaaccuugaaaagucuuguuuccuggaucuuauguucccauccaugguggcacacaguagcaguagcaggaagagcagguauaguccuguccaaagaucacacauguaauacaccuacuauucagcuaggccccugcuccaguucugucucacagugauggccaaguuccugguuccucauaacuggugugaucuugcaaauagacauacagaggacauucucaaauaggaaaggagacaaaugcacuuggaaacccagcaauugucuaugacauauuuacgacacaaucccacuuuuguaaaaaaguaaacaggcccggcgugguggcucacgccuguaaucccagcacuuugggaggcugaggugggcagaucacgaggucaggagaucaagaccauccuggcuaacauggugaaaccccgucucuacuaaaaaauacaaaaaauuagccaggcaugguggccagcgccuguagucccagcuacuugggaagcugaggcaggagaauggcaugaacccaggagguggagguugcagugagccaagaucgcaccacugcacuccagccugggcgacagagcgagacuccaucucaaaaauaaaauaaaauaaaauaaaauaaaauaaaauaaaauaaacaagugaaacucgauauagagauggcugcacauggggagaggaugauggaagaagagacacuaucguacuaauaguuuguauuccuagguagacuugagggcguuuggguuuuuuuuguucuguuuuguuuuguuuguuucgucuugcugguauuguuucucuuuuaagaacggguuuaaguuuuauaauaagaaagacuuuuuuaagauaaaacuaaaaaaaaacgaggaaaaaaaagaaaugauaaaagaagaauguaaauuucagcauguugcaauggagauuucuauaagagccauuagugacucuugucuucaauauugugugagcccagcagagagcagagggaaguacagacagggaauauacuguagcuaaaggggagauauaaauagcuagaaaauggggagguucagugucugcucugauuccuuugggaauguucucaugacagauacacauaugggaagccugucccuggacaugugacugugagcauuugcagaaaguauagugacgcuuccgacugccacggugaagauucacaggcuuucugugagaaauucaguggacagguagguugaacacuauuuuuucuagagaauagcgauaaaggcauuguugaaaagcagugaguugcagcauuuuucugacgcaggaagagaacaaucuagaagagaauuccauguuggcuauuguaauuuuucaaaaaaaaucaugaacuuagcacaaugggaauuauuuauuucucguaauugcccauugugaguguuucagaacgauagacacugagccaucuaaagccuccaugggcauucacuucuacaaaggaaggaaaaaaccauacaccucuuaauugccuuagcuggccaggccaucaguucugcucucucugugaacaagaaccuaucacauggccccaccaagaugccagagaguugacaaacacaguccccauauagaaggccgcuucccagccacagcugaauauuauggaggaggaaccagacuuugaugaggaguucuaauggucaagagcagauguacuguguauuucaaaauagcaaguggacaggacuugaacuauuuccaacacauagaaaugauacauacuugaguugguaggcacccuaaaucccgcgaugugaucauuacacauucucugcauguaacaaaauaucucguguaccccauaaauauguauaaauauuaugcauccuuuguacaaaaaaaauuacuccucaaauuuuaagacauuucuaucgcaauauaucuagggaauuucagauaccaaggaauacaucugucaauuauacaugagauauuguugugaaauuuaauauuuaguugcuagagaauauuuauuguguccucgucauagaaaaugccuacaugauguuguccccccacaaaaaucacaccgguuaucugaccacugaucuauuuaguauaauaugcauuauauuuuuguauuuuauuuucucccuucuuagcuaaacagccauggcugcuucuaucagcaaguaaaaaccaaggucuuccagcugaagaggaaggaguaugaaaugaaacuucacacugaggcccagauccaagaagaaggaacagguuuguguacuacauggguauaagagaaaacacaacaggcauugauuuucuuagccaaauaaugaauuguaaguuggggggaggugauagaauuuuagagacaucauucuucccaaaaauaacagauuuuuuucucuuuuuucagugguggaauugacuggaaggcaguccagugaaaucacaagaaccauaaccaaacucucauuugugaaaguggacucacacuuucgacagggaauucccuucuuugggcagguggaguauuuuccaguucacucaucaacccauguacuguuaccuaauuagcacaauaguuaugguuugugcuaaaaccaugccugguuaauguuaucauuuaauauaaccaaaaguauaaaauaucaccaaggcuugauuaguauaaccaaagguauaaaacuacauaaaaauagauuuauucuucuguaaauuuguguaugaaauguauguaauuauccuaaggccuuauuaaaauuaguagaguuuuccccccuucuuuugaaacagcauuguacaagucacucaaucuccuucucaugguuuaccaggcagucucagguuuuuaugacauuuucucacaagaaucucaaaauucaugcugaccaguuucauuacgaugcuaacacuaacuuuguauggaaacagguggguaggugguuuuaauuuuuauuuugaaguauuaaagauucuacaauaauguuuauuucauggauaguauauuuacacuauuuuucuauaacaaguauauuucuaaaacagugaacaugggguaaaacacugcuauuuaagguucucagauuuuugaauuaugaauuuucauguuaucuaccaaaaaaaucuucucuuacaauuuuucuguugucagcagaugugcaaauggaucuuuaugacucuagaagucugagaucacaguuacaugugccucaauguguauuuacuguguaucauuuucuuaauguaaauguuacaggauuucagcuaugaaggguguaaaagaggcauagacucaacaaaguggaguacauucuagaaggcuugguuaugucaugacaccaaaauguauucaacuuccuaaaaugaaaguguagcucauuuguaaauuucucagaaagauaguguacuuuguaaguacauuuuauugcuguuaaauauccuauuugucauaagacucucuagcuagaagaaaaucagaauuaugugccuauucuugucuuuguacaugcagccaacauuucacuggcaaacuuagauuuuguaaaucaauuaugaguacugaugggggucagccuauuguucuuccugcuaccaacuguagcuuauacugaaaaagaauugccaccuuuacaaucugaacuggacuacucaacugccaauacaauauuagcaguaaauuagauuuggcaacuuauuuaauacugugugccucuuuucaauuuuauauuuuucacaugggaagugugucauaaaaucugccuaccuuccaaaaggcugaagaucuagguugagaagcagagaccaugucuaaggcaacuggagaaacacacaggacaauguauuggcaauuguuuacuugugcacuuaugagacuucagacacuaaucuauaggaaguuaaugguccacuccaaaauagguguuuggggcacaaauaaauuuaguuaauagauuaauagauuaaaauauuucauuaucauauuacucuagugcucugugacucucuaagaguuauauauaauaauacacagcacuuccaaaauaucuagaagacauuuuucaggucacucuuguuauuaucccuaucacucucuaucccuucacacugcucuguuuuucuucuuaggauugauuacuacuaaauuaguguauguuauguauauauuuauuuagcaucuaucucuuucacuagacaguaagcucugugauggaagaaacuucguuuuuuuucacugcuguguccucagugccuggaaccauguucaacauagaggaggcacuaaaaaaugugauaaaugaauauguuuggugccuauuaguuauuaccaauauaacuaauccacagcuuuuaaucuucaggugcgccuaguagaugggaaaggcgucccuauaccaaauaaagucauauucaucagaggaaaugaagcaaacuauuacuccaaugcuaccacggaugagcauggccuuguacaguucucuaucaacaccaccaauguuauggguaccucucuuacuguuaggguaaguuuggaaagaaauuaccaaugacaugaaguagccuuggaaacaagguugcaaccuaagggugagaaaauuuccaaacugugucuaguucuauggagagaaaaaaacuagcaauuagaaaccgauugaagguuaacuuuuuuaaaguuuaugaaaagaaggcaguauauugugauuaaaagugcggguuagacuuuagcaguguugcugggaacguaaaauggcggagccacuaugaaaaacaguauaguaguuccugaaaaaauuaaaaaauagaauuaccaaaugauccaguaauccuacuucuggacauauauucaaaagaaucgaaaacggggucucaaagagcuauuugcacacccguguucauagccgcacuauucacaauagcugagagaucgaggcuacccaaauguccaucaagggaugaacagguaaacaaaaugugguauauaaauacaacagaauauuaugcagccugagaagggaagaaaauccugucacaugcuacagcaugaaugauccuugaggacguuaugguaagugaaauaagcuagucacaaaaagaccaauacuguaugauucacguacaugggguuucuaaaguagucaaagucauagaaacagaaaacaggauggugguugccaagggcuagggaaagagagaaauggggaauuccucuuauugguauucagguuuaguuuuacaagaugaaaaguucuggagaucuguugcacaacagauauacuuaauacuaccaaacuguacacuaaagaauaaugaagaugguaauuuuauguuguguguguguguguguuuauaauaacuuuuuugaaaagugugaauuccagaaucugaaucagauaaagugguuaaaaauacuggcucaacccuauuuuaaggaauuaacuaaaaccucugugcuucauuuccuuaucuguaaaaugauugcaauacuaacaccugacucuuggggugguugugaagauuaagugaaaucauacauguugaaucacuuaguaagcccccuuuaacuguuagauacuuuuacuauaaaagccaauucuaacauaauuagcauuuaguuuuaaauauauauacuccaaaaauuauuaccuuacuuuauuuugucuugcuauucuaauuuucuccagaugaccuguucauaccaauauaaguuauucgguauagcaugcaguccucuauucaucaagagagauguagacaugucuauagauacauggauauacaauacauauuuaauauauauuacauaaucaugguaauggaaaacgccugccucuuuagaguuuuaccuuguuauagagaaauaaauaauacauuuuauuuauuuagcuuuaauagauggcauaaaagcaccucccucuaauuugaauguuuacucauuucaaaaagugucuugaaugcuuuccacgugccagcacugugcuagucuugacaaugaaauuauuauuucuaccuguucccuguuuggggugaucauauauguguugucaccaaaauauacauuaagauaugaacaaaauguuuugcucaaggauucacuagugcuauugggagcuggggaugaagguagaggaagccugaaaggagcuaaggaauaacuucuacaggaagaaaaguuggaaauauaacccaaauagggccucugagguauuagaauccagauugcagggagcauuaaaaauagucagccuaggccaggcacgguagcucacgccuguaaucccagcacuuugggaggcugagguggguggauugcgugaggccaggagaucgagacgagccuaggcaacguggugaaacccugucucuacaaaauauacaaaaaauuagcugggugggguggcaugcaccuguaguccuagcaacucaggaggcugacugggaggaucacuugagccccagaggcagagauugcacugagccaagauugugccacuguacuccagcaugggcgccagagcaaaacccugucucaaaaaaauaauaauaauagcaaucagccuaagauagcccagaagagguagacuucagcuaauucaucagcucagcucuuaaaccaaugcuuucuaccaaugucuucucagaccccuaagguuacaauauuuuauuuauucauaauacccauucaaaauccacccuaaaagaggcagcugcuuucugaaagcacaguucuuccauuucuagagauuauuuacucuccucaaugaaguuucauagcuccagugucucuaauugcacagguaaagcagucaaagaaauuucaagcaagcuaaucagagcaaaggaugccuccuuuuaugcucuuaagaaauauaaaucucaaucccaggaggcucugcaguguaaagucacaaagcaugccuacauuugaagcagagaaacaaaaucagggguccuucucccacuuuucauuguggaacaaaagauuucuagcuacuaguuaagguaggacaguaaacuuacguaguuuugugagaacauuaaucuuuaugacguauaaucuaaaaauaauauaauuuuucuaauucauuaggucaauuacaaggaucguagucccuguuacggcuaccagugggugucagaagaacacgaagaggcacaucacacugcuuaucuuguguucuccccaagcaagagcuuuguccaccuugagcccaugucucaugaacuacccuguggccauacucagacaguccaggcacauuauauucugaauggaggcacccugcuggggcugaagaagcucuccuucuauuaucuggugagaagggagguuacugcguugacuucacuguagacaaaagcucucuguggagcaaguaaucaugaagcucuuuagaugucauuacuucaacuucuuauccauguuccuuuugaaaguuugauuucucuugaggugaauuauugccggcagggacucaauaaaacaaguauauugaagugagacugaagcguguucucucuggcacauuuaauuucuuuuuauuuccuuuuuugcagauaauggcaaagggaggcauuguccgaacugggacucauggacugcuugugaagcaggaagacagugaguauuuccaucaucucugcauugcugccccauucugacccauucagccuuacaccacggaaguaucagaauacuuucccuuuuuuuccauagguuuuugggggaacaggugguguuuggucacaugaaugaauaaauucuuugguagugauuuccgagauuuuggugcacccaucacccgagcaguauacauuguacccaauuugcagucuuuuaucccucacccccuuccacccuucccccugaauccacaaaguccauuguaucauucuuaugccuuugcauccucauaacuuagcucccacuuccuaauagcuuagcugccacuuccuaauagcuuagcuccuacuucugagugagaagauaugauguuugguuuuccauuccugagcugggaauaucaggaauacuuucaaguaacgagagaccauuuccaucuaauauuaauuaaaagaaaguugagggagggaaaacaauaaugguuuuuuucucacccuuuaucaaauauguguugucuuuuuuuucagccuauuuucuuugcguuauuuaaaauauuggugugggccagcuaugauggcuuacgccuguaaucccaguacuuugggagaacgggaugggaggaucucuugaggucaggaguuugagaccagccuggucaacauagugagaccccaucucuauaaaaguaaauaaauaaauaaauaaauaaauaagaacaaagggggaaaaauaaaauacauaaaauauuguuguguauaaucuaugcuuauuccagauuuuuaaaccauaaauauucuugaaccucuucucaaaaugagaauuguguuagagaaugggguggagaaaauguacgauuucaagguauguuguauauaccaggucuugugcugagucauuuaugucauuuauauuauuauaaauaucuuuuuucccuuucaagauaguuaugauuuaugaagcauuaaauuggguacuucuaccgacugaagcggacucuugccaugagcaaauaugucauaauauaaaccuuugaagguugcuccuagucuaguagacucuaaaagauaacuugcuagaaaaguaucaguaaucuacucucucauuaguucuuguagcaacacagaagcaccauagcagacugaaggaaacuuaaugcaaccucuaaagaaucuacauaggcaucaaaaaauaacuucugaaggagcaugguguuccucuuauggagaaagaaccaaauauuggcucauagaagguuaaagagcauguagcaugaauacaauguguugaacucuuacucuuacaucucauaacuucagguucuauuucccucuucuaguaugaggccuagaucaaaugguagugaauuggaugucuucauacccuuaacuagcaucagaacauuaggugggugagcugaagcuuaaagcuggugaaaaaucaacagaguauaugauuuaugagaggagagagggcuuugauaggguuuuuuucuaaagcuagaguccuuagagguaaucauccauuuguuacaucuacuguuuauuaugucuguuacaucuacuaauggaaauagucauuaaccuaugauggcuuccucucauucucuuugugccccagugaagggccauuuuuccaucucaaucccugugaagucagacauugcuccugucgcucgguugcucaucuaugcuguuuuaccuaccggggacgugauuggggauucugcaaaauaugauguugaaaauugucuggccaacaagguguguguuuuagaucauaaaaucuucaacauguaaaacuagaaguuacuauuguuaucauuuguuuuacacaugugaacauuagggccaaaaggguuaaacaaauuccccagagacauucagcaagguaguggcagagucacacuaagaagcagaaucacuugauuccuuauacaaaacucucaaacuucuccuagcagugccucuuaccaauuacacaguucagaguauguuauucccuucuucuaugaugaaacguugggaaauauguaagcaaguuuuuaagacuacuaaggagccaaaagaaaaaugcaagagcaccuagacccaugcaugucccaccacaauuaaugagcaccuugccguguaucaaagauaaaaauggcauuucaugacuaguaauuuauaagaauaauuagaaauaauucuacuggcucaagugauucuugagaaugaaagagaaguguagggaacaaaaagcuucaggauugacacaaugccaacccuccacgaagucaagcagagugguuauacauuguacaugaggaacacucugcaaaugcgagugaaugcauggguaaaccuggaaauuugcuuuucugaccuuuuguuccaauuucacagguggauuugagcuucagcccaucacaaagucucccagccucacacgcccaccugcgagucacagcggcuccucaguccgucugcgcccuccgugcuguggaccaaagcgugcugcucaugaagccugaugcugagcucucggcguccucggugaguuccuggcagccucaggaaucaagaagggccgugccaggggcucagagcaaggaaaaaugacuggauaaguaggauaagaucaauuaaaauuauauuuaucuaggaauuaauugcuuugagcucucuugugggcuuucauugguaaggaauuauauauauauauauauauaacuacucacuucugcaguuaaaaaaauaaacaaaauacaauauauugaaucaaauaaaagaauuuuuaaaaggacaaaaugugaugaaaauuaacaaccaaaaaaggacucguuauucagacacguuaagcuucuugcucaagagcacauagcaauacaaauucaaaucuucugauugugucaggacauccguauaugcaaggcuggagagaauacagagcagauugugaaaagugcuauaugagaagugcaguuaugcaaaauaaaagaaaggauuaacugagcaaccggggaagccguucgaaaauuauauauuuaaaauguaaaaagaccauacaguacccaaaguccuuaaaaucccagagcuccaugcaaccaguaauaggaguugucaaacuaguuucaacauuucaaaaagccuaacaaaagugauacauauaccugcacugaggcuauacaggcuaaaugaaauaucagauuuccguuuuuauaagaauuauggcugggccugguggcucacgccuguaaucccaacacugggaggccaaggcaggcagauaacuugagaucaggaguuugagaccagucuggccaauauaaugaaaccccguaucuacuaaaaauacaaaaauuagucagacgugguggcgggcgccugucaucccagcuacucaggaggcugaggcaggagaaucacuugaacccaggaggcagagguugagugagccgagaucgugccacugcacuccagccugggcaauagagcaagacuuggugucaaaaaaaaaaaaaaaaaaagaauuacaucaguugaaauaauugcugucccaagcuacacauaauuucugagggaacauauguauuaucucugaggaacaaaacuuagggaaauugaacuacuauauaauugacauugauaacugaacucuuugaaaauauggagcuaauagaagaaauaccaaaaggauaugcugaauuggaacaacaaaaacuaguuaauagcauguacuaauaguaguuugcucacaucuucaaauuuuuaauaugagaccaauuguaauaaccucuuacugaagcuuuuucuacuaccauaauuuaacaaagagaaauuuauauuuuuauuuuccugaaauagaaacuuauaaaaaaauguuucuuacuuguuuguccuucuaaugggauuuuaacugaaaauauuagaauacuucuaaaggaagcaucaaguacauuucaacaguaggaucucaagaggauaugugggaaaauaauauacauguuuuauacuuuuauaauauaauuuuauaauucucaaagaauuuuucaaauuauaacaacccugauggguagauaaggcagacaguccuauuuauuaauaauaaagcagaagcuuucagggauuuaguaguagaccugaguuaaaacaccaacucuucucaagcuuugauuagugucuuaccaaugaaacacuuugcugcuacuaguguaggucauucauucaacacauuuauuuaaugcccacuguguucuagguauuauacuaagugcuaguagagaucaagcagugagcuacuggaaagauaaaaauguaugucucauggaacuuacauugucugucccauagaugagacagacaauaauuaugcaauaugccacaauaaaagcagggagaggaaaugagaaauguuaagauacuuugagaaagugucuaauuucaucacaccacucacuuugcucaucuguucuugucaaucaguuuuaaacuccuacgaauauaaugcaauguaacuaucacaauuuuuaugucugucuuacuucucaccuucaaauggacuugaaagcaucaugccuagaauuuuacgguuaaaguuguauguauuauaugaagaucuggagcauuuuguuuccacuaauaauaccuaagaaaaugccaucguguccuguggagagaggauauuccuauucgugugccuguuuagaacaugcacccauuaacuuugcuauauacugagucaguugcucaccacaagauaagcacaaaacuaucauuuccuucuaucaucucaaagcuuugugcaaugucacaaauacagcagaccucgauuuuucaauuaauaaaguuuuauuucauuccaguguugagucuagugguggccucugaacuguguaacgaaguaguacuuaguacuuagaugaguacuuagauggaguguuugguuuuuccuaaaauuguuaaacaucuucaaaaugaaaacacugugucaagaaaaugauccauacccucuauaaaucaucaaagcaaugagagcgcucaaagaaagacggauguucauuauuccuguucuuuucuccuugaacuuaaaaaaugucacaaaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcgguccggccugggcgacagagcgagacuccgucucaaaaaaaaaaaaaaaaaaaaaaaaaaaagucacaaauaaguuugccuuuuugucuuucguauuuguacagguuuacaaccugcuaccagaaaaggaccucacuggcuucccugggccuuugaaugaccaggacaaugaagacugcaucaaucgucauaaugucuauauuaauggaaucacauauacuccaguaucaaguacaaaugaaaaggauauguacagcuuccuagagguaaacuccuuauguugcagauggucugaucuuaagcuucuuaaaauauuacacauggaaaagagucuguauuugaaugccuucauguccuaguugaggguaaugggauauaaagagguaaguggcuucucuacuaauagcagcagaucugcgaaaagcugcugaacuaagcuggaacuuuuuggaguauuauucaaguuuucuuuuuucacaggaauuaauugcucugugauguuuauuaaaaucacauauacaaaauaauuacuguugaaagaguuuaaugaaaagaauaaaauuacauccuuaaguauauaaauaucccuucuacagaugugaauguuaaaaguuuaauuuaaguuaacuggauugcuugucaaauucaauaaaaagaaguagcuaccuauguauauuuuauaauauauauuuacugauuagaugauaauuuucuuugcaggacaugggcuuaaaggcauucaccaacucaaagauucguaaacccaaaauguguccacagcuucaacaguaugaaaugcauggaccugaaggucuacguguagguuuuuaugguaaacaaaaaauuaauaaauauauauugccuaauauauucaccaaauuuuaaauuuuuuaaaagauacaaugugacaaaaauuaacaaacaaaaaggacaugugagucauacauauuaagguuauugcucaaggucauauaguaauauaaacucaaauucuaguaaauggagguacauguguuaggcugaaaggaaagagaaaguuuccaagcguaggauuaguguaaacagaaauagaaauguucacacaacaacacuacauucuccaucagucagguaaaaaagcuguucaacuuccccaaaacaucagccaauauuuauguuggaaccacacacauucaucaaugacaugagcuacuucuuugaugaacugaauaguaaucaagcauuuauuuauagucccauauugucaaaucaugauugaggauaaguugaguacagagaaaagagggucaaaaaucaaggaaagcauuuaaggagaaucaguuggcucuauggaauucacuaugaagccuaccgcauauuuuauuauuuauaaauuauauuguauaauccuuuaucaguaagauauauaguaaauuuaugcauguauagguauauauauauauauauauauauauauauauauaugcacaauuuuuuuuuccagagagcugguugugaaauauugaccagcacacccuuaauagaaggugaauagagugaaggaaacuaacuguaaucuucugacacgauagagaauaaaaagucuuuauuauuauuaaacuuuucccuccuguaaacuguuucucaaagccacugucauaacaugugugucaguuuuuccuugcuccugcagaggagcacaccaauggaaacuuggauuccugccccucuucacggccuugugucauaacacucuccacuuagcacagcggcagcagccacauaggacuccacagaguccuugugccccacagacaauccaagccucugucugccaaagucucuauagccucugcuuaugacccuccucccccagcucacuccuagcuuauucuuguuuuuuuuuguuguuuguuuguuuguuuguuuguuugagacgaagucucacucugucgcucaggucgcccaggcuggagugcaguggcgccgucucggccucggccucucaaagugcugggauuacaggcaugagccaccgcgcccggccucuccuggcuuguuaagucaaccaacauauuuccuccucaaagaagcuuuccuugaugacccaagcgcccucuccuccuuccucucuauuucaucagacgauuuguuuuuuguuuuuuuuuuuugguggcaacuauuacauucucucauaagcuuuaucuguauguuuauuguaaugucuucuuccucacucaccauagagucagauguaaugggaagaggccaugcacgccuggugcauguugaagagccucacacggagaccguacgaaaguacuucccugagacauggaucugggauuugguggugguaaaguaaguaacuuccugcauaugcaauaugcaacaauagaggucccugacuauuuucaacucuuugcuaguuuuucuguuuuuauuguuuuauauguuuaugauguacaacaugauguuuugauauauauauauacacauacacauagugaaaugauuacuacagucaagcaaauuaacacauccauuagcucacauuguuaccuauuuuugugugcauagcaagcacaccuaaaaucuauccucuuagccaaguuucaguauccaauacaguauuaucaacugcaguccucaugcuguacuuuagauuucuaaauuuauucauccuacguaacuucaacuuuguacccuuugaccugcuucuucccaucccugcaaccccaaccaccuuucuacucucuguuccuauguauucaacuucuuuuagcauccacauacaaguaagaucacgcaguacuuguccugugucuggcuuauuucacuuagcauaaucucccccagguucauccauguugucacaaguggcaggaucuucuuccacuuaaggcugaauaauauuccauuacgcauagccacaauuuauuuauccauucacccagacacuuagguuguuuuuauaucuuggcaacugugaauaaugcuguaaugaacaccaaaacacauauaucucuacaaggugcuuauuucauuuccuuugggaguauacccagaagagggauuucugggacauaugguaguuuccauuuuaaaauuuuugagguaucuccauacuguuuuccauaauggcuguggcaauguacauuugcaccaaggggagugaacaaauuccuuccagagagacacuggaaacagaguuuuauccgugaaacaagccaguggggcagguggagagaaagagccggaauggccauauacucccuuucaggcuccuggagucuuguuuacuucucccuuucacucccagaugcaggcuguuuagaagcccaacccuuaggagacagccagaaaugggagauuuugccuguucucucuguauugagccaagggguggugggggcggguagccacuggcauugcucaaaggccuauuuaaaaccaccucuguguucacuguggucuagggagacuccugauugcagagcuccaucuacuccuggagcuaggugauuuaggagccagacccuuagguacgagcuguaaacauuggggugcuugaugcauagacaaauuauucccagggguauguucagaccugguuuuauccguggggcgagccaggggaaggaggcaugggaagugcccuuacugcuuuucagccuuccuguaagucugucguuucccugcuccuucugcuucccagugcaggcuaguuagaagcccaacacucagucagcaacugauaaaguggguagacgaagcccuuccagggagaaacugggagcuguuagcuaauuuuucaguacugaaguacuucuuucaaacgcauugcuaauuucaggagauguuuaacauaaauacaucagcuaagaagucuuacuaaucuaauugcaucagagcuaaaaaauuuugugcaaauuuaauucuaagauuuccagaaaaugggcauaaggaccuaauacaaccaaggacugcacagauugccuguaagagaucccucacugguuagcaauccugaguuaaauacagauucagucaggcccacuauacacaauaguaguagaauuuaaaauuauaaagcagcccucagugaaauagcauuuuagagaagagaacuuaagaacaaucucaaacugcauguuaaauuuauaacuauauugucuguaaaagauuaugcuacaauucugauauacuacaauuaaaaacaguuggaagaaaaggacuuauauucccaucucaauccuugauuauacucuccauuauugguauuucuauugaguguuuuuaagucauggcaguagaaucauuccuagggauucucucccuagaaaggauguauuuaacugcuuacuuucuguucuucacuuacacuccucuccagcucagcagguguggcugagguaggaguaacagucccugacaccaucaccgaguggaaggcaggggccuucugccugucugaagaugcuggacuugguaucucuuccacugccucucuccgagccuuccagcccuucuuuguggagcucacaaugccuuacucugugauucguggagaggccuucacacucaaggccacgguccuaaacuaccuucccaaaugcauccggguaaggaucucuuuccuaaauuaaauacaagguagccaucaaguaaauuaaaaguugcauuccuaggaauacugcaaacucuuguaugcaaaauaugcuuacuagauauucaugauuguaaaaguuacagguuuugagaucuccaaauaccaaauugcaccauaaagcaaguuucuagcccuuauaacccuucaaaguuaguauuugugugguaugaagaauucugacaggggugacaaaagucaguacucuauucucaugacagauucuacaagguuucaaccucuacgaucucauauauuuaacuuuucguagcucauucauuauauuaaaccuaauuuuaaaagucguuugugagcaucuuaccuuugcugaaaccauaacuguuuauaagucuuguauccucugccgggagauccgggggaauggucaaaguuccagaccaaagagguagagcagcaugccaucauuaccuuucccuuccucuggucccaucaugugaaagagcagguugcuuccaaaauaacucagauuuaccuguguaaaucugauacauuaagauccacuuaaauauauuucagguacuugaucuucauuuauaucaucuuuaaugugaggcaaccugaaaucuaaccaauuccucaagaugcuuuacuucaaacccauucucccucuguucuccuucccucucuacucccuuucuuaugugugguuucaggucagugugcagcuggaagccucucccgccuuccuagcugucccaguggagaaggaacaagcgccucacugcaucugugcaaacgggcggcaaacuguguccugggcaguaaccccaaagucauuaggugagcaaaaaacugcuagagauaauucucuacucaaagauuguauauggcagugggaaccuuauauugagugcuacuuccuucaggaaaagaccacuagaugcugcgauuuuuuuccuuugccuuuuauucuaagaugccuacaaggauauccucaacaucuccaccuugaauucucaguaucauucaccucucauuugcauguuuccguuccugcuucuguguuuuaauaaaacaaaaguuuacagagcauugaacauuucuaaaucuugaguuuggaggcauggaggaaggggaagaugcuauucauuucuacuggccuuuuuuuucaggaaaugugaauuucacugugagcgcagaggcacuagagucucaagagcugugugggacugaggugccuucaguuccugaacacggaaggaaagacacagucaucaagccucuguugguugaaguaaguaaaccuaaauaauauauaguccacaauaauauauaauauauguggguaauauaauaauauauggauauuuuauaauauuauucucauguaucucucuguccuaucucucucuugauuuacuuucuguuuuguuggggguuuuuguuuuuguuuuugaggcagagucuugcucugucauccaggcuggagugcaguggcaggaucucugcucacugcaaccuccgccuccuggguucaagcaauucucgugccucagccuccugaguagcugggauuacaggugugcaccaccacgcccagcuaguuuuuguauuuuuaguagagacaggauuucaccacguuggccaggcuggucucgaacuccuggccucaagugaucugcccaccucagcuucccaaagugcugggauuauaggugugagccaccaugcacagccucccuuugauuuacuuucuuaauuuuuccuucauuuguucaugcaucgaacuaccuccuacguauauugcuuauauguacagaauuuucuuagauaauacaguucaaauccuucucuucacuauccaaauaucuguggucccuccauuaaaacacauguucugaaggucaguccauucucacuagcuuuucuuucuuuuaccuaaagccugaaggacuagagaaggaaacaacauucaacucccuacuuuguccaucagguaagagucaaccaucauaauuuaaaaaacauuaaagucuaacauuuaaaguucaaagaacauuuauauauuauuccuacacuuucucugugaucuaagaccugaagcaccaucaaugcauuugacaaauguggaaaauaguucuuaggaaggccaaguaauuugaucagaauaucccuaggccugcauucugagucuugaucuuuugcagcaccugugcaaacaccaaaugacuuucugaccaguguaugguaugggcauagguagaaaguggguagaaucaaaauuaauauuaccaaaagggauguuuccuuaaauaauuaauaaugcaaacuauggacggcugaauuuagggcauucuaacacugaguuuuacauagccaacaguauuugauaacgggauugcuauuucccaaaggaaaaguugucauggccuuuaccauuauugucauauuaauaucuguuugaugccuaucccguaccuaaugcccuaucaaacauuugagaaggaacugaagaaacuuacaggaaaaauuuaauacacuaagaaauuuaucagcacaaugcauucucaccccaaaccaacauugaaucaacaucauacauagguucauugccuuucucugacuaccuacaaauuuaguauguuuuucguacuaaauacuuuaucuauucaucuguugccaagauguaacacauaaaauguacccuaaaaacauaacuuccuugucauuuagccuuauuucuacauuuaagugaacugauuaccuaucauucaauccuuuuaucaugacuucuccguuucugaguuacucauuuugauguaucucuuaaguguaagggcuaaucaucaaauaguuuuacuaaauuucauuuuaauuaccaacauaaucaaaugugccuaccuaauuuuacaaaaauauauucuucuuuaaaaaaaaaaacagaacaucacauuaaagguuaaugucaccccccugaacauuuuucaguacuuugccauccauuuaucuuuagaaauaauguguguagauguauauguuuguggaugugugauuuacauauaauaaacuguauaaguuucauucuauaaaucacuguuuguuuuucacucagcauccugucuuggagauuuaccuauguuaaauuguagaucuaggucuuuccuuggaauugcuuuuaagccuauaauauaaauacaucacaauucugcuuaguguuuuagucuuccuauauugguuuuuucaacuauucacuagcuuuaaaaaauuaguuaguuaauuauaauaagagccucuuaaugaacauaugcaaguacagcuaggguagauccaaaauguuaaauuccugagucagagagcauaugcauagauaugcauaguuuuguuugguugguuguuguuguuguucuuuaauuacauuguaaacugaccauuuauaauuguauauauauacagcauacaaagugauguuaugauuuaugaauaaaaugugaaauaauuaaaucaagcuaaccugaaauacuuauguuuuguggugggaacauuugaaauucucuaagcaaguuugaaacauaaaauacacuauuauuaacuauauucaccaugcugugcaauagaucccaaaaagaaaaaaauguauuccuucugucugagacuuugugucccuugaacaccaccuuccuuuuacuccagcuucauccuccauaaccaccauucuacucucugcuccugugaauuugaauguuuuagcuuccacauacaaaugagaacaugcaauauuuguuuuccuauaccuggcuuauuucacauaacauaaucuccuccagauuuaaucaugcugccauaaauagcagaauguucuuguuuuuuaaaauggaauggaauucuauguguauauaccaaauuuucuuuaucuguucaucuguugaugacacuuaugauuccauaacuagacaucaguaauuuguuagggauuacauucaauauguagauugcuuuggguaguguggacauuuuaacaguauuaauucuuccaauccaugaacauuguauuuuuuuucauuuauuuguguucucuuugauuucuuucaucaguguuuuauaauuuucacuguacauuucaccuccuugauuagauuuauuucuacauauuguuuauagcuauuguaaaugggauuguuuuuauuucuuucucaaucauucauuguuagugaacagaaaauacuacugauuuuuauguguuaauuuuguaucuugcaacuuuauugcauucauuuauaaguucuugcagcccuuuggugaagucuuuugagcuuccaauauauaagauaaugucaucaccaacagugaaaauuuuacuucuuccuugucaauuuggauauuuuucauuucuuuuucauguuugauugcucuugcugcuacuuccagugcuacuuugaaaauaaaugguggcaguggguauccuugucuuguuccagaucuuaaaggaaagucuuucaauuuuccacuguuaaauauguaagcuauagguuuaucauacaugcccuuuauuguguugaggaacauugcuuguauaucuaauuuggugagaguuuuaucauaaaagagcauugaauucugucaaauacuuuuucuccaucuaacaagaugaugguaugguuuuuacccuucauucuguaaauguaauguaucacauuuauugauaugcauauguugaacaauuuuugcaucucagggauaaaucccacuugacuagguagaugauccuuuuacuguauuguuggauuuagucugcuaguuuauuucgugugguugguugguugguuuaguuuuuuaagugaugagcuuuugcuguguuccccaggcuggacuugaacuccugaguucaagcaauccuaccaccucagccacccacagguguaugccaccaugcuuagcugcuaugcuaguauuuuauugaggauuuuugcaucuauauucaucaagaauauuggucuguaauucuuuuuuguaaugucuuuuuaugacauugguaucaggguaaugcuugccucauaaaaugagcuugaaaguauuccuuccucuuccagcuuuuggcagaguuugagaaggauugguauucauucuuuuuaaaugauaaguagaaccuagcagugaagccaacaguuauuaggcuuuucuuuaauggaaaacuuuuuauuacugauucaaucucuuuacucauuauuugucaguucagauuuucuauuucuucaugauucagucuugguaguauguauaugucuaggaaugcauucauuucuucuagaucauccaauuuauugguguauacuuaugcauaauagucucuuaugauccuuuguauuucugugguaucagccauaauuucucuuucauuucugauuuuauauauuuaaggccucccucuuuuuucuuagcuaaccuagcuaaaaguuuuugucugucuuuuuaaaaaaacaauucaguuucauugaucuuuuguauucuuuuucuagucucuauuugauuuauuucugcucuaaucuuuauuauuuuccuuucuucugccaauuuugagcuuacuuuguucuucuuuuccuacuucucugaggaauaucauuaguaucuuuauuggaaauuuuucuucuuuuuugguguuuauuguuauaagcuuuccucuuagaauugcuuuuacuuuaugcuauguuuuguuaugcuccauuuccauguucauuugucuuaagauauuuuugaauuuccuuuuaaauuucuuuauugacccauuggcuguucaggagcaugucauuuaauuuucauauauuugugaauuuuuucuaauuccuccuguuacucauuucuaguuuucauaguauuguggucagaaaagauacuugauacgaugaaacgauuucagucuucuuaaauuugcuaagacuuguuuugugggcuaaaauaugaucuaucuuggagaauguuucuugugugcuugagaugaaauguucuguauguauccauuaggucuauuugaucuaaaguguuggucaaguucaacguuuucuuauuaauuuucuuucuggauaaucuauccauuuuuaaaagugagauguugaaauucccugauauuacugcauugcaacauaucucucccuucaaccuuuaauauuuguuuuauauauuuaggugcuccaauguuggauauguauagauuuacaauuguuauauccuuuugaugaauugacccuuuuaucauuauauaauguucuccuuugucucuuuguacaguuuuugacuuuaagucuguuuuguugaauauaaguauagcuaccccugcucucuuuuaguccccauuuaccuagaacaucuuuuuccuucucuucacuuucagucuauguguguccuuaaaaauuaggugagucucuuguaauuagcauauguuucgguccuguuuuuuuaaauccauucagucacuuuaugucuuuuaaauggggaauuuaguccauuugcauucaagguaauuauuaauuuaaaaaugacuugguacuaccauuuuguuguuuucugguuguuuugcuucuuuguuccucuuuugcugucuuccuuuguggucugauguucuguagugguaugauuugaaucuuuuaaaauuuuuguucugugcuucuauuaaagauuuuugccuugcuguuacuaugggguuuacagucaauuucaagcugauaacaacuuaacuuugcauucuuucacucccccacacacauuuuaugucguugaugucagaauuuacauauuuuguaauguguauuuauugacaauuuauuuuuagcuaugcuuguuauuaauauuuugucuuuuaacccuuguacuagagauaaaauugcuuuaaauaccaucauuacagucauagaguauuuugaauauggcucuauauuacuuauaccauuaaauuuugugcuuuuguguuuuuguauuauuaauuaggggccuuuuguuucagcuuaaagaacucccuucaguaauuccugaaggcaggccuaauguugacgacucccuuagcuuuuaguuugucugggaauguuuuauuucucccucauuucugaaagacagcuuugcuggaugaagaauucuugauuccauguuguuuuuauuuuuguuuuccuucaguacuuugaauauauuauuccacucucccucagccugccggguuacugcuaaaaauccauggauaguuguauuggaauuccuuuguaugugauauguuucuuuaucaccuucugcuuuucagaauuuuuuuuugucuuugauuuuugauaguuuaauuauugugucuuagugagcaguucuuucauuugaauuucacuggagaccucugugccuccuguacuuggaugcuagcaucuauccccuaauuagggaaguuuucagcccuuacugcuuuuuuuuuuuucugauucuauacucuuuuuuuucauuauugcuuuaaaugugcuuuauagucucuuucuucuucuucuggacuuucuuuaaugcaaagguuugauuucaugaugaugucccauaauuuccauaggcuuucuucauucuuuugucuuucugcucuucugccuggauaauuccaaauacucuaucuuugagcucacugauucuucugcuugaucaagucugcuguugagcuuacuuugaauuuuuaauuuuagucauuguauucuuuauuuccaggauuucuauuugguuucuuuuugauuguuucuauuuauuuuuuauuuuacaauauuagcuaaguugcagauaauuguuucuauuucuuuuuuuuuuauacuuuaaguucuaggguacaugugcacaaugugcagguuuauuacauauguauacaugugccauguuggugugcugcacccauuaacucgucauuuacauuagcuauaucuccuaaugcuaucccucccccauccccucaccccacaacaggccccggugugugauguuccccuuccuguguccaaguguucucauuguucaauucccaccuaugagugagaacaugcgguguuuguuuuucuguccuugcaauaguuugcugagaaugaugguuuccagcuucauccaugucccaggaaacaacaggugcuggagaggauguggagaaauaggaacacuuuuacacuguuggugggacuauaaacuaguucaaccacuguggaagucaauguggcgauuccucagggaucuagaacuagaaauacauuugacccagccaucccauuacuggguauauacccaaaggauuauaaaucaugcugcuauaaagacacaugcacacauauguuuauuguggcacuauucacaaucguuucuaugucaaacuucucaguuuguugguguauuguuuugcaaauuucauuuaauuuuguauuuauauauucuuguaguccacugaauuucuucaagaggauuauucugaauucuuugucagugauuucauagaucuuuauuucuaugaggucaauuuuuugagcuuggccaguuucuuuuggaggugucaucauuccuugauucuucauaauccuguguccuugcauuauuugugcauuugaggagaaagccacuucuucugguuuuuauagguauucuuuggcagggauaaagguuugcuauuuagucuagccuauaauucuggaaagaucaguuggugacaaccuugagcaggcagaguuuucauggguucccuaguuggcugggccacugccuuugcucuuauguuugguagggccacugguugggccuugcucucuggcaagaucacuguuuugucucugcuaucugguggagcugcuggcuggguacuacaauggccucuggucaggccagucacaagauguguugccuggcuggaugauucugcuauuugggaccugaaguuaggcagggucacaauccgggcugugagguuagguagaguuguugcuugggaugggcagaaauaaauacuauacuucuuagaugugcauaauagaggauugcuaccccacccuugugaauggagccauggagugagguuuuggcugaguugagcuacccuuuagacucccaggucaagcauauuuaaccccuacacuucuaugaaauacacagagguggugucugcuaccuggguggggucacuggcauaaccucugaagcugggcuuacagacuggccaucuggaaacucaagcuagguugaacuucccaacaugcuucugaaagugaccagcucaguuuugcagaugggcuaugcaguuggcugguaucucugaaugggugccauagcuggcagaaacacagaagcacuaccaaaauccacaugcuggucacugugagcucuguccuucuuuguuucuaccugaccucauuacuuccuguguucccggugaaaugagaccagagugggcuuccugagaagugucuuugaauacuugagaaucuugaugucuaccccugguucucuuccccgcuguagaaacugugaccccagggaacuccucucuaucuggcauugugcuaaccuaaaggagugggaacaaugacauggucaaagugagaccauucuuccuacucuucuaauuugucuucacucaguucuaugaacaauguagguguccuagacuuguuuccaaguauugggguuuucaaaauagauuuucugaucuguggauagcagcuaguuggacuuucuguggagggaggaagauccugagacuuucuaguccaucaucuugcuuuauucugaauuuuaauugaacuacaaaacgaaaauccuccucuuuauuaccuaaaugcauuuauacuuccaccaggauacauuuccauaguguuauauuugccaucaucuguuaccaucaaaguuuuuaauuuuaauuuuugccaaaaauuuagaaaaaaaaauuuugcuguuguuuuaauuuauauuuucuuaauuacaaggaugaccuuauuuuugcauguuuauuaauugccuuuauaaucuuuggcuauuugucuuuugaguaguuuuuuucugacucaguuguaugacacuaauucuuuaucuguugaauauguugcagauauuuucuuucacuuggucauuuuuuuaacuuuguuuauggcaucuguuuuuuuacaaaaguuuuaacauuaauuuuaugagaaagggaagauaacugcuacauuuuucauuuguauauaauucaccaauacuaaaauuguaguaaauguauguucaucaguagcaguuauuuuauuuucagugagucaagcauuuuauuuugcuuagccauuuguccuuuaacuaugcuuauggcuuuuuuuuaagaaacauuuuaauaugaauuuuaugaggaagggauucaguaugaaaauaaauaccauacuucucucauuuucauuucauauaauuuaccaagauuaaaauggaaguaaauguauguucaugaguaguaauuauuuuauuuucaaugcaucaaauacuguucgucuucacuuccuuacccucaauuuucuagguuuuccauaaaaauacuaucuuuguauaugaaauuugaagaaagaacauagcauuauuauagaauucaggaccuuuuguggguaauuuuacuuauguauacuuauagggcuuuguuguugguguuuucuccauacaacuguugaguaaggaaguugguggugggaacuaaauagaucaucuugugauaaccgucuugugucagccaucagaugacagcaacugaaucacaacaucaccaggcucuuacaauuuguugucuuauuuggcaugcgauucuacauaaauuacugaaaagaucauugaagaagaaauucugaaaaucacaggaaaccaguagcccauuuuuaagauauuuauauauuacuguuguauuaaaggcggacaacuuuucaggaggaguuuagguauaaggcauaguccuagcuucugggucauagagcuguuuagaaagauauaaugcagaaauaauuuucauaugucugauuugcuuauuucucuagguggugagguuucugaagaauuaucccugaaacugccaccaaaugugguagaagaaucugcccgagcuucugucucaguuuugggugagucuccagccccuaguggauccgggcauuaacagcuucuauuauacuauuuuuauuucccauaaauauuuacuaaaaauaauacuauaauuuuaacuucuuucuucucuucuucuuugggcuuguuuauugcuuucaaucauacuucuaucccuggaagaaucauccuuccuaaaaauucucaauuucuaagcucaacuaauuauuucugcuuaaugacuuugauagaugauaaucuccaagcuuuaugacuucccaucucucccauucucuaggagacauauuaggcucugccaugcaaaacacacaaaaucuucuccagaugcccuauggcuguggagagcagaauaugguccucuuugcuccuaacaucuauguacuggauuaucuaaaugaaacacagcagcuuacuccagagaucaaguccaaggccauuggcuaucucaacacuggugagugauuacuugaguaagggaaaacuugaauguuauuucaacuggauuucccaguagguuucaguuacuuaugaauauuaugauacauuagcuuagcucacuaugauagcugcuaugauaguuaauuucaaggaaacuauccacucuccaaccuccaauaaaauauuuaaggcucagaaacuccuaaucuaugacaacaaaauuuaagaaaugucacaagagaagccaagguacuuuuaguaauuucuccacccucagcaugcacauuaauccauugugcuguuucguuaaucuuccuuuccagguuaccagagacaguugaacuacaaacacuaugauggcuccuacagcaccuuuggggagcgauauggcaggaaccagggcaacaccugguaaggaaagaacaauuuuuugagcuucuuuuugugugccagcucuuuuacauguauuaccucaauuauauucacagcaacacuaucagauauguauuaucagaccgaugguuuguuauacuagauaaauccaccaagauuagcaagguaaucagaagaaaaccugauauccaaauacauguuauguuaggcuuguuuccaaaauggauccuauuaauaauguaccaagguuuucuuucugaaauggcuauucuuucuaaaguagcuaccauaaccaugaguuuuaaaaugauauugccagugaacauauauaacuuccagauaaaccauguuaacuucagcuuauauugucacauucuaagucauucagcuugacuuggaaugaauucauuaauaagaggaaacaauugagaaggaaacaguaauauaaaacauuuuuuuaaaucccuaaaguaaagcaauauuaaaauuuacugcauguaagagcugcaugugagaagauucugucaucugcagaaggaaaucucuaaagauaagagagauuuaaagccuuacucaaguaacuaacaaaaauaaguacauucaaauuacuugaauguaaauuuguucaaccauuguggaagacaguauggcgauucuucaaggaucuagaaccagaaauaccauuugaccuaguaaucccauuacuggguauauacccaaaggaauauaaaucauucuacuauaaugacacaugcacauguauguuuaucgcggcacuauuuacaauaacaaagucauggaacuaacccaaaugcucaucaaugacagacuggauaaagaaaaugugguacauauacaucauggaauacuaugcagcaauaaaaagaaaugaaaucauguccuuugcagggacauggaugaagcuggaagccaucagccucagcaaacuaacacaggaacagaaaaccaaacaccacauuucucacucauaagugggaguuaagcaaugagaacacacggacacagggacaggaacaacacacaccagggccuguugggagguguggggugacgggagggaacuaagcggaugggucaauaggugcaagaaaccaccauggcacacguauacuuauguaacaaaccugcacguucugcacauguaucucggaacuaaaauaaaauuaaauauacuaagacucccuguggcaaagagagaguuagcaaggaaauacuacaucuagcagauuaaucaggcagacuaaagauuaaucaaggagauaagcucucuaaguacacaagaauuuuguuagcuaacucacaucauaugaagccuguugcugugaagugguuauaaaaccauuuugacaacauaaacaucaugauugcuuccucccuggucaggcucacagccuuuguucugaagacuuuugcccaagcucgagccuacaucuucaucgaugaagcacacauuacccaagcccucauauggcucucccagaggcagaaggacaauggcuguuucaggagcucugggucacugcucaacaaugccauaaaggugaaucauucuggagcuaguuuugauuuguccauuaugauaucugcaaggaugaggauaggaagugauaaugugaaaaauucuaagggaaagccucagaggaaaauaaaaccuggauggcaccaaaaaagaggggauagaacaaaaguugauugugauacuuugcccuauagggauggauauggguaaggaugaauuccaugacacagcagaauagaaagaacuaaucaauagcauucucagaaguugaauuauucagaucucucucucguauucacagggaggaguagaagaugaagugacccucuccgccuauaucaccaucgcccuucuggagauuccucucacagucacuguagguaccaccccauuccucugcugaaggagaguucuggaugcaaugaaacugcugaccugcugucugaaauacuauccuauuaaaagcaaagcaucagcuuucuuucuaugcaaugccagugcuucccagaucuacagagaauuuggucagcccauuaagaaagguuuaaauuuucccaguaauuccccuaggcuauuuaccaccaccacucaaaaaagaaucuuaaagauguaucuuuugaaugugagaauaacagauaaaaauaauauuauaucuauugauaagaaugaggaaucguuggaaaaaugcguuugaaaaacuucugugcugugauccguguauuugccugggaaugcuaauaugccuguuuacauagcuuaguucccuucuuguucugccuucacagcacccuguuguccgcaaugcccuguuuugccuggagucagccuggaagacagcacaagaaggggaccauggcagccauguauauaccaaagcacugcuggccuaugcuuuugcccuggcagguaaccaggacaagaggaaggaaguacucaagucacuuaaugaggaagcugugaagaaaggugagagcacaccugagauccuucuccuggcccauccucuguaucaagaacugcauggcaaaaaucccucacuccuaccuccugugaucccugucuccucucuucuuuucuauauaucauauauauuuuguccauauugcaucuuauaaaaucuaggauuucuuaaucaaaucagaaaucagaagacaagaggccgugcagaugcuucucaauuacgaugggguuauauccugacaaacucauuguaaagucuaaaaaaucuuaagugggaccauuguaagucagggaccaucucuauaguaugcugguaagaagagcauucucuggagacuagcuccaaaaugugcuaccuaugugagcuugggaaagucauuaacuuccuuguguuucaguuccuucaucaguaaaauggggauaauaauaguauuuaccucacagagcuguuguaauaaaugaauugguacacguaaaacacuuaguagaguacaugucacauagcaaauccuauaaaaguacuaguuauuacaauuaacauaucaguucucaauauaugcccaacccuuaccugguacauuauauaaccuuaaacauaagaaaauaaucauggaaguaacuccuugaaugaauucugguauuuuaagcccauuucauaagaccaauaauguugaccaaucuacucauauucacacaguacuucuacauauaccauggucuauaugagcgguugaagaaauagaaaauaaaaugcaaaucacaagauguccauuaaaacagucuaccuuuuuccuuugacagccauuaauucuucuuaaaauguauugagaaauauuuuauaauagauauacaaaagggcauaagcuauaacuagaaaacacuguacaacucucucauagauuaagaaauagaaaauuaccgacaugggaaaaauaaaucccuuguguaucacuaccaccuccagaggcaaucauuauccugaauuugucguuacaauuccauggauuuccuuauauuuuugcugcauauguaucccuaacuaauauuuagaaucuucacauguguuucaucuugagagaaacaagauuuuuauuucucucuuauucaagaaacaagagaaacauuuuugaauauuucagcagcuuaguuuuuuguuugucugcuuuuuauuuucuaaguucaacacuauguugaugaagaccccuauacaaguaugugcagagucagcucauuaauuuucacugcugcauaauauauuacagucuauaaauuagucauaauuuacacaucgaguuucuccucauggauuuuuuuuauguuuugcuauuaaaaaaaaugcugcaaugaauacucaugugccuguuuucuugugcaucuguguuucuccaaauuaugcuuugagaagcauaaugacugauuagugggcuaagcacaucuuccccauugcugaauauugccaaagagcaguuggcuucccacagcaguguauauugguucccauuguuucacauccaugucagccuuugguauuucaaggauuacuguauuuuuuuuuucaauuuaaugaguagaaacucuacuauuucaugugaucugugauccucacaagaaacugauaaagacacacuuuauaggaaauguaacaaacuccagcuauagucuaauauaacaucauaaauaggaaauagccagacucaaugagacaacugcugugccauuucuuucucccaccaacccgacuauagcaacgauuugaaaacauagauaggcauaggcuucugacuccagcaucaauaucugccuuagcugggcuaaaacacaccaaauucagauuuacaugaagggaaaagcaucuacauacaguacaggggauuauaaugggcaugcaauucucauuucagcacuggcuuggguacuuucaccuugaauuaaauauaaauauguaggcacuuauaaauaucuuuuucucaucuuuaagacaacucuguccauugggagcgcccucagaaacccaaggcaccaguggggcauuuuuacgaaccccaggcucccucugcugagguggagaugacauccuaugugcuccucgcuuaucucacggcccagccagccccaaccucggaggaccugaccucugcaaccaacaucgugaaguggaucacgaagcagcagaaugcccagggcgguuucuccuccacccagguuggugauuugccaaaaccuuuuauuucaccuucagguagcaaaagauuugaaugaaaaagaaacaaacacauccaagaagaaaaaaauacagaugacaguaacuugaaaugaggaaaaguuuucaguauccaaggauaauggaaauaaaagcaaaucaaagucaaagagggccaaaaggaaaugcucagaaucccggcaccccaucgcuguguuauuauccaucuccuauuucccauaacaacacugccuuccucaagcagcaguggagcaccagcagaaugaaggagaugucuccugccauucuccugaaagcucuagggucucuuucaaacuguucaaaggaacucuacucaaaauccaacaaccucuccucgcaaaucucuccauucuuagguccccuuuaauaggcuuuucucaaaacuacacauuuugugcuuccccuauucaccuuuuuuuuuuuuuuuuuuuuaagacagagucuugcucugucaccuaggcuggaaugcaguggugcaaucucggcucacugcaaccuccaucucccagguucaagcgauucuagugccucagccucccaaguaucuaggauuacagucaugugcaaucaugccuggcuaauuuuuguauuuuuaguagagacgagguuuugccauguugcccaggcugaucucgaaguccugagcucaggcaauccauccgccuuggccucacaaagugcuaggauuauaggugugagccacugcguccagcccccuauucaccucuuaauacacaaacauuuauucaucaggagcauaaagaacugucuuuauucauccaaccuccuaaaucuagcuauauaaccauguaucugaacaauucauugauauguacacagcagaaaguuuuaucuucagagaauucggauguuugcuuauauacccuaaaacggaaaaaaugugacaaaauggcauuccauccuauuuccauuguauuaaucuuuuaucauaugaaugaaaaaaacuaaguaauuuuguuaaagguuaucauucauuuauuagaaacauauuauuugaaggaggccaagcagguuuaauguuguugaggauacauaccagcagacauucacugggaacaggaaaucauccaauaaaaagggaaagccaaauaaaaaugucauuaaauccagaagauaauuauaauacucaucuuuuauuucuuuuggagaaacugaagcaugacucugcucauggcugcaaagaaccuuggguucucuccaggacacugaccucagcaacugagcaaaguuuaauaugggagagagccagacugaacuuugcuugagugguggcagauaugagcauaguugucaagaaagacauguuagcaaauagcugaugccaauaacugauugccauucacauguuuuccacauuccaugucccacauauacuuacagagagaaaaggaucaauuuucugauaaauaaaauaaacauguagggcauacaguccaagguagauaugugaauguuaugguucuucaacuaucuaaagauuauaaucaaucuugaaauuacagcuccuauauuuaaguagugagggaaguaggaaaucaaagucccucacaugggucuuugaaaaauaucucagcccucaaagccuuauaaugcccaauggguucucucacucaucugucucuaacaggacacagugguggcucuccaugcucuguccaaauauggagcagccacauuuaccaggacugggaaggcugcacaggugacuauccagucuucagggacauuuuccagcaaauuccaaguggacaacaacaaccgccuguuacugcagcaggucucauugccagagcugccuggggaauacagcaugaaagugacaggagaaggaugugucuaccuccaggugagacucuugggcaggugaggacaggacagaugaggacagcagcuguucucucugagaaguccuaacucagaaaacaaugggacagaucagagaaaggguuagggacguggacaggaauucugggaaagggcaaaaaacugauuuugucuuugauguucuauagacauccuugaaauacaauauucucccagaaaaggaagaguuccccuuugcuuuaggagugcagacucugccucaaacuugugaugaacccaaagcccacaccagcuuccaaaucucccuaagugucagguaagaccuucugacucuaucaccuaauccuaagaauaaccaccagucuucuuucgggaacuccucuuuaaguaaagcagugcaacaguagauauuugcacuauucacaaaaaaugcaauguauucucuuaaguugauauaauuucucaaugaugggguuuacauuguccauccaggaucuacuauugugcaaccucauuguuuaaaggguaauaauuucccucaauaacaacuaaguaaauauuacccauugccucugaccugaauuccuuguuauguaaugaaauccuauauuauucuugcuuuauugaagauagagaugaagaauuauugaaaaguuugaauagaaggaaguagugacuccuuaguuagaauuccuacuggcaauaauaaaucucagguuauauaugauauaauuaauuuggggggaagauacacuuauaugcaucaauauuuaaauagcugcagaucugauaaaaaacucucucuccacaaacauauuauuacuugguuggagauacuauucaggaaaaaaguuaggacaaaauacauguaacaaauaacuggcacacaucaaaaagaaugagaucaugaccuuugcaggaacauggauggagauggaggucauuauccuuggcaaacuagcacaggaauggaaaaccaaacacugcauguucucauuuguaagugggagcuaaaugaugagaacauauggacacaaaaaggagaacaacagacaccagagccuacuugaggguuaaggaugggaggagggagaagaucagaaaaaaacaacaauucagugcaaaauuuaguacccaagugauaaaguaaucuguacaccaaacccccaugacacgaguuuaccuauauaacaaaccugcauguguacgccugaaccuaaaaguuaaguauauauauauauauuuuuuucauuuaauuugguguauauauaugccaaaaaauaaauuaagcaguccaaauuucggaugcaaacucucggggacaagacgcuagguguuucuaaguguuuuguugaaagccaguguuuaaguaaacauuauaaauuauuguuguuuuuguaaauaauguagacugaaauuuauuauucauaauauacaucauuuugucagcugaaagaaaauaaaaguaaacaaauaaauaaaauaacuggcauagauuagaggucacaaacagccugugcaucacuuguagagcuuucuuaaaaugcagauccucagccgggcgugguggcucacgccuguaaucucagcacuuugggaggccaaggcgggcagauuaccuuaggucgggaguucaagaccagccugaccaacauggagaaaccccgucuguacuaaaaauacaaaauuagucggacgugguggugcaugccuguaaucccagcuacucgggaggcugaggcaggagaaucacuugaacccaggaggcggagguugcggugagccgaaaucaugccauugcacuccagccugggcaagaagagugaaaaacuccaucaaaaaaaaaaaaugcagauccucagcccccauacacuagacauucugauucaucaggucuagaguagggccuggucucuguggcuuuaacaggcuuccuaaaaauucuacgcacaccacuuuuacaaaccacugggauaagauauuugggaagacuuacguguaccuuuuagagcuguggaaugcuuaacauggacauagaagaagaaaauauuuaaaaacacagaaaacccuaauccuuuccuccccuggauccucaguuacacagggagccgcucugccuccaacauggcgaucguugaugugaagauggucucuggcuucauuccccugaagccaacagugaaaaugguagguuuaucauaaccccagacugcccuauuuuauuuaaugauguauguauccccagcauaagacaauacuaauaucaaaauacuauuaaagucaaucucuaucaaagccuuauccuuuuuccagcucagaaauauaaucacauguguuuguaugaaugcugaccaugugcagagcacugugcuaggacccaugacuacaagaaaaagauugucagcagguuccugcuuuucaauuucuucuuagcuuagaauuuugcuaagaagauaaaagauaugaacacgaaccagugaaaaauaugaaaaugacugauuggcauaaacuauaaguauuacagaaguuaaaagaaaaauagagcaagcaaaacaggaaaaaaacuccuuaugaagaaauagaaacugaauugaacuuugaaauaugaguaacuaccaaguuuaggauacuuagcugucuuuucuucagauaaauaacuuuacacauuagucguguguuauacuaauaguaaacccuuuaugccuuucauuuuuaauuguauuacauuauauauuuccuuacaaaaagcauuugaagaauucuacccucaggguuauuuuggcaauacaaagauuuuuucucuggaucccccagggguuucaucuauuuauuaacauuugugguauuucaauuuucuucagcuugaaagaucuaaccaugugagccggacagaagucagcagcaaccaugucuugauuuaccuugauaagguaagagaacuuccagucuauuugcaaaaaaacguagauaauaauccucuaagggaacaucugggaagguaaaugcauuuuagaaacaucacuuccaugcuagaaauuugagaauucuaauguuaacucuaaaagaauguucuucucuccuuuauuuauauuucaccagggauuacagguagaaauggcuuauuaugaucuugggauaugaauauuccuaaaaucccauaagcaagaaaucuucacaaaauguguuuauuauguugacaaguuuuuuggauacccaguaauauaaggaaguagcccuugugauuagucaauuauuaguuaauuaucaacauacucaacaacaauaugaaagggaaaaaaaacugucagucuccacaaggacuugaaccauaaaauaauaagaccaguucaccaguaaaccaaucugauuuuauagauaugugugguaggagaguuuguucaugcauaaguugaugggaauuauaguuuacaaauuuuaugaaacuuaagccugggaagaucaaccuuuuagaugccucuuugagucuacgcaaguauuccugcaagacagagaagucaaacuauaccaaaucucuggauauuaaaaaaugaacacaguuagucauccaauaaaaaguauauaucauuuacccccaugaacagagcuauguauuggcauugacagagguauaugcguuauguuaguuauuuaagaaauaaucuggagaauuuaucauccccucugagagauuucugcacaauuuaauuaaggacccuauagugugcuguaggauaauaaagcuuuucccccaaaaaacaggugaauacuuaaacuaauucaaagagagaagaaagcuuccugaaaggucauuuaauugacuuuugcuuuccaggugucaaaucagacacugagcuuguucuucacgguucugcaagaugucccaguaagagaucugaaaccagccauagugaaagucuaugauuacuacgagacgggugagugagagugauuuucacguagaaauauuuaauuccugaucacagaaauucagguuuaggagauguguugggguuauuuauuacauuaaguaauuacauuaucacuucauuuugucuccaucaagucugaugccccucuuuuugucucuuauacauacauuauagaaacaaccuacauuauaaauuuaucaacuacuaauacaaaacaccugugggauauuuaguucccuuuucaucagauaaauggacuguaugacaauaugagauuuaaguaaguagaacaucugaagaguccuucaggaguuugggauaaaagaauauauaaaacacuauauuugaaaggagaauauaagguagcaagcaacacaucagaugaaugaugcuuauguuucugguacaauacuguucuucccacaacaaacuccuuccuuggccuguaucccacagauguuugcuuucuuucucacuucauguaaugauuucugguuuuuuguugguuuuuuuuuuuucagaugaguuugcaauugcugaguacaaugcuccuugcagcaaagguaagccacucacacuccuccaaaaggcagucagagcuccuucagcuugccccccaaaccuucuccuucauaaaacgcuggguaaauauuugucaaaaacaucaaauuacucacacugcacauuauuauagaaaaacacauuuauuggagagggccgcugacucugucaaaccucagagaguccauaggauugcuuauggguaaugauuuggaauagauuugguuucccacuguacugauuagguuuccuugggcacuaugcuacccagaacuaagggaaagaauacucucugcucauggagacccaaaucugucuuaauuuuuuuucuuuccaaugucacagaucuuggaaaugcuugaagaccacaaggcugaaaagugcuuugcuggaguccuguucucagagcuccacagaagacacguguuuuuguaucuuuaaagacuugaugaauaaacacuuuuucuggucaaugucuuucccuguuuccuguucauuc

SEQ ID NO: 14876 - RNA, 9656 nt, Homo sapiens
aauauguuuuguuuguuuuuuaaucauuaagaguuuuuguacaaaaggugaugguuuuuuuucuucauuuuaaaacaccagggugugggggagggaugcaaacaaauaacaaaaaagaugcuuuuguaacauuauuuucccuguuuagaaagaaaaaaaucacuccaauaguauugaaaaguccaaagaugaaauaguuucauuuucuuuuccuaaggcuuauaaaaggcccccugccuguugauuccaucccucuuuuguguccaguggagccauguuacucuucaguggcccagggguucacuauuaaagaaagaucaguccagguuucugggcacauggccuaaacaggaagauggaagcaucagaggauuaaaaaccuuuccccacagaaaugugggcaagaagacacuucccugagccagcagaagggacaggugcagcagcauuccacacccagcgcagaggacagcagagcccucgaugucccacuucugcuuccguucccuuucuagaagauugaaaaaaaggucaaaaccacaugccuguggagaaagugcgacauguuuagaaauacugguagggaaccaggaguaagaaaagcuuuaccagcuuuuacuacaaauggaugaaagacaucaggaucccaccaccgcaagguaaagugacuucccuuuucuggaaccccuguggcacaggaguaccaauuuuccuuuccaacgaacuggauuucuggauaggcauuuuggcuguauguggacagauaagaccacaguccuuagcccaaucccagcuauacagucaccccaauuuccacaaaugaugugaugguaccguauaauccuguaauugggaaauuucacauuuuuccuguccuaaucucagaggugggagaagcaagucuagaacaucuccaggcucagacuaaacgagaguacuuggacugcaaccaaguaaucacugcaaaguaguuccaagcagcaagaaauaccagauucucauggaggcuacuauaggguacagaauaacaacaugaaagcaaucaacccuguauaaauaauguuucuuggcauuuuuuuuuuaauuaaagaaauccagugucucaaaaacuugugaaaauguguuuaaaaaacaaacggccagugagccugcuacaccauuuugcccauaugccuauuguaacuucugaugucaagagacaaugcaaaagccucuguuuucacaggcccuauuauauuaacucugacuuacaacuguaccucucuagagaaaaaacagaaaauaaggaacaaagggaaggcaguuuuacuagugagaagaugcaaaucaaaagcaaacuggaaagcaagagcaauaguaagggugagaugagggacuggaguugagacugcuugagaaaucuggcuguguagcuuugguuugggggacugaggaagaggcuggacauauaaagugcaaucuacauugguaauaaauggucaucccuuucuucugacuccucccccagcuggucaucccccacaccacgauaugcugcaggcacauuucgagguuuagaacggcagacaaagucacagccauccuguagggggaaaaaaaagaaggaaauaauucgcagcaucuaacuuuaggauaugagaaaguguacuuauggucuaggaauguggcaagaauugguuuucuauagggauaaugagaaaaccuaaaagaucugacaaucagccuaaauucaauuuggggcaacaggagaaaaaguuucuucuuauuaggccucaccuucuucccacccaggcccucuuaaaagcuaaaucagauuuagaagagcccaucuggucaacaguguugcucuuucagcaaugucuuaccaaggccagaaauggaugcugugccacuuacuacucuguacuagggcaacugucuuguuugcugggacuuuugugguuuuagcacucaauguccugugucccaggaacccccucagugugaacaaacgaggaugguuggucacccaaccuuguuugcaggcuacaaauucaaccagcugcccuguuacuuacugcuaccagguugccaagauccugccagaaggcuaaguggggaaacugcuccauuccuuuggcucccacuaccagucgcugguauaggaaccccccaacaacauaaacagcaaccagugaugcaaaccuguagagagagaaagacaucuauacuuaagaacugggaaauaguaaaaacucagauaggauaaccucugcauuuauugucagcuguuuccuaagauacauucccugaaaaggaaaaaugaguagugauacuaaaugaaaaagggggcugguaacucuuagaaaaccaguuagagugcugucaguccaagagaagcaaaggcccagacaaaaugugacagcgugugauucuauggccaagaauaaucaccauuaaguauaugauuccauuucucuagaaguucucauaaucuaaugaaauaauauaaaaauugccuaguccugcaguaggggaaaaaagcaccuccaaaugcaaaucuauaccggcaacuaaacauuaaaucucauuuuucaaaaacuugcagucagaauuuuuuuuuuuuuuuuuuuuagacggaguuuugcccuuguugcccaggcuggagugcaguggugcgaccucagcucacugcaaccuccaccucccagguucaagugauucuacugccucagccucccaaguagcugggauuacaggcaugugccacugugcuggcuaauuuuguauuuuuaguagagacggaguuucaucauguuggucagguuggucucaaacuccugaccuuaggugauccaucugccuuggcuucccaaagugcugggauuacaggcgugagcccuguguccuggcagaauuauuuuauagccagaggauuuaaaaaguuauccccaucaauuacagcauaauguacacauacaauuugugcuuauguaccaccauauaguuacugaccuuaaaaacaaaaggaaggaaggucuguucugauaaaggaaggcauacucacgugacaaguaagauggaacccacacugaggugggagaucucuggugaacaggccaggcugcuauccaucucaaagagguagaaacaaucuuggacuuugccacgcuccucagacacaggguuaaaauuguccugaugaugagauggcauaacacauucaggugguuaaguguuuugacuccuguccaacaaaauaaaaaacccaaaaaacaucugcuccuuccugguucagcagccuauuuuccauggaagaugcgugucugacacagagagaaacugagcuccuaguuuucuaauguccaucccaacguaucguguccccucuggauauucuccccaaccucaggucaguccuuucagucuccucccucggcuuauacaacacagggugccucaccgcuagggugugucgauugcaggagaucaucaccacugcacgacgcugcuccuugccacagugguugucauauucaucacccccuuuauagaucagcaugauccaauuaccugaggagggacaaggaaaauggagcuauggggugggggaaaagcagaggcagaucugggugguauggcagaguggaauugcguaauucauugcaauugguuauaacuaaacaacccucaucaguacgaacuugguauaccagaaaugccaagcuaaacuuguuugcuuacaaagacuuguguucccuuaagacaagaaucagauauucauuuaagaauaaucuuaauuuuuaacauuaaagguaggcaacugacaaugcaaaaccaauuaugauccauaccuuaacacugauucauuuucugaauaccuucuaaaagcaaaaaaagagguuccauacaauugcugagcagcagggguaagcccaucuaagauuucaacuuagccccagauaaauucagaguggauaucuaagauuggaaugcauaucucuucuuuaguauuuacuguguucaguucuuuugcaaaauaucauuugauucaguaauugugaggugaauaagguaaagauucugcuccuaguuuugcauaugagaaaacaaggucaaaaggugauacgacuuuccagucacaggauuaggaaacaggaggagaaccuggucacaugauccccagccccaaacccuuuuguuacuuuuuuauuguauuauuuaccaggaguaaauagcuaccuuguauaacuuauuuaucuguaugggagggaauuggaccauaggugcuuacaugguccucuccagcaauaugacuuuuaagaaauaucaccaccauagcacaaaaaucaguggguaaaguuuugcagacugaguaguuugcaaaaaaaaguuugagcucuuaaaauuuaacugguaaacuuugauuaauuugaugaaaaguggugguggugguugguauuuguaagucuagugugaaacucauuaaaaguauuugggugaauaaaaggacucuaggcuacagaauucuggcuagaguuggcugggcgcggugguucaugccuguaaucccagcaccuugggaggccaaggugggcagaucacgaggucaaagaucaagaccaucauggccaacauugugaaacccugucucugcuaaaaauacaaaaauuagcugggcaugauggcacacaccuguagucccagcuacucaggaggcugaggcuggagaaucgcuugaacccaagaggcugagguugcagugagccgagauugugccacugcacuccaggcugggugacagagagagacuccgucucaaaacaaaacaaaacaauucuggcuagagucuucauuuugcauaaguuuuucacugauuuuaaugcacaacuguccugagcuguggcuuacagaggagcuguggaauuaggcauccugugguauauuacagucucaggugugccgaaccacacguaugauaugcugaagacacuagaaacggccaagacauacaggauugucagagggauugacuugggaucaguuagucaaucgaugguaggaaggggaguuuucuuacuuccguugaagaugugagucucguugagucucccuaccacugucuccuucccauuacuuuuguugauuugcaccaggccugccccagaagugugguugccagcuucccggcacacccugaagauguagauguaugugucugaacccuggcccacagugcucucaaagcuguaaagagaagugggaagaaagaagaggagaguuacuagcuaucagccucaggaauaacagcaucccuuuccuuaauuaaaacaaaacaaacaacaugcucgauuuauuuauuugaggucauggcugagugaauauuuguuuaauuuuaagauauucauaaccuugacagaccauccuuauugcugaugaugaauuauuaaaacacacuugagcuaucuugauagcucaauauucuaguuauuuuuagaaugccuguuaguaaccauguuccaaugaauaagggcccauguucaucggauagucucguuucuuagggaccaacuucagauuuauauaucugaagguuccugacacuuauaaugacaugugucggccuaaauauguuuaucugauauuucuaaaguccuauuauauguaggugucaaauaauccuuaaauuucuacaagcuggucucuuggauccagucuuggaaauagcuacacuucugugaaagaugagaaaacugcacacagcaacuaaaaacugggcugagaauuugcucuaugucauaaaagagagcacauuaugaaauaaaaucaguaagaagaaaagacuuuaacauaaauauuuucucaagcucuuuaagguucuucucauuuaccuuuuauuaaacagugguuucagccucuucacuagagccaacucuuucucugacucuuuacccuuuucuccuaccaagucgcaaguuuuuucuucugucugccaggauucucucacugccacagccaggaguaguaguagcaguccaguccuccagcagcuguagaaagggaacauccuuugggagagaguguguguuggggagggcagguaggaucaggagagagaggaaagagauaaagcguaugaauguguaauaaaucgaugguauuuuaauuauccagaaaguacaagauucucuggcauaugcaacacauaguacauuuuaauaucucuguaacaagagcaucugcagcagaaaauucauuuauauguaacuuguagucuaauguauaggugagucuuucagaacaaacuacaaaguugggaagagggaaaugaaagaacuuaaaaaagaaugaugacagcuuggguggagccauccuugccucuuuacuguuugauggcuugauguagucuucugaaaccucuuuggccucuacaggucacaaaucucaaggguuucuagacuucccauaaguacaguugucuuuuacacuacaaaucaaugacaacaaauuggggaucaccaagccacuuuacaauugaguaaauucaaugcaccugcugcuuguacugcucuaggaaugaaaacacacagacagcucucuuucccaaacuuacuagacuggugcaaaggucauugugguuuuggcaaaaaaaccccaccaaaaccuaacauuuucuuuucucuuauccaucuucauacccaggacagacugacuuacccuugcaaaacacuuuacucugguaucuguuaaugaucccucaggccauugcuacuuguuuauuccaagaguaucacggacaauuuccugauuuaacucuucuaaacuuuucucacuuacaaaaaacgcugcaagucuggacuuugguuugaauauucuuuaaaguucucuaguucuuuuucaugcggguccacuuacuccaccucauuuuuaaaauauaaaacuugaaacaggcagaauuuucauggguacuaaugaguuugaagaugggaaaauggaagcuccaaccuuggccgugaaugcacuuuccccauuccccuaaacaaccuaacaucugaccuuccacuucccacaccccacuaaagcaaaaaaucccgggaaauugucuaccugacuuccuguaccccaaacaucaauucucuacuguaauauuaugguaguuuccauagaauaaucauagcuaaccaagagguccaaggcccucauaacacauuuaaugcacugaaaccacacaacagcaggaaacaacagacuacugccuugggccaggugcuguucaaagcacuuaacauauauuaauuaacuaauuaauccucacaaccuuaugaguaaauacaauuauuguugcuauuuuaccaguaagaaaacugagacacagcuaguggagugagccagagagucuagcuccagagcucauggucuguguugaacaacuacauguauauuuccacuaugugcauaacaauuuuuuggagaugagaguagacagccaaaacuguggguuuuuuuuuuuuucuacuaagaagugaaggggaagugauuccucacacaguugacugaauaggaggugaaauaaagaacucagaccuccaacucccaccuucccuaaguuaacccacugcucaacacacaacuugaccagcugacucacuaaaaagaaauaggagacuccuucuucuagacugacuuagccugccauuuuccuuuccagucucucaggaccuaauuaaaaacugacaguugauuucuuuuccuaaauuagaacaaggaaucucacaaaauuaggaagggaugaaagguuaaacaccucagccauuagcugaguugaacuaucuuucauuugcuuauuauucaaaaaguuaggauaauaaauuuauacuguauucuucuuuccugcuuaaggcuugucuuuaaauuuaagcugcuucucuuuaauucaguggcauaugcgcuaaauguuuucccuagauuauguucauucaucuucacaacccagaaaauagguauaauuuuucauacuucacagaugagaaaacugaugcuuuacagaauuacuuguuaaauuacuugcuguacauuacacagauauuaaaugugugugaaguuacuggggcaauuuagacgauucguggcauaaagauaacugcuggaaaacuuauaaacauaggggugcaacaaucaggaagagaaugaaauggaagggcccaguagcccccuuuuaauaugcuacaauuagauucucaagguacaagaguuugucuauauacuuuggaaauaaggagcaggauuuuaugaucuugaaaaaucuuucaguuuucuuauucucuaacgacagaucuauuuuauuuggcaaugcuaaaaauuauccuuuauuaggguggccaaugacuaagccagcaacugggaagcagcuuacaccacugggccucuguagcacucacuuccccaucuguuaagacagccauggccauuuaccaguggaauuucuacugucuucccgcuggcuccuuucugauguagcaguccuuaucccuuuuucuccagcagccuacauguuuagaaaagcagccucaauuggcuaaaaggccuaaugcugaaagaacucaagagagaaggagccucagacaaguagcggcuaugucccaagagcggaagcuccccacaacgaggaacacaagauaauccguccaucagccauucuuauccacaccacagucgcaucccccucaaagcucucccagggugccagaaauucucgcucugucuagugucccgacuuuccaagcgcuuguagccauacccucuccaaaugaugccacuugaccucccaccgugaugcaggccaaaauuccuccuacaaauaaauccaccaacaccuccaacggacuccauacuugggguauuuuccuuucccugcuuucuaaauaucguaaauccccucucuggucuuggaaguccuuucucccucacaccuuucggaacuccgugacucuccgcucucaugccuccgccuccauucuacccuuagggcuccucagccagaucuuuggcuagaaccauggucaagggagaaugcgauuccggcuccugucacagacgcuuaagugugagcgcaacccagcccgccuccuccuccacgccccucacacucacgugucgugggaaacuggaguagccaaagcucagaauccccagugaauacccuucuggggaugggagacggggccagcuaggggccggccgcagaccccggucccagagcuaguuucagaggccagcguucccccuagcgccucgcugugccccacucugggaaccggaaacaggaagcgccaagaggccgcugggcaaccgcuccucccaccagaccccgcggcaugugaccauagaaccauuucgccccuuuccccuucccgggcucccugauaaucuuaaacucugauuggccaguauucugggacuuuagcuccgcccucguuccaucagcuccaaucacuaucgagguugucguuucgccuuuucugguugccuuucuuucaauggggucccagagucccgcuuccagggccucucggcucgcgcaccccggucacgcggggucacgcgccugaccgcucccggguaggguucgagugaagagggugagaggggcagguggcggaagcggaaguuacgcaggc

SEQ ID NO: 14877 - RNA, 2499 nt, Homo sapiens
ugagacgccgacaucuccucucuuucccagggaaaauugggaugcuuccaauuuagagacaaacuuaugggggaggugugauuccagggcugacaccugauuccuguauccccagcucucacccugaugcaauccuuuagguaauugaagaugguggcaguaagacgaaaggauuccccacggacuacugaguaagggagagucaggucaacaaagaacggcuugaaagcaguuaguccaacagugggugaaagcccgaagccucuugacugggaagugcagaaacucaucgccuuccacucggugauggcgucaggaacugugacguggaccgccuccuuccccgaguuacugugaaaacacaaggaccaacaugaggcagagguagcguggggcaaggagaacauuugugaauuaagccacaaauucgguggggugugcuggcuuacacuuguaaucccagcucuuugagaggcugaggugagcagauagcuucagcccagcaguuugaggccagccugggaaacauagcaagacccuauuucuaccaaaaauuuaaaaauuagccaggugugguggugcaugccuauagucccagcuacuuaggaggcugaggcaggaggauugcuugagcccaggaguuugaggcugcagugagcuaugauugcaccacugcacuccagccugggugacagggcaagacccuguccaaaaaaaaaaagcuacaaauucaucugcagaaguaaaauuguuauuguuauuguauggggagaaguaaagaggcaacugaacaggugagucucagugugagugaggcugcacucauacggaggagggggacuaugguggggagucggggugggcaucucugugcaagcacaucugacagagaggcuggugcccucugagucugaggauguguggucucagggcuugucaaaauggauaugcaagcagugagcaaaaauugaugucaauauauaccuuuaaaugugugugguucuguagugagaacacagggccugcaaugugugaguguggaauuguguggauuuguuuugagugguuguauaugaaugcaugaagaauucagguaggccgggcgcaguggcucacaccuguaaucccaacacuuugggaggccaaggcggguggaucacuugaggccaggaguucaagacuagccuggccaacauagcaaaacccugccucuacuaaaaauacaaaacuuagccaggugugguggcaugugccuauagucccagcuacuugggaggcugaggcacaagaauugcuugaaccuaggagguugaggccuacagugagccaaaaucaugccacugcacuccagccugggugacagagcaagacucugucuuaaaaauaaaaagaaaaaaagaauuccggaaaauaaauaaauucccacaccccaucaagcuuucuuugcuuaagauuuagauccauuaggaaugcgucugauucugaguuuucuacaggcucuacauugcagaaucuuacuguuuuuuuucuggguuuguuguugucguugucguuguugauuuugagaaggguuuugcucugucacccaagcaggagugaagcaaugugaucuugcuucacugcagccuccaccucccagacucaagugauccuuccaccucagccuuccaaguaggacacaacuaccaucuggcuauuuuuuuaauuucuuuuguagagacagaagcucauuauguugcccaggcuggucuugaacuccuggucucaagugauccucccuccuaagccucccaaaguguugggauuacaggcgugagccaugcaccuggcccuuuacuguacuuuugagucaucacuuacccaauaggaaacagaucccagagccaggucucugggaaguacuggcggaccugagaauccucugcuugauguaaaggaguugaugacucaaaagccucuggaugaccaccgccugcugaugaaauugagaauacgaaaacuuuaggaaacaggagacuucuuguugugacauaaauugggauggagggauuacuagaaagaaauuuagagggaagcagagaacauccagucagaggcaaggaggaaggaccaaagaggaacuaacuagucacaaaggccaucgagggaagugauagccaaggagguuuggccggggaauggauacauaagcuucaggcuucaaaagcucuccccagagagagaacacuugggaaacuguccugcaucugugacccacaacccauuagcauucucgggcuagaggcucagugcaagaacaggaggcaagaggaaaucugcagaguuccaggacuguuaacaucucagagaauccacagaccacagagguggcuuaccacccauagcagugcuguauucuggagaucugugacugcaaucuacuggcuucuugauuuuggcauuggacaguauuuucaggcccacguccugauaggcaucagagaaauaaguauuaaggug

SEQ ID NO: 14878 - RNA, 2499 nt, Homo sapiens
caccuuaauacuuauuucucugaugccuaucaggacgugggccugaaaauacuguccaaugccaaaaucaagaagccaguagauugcagucacagaucuccagaauacagcacugcuaugggugguaagccaccucuguggucuguggauucucugagauguuaacaguccuggaacucugcagauuuccucuugccuccuguucuugcacugagccucuagcccgagaaugcuaauggguugugggucacagaugcaggacaguuucccaaguguucucucucuggggagagcuuuugaagccugaagcuuauguauccauuccccggccaaaccuccuuggcuaucacuucccucgauggccuuugugacuaguuaguuccucuuugguccuuccuccuugccucugacuggauguucucugcuucccucuaaauuucuuucuaguaaucccuccaucccaauuuaugucacaacaagaagucuccuguuuccuaaaguuuucguauucucaauuucaucagcaggcgguggucauccagaggcuuuugagucaucaacuccuuuacaucaagcagaggauucucagguccgccaguacuucccagagaccuggcucugggaucuguuuccuauuggguaagugaugacucaaaaguacaguaaagggccaggugcauggcucacgccuguaaucccaacacuuugggaggcuuaggagggaggaucacuugagaccaggaguucaagaccagccugggcaacauaaugagcuucugucucuacaaaagaaauuaaaaaaauagccagaugguaguuguguccuacuuggaaggcugagguggaaggaucacuugagucugggagguggaggcugcagugaagcaagaucacauugcuucacuccugcuugggugacagagcaaaacccuucucaaaaucaacaacgacaacgacaacaacaaacccagaaaaaaaacaguaagauucugcaauguagagccuguagaaaacucagaaucagacgcauuccuaauggaucuaaaucuuaagcaaagaaagcuugauggggugugggaauuuauuuauuuuccggaauucuuuuuuucuuuuuauuuuuaagacagagucuugcucugucacccaggcuggagugcaguggcaugauuuuggcucacuguaggccucaaccuccuagguucaagcaauucuugugccucagccucccaaguagcugggacuauaggcacaugccaccacaccuggcuaaguuuuguauuuuuaguagaggcaggguuuugcuauguuggccaggcuagucuugaacuccuggccucaagugauccacccgccuuggccucccaaaguguugggauuacaggugugagccacugcgcccggccuaccugaauucuucaugcauucauauacaaccacucaaaacaaauccacacaauuccacacucacacauugcaggcccuguguucucacuacagaaccacacacauuuaaagguauauauugacaucaauuuuugcucacugcuugcauauccauuuugacaagcccugagaccacacauccucagacucagagggcaccagccucucugucagaugugcuugcacagagaugcccaccccgacuccccaccauagucccccuccuccguaugagugcagccucacucacacugagacucaccuguucaguugccucuuuacuucuccccauacaauaacaauaacaauuuuacuucugcagaugaauuuguagcuuuuuuuuuuuggacagggucuugcccugucacccaggcuggagugcaguggugcaaucauagcucacugcagccucaaacuccugggcucaagcaauccuccugccucagccuccuaaguagcugggacuauaggcaugcaccaccacaccuggcuaauuuuuaaauuuuugguagaaauagggucuugcuauguuucccaggcuggccucaaacugcugggcugaagcuaucugcucaccucagccucucaaagagcugggauuacaaguguaagccagcacaccccaccgaauuuguggcuuaauucacaaauguucuccuugccccacgcuaccucugccucauguugguccuuguguuuucacaguaacucggggaaggaggcgguccacgucacaguuccugacgccaucaccgaguggaaggcgaugaguuucugcacuucccagucaagaggcuucgggcuuucacccacuguuggacuaacugcuuucaagccguucuuuguugaccugacucucccuuacucaguaguccguggggaauccuuucgucuuacugccaccaucuucaauuaccuaaaggauugcaucagggugagagcuggggauacaggaaucaggugucagcccuggaaucacaccucccccauaaguuugucucuaaauuggaagcaucccaauuuucccugggaaagagaggagaugucggcgucuca

SEQ ID NO: 14879 - RNA, 833 nt, Homo sapiens
agguuucucuaaaguggcuaaaauaugcauuuaauauguugucuaaaugaguacauuuaauucuagagacuguaaggaguagagauuauaugcuuuggggcuuuuuguagcauuuuuuuaaaaucaguuguacagaucccauuaaacgaaauuguuucuuaacagcaagaaucugaucauuuaacuaguuuucucagcaauauaaaaggaauacaaccuccacugucauauauaacuuguugucuccuagcuccuauuugaauuccauuggcuuuuauagaaaguuauugaguuagucagacagaaggauucaugauauauaauuugucauuuguuauaaugggauuuucuucuauuccauuguggacugcuacccucaccuaggauaaagcagauaugguugcuaugaauuagacuguaucuaagcuucaagaaauaugaauaaugcauuuaaauccagagaaucauagaauuaaaggaaaucuuagaacuaagaauauauauaauauauauauauauuucuuaagauggacuuuugcuuuugucacccaggcuggagugcaauggcgccaucucggcucacugcaaccucugccucccagguucaauugauucuccugccucagccucccgaguagcugggauuacaggcacgugccaccacgcccagcuaauuuuuguauuuuuaguagagaugggguuucaccauguuggccaggcucgucucaaauuucugaccucaagugauccacccgccucagcuucccaaagugcucagauuacaggcaugagccacugcgcccagcaguacuaagauaaauuuaaccuucuca

SEQ ID NO: 14880 - RNA, 733 nt, Homo sapiens
gacaggcuuuccuuuccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccagcuccaccguuaccgcuaauauaaguaaagucuguaaaauucauacuuaauaaacaauuuaggacagucaaaaaaaaaaaaaaaaagaaga

SEQ ID NO: 14881 - RNA, 949 nt, Homo sapiens
uaacguacagaccucaggcaccacaucauuuacccuccaauaaugaacaacauuucucccuaaauucuuauugcaccuuaaccucuccagcaucaaaucuucuacucuauaaccucucuuuaaacaccucccucuaaucucaauuuccuucuguuuuuauuauuuggcaaaauuacgcuuaaaaaaauaaauauuuccaucauggcauauauauaccuauguaacaaaccugcacauucggcacauguauccugaaacuuaaaguuaaaaaaaaaaaauuauguaauuaaaccagaggauaaaauaaauaaaacucaaguuaauuugccacguagagcuguauggaagugaggaaggugcucuuacauaaacacccuccggcuuccacacucauauguaucugcuuccugguaagucugagguugggggaacugcaccuuacuuuuccucuccuauauccccuagugcggcaauaucagaacccaagggaggaaaagcuggcaaaguugucaugugccaagcggccaaucccuccugaaaugaagguagguucacucggucucuccuaagcagaagaggauguccaggaaauaaaauuuaaaaagccauugaagauccaacaaaccgcagccuuggggugcucauggagugcgugggaugagaaaggaauuaaguagcagcauucagaagcguccuggguucauccugaugaggucucucccuuguugagggagagguggcuuucccaugccgggagggagguggaaggaggcacgacuuagacauuggugguggucuccuuagcaggcucgaugcuguucaucuccaugacgccguccuuuccagaucuaucugcaccgugugccugcccuucaaaggcccgugugauauccucaaaaguccugccacgggucucagggacuuugaagaagguaaaagccaagaaggu

SEQ ID NO: 14882 - RNA, 949 nt, Homo sapiens
accuucuuggcuuuuaccuucuucaaagucccugagacccguggcaggacuuuugaggauaucacacgggccuuugaagggcaggcacacggugcagauagaucuggaaaggacggcgucauggagaugaacagcaucgagccugcuaaggagaccaccaccaaugucuaagucgugccuccuuccaccucccucccggcaugggaaagccaccucucccucaacaagggagagaccucaucaggaugaacccaggacgcuucugaaugcugcuacuuaauuccuuucucaucccacgcacuccaugagcaccccaaggcugcgguuuguuggaucuucaauggcuuuuuaaauuuuauuuccuggacauccucuucugcuuaggagagaccgagugaaccuaccuucauuucaggagggauuggccgcuuggcacaugacaacuuugccagcuuuuccucccuuggguucugauauugccgcacuaggggauauaggagaggaaaaguaaggugcaguucccccaaccucagacuuaccaggaagcagauacauaugaguguggaagccggaggguguuuauguaagagcaccuuccucacuuccauacagcucuacguggcaaauuaacuugaguuuuauuuauuuuauccucugguuuaauuacauaauuuuuuuuuuuuaacuuuaaguuucaggauacaugugccgaaugugcagguuuguuacauagguauauauaugccaugauggaaauauuuauuuuuuuaagcguaauuuugccaaauaauaaaaacagaaggaaauugagauuagagggagguguuuaaagagagguuauagaguagaagauuugaugcuggagagguuaaggugcaauaagaauuuagggagaaauguuguucauuauuggaggguaaaugauguggugccugaggucuguacguua

SEQ ID NO: 14883 - RNA, 853 nt, Homo sapiens
gcgccagaggcagcaggucucuccugcccccuacuccaccggcgcggggaggagcgugugaagcacgggccauugggguuggguuccuuucuggaggaccucagggauaaggacacguccuacugaaacugggggccggguacgugggccauggggcccaucuugggguggggucuuggggagacagaacuggcacaggagauacacagcacgccgcgaucguuagcaaaagucguaaguuucccucguuccggacgcaccucuucaaaucauuuccaaaagagguggcaaguuuuccauccuccgccccaauucuucaucuuccucuuaauuggcugggguucggguaggcccggcccaagaucgcuuguugauuggcugcguugguaaucuaucacaggaugacgcacgcgaggggugguauuugggggaggaagugaggauuauuuugguaccuccuaccccaacuacugauuggcugagauuugcagugauguaaaacaagacauaaaaauguccacuaaagggaagggucuguuugccauucucucugggccggggggacucuguuaauguagagaaggaccaaacugauugaaacacggaaaugaguuuagaaaggaacugaaggaaaacgagggaaauccgcgacaccuucguugccuucaaacaaggucauuuccugcacgggaucgaugguuuccuguuuacugccuccgaagucugcguguacacuggcuuucuggaaucugcaugauaauuaaauucuuaugagccuuuggucccagacuucccauuuguuuacguuacauaagagaaugaaugacacggaggaaaggaaaaggguuucacc

SEQ ID NO: 14884 - RNA, 22787 nt, Homo sapiens
agcggagccgagccgagcccgagcccgcgccgagcccugacacugucugcccgccuucuggcuccccgggagcccagacuggucggagcccgagcgguggcagcgcggggagccccacgcgccgaagggagcggacccgacaggacggcccuagaggaggugcugccgccacaguagcagggaccggagucucgagccgcggccucccggaccgugcugcccaggccagcucagggacagccgggaguacgaaagccccacccucuggggcaccccgggagcggaggcgggagcggggacgcgagcaaccucucccccuguuggagagaaaagacccuuaccacucgggugagggaaagaagagaccccuggaggggacgccucucuccugccuagaggcgaggaagaccccuguacuggccggggaggagacccccagaaguggaaagaagggagcuuuccguagggaagcagagugagaccacccuagcgcgcccccgccccuccaaacacacacucucaacaguucaggacuuuggaggcaaagagagacggggcugugccuguggaguaggcacccucggcccaccacuauucacaggagacaggaguccuuacguucagaagccacuccagggaaagaagaggaaucggcuuucagccuucuggagaggggaagaccucccccucaacuuccucgugccuagacaguggaacgggguggagccccuccgcuccuaucuccagcagacagaaagagcccuccaccucagaaagauccaguuugggggggaggggaacucccccaagggggaggagacaacuccugguugggagaggcuccuccccuccucccccggguaacaagcaggguguggggggugugccaccuuccccaaguaggaccuccuucuccucccccucccccuccuccaaccuugacuccucauccucaggggacccaguuccccucaccaacuugggaggcucagccucguccaggaagagccacugaggaugagagccgucaccugccucugaagaggggaaucccuccaaccccaaacuccaguaccaggugguucccucccuuugccggaggaaccuuggagacagguuagugcuuucuuucaucuucucucugucauugucuggcacuaguggguguaggggguugagcugguggaucguggguuucacugccggggaagacagagugaugacucagaaaauccaaugggaaaugugauccaagggagcuccuggauuugaacccacaucuugcugcagaagcucugagaaauggguuucuuaguguuuggggacuaaagggaugggauucauuuuaggucccuuagggaaguggauguuuucaugcugaggaaaaggguuaucggaaaacagcugcauuuugagaacaugcauacuguguagcagugauuuacacaacccaaccagugguaagauucccauaccacccuucacccuugggccuuuuccccuggagagugggcugucaugaaaaucacgguggcaucugggguccuggccuugcccagggcaugccgaggucagcuuaguguucaccagagguguucccuccagcuuacugcaauuauagcucccuugacaagaaaagcaaucuguuccugcucauccuaucucagauaccaagaggccuccucuccugacauuuccauuccuagcuggauguaugccucugcccauaaaauccaaagggaaaaugggaaucccacauguucugaggcgagaagaaagugugcaggggaaugccaacucccggguuaaagugcuuccuugaugcuggcccugaaccacugccccaguccccuucucgacuccuguuuuuugcucacaauucuucaggaaaaauuagauccuggauacgaagggaggagggcugcugcuccgcuucuguccagacuuccaguuaaacaaguugaccacuggagagauuucacuucugaggaguauauaaaguuuccuuccagaaaaguaccuaauagucucauccucucccuuccuguuucuuguucaguucugagucccucgaaccuuguguuaaaguuuuccuucauaagcuagggaauuaucaaaguccagaaucuucagaaaaggcaggaaaaggguaccaggaaauccuccccugaagccuaggcuguuuuuaggagaggucacuagcugguugucugcuuuccugccucaccauuagcagauaccuuaucuucugucucacagcaaggacaaguugugaaggaggcuucaucugacuuggccuuucauauuuccuccucucucuggggcaugggugaggucuaccuaaauuccugaguacagucauuuguccuggaagcuacuggugguauaugagauagggcacagguuuguguggcugugcuauaggacaacaugcauauacuucuuaauucaugugaauguggcucucuguuucaaguggguauguguguggagacagguacuuaugugcuuuucagacuauacuccaguuaccuagaauuguauguuucuggugggccucuagaagcaggugccucuguacaaggacauggauagguggugguaaggauggccaccugaggggaaaggcuuggccuccccccagucaaugggagcccucgugacggucuacaggacaguccuuuaagcagcagggcaacccagucucaggcugggaucauuucuucuaggacuaauaagagagcuucauugcugauaccucuggucucagaaggaugaggauccuugacuccuaacuccagaacuccuuccccuaccuuuuacaaaagaggccucgcugguuaacagcagccuguuucuuauaaaguacuucaccagaugcuggcgugcaccugccugaauggcucagggugaacuauaucacaacaucuccaaguacaccaccgccacgcaguuuaacuggcccugcuuggacugaguucccuaacccugcuugcuucucuggaaucaguuagaaguagguggcuacugagugggauuaacugugguuuagagagugugcuuucccagaccaugucuuaugacuacaccuaguucccccgggaagauaagagaugauaguuccucauuccuucauccuuagagucuuccugauccuagcauuagccaguacugggugauauuaucucuaaaggaaaaguuugagauucugacauccugaaaaccauugcagaugcagugcaggcuuuguaaugcaaaccacugcaggcuugcugcuuccacuucuaccucuauagucugucaguuugcuaauuuuuaauuucuaguauucucuuuuuuccccauuuaaaaacaacagcuacauuuauuuagcacuuacuaagugcucuaaaaauauuaacucaagguaauccuuacaacaaucaaaauaguggagcugggauugaaacucaggcagccuaacuccucaugugcuacaccuagccacugcccucuuuguucuagcauucuguauggggcaggaagucaucacaccuuauuaccugacauuggcauuagaacaauuaguggccuuucagauaaaaugggaagaaaacugagccuguuauuguggaucuuacauguuucauccaggaucggucuuucacuccgagaaugucuaugugucuguuuuucucugccuuucucccaguucuguagucuucauuagacgucguguggaugugauggacccugcccuuuggcugccuuucccagcuucuauggguauuuccuuucagucuuccagcacacagagaagaauguggccugacucagguucugcccaagccccguggcacagggcccuggagagagaggucuggguaacuagguugguuggacugagaaauggaaguaccucuuguuugccuuucuaauaauagcccugaacauuagccucgugccauuauuuuggggagcguggaauguguggcagccaccagcucauuaaguuucauucacuucccuccagggacgaugcuuuggcaggguuuauggguucaucucuuuuauggaagggggaaacugaggcaucaagacuucacugggggccaggcaugguguuucacaccuguaaucccagcacuuugggagaccgagauggguagaucaccugaggucaggaguucaagaccagccaggccaacauggugaaaccccaccucuacuaaaaauacaaaaaauagccgggugugguggcgugugccuauaaucccagcuacucgggaggcugagaaaggaaaaucgcuugaaccuaggagauggagguugcagugagccgagaucgcgccacuguacucuauccugggccacagagcaaggcuucgucuccaaaaagacaaaacaaaacaaaacaaaaacaaaaaacacuucaucagagaggcacggaugguuagggacaguccagcaggauuuggaauagaaccaaggaaccucagucucugaggcucuacaugcugggcugcccuucacaaauggggaagugaagagggugaggaagugggaugggucaaaggagaacggugcggaaagaucaaaagaaucagaugcuacaagcugcuuguagcuggugagauuugaauauauuuugagugcugggggcuguaucuggagggcugacuggaagggggcuggagaaagguuaaauuuaaccucaguguccuaaccuggugcuaggguaaggguagggaagggcguagaacaacuugcaaaaggcugagagugcuucccuuucaggaacucacugugauuggcaugugccaaauggguucuucuguaagcccucuaaacacuuuaaauccacucucaugccccuguccaaugcugggaaaguuguuucaaaugaacaucaacugaaggccuccgugcucuuaagaugaaauuuccuagggaucuuuagaaggagauaaauagggaauagggcagaaguacuuuagggaccuccccaucuggggaggacccaggaggacccuggucauuggaaaccugcucauuggcaugccacucuucagcucagaugacccagcuacaggacugugauccugcuacaaguauacaaguauauaugugaucugcuauagcccagggacugggguguuuugacuuaguaguauuggaaggugugagguuccuggaaugauuaaguguuccuauuaguuuccaaguuuccaugguuagggcaagguggcagugggaugaagaggauagugggagagaagcuaaggauaaaggggaaacccuucaugacgcuauuuauaaacaugccagccccccucgcuccgccccuuuucuccugucaaacaauucuuggguuagaguugcgucucuugcugcccccgccccugaggcacuaagguguuuccuucagccuuguggagugaguguguugcugguuaggagcuggguacuugugcacacaugcagauugccaucugcgugggugggaccuuggggagaggggaguaagucagaaugcugaccccuaggagaaaggcuuaagggucaagggcagaagaaucacuaccuaggauagaagagggagcugagacccugaaggauguguuggagucaggagagagggggacaugguccuaucugcuguugagcuuuggccugcaaaguguguggaucuguuguauuuuauggauacgcuugugcauauaucuggcuguggauuuagagaucacuuacaucauacguuucuguucaggauucugaacuuugaggcaaucuaguccuggcuccucaggagaagugcccuggugggacugaggaagacaauguuagcuggcaucuggcggcugugcaggcacaaaccugcuaggcagcaagugcuuaggggguugcuggcaucagcucuaggggagugccaaauggcuaccuagggguuccugccagccuuucuagacccugcaauacagauaucacccaucguucuucaccuucccucgcaagaugucacuagcuauaccucucugcuggcaagagugcccaggcaguguggguggcagcagggcgugcaagcaucaggcguaggcggucuggcagcuccaggaguuugcauggaggugcagcgagcgugccugccuggcugggaaggaaggagggaggaggagggcggagaaggggagccagcuccgagcuccagaguggcuauuuuuagccaggcuaucugauuguuaccgguaggcacacagcugggugucucccuggcucggugaagcccagcaggcugagaggugggagguccuuguggaugacuucuuccugguguuggugucugugggcgggagcgugcaagggguagcuuaaaaagugugagggcagcuguguacuucaggauguguugcuucugugugugacuuuguccucuggugguaauguaugcuguauauguaaucgugaucucuguguaugugcuucacuguuuaugagucugucugcugguugucauguauacuuuaugccugggauauaucuaauaugccucaggugcacaugugugugggauaaaaagggcaagugcucguaaugcaucuaguaggaaacaucuuuagacguguuggugugugcuucauccguguauguuuguauuuagguagacuuuugcuuuauauguacguucgugccgucuaucugugcauguuguaugaaaauauaacaggugucacaugauugcagaauggacuuuuaauuuuaccugcuaucuaagugggguuuuucuuuuuucaaacccauuccuacauaguuuaaaaauacuauguuguagggcuaugaguaaggugaauugaggaaauagcuccauuuggugugaaguuuggucucuuuuagucuuacauggagaggccccuuggcccugcuccacaauaagauguaggguaacuagcaguccaucaucugguagauagaucugcuuggggauucugggaacaccugguggaaggccaugccaugggugucuuaugggaaugagaguaggaagaaacucuacuucccucaaacaaaaggauuugaguauuacuugcccccaguauuuucgucuccucuuugucuucucugcagaacccagaaguaccauggcuucugaccuagagaguagccucaccuccauagacuggcucccccagcugacccuccgagcuaccauugagaagcuuggaagugccucccaggcugggccucccgggagcagccgcaaguguucaccagggucacccacagauccuaaugccacccugagcaaagacgaggcagcagugcaccaggacggcaagccacgauacagcuaugccacucucaucaccuaugccaucaacuccucuccagccaagaagaugacccucagcgagauuuaccgcuggaucugugauaacuuccccuauuacaagaaugcuggcauugguuggaaggugggaaugcuucuauaaucuuggcuuagguuuaggcuucaacagccuuuuuagagaaaaagguuuuguuucuucuuguaaccuguucaguuuacucugguuugucucagagaugugaaaacuuaaaaucucauauguucugcccucuacuuuuuuuucagaguugaacaacuuuuauaagguauauuagggaaacuccaagccauuaaguauagugauggggauggcaggacgcuguugcucaucacacccucuuaucuucuuuuuuuuuuuugagacagagucucguacugucgccugggcuggggugcaauggcaugaucucggcucacugcaacuuccaccucccagguucaagcgauuuuccugccucagcuuccugaguaguugggauuacaggugcccgccaccgugcccggcugauuuuuuguauuuuuaguagagauaggguuucgcuauguuggccaggcuggucucgaacuccagaucucauuauccacccgccucagccucccaaagugcugagauuacaggcaugagccacugcacccggcccacauccucuugucuucugaucccucaaagaggauauucacucauuucacaaauguuuauugccauucuacgauguuccagucacugugcaaggcauggcaucacuccuuccuaccuagagguaggagucuaaucuagagcaucagauuuccauagcuccauugcacagucaucaucuuuugaaaagcugcauuccaagaaaaaucauaauauaauuagguucuuuacaaacagcuggcuaccaagcaaguaaugagaaguuaaguuguuuggcuggagaugaagaaagaaggggcuccucuccuaagcaaagcaagaaggcugauaggcucaauuuuuuggagcaguagcucauuugucaauuguugaguaggaauaggaacuuuauauguaguucucucacucuauaaauccccaguugacauacaaaccauguagugaguuggagacuauugaaagcacucagcuuucuuuucuuuucuuuuuuuuuuugugggggugggggacagggucucacuguccccagacuggaguuuaguggcgugauaucagcucaccauaaccuccgccuccuggguucaagcaauccuccugccucagccucccgaguagcugggauuacaggcgccugccacugcaaccagcuaauuuuuuuuguauuuuuaauagagacgggguuucaccauguuggcugggcuggucuugaacuccugaccucaaaugauccaccuccugccucagccucccaaagugcagggauuacaggugugagccaccguacccagccucucuuuuuuuuuuuuuuaauuuuaagacagggucuugcucugucacccaggcuggauuguagugguacaaucacagcuuacugcagcuugaaccugggcucaagcaauccuuccaccuaagccuccugaguagcugggacuacaggcauacaccaccaugcacaggaacuuuuuuuuauuuuguagaaaugaggucucacuguguugcccaagcuggccucaggcuucuagacucaagugaucuucccaucucggccucccaagaugcuggaauuacaggcaugagccauugugccuggcccauugagcuuucccuuuguaaauaugucccugcuagcuaccauaauccccaaucccacccaacacacacauuuuuuuuuuuuuuugagacggaguuucgcucuuguucacuaggcuggagugcaguggcaugaucugggcucacugccaccacugccuccuggguucaagcgauucuccugucucagccuccugaguagcuaggauugcagacaugugcuaccacgccuggcuaauuuuuguauuuuuaguagagacgggguuucaccaugucggcuaggcuggucucgaacuccugaccucaggugaucagcccaccucagccucccaaaguguuggaauuauaggcgugagccaccacgccugaccccaacacacuuauacaauauuucuuuccuccaaaugugaacauucuaugggcuauugagaaaaugaaggugaucuguguuuuuguuucacucaauuuauauaaaaaguuuuaaaacauuguucuuuugcuaucaguaggguagauugaggaacugggcagaugugauugugaggcauuuauauacuuguuacucggcuggaaagauugaaaaacuauauaaucaguuuuuucagaagcauuaguaaucaaauuuauagccauucccucccaucaguuuaaucucugcauuuuucuuaucucauugcuauugcuauuugaugcauaauucccuccaucgguguaguuaagagguacugagcuuacccugauacuucaacugcaugguguauuauguuuuuuugugugucccucuguguucuauuggaaaauguucugcucugcauaaugcucaggccuaacuugcuucucugccucuccagaauucaauacggcacaaccuuucucucaacaaguguuuccggaaggugcccagaccucgggaugacccugggaagguaagauacuacuguaagcauugaaaggaggaguaggaaggagagugaaguaguugacaguccagaguccuguggcuguuuuaauuacccagaagaggaaaucaugcuaauuagagaagcaucuuuauuuuuuucucagaggaagcuugguugucaagcuuaugggcccccaguagaaugggugacugagaaagacugugaggccaggcgugguggcuuaugccuguaaucccaacacuuuagguggccgaggcgggcggaucaacugaggucaggaguucaagaucagccuagucaacauggugaaaccccaucuguacuaaaaauacaaaaaauuagccaggcguggugguacaugccuguaaucccagcuacucaggaggcugaggcaggagaauugcuugaaccugggaggcagagguugcagugagcugagauugugccauugcacuccagccugggcaacaagagugaaacuccaucucaaaaaaaaaaaaaaaaaaaaagacugugaaaucuuuuuuuuaaaaaaauagaaauacuuaguguaaaguugacuuucaugcucccccuuuuuuguguggcacucuuuuuuccuagauguaaaagguagacuuaauaaccuuuguacaaacaucucuauacaaaagucccugguguuucccccguaaaagagaagggauggaucauucucuccauuugacagauguggaugcuaaaguccaagcaaguuuugccucaggucagaagggaagggagaggcugugucuggacauuuccagcucuuugagcuagaugccauuguucugccccuccaaaacaaucgaggccuguguuuggaccacaggauuaccucuggcauacucagugaguuucuaggacaaauuugcucuucauuaauacccagaacccugggagguucugaauguaacaauuuuguuuucugugggaaugggaucuccuuccaggguuccuauuggacaauugacaccugcccugacauuucccgaaagagaagacacccuccagaugaugauguaaguucccagcucaugaggagaugccauaucugagccagcugcuccuuccaccuccucuuauggacguucaguccuuucagaggcaaagguggaaggaauaccagcagaggggaaaccaugggucuugggaggauauugcgccucugcuuauagauuucuuuuuuuucacaacccucagcugucccaagacucaccagaacaggaggcaagcaagagcccacggggaggcguugcagggaguggagaagccucacugccuccugaggggaauccgcagaugucacuucagagccccacaucuauagccagcuacagccagguaggaagcagauauggcaggggucaugggauggguggugaauagauucagaugucucccuguuuauucagaauuauguauugaguaucugugauauaugaggcagauaaauugagaaggaaggggaaggcaaaagagggaaauagagagagagagaaauagaaaggcauagcagaacuuugagaaacaucaggaaaaaaaagcugggcacaguggcucaugccuguaaugucagcacuuugggaggucgaggcaggcggaucacgugaguccacgagcuugagacccgccuauccaacaugccaaaaccccaucucuacaaaaauacaaaauuagcugggcgugguggcaugugccuauaguuccugcuacuugggaggcugaggcaugagaaucacuugaaccggggagguggagccugggcgacagagcgagacccugccucagaaacaaacaaacaaacaaaaaagaagaaauggagacugaugagagaaagaggguagauucaagauaagaacuaaugaggaaagaaggagaaaaugaugcugggucauugaagagcuaggcgaggaugaagaggacagacaggagagccuggugaccauugaaggguuuuauuggucccucagcugggacacugaucaggaauuucuuaccuguuuuugcagggcacaggaucuguggaugguggagcaguggcagcaggggcuucaggccgagaaagugcugagggucccccuccccucuauaacaccaaccaugacuuuaaauucuccuacucagagaucaacuuucaggaucuaagcugguccuuccgcaaccucuauaaguccaugcuggagaaguccucuuccuccucucagcacggugagucuggaguugggaugggugcagggagacuuuuuuaucuuguugaacaaguggggugacauuuucuuuuuucccuuaguuuuuuauuuuuauuuuuugugagacagggucucacucuuucguccaagcuggagugcaguggcacgaucugagcucacugcaaccuccgccucacggguucaagcaauucugucaucucaacuucucgaguaucugggaguacaggcacgugcuaccacgcuuggcuaauuuuuguauuuuuuuuuuuuuuuuugagauggagucucgcucuugucgcccaggcuggagugcaguggcgcaaucucggcucacugcaaccuccgccucccggguucaagcaauucuccuuccucagccucccgaguagcucagacuacaggcgcaugccacacccagcuaauuuuuguacuuuuaguagagacaggguuucaccauguuggccaggcuggucucgaacuccugaccucaggugaucugccugccuuggccacccaaaguguuggaauuacaggcaugagucacugugccuggcuuaaguuuuguauuuuuaguagagacaggguuucaccacguuggcugggcuggucucgaacuccuggccucaagugauccacccaccuuggccuuccaaagugcugggauuacaggcgugagccaccgugcccggccauauuucuuucuuuauuuuuuugaggcacaguuucgcucuuuguugcucaggcuagagagcagugucgcgaucucggcucacugcaaccuucgccucccagguucaagcaauucuucugucucagccucccaauuagcugggauuacaggcucccgccaccacgccuggcuaauuuuuauauuucuuaguagagacggaguuucaccacguuggccaggcuggucuugaacuccugaccucaggugauccacuuaccucagccucccaaagugcugggauuacaggcgugagccacugugccugacccauauuucuuauuuuuaacacaaagagagguaucacuacucagaggaaauauuucaugaacuaaaacuguuuggagucaagugagcucaucuguccuugugcaaauacagcuguuucaggaggcaagcuaggcuaauagcuucagaaagugaauuggaggauugccccuuccaggacuaagggcagugauuuuagggcugcaagugagucauuuggaggacgaccacgagggggcagcagcaguacccucuccugaagaaucccugcguuucauugugagaacaguuucuuuuuaguguauuuacauuuauguuacuuuuauugugaaaaauugcaaacagaugcaaaaguguggagaaaaauauaauaaaccccuguguuccaucccccaacuuuaaguuaucaguauuuuauuaggcuuguuuuguuuaccacugagccuucuaaaaauuggaguaauuuaauggaauucacauauaccaugucauuccacucauaaauacaacuucgauauacaccucuaaaugaugacuuucuucuaguuaucuaccaugacauuaucauuccuaacauaauugauaauacauccuuaauaucagcuaguaucuuguccgugcacauuuuccuaauuaucauaugagaaugacuuaaaguuuuuacugggaggccccuugagagaacaucugguucggcccucugcaauaucuguguguucguuuuuuaaauaacuuagagacaguggugaaguugauuucaggugaggcauuagaccuucucauucugugcaguagcccuauguuggcagcaggggcugaauggaaugauaaaaacugguuaggagucacuuuuuggaaaacuuauauucauuuucaugaauuucuucuuguauaucacaggggaucaauuccuagaguaguguccaagacuguagcauuugcucaaaaaaugaauccgacucaggugguugguugauuggaggagggaacaugagaaacugucagaaauaaaguaaaaaauuagauugggugaggacagccuagaguucacucaaguuuuauugugaccgaaagccccuagucucagacuuuuguucuucccagccugucugcuugagaaauaacuccauccugucucugcuccuuacccaagcuacauuuguuuauagaggguacaggaaugacuuggcaguagcagaguguagagaaaauaaggggccggucguggugucucaugccuguaaucccagcacuuuggaaggccaaagugggcggaucaccugaagucaggagcucgagaccagccucaacauggagaaaccccgucucuacuaaaaauacaaaauuagccaggcguggugguacacaccuguagucucagcuacucgggaggcugaggcaggagaauugcuugaaccugggaggcggagguugcggugagccgagaucgcaccauugcacuccagccugggcaacaagagcgaaacucugucucaaaaaacaaaaaacggaaggaagaggagauaguagacaacugauggcuuuguuuuguuucugauuuacuuuuuuuuuuuucccuaaacacuagaugaccagggaugguuuccuuuuuaaaguucaccugcugggaaacugugauuucaggccuucagccaaaucccuaaaaaguagcauuaaaugcuacacacugaccuuuuuaguaagauuucaguggucuccacacugucagggcccuccucuaaccuaagugccuuccugucucuuguaccugccaggagggccacagggaucuuugcugcccuagaauguucuuacccuuuuaacuccacaguuuuagucugaggcuucccaucucaacccagggaaaaucccauuuugugaaaaaugcauugcuuaagucacuugccugcuuccuccccaccugcaggcuuuucuucucuccugggggacaucccacccucgaacaacuacuacauguaucagcagcagcagccaccgccaccucaacagcagcagcagcagcagcagccgccacagccaccuccccagcagucccagccacagcagcagcaggcaccugcccagggccccucagcuguagggggugcuccuccacugcacaccccaagcacagaugguuguaccccaccagggggaaagcaagcuggggcggaaggcuaugggccucccccuguaauggccaugcauccacccccgcugcagcauggaggcuaccacccucaucagcaccauccccacucccacccugcccagcagccaccaccuccacagccacaggcacaaggccaggcucccaucaacaacacuggcuuuggugaguaaggagggugcacagugaucuagaggaggguggggugauguccuuguccuaacaccggcauggaggugcaguuaguuaggaaguuaaugaugggucuuuuaggcuucgcuccuucaugugagcuaaucugaacaaaguuacuacuuagagcucugucuuauagaauuccuggaucaauugagauuguuuuacauauucuccugacuaugagccuggcuguacuuaaagcguagcuagcuuuuccaguccuaaacucccagggagggagaguccaaaacuuggaaaugcaacugcuaaucuguauagaugcaagaaucuugcauguagucagccugguaucaguugacugcugucuuacacuucacucuaucuuauuauccacuuuccccuccucuuuacagccuuuccuucugacuggugcucuaauauugacucuuuaaaggaaagcuucaagauggugaaucggcucaauugguccagcauugagcagucacaauucucagguuagugaucaaaggacgaaggaagagagggauacacuguaagggaaaacccaguagaaacuggaaccggaagggggugguuaaaugaaguugcagaaaugaggauuucauuguuuuucuuucuuuuuacacaagauggaucauauuuacauuauuuucaaauuaacucaaauuaaucuugucuuaacugaaaauguggcagugaauaauccuaguccauucugucuuugggagggagaaggcccucaggaauuuagagaccguggaccacgauuuuguaguuuugucaccacucacugacagugugaccuuggcugagucacucagucacauugaaaguuuaucuuacucaucaguaagauggcaauuauaagaauuugguaagggaucaaauagaaugagaguuugaaaaugcagagcucugaaagauauaaauuguuauuguuagugcccguuaucagugggggugauugaugguguguuuggaacagugagauagggcggggucugauaggggcuuccuaccucugcaagguuugcauugcuugcuucccucuuuguagaacugauggagagucuacgacaggcagagcagaagaacuggacccucgaccagcaucacauugccaaucugugugacucccucaaccacuuccuuacucagacuggucacgugcccccucaaggggguacccaccgcccaccagccccugcccguauugcugacuccugugcccucaccaguggcaaacaggagucagccaugagccaagguacugcaccaagccaguugccauggagguggagacuauguugaaaaggaagcauaggagaaaggcaaaagagaacugagagaaaggauuuuauggggcagugacccaaauugagcaguggaacuaguuuaucaguugacugaauaucuguugaaucagugaaguccuaaacugaaaaaugcaaaagaaauagacuguaugauuccuuuuuagaccucaguuugggagaucagaauuguuuaagaaaagggaggagauuuguuagagaaaggcuguauuuuaaauuugcgucucaguaaucccuaccgccugggugauaccggaugaaauggugguucuaugcuuaugugauguucaaacuagugaaaugagagagaugucaugauuauguuccuguuucuugcuuuuuguuuuugagauggggucucgcucugucgcccaggcucuggagugcaguggugugaucacggcucacugcaaccuugaccccuggagcucaggugauccucccacuuuagccuccugaguagcugggacuacagguguguaccaccaugcccagcuaauuuuuuuuuuguauuuuguguauagcugggguuucaccgugucgcccaggcuaucuucaaacucuuggacucaagggaucuacccaccucggcugcccaaaguguugggauuacaggcaugagccaccauaccuggcccuguguuucuauauuuuucuuccuuauaucuuuccuauuucacaauuguacuauccauuucuuuuuacccucaguggugaggacugacagcuucugcagaaagccuucaugccugcaggagcuacagaacagggcagggaagagagaaggaggaugggagcaaggguauauuuuuuucuucccugcuuuguugaguacagugacccgccccccccaacucaaguaacucuugucuugcuuuggcagugaacucuuaugggcacccacaagcuccccaccucuacccuggcccaucaccaauguacccaauccccacccaggacucagcaggauacaaucgcccagguaagagcuaagaagcuuguuucaaaaccguuguacucugaugaguugcuuugcuuuccuuugacucugagcuggcauucugugcauuuuugccugcaucucgcuggagggaaugagccuuuauaauucccaaggcuggaggauggguuaccugcuaagaaggugugugucggggagacuaacgaagacaguguccccuccccucccuuccccucccuuccuuucccuuccccuucccuucccuuccccuucccuuccccuucccuuccccuucccuuccccuucccuucccuuuccuuccccuucccuuccccuuccccuucccuuccccuuccuuuccucuucccuuccccucccuucccuuccccuucccuucccuuuccuuccccuucccuuucccuucccuucccuuuccuuccccuuccccuucccuugcccuuccuuuccccuucccuuccauucccuuucccuucccuuccccuuccccuucccuucccuucccuuucccuuccccuuuucuuuucuuuucaacagagucucgcucuguugcccaggcuggaguacaguggugcgaucucagcucacuacaaccuccaccuccuggguugaaaugauucuccugcuugagccucucaacuagcugggacuacagacccacaccaccaugccuggcuaauuuuuguauuuuuaguagagacgggguuuugccauguuggcuaggcuugucuugaacuccugaccacaagugauccaccugccucugccucccaaagugcugggauuacaggcgugauccacuggccccggcuagauguacuuuaaaauuagcaacugcaauaguaaaaggaagugaaagcauacauauaagcaaaagauagcuaugugcaacauuuuuguguggcuuuggaaucuagauggaagaugugcucaggcaaauaaaaugaauuuguuauccacacauacuugcugugugcccaugucugcuuuccugucaccugaucucuagaaucaggggucugggacugaaguaucucugauaguggggguggggcagggagacacuaaauugccacagacagaacaaaaugaacagguccuucacauuuagacacauagaaaaaucacuguuauucugccuaaccacacguguuuucaauuuugggggugacaucugacucucucuauucuuuguccauauaauauaaauacagauuucuauacugcuauuucaugugauauuaucuucuguuuguuuguuugagucagagucuuuuucuguugcccaggcuggagugcaguaggcaauggugugauccuggcucacugcaaccuccgccucccagguucaagugauucucgagccucagccucccgagcagcugggaucacaggcgcccgccacugugccuggcuaauuuuuauuuuuuaguagagacaggguuucaccauguuggccagucuggucuagaacuccugaccucaagugauccacccaucucggccucucaaagugcugggauuauaggcaugagccaccacgcccagccauaugauauuaucuucuguauguuauuuuaucauuaucauauguuuucagaaguacaauuuuuuuuuuuuuuugagacggagucucgcucuaucgcccaggcuggagugcaauggcacggucuuagcucacugcaagaccucccggguucaugccauucuccugcuucagccucccgaguagcugggacuacaggcacaugugaccacacccagcuaauuuuuugaguuuuuaguagagaugggguuucuccauguuggccaggcuggucucgaauuccugaccucgugauccgccugccuuggccucccaaagugcugggauaacaagugugagcaacugugccuggcgucagaaguauaauuguuaauggcagcauaauauuuaauugcuguggaauguaauuuacucuaguuuauuuccugagaccucacugaaauggugaccugcaaccaaaauuaacuccagcugauaagggcgauagccucacaaggccuucuucgugguguuaucuggggcugagcacuguccuuguaaauugagggaacagcuucccauccacucuccuuuuacucucuuucuuucuuucuaacagcacaccauauggucccucggccaucagugccaccuccuggugccaaugaggagaucccugaugacuucgacugggacuugaucacuuagugcaucacagaguguggacaucagcccagggccgcguggugaaaucuggcaguggggaaagagcaaccccagcccgucccuuccccccgucuguauauagacauauauccucuuuuuguucuuucucugucagagaagccacugcaagaugcugccgaagauaacccucucuuuccugccucauucuucucucuuccuuccuguuuuuuccuaguucuuuuauuauuauucuuauauuauuauuauuauuauugguuauauacuguccauagucuccugucccuacaucauggaucauguccaccuuuugcuaauuuaaaaucaucaggcuggaagaugaagccaugauagcuacagagaaagguuuuagacuccaguuuaccuuucucuuggagaaacucaaugcuaaucccaccuuuuggcccuaaauuguuuuuuguucccaucaguuucaggccaggacuggagaggccacauuaccaaguagaaagggucugaaacauuacuuggcagccaagaauuuggagguuuuaaaauggugcuaauucuguccucugaggucuuccuugucccuuuauaccuucaauccuuacuucugccagucuguauuuccuaucaagggugaaagugaugaugguggugcaggagggugacaauaaaauccuaguggaauuggagaccauuggaagggauggaauauaagucagugugaaacugaguauacacugccauguuacaucaguguccauuggcuuguuuugagccuguucucuaagaagauaggauugguuuuagcccaaacucugcuucuaugguagggcaugaggacaacuauucagcaugguuuuagcuucuuggagaugauuccaacuuaacuauuuuggcuuuuuaaacauaauuuucucugaaaauuaauuguggcucuuauuugcauuuacgaaugaucuucccaucccuuuuucccauucagcaaauauuaguuuguccuccuuuaauuguuugcccaaaucuuccacccaucuuuuuucuucccucauuuucugggauucucaagaaagaaaaaguaacccauuaucacucugaguuucgucgugcccugagacaugaugggaaucucauucccaccucucauagcagagccaaaccuuuaguguuggugguaggaggauggggagaggaaaaaagagcuggcaaagaaauggauagggaauauuuuaguucuuuaaauauauaggcagaugcuucucuuggaauccagaucaucuggcugaagcuuuugcaaguaggcuuugaggggugaaggagauugguggaggagaguaaauaaucuagaggcaagaguucagugagggccaagggggacccccagaaaaagguauggagcuaacucaucucuuuuacaagggguggccaugacuuacuguugcaaaguacucaguguauauuuaauguugauuguugaauuuuaguuacgagagggaagaacaauuuuacuucuguccuuauuucacuugcugaaaagcugugggacaaaauguauggaauagacaaggccacuuucuuugugauuucugcuuuucaugcauauuauuuuauuuacccauaauuuccaagagguuuggcguuccgcucuccugcuuuuuucuuucauccaccccuuuccuuuuuuuggaaggggguuauauaugagaguucauugaagaaguccagugaggcugaaguaaaggggcaagauagggcaguuaacuaaagagcacuuuauuucuuugaagccuuucuaagaaagaaaugggggugcgaguggcuugaaucucccaugauguuggagggcacuuagugggguugaaguaugacauaauauuucccauuggggaaaggagaauuucucuuagaggguggcaaaaugccuuugcccagugucccuauuuuaggcaucuuuuccuuccuuauuccuuccagucaggguguguccuauacaaaacuucccaucaguucuccucaauauuccccauuuguaaaugaucacuucucuuuucuaaacccuuuuccuguucagauccauacaggauuugcaaggguaggaucauacaugcaaaugccccuuguucaucugugucuucugcaaacuagucucaugaagaauucuggcgugcagccaggguagcugaaguuugggucugggacuggagauuggccauuaggccuccugagauuccagcucccuuccaccaagcccagucuugcuacguggcacagggcaaaccugacucccuuugggccucaguuuccccuccccuucaugaaaugaaaagaauacuacuuuuucuuguuggucuagcauugcuggacacaaaguguagucauuauuguuguauugggugaugugugcaaaacugcagaagcucacugccuauaagaggaaauaagagagaaaguggaggagagggacaaaaggaguaauuauuugguauagauccacccaucccaaccuuucucuccucagucccugcuccucauguuucugguuuggugaguccuuugugccaccacccauaaugcuuugcauugcugcauccugggaaggggguauauggucucacaaguuguugucauuguuuuuuugcaugcuuucuuaauaaaaaaaaaaaaagaau

SEQ ID NO: 14885 - RNA, 9603 nt, Homo sapiens
cuuccugugaggucagauaguggucuagagcauaagacuuaacuuauugccggaaacagagagagaacagaagaagagaaagcucagcaaauuuucuugccauacuucaugacuucacuguggcuaaguguggggaccagacaggacucguggagacauccaggugcugaagccuucagcuacugucucaguuuuuugguaagaaaaccuagaccuaccugaugacuugugcuuagccuguuuugcucauuauagguaaugaguuugagugucacuaucuucuauuuccccuauuccuucucugacuuugaauucuuuuaucuuaucucuaugucuaacuuccuuuuucuaaauauuccacauugcauuugucuuugcuuuuaauauuuucauaguggaauuaauagugaauuuuuacaucauuucuuuccuuucuuugaauuggcuauguauuucacccugaacuuugauuccagcuguccccauuaauuuguuuuucaaauaauugauugcacuuuuuuucccuuuccauuuccucuuucuuuuuuuuauucuuuugcccauuccuuauugcuacugacucuguuauccuauuacuacaauuugauucugggguccacuuuucuuucucuaucacaguggaauuuuaguuucaggauauuaauuaccuuuaaauuacggcuggucaacuuaguaauaauuuuuuuuaauccucuacuaaucuuaaacacauaaagguaugguauuuuuagccaaauuaacuugaagaaauguaaaaaguaaucuugcucugcaggacuuuuuuuuuuuuuuuuuuuuuuugagacagagucucacucuguugcccaggcuggaguacaguagcaugaucucagcucacugcaaccuccgccucccagguucaagcgauucuccugccucagccuccugaguaggugggauugcaggcacgugcuaccacacccaguuaaauuuuuuuguauuuuuaguagagacaggguuccaccauguuggccagguuggucucaaacuccugaccucaggugaucuacccgccucugccucccaaagugcugggauuacaggcgugagccaccacacccagccuuguucuaaaggacuuuuaaucccugacuccuacauacuuucauuucaaaacagauaauaacaauauuuaacauauagcucaugacagauaacucuauuuuuauuaaaauuuugcuguuugcagucccugcuacuucaguucaugcaguucucggcagcuuccccuuuauuagcaauaccauauaucuuuuuuuuuuuaaugugauuuuuuuuuuuuuuugguaguaaaaacagcauuugccuaacaguccucggaccugaaauccaagaaccucccuaguaaugauuauaugcuuguaaucuaauuugcugaguuucacugucaaacuugagaaauaaaagcagagaaaacguaggcugggcacaguggcucaugucuguaaccccagcacacugugaggccaacaugggaggauugcuugaguccaggaguuugagagcagcuugggcaacauagcaagacccuaucucuacaaacaaacaaacaaacaaacaacaacaacaacaacaaaaugaggagaggagagaugauuaccaaguuuucuuucagcccuagcaucccaugacucuauucuucucucaauauuuuagggggguaccgugauaguauuuaaauaucugaguagacaaggccauggaaaggggaaugagaauaauuucuucuucuuuuuuuuuuuuugagauggaguuuugcuuuuguugcccaggcuggaguguaguggcgcaaccucggcucaccacaaccucugccucccagguucaagcgauucuccugccucagccuccugaguagcugggauuacaggcaugugccaccaugcccaccuaauuuuguauuuuuaguagagacagaguuucuccauguuggauaggcuggucucaaacugaccucaggugaucugccugccuuggcuucccaaagugcugggauaacaggugugagccacugugcccagcccaugucuucuuuuuuauuauuuuguugacuugcuauuuuaacuucugcuaaucauaugaggcccuauggcaauauuuggcugacucagcagaacuacuuucaagucacaaaaauauuuugagccucuauaaaaguaaaauguuauuuuauccaguaaaaauuaggaauuucacaaaaagaaaguuaaaagggacagcaugggaauuaaggaagaggccuggguaaggauuacauggauacaaauuagaauuuuagauguaauugcaaaagaaaaaaaaagucaacccccaaaaugggcauccaucuauucaaguaauuuuuuuuuucuuuuuuuuucuuuugagacagagucucuuugucaugcaggcuggagugcaguggugcaaucucagcucacugcaaccuccaccucuccaguucaagcgauucucgugccucagccucccaaguagcugggauuacaagugugagcuaccacacccagcuaauuuuuguauuuuugguagagaugggauuuugccauguuagccaggcuggucuugaacuccuagccccaagcgaucuucuccccucggccccccaaagugcugcgauuacaggcaugagccacugcgcccagccuuuccacauaaucuuuaaccuuggugucucauaaggcauuauguuaaauuaugugaaaugagcauuuaugaauaagacuccuuuuuaccaucauaaaguuuaaauccagaauaauagauuagacagccauuauaauuauuguacaagauaaaaugugucauugcauauagaauaugaaaaaaagguucaaacaugcgcacacacacaaauuaagaagcugaagacuuggugaagggcauaauuccagauagaaguaaacagcauuagccauggaacggaaaauggcauuaaguuggaauagugaauuguucaggaaagcuauaaagcaggguacauuuacgagcauguucacaguuaggggaagguaauaucacagaggccaagagaagagaguguuaagaagucaguguaucuaaugacacauauuguggaaggugacugagaaacaaacguuuggauuugguuuuuagaaguaauuuuagcagaauuauggaagcagaagauacauuacaaagaauuaagaaguugguggccggccgggccugguggcucacaucuguaaucccgggacuuugggaggccgaggcgggcggaucaccaggucaggaaaucaagaucauccuggcuaacauggugaaaccccgucucuacuaaaaauacaaaaauuagccgggcguggugguacacgccuguaaucccagcuccucgggaggcugaggcagaagaauugcuuaaacccgggaugcggaggcuguagugagccgagaucgcaccauugcacuccagccugggagacagagcgagacuccaucacaaaaaaaaaaaaaaaaaaaaaaaaaagggccgggcgcgguggcucacgccuguaaucccaacacuuugggaggccgaggcgggcggaucgccugaggucgggagaucaacaucauccuggccaacauggagaaaccccguucucuacuaaaaauacaaaaaaaaauuagccgggcaugguggcgcaugccuguaaucccagcuacugggaggcugaggcaggagaaucacuugaacccgggaggaggagguugcagugagccaagaucgcgccacugcacuccagcgugggcaacaagagcgaaacuccaucucaagaaaaaagaaaaaaagaagaaguuaguguucagaacaguaggcguaggccccaaaacaaagcaguauccuugaaaaagagaaauuaugcuaaauuaagagacuuaagaagaaagugcgaucugaaguagauauugucguggacaagccagcuauaaaagaugucuuagggacaguugaaaaauaaucauauaaaagggggggcauggugguucgugccuguaaucucagcacuucgggaggccgaggaagaaucaguagagcccaggaguuggagaccagccugagcaacauagcaagaccccaucuuuacaaacagaaacaaaacagauaaaggucggguauuccuuaugguacauauuguauaauguggagacugcuaacugaaaaaagaaaaaaauguauaaaaaauauguauuuacacccauguucauugaugcauaauucacaauagucaaaaggugaaagcaauccagauguccucuguggaaugacuggauaaacaaaaugaaguauagaccuacaauggaauauuauucagccuuaaaaagaaagaaaauucugacccaugccacaacgcggaggaagcuugaagacauuaugcuaagugaaauacaccagacacaaaaagacaaauacugugugauuccacuuagaucagauaucuaaaguagucgaauucauagaaauugaaaguacaauggugauugccaggggcugagaaaaggagaaaauggggaauucuuuccugagcacauuuucaguuuuguaagaugaaaaaguucugaaaauugguuguacaacgugaauaugguaaacacuacugaacuguguacuuaaaaauggugaagaugguaaauguuaugauacauguguuuggcaauuaaaauuuuuuuguuagggccaggcgcgguggcucgcaccuguaaucccagcacuuugggagggagaggagggaggaucacucgagccuagcaguucaagaguagccuggccaacauggcaaaaccugucucugcuaaaaauacaaaaauuaguugguacguuggugggcaacugcagucccagcuacucaggaggcugaggcacgauaauugcuugaacccgggaggcagaggcugcagugagccgagauuguaucacugcacuccagccugaaugacggagggagauucugucucaaaaauaauaauaauaauaauaauaaauaaauaaaugaagcacugucccacauauuagaaggcuucuagccaucacagccccugcugucuaaagauacgcauguguauaccuaaaugcacacacacacauaaaaaaaggucaagaggauauaaauucaggugcuaaaauaauaaucacugacuagugaguauauuuuuauuuucuuuuuuguuugucuauauuuuccaauuuucuucaugcauauuuuuugcuuuuguaauaauaaagcucuuuucccaaguuacggucauaaaacacaaauaaauaagaaagaaaugauagguagugaggaagucaaugcagagggccaacaacucuuggaaaauuugaaagcaaaaggagauggaguuguaucuaaaagacaucgcugagucuagaguaccucuuucuguggcggcgaguccucugaaaaucugguggggagaguggaugaagcuucugcccucagagaaaugagaauauguaaaguugaaguuuugcauaucauuuuagguggugauggaacuuccuaaaacccuuucgugaccucagguuggagaccuccaguccagauauuuuuguguguuuacuuauuuagcuuauuuguuuauuuuuaaacacacugggugaagaaaggagccaguggaaaaaccaagauugaaaguacaagaaagaggagaaauuuacacuaauauggacuuccagaugaggcugugauuuugauacacacauaaaucaauacaguagauuuuaaauugucuaucauaggaugggcaugguggcucaugccuauaaucccagcacuuugggaggccaaggcaggcagaucacccgaggucaggaguucaagaccagccuggccaacauggcaaaaccccgucucuacuaaaaauacaaaaauuagccaggcgugguggugcacgccuguaaucccagcuacucuggaggcugaggcaggagaaucgcuugaacucgggaggcggagcuuacagugagcugaaaucaauccacugcacuccagccugcgcgacagaggaagacucugucugaaaaauaauuaauaaauuaauaaauaaauauaauugucuaucagagaaugcuuuuauguggucccgugugaggugaaggaaggcaaacuaaaacagcgugaggaccuucugguuucaugaucccacaucuuuaugugggaagauuagaauccuaagaauauguaugcauuuucaaaaagauacuguuuguuuuaacauuuuuuucaucuuuuugcagaaguuuagcaauggcgucuuucucugcugagaccaauucaacugaccuacucucacagccauggaaugagcccccaguaauucucuccauggucauucucagccuuacuuuuuuacugggauugccaggcaaugggcuggugcuguggguggcuggccugaagaugcagcggacagugaacacaauuugguuccuccaccucaccuuggcggaccuccucugcugccucuccuugcccuucucgcuggcucacuuggcucuccagggacaguggcccuacggcagguuccuaugcaagcucauccccuccaucauuguccucaacauguuugccagugucuuccugcuuacugccauuagccuggaucgcugucuugugguauucaagccaaucuggugucagaaucaucgcaauguagggauggccugcucuaucuguggauguaucugggugguggcuuuugugaugugcauuccuguguucguguaccgggaaaucuucacuacagacaaccauaauagauguggcuacaaauuuggucucuccagcucauuagauuauccagacuuuuauggagauccacuagaaaacaggucucuugaaaacauuguucagccgccuggagaaaugaaugauagguuagauccuuccucuuuccaaacaaaugaucauccuuggacaguccccacugucuuccaaccucaaacauuucaaagaccuucugcagauucacucccuagggguucugcuagguuaacaagucaaaaucuguauucuaauguauuuaaaccugcugauguggucucaccuaaaauccccaguggguuuccuauugaagaucacgaaaccagcccacuggauaacucugaugcuuuucucucuacucauuuaaagcuguucccuagcgcuucuagcaauuccuucuacgagucugagcuaccacaagguuuccaggauuauuacaauuuaggccaauucacagaugacgaucaagugccaacaccccucguggcaauaacgaucacuaggcuagugguggguuuccugcugcccucuguuaucaugauagccuguuacagcuucauugucuuccgaaugcaaaggggccgcuucgccaagucucagagcaaaaccuuucgaguggccgugguggugguggcugucuuucuugucugcuggacuccauaccacauuuuuggaguccugucauugcuuacugacccagaaacucccuuggggaaaacucugauguccugggaucauguaugcauugcucuagcaucugccaauaguugcuuuaaucccuuccuuuaugcccucuuggggaaagauuuuaggaagaaagcaaggcaguccauucagggaauucuggaggcagccuucagugaggagcucacacguuccacccacugucccucaaacaaugucauuucagaaagaaauaguacaacugugugaaaauguggagcagccaacaagcaggggcucuuaggcaaucacauagugaaaguuuauaagaggaugaagugauauggugagcagcggacuucaaaaacugucaaagaaucaauccagcgguucucaaacgguacacagacuauugacaucagcaucaccuagaaacuuguuagaaaugcaaauucucaagccgcaucccagacuugcugaaucggaaucucuggggguugggacccagcaagggcacuuaacaaacccucguuucugauuaaugcuaaauguaagaaucauuguaaacauuaguucuauuucuaucccaaacuaagcuaugugaaauaagagaagcuacuuuguuuuuaaaugauguugaauauuugucgauauuuccaucauuaaauuuuuccuuagcauugucuaagucuuccagauuccauuuaaaaccauuucuuguucuccuacgugagugaaagaugaucauauauccuaaugcuuuguugucgugugguguugaugguuuuaaacgaaaagaaagugcaaaaagaaaaugccugugaagacaagaagccaugagacugagucuggagcauaggguuaugcaaugaugccugucccugggaacaccccuggguacaggauauagaaauuuccacuauuacauagaguuuccacuauuacaacuaaauaagcaucuauugugugaaaacugacucaugaaauguuaugaaagcugugguuuggggaguucuguuucuucuaacugccuaccgguugggcaccuauuuuccacuccucuuccuaagcuccuuaauuuccuuauuacuccccagccuccaaaucuuccacaucagacuuugugccucaaacaaccucuaauuucguaagauucuaguuacucccuuccucuugcuccaaaugaauacuuucuaagaaaguauuucaaguggaaggagaaagaggguggaggauggagcagcaauucuucuacucucugcaacugaguacccuaccaggcuugccaucacauuuuaaaacaugacgacaggcaacuuacaugccaaaauuaccaaauauaucuucuggguuuuuuaaauccuuuucuuugccaaaguaauacaugcacauaguuuuaaaauaauuuaauaagguauauaaugaaauaugaggucuccuaccucacugugcccaaaaguucccuccucccacucucauuucccagagauaauccuugcacaauuuuagauguuuccuuugauaauuaucaugauguuucuaaaucaugugcuuaugcugcucuuuucuggaggcaugauaaaacgacuucuuguuuugaaagaugaagauguuuauccaagcaccccauauuuuuaauuuguuuauccagcaucccaacauucauuaauaaccauauuuuaauucauucaugaccacauauuuuucuucuacuuugucuauacacuccaaccauuuauauagcuuuccuucugucccuuuuucauuuaaaacaaaauuaccuaacucccuaccaccuucucauuuuucuguauauauaaauguuugugucaaacgucugaaauuucuggcuuguuuguaucacaacguggccucaucuaaaccaaauacaaugauguagucuaaaaacagaaaaugacauguguuuuagaccugcaagacacuaucuguucaauggcugaggugagggucuggacuacagauuuuuuauaaaguauaugcagaaaaauuacaaaucacuaggaauucuuucaguugugaagaaugucugacauaagauuugaagugcuaccuuuccagcuuauauauuaauuugcuuauauauuugauaugaauaaaugcuuuuuuucucaug

SEQ ID NO: 14886 - RNA, 11054 nt, Homo sapiens
cagagggagcgucaaggcccugugcugcugucccugggggccagagggguugcccagcaugcccacuggcaggagagagggaacugacccacuugcuccuaccagcuucugaagguaaaauccuuacaaacgaggagcagagcuuugauggaggaaaaaggaaaggcagaaaacuucacguaggagggcuuggggcaaugauagagggcugacaaaggcagcauaaaaaaaggcagaauauagacaaccuauuucucuuaggcucaccccauccaccccuacuucacccccuuaccuaccacuguuuucaggguuaaagcaauuuuagcaacccuuuacuaggaacuguggggagauagcuuguauuuucaguaaguuggcgguggggggcagggacaaacuccaaacaaacucuggaaaacgaauguaggaaguuuuuauguuccuugucauuuggcugucccuuuucuccuuccucgcacaacccuguaucaguggggcagcacuuccuucucagaccgcuugucccagggucccugccuuccccuagugaaagaagcuccugccuccaucggugggcguugggagcaucagcggagaugcacgcaaugauaaacagcagacagggcugcuugaggagaugaggugaucacgguuaaagaagaggggcuguccuacauggaugaucaugaugcgccaagacuguugaaaaccugaguggaaaugggagcaucguucuugagggcaggagagagacugauaccgcggggguggggcugguggaggacaauagaggaagaagaaaacugggagaaaguacucgauuccuuuggagaaaaauuaggagaaagucuagagaagcaaugagggaaggauacaauuuagcuauagucuagaaaguuagucgaaguuaacuagggagggugugaggggcacggugccauguggggauguuggugauauggcccuguguguuauaccuuugaaggugacacugagccccaggugacgccgcaccaccaaagaaggugcuuguguuugucagacaaauacagccaggccugccaccccuuaggcuccaaaguccggaggugcagaaagccaggaccaagagacaggcagcucaccaggguggacaaaucgccagagaugugguaagugaucaagggucccugagaugacacagacuccauucccuucaucuucucaagaaaagcgcucaagggccaggcaugauggcucacaccuguaaccccagcacuuugggaggcugaggcgggaggauugcuugagcccaggacuuugagaccagccugggcaacauaaggagacccugucucuauuaaaaaaaaaaaaaauuagcccagcgucaugcgugucaccuguggucccugcuacucaaaaggcugaggugguagaaucacuugagcgcgggaggucaaggcugcagugaccugagaucgcaccacugcacuccagccugggugacagagugagaaccugucucaaaaaaaaaaaaaaaagggcucuugucugaagccuggguuuugguuugaccugggccuuuucuuuauuccgaccuaagauucucccccauggccgauugacugccucucuucuucccccuuucuucugccucuggcaaauagcgcguucuguccuaggcuacuggugccuggucacccgccaaucuaugccucuguuuuuucaggugcauuguccuguuuucacuuuuggcauggguuuaugcugagccuaccauguauggggagauccuguccccuaacuauccucaggcauaucccagugagguagagaaaucuugggacauagaaguuccugaaggguaugggauucaccucuacuucacccaucuggacauugagcugucagagaacugugcguaugacucagugcagguauguuauaagcacaaaaagaauagagauggaagacuagggcuaagguagcggaauaaggaugugggagggagugccaccuguacucacagugaacuggagucaaguccuaguggcauaaauguucuauucucucugucccuucuuuuaacuccauaccaaaauauuacccuuuccuagauuuuuuuuuugugacucuucucuuagauaaucucaggagacacugaagaagggaggcucuguggacagaggagcaguaacaauccccacucuccaauuguggaagaguuccaagucccauacaacaaacuccaggugaucuuuaagucagacuuuuccaaugaagagcguuuuacgggguuugcugcauacuauguugccacagguaaggcucacccuucugcaugugccuuauugacccagcuaaaagauuagaaaugagaaauccacugagcaacacauugaaugaggauucuguucguaauucuuauaaaaaguguugacuuggccugggucgcuccauaaaucacuuuugugaaauucaaaugcaugaucauaucuuaguggugaugaugaucaugguaauaacacauaguacauaauaaacagcaauuuguugagagccacuauaaacuggguauguauuggggauuggggauuuuuccuauuuuaacacaaucgucacuuuaauccuucaagguagguauuauuugcuccauauaaagaugaagaaaauaaggacuaggaaaguuaauaacuugccaagaaucacacaaggaauguguaguauuuaaacccauucaauauauggcauucaaaccuucaaauucuggguacuucuguaucucucucuagguuaaaaugaagcuaggacaucucauaaagccaaacuauuguuuagauuugacagaaggaccaacaucauauaaagcaaugaauguacugauuccucccugcagaaggcaucgucaugauguuuaccuugcagagugucauuccuggagcugaaaugcucuguacaugagaaaagucaaggaucucugacauuaagagcugccuaggccgggcaugguagcucacaccuguaaucccagcacuuugggaggcugaggcagguggauuaccggagcccaggaguucaagaccagccuggccaacauggugaaacccugucucuacuaaaaauaugaaaaauuaaccaggcauagugguggugcgugcuuguguucccagcuccucgggagguagaggcgugagacuuguuugaacuugcuugaaaauguggagguugcagugagccaagaucccaccacugcacuccagccucggugacagagugaggcuaugucacuuacacacacacacccccgagcuuccuuauagcuguguagugguagggcucaacucuggaaucauaugucaggagaguaauauggaauaauaguagccugaaaugugaucccuugacggaucuuuaagcaauaggccuuuccuacuuuuucuuacccuuaugguuuuggauuuaaccucauucucccuucuugguguuuguucuugaccucagccucuuucuacucuuuguagacauaaaugaaugcacagauuuuguagaugucccuuguagccacuucugcaacaauuucauuggugguuacuucugcuccugccccccggaauauuuccuccaugaugacaugaagaauugcggaggugagcuugguguuaagaggguugcauguucccugggauuuggaauggcugaggccucagaaagggcuuuguccacccuuccaacuucgauuaggccaagccuucauuuggcacuucuuuuuuauuuuagaauuuauuuauuuauguauuauuuuuaauaauuucaauaguuuuggggguacugguguuuuugguuacauggaugaguuccuuaguggucaauucugagauuuuagugcacuuguuacuugagcgguguacacuauacccaguguguaguuuucucgccccuguuucaaccuccucccacguugaguccccagaguccauuauaucacucuguauuggcaucuauucuuaguuacucauaagcugagaugaagccacaagaaggaggaagauaagacuauaggguaaaguuaguuaauuggauaagagagauagaugccuguaaagggucuacugggggcuguucauaaccagaaaggcuccauccuaagcaaagugauggaaaccuaauagggauuggguauuccuacugauacguauugcacguguaauugcucuaucccuccaguuagggcagggaucucagguuaguuugaaugcaggacugucaguuucugagagaaggaaucauagaauagugcaggaauuccuuugcuugacccuguauuugauucucccuuucucuuuuucucuguuaguuaauugcaguggggauguauucacugcacugauuggggagauugcaagucccaauuaucccaaaccauauccagagaacucaaggugugaauaccagauccgguuggagaaaggguuccaagugguggugaccuugcggagagaagauuuugauguggaagcagcugacucagcgggaaacugccuugacaguuuaguugugcgugaugguugauuaauaccccacccuuaacuuacacagagagaucucucccugaagacaaauuuuuuuuucauacagcaucuuucucuguugcucaagcuggagugcaguggugcaaucacagcucacuguagccuugaucucuugggcucaagcaagcgucccaccucagccuccugaguagcugggcccacagacgugugucaucaaacccagcuaauauuuuuauuguuauucuuuuuuuuuuuacagagaugggguuuugcuauguugcucaggauagccugaaacuccuagccucaagcaaugcucccaccucggccucccaaagugcugggauuauaggugugagccacugcacucagccugaagauaaaauuaucuuuucuccugacccuuauuuucuucuuauuuuaugugacauuuaaugccucuuuuauuuguaucucccacuucccaauuuuaccucuucccuuuaguucuuucccucuucugauuucaucauuuuguucaguuuguugcaggagaucggcaauuugguccuuacuguggucauggauucccugggccucuaaauauugaaaccaagaguaaugcucuugauaucaucuuccaaacugaucuaacagggcaaaaaaagggcuggaaacuucgcuaucauggagaucgugaguaacuuagaagugccucuuugguuggugauaccaaaguccccaaacaaugugggaucaaagcagguagaugauccaggcacacuggaagcaccugugaucucagcuaccgagggaggcugaggcaggaggaucccuugagcccaggaaguaggaguuugaguccacucugggcaacagagcaaaaccuugucucuaaaacaaaacaaaaacaaagcaacaauaauuuaaaaaacagauagauuguuguucugauagaauccugagauacuucacuucuucaggaaaaucuaaaccagucaacgguugcuagaaaugccucaaccucuaguaauccuuuaacuagaccugagacugcagacagcuugcgggugguuaguugguaaugccauaugauuuuagacaucugcuguauuggaauguuaagcaucaggauugaggacaacuggacgauuuuagaaagugugagaaugauguaaauagaaugagagucuucaacuauuuaguaauuuuuuccuccugucccaacuucuguucuuucaagcaaugcccugcccuaaggaagacacucccaauucuguuugggagccugcgaaggcaaaauaugucuuuagagauguggugcagauaaccugucuggauggguuugaaguuguggagguaaaguaccaccuuggcuucuccccagucccuggccccagaucaggaugagcggacugaaauuguccaguuguuuacccaauguaugugugugaucaagguauaacaccuuucccauaaacacaacagcuuaagaucuguaguucucccuugugagucauggagcugccuggccagcuuggcauucucucugccuucagucuucuugaggaaggggaguugacacguuggggcaaagcuuucugucagccucaucuccugggugcuuuaggucugcuaagauguucccaagcuucuuguggugaggacuccucauugauccaaggccagagaucaauuccaguuuugauuuugguuucccauaucucucuucagaaauaaguggugauguuuauuauucuccagggacguguuggugcaacaucuuucuauucgacuugucaaagcaauggaaaguggaguaauuccaaacugaaaugucaacguaugugucucuucaaaguggaagucuuucuuuuucucucagagagaauggaaagaucagcacaucaaaauucaaaugcaugguuuccucuuaggcaugugagggaguggguuggguuuuugaagggaagccagucauggaagcuuuucuagucccagccccgcaucuggucccaggccaacuagaucggcauguuucuuuccaagaaaggggcuaugggauaggucgaguuaguagccccacgugggugcauuuguggcuuccacugggccuucaccaaccacugagaaccaggcucuucacuacggcuuucauggggccaucugaauuggcaucucagcgggugagagagcugagagaugccaguuggggaggauggccacagagaggcugguguggggagguucaucccaggugugccuguggauaugggguggggaagcagugaggaugaaccuggccccaugacucuuccuuggaggaaguggcuguccugaccaucgcucuccuuccuucgucugguagcuguggacuguggcauuccugaauccauugagaaugguaaaguugaagacccagagagcacuuuguuugguucugucauccgcuacacuugugaggagccauauuacuacauggaaaauggaggaggugguagguuucuucuacuggagaagagagagagagagugagaagguguuggaggguggauagcauaaucugugccagagacagaguuuggagacaaaugaaggcgauaggacagacauuguucauccccuuggcuucguccaaagauacaguuuucaucuggagcagggcaaguucaggggagcaucagccucagggaaucauagaggucaccaacugaguucacagcugcagcaggaauuccccuacaacauccauuucaugggauuacccaccuuuugaccaguuauuucauguaaaacccacaggagcaaugccuucagcuuuaagccaccaaacuacacugacuggcuuucuugauguagaggcuuuggucaugcuaggugcagggcugaaugagacccuaauacguucucugcauugcucuguauuuauuucgccacuuucccgaugccuucuuuccuucugcuuuggagauguucccuuugucucccuggcaggcuagaggccugagggauuguuuggaggaagauauuuuuuuucuggcugauuuaaucugauuuacuacuugaauccuagacgagcugagguucugaaggaacggggcaggguguuggggucggaggggggaauggaagaaggaagaugugguggugaguguggccuguguucucugugcuauuccaggggaguaucacugugcugguaacgggagcugggugaaugaggugcugggcccggagcugccgaaauguguuccagguaaggagggcugaggcuuggggagagaugauagccaugggugacugggagucaccuucugaaagcaacuguaauccucuugggaaaggacugaacagugaccugccagaguccagcucagugagguggcaguaucacugugccgugggcugccagggccguggggaaccuccucagccgcacugaagccaggccaacuggaaggaaauagaaacgucagccagcgacaguuggugucugguaauguagcugcagugagaagauacagaacugcuaaaaacagggccugaaagcugagagugugugaguaaucaacacucagaaacaagucuagcuaaauagccuaguuauuauauuaaaaguuuauagggcagcaagauauagaggaauucaaagaaugaggaagauaagaguuggguagcagaaggcugaggcaaauccaauaggauaauaaccauccugggugguacugaaagcugaagacugagcugauuuguugcauuuauuaucucauucguguccguauaacagcccugugagcuaggugucauuggucuuaucugaccaaugucaaaugugaauggguggggugcaaguucacagaguuagcaaguggcaaaggcaggcuuugagcccaggucugucuaaguucacagcccauugugcucaacuuggagucccuccaggcugucuaguaagggauuuaaguaagcagcuucacuugaauucaguuauuaguauaacugaaugguaauggcaccagucacugggagugagaggucagggccaaagaagggaccccucucuacuuccuaggcugaccugugguuuacuaggagggacucaggugcaacuaggacuccaguaaagaaggugauuaaaguuugaucugggcaucugaagaaggcagaaaucuuuccuccuccaccaucugugugagaaaaggguuuccagcacuggcucuugauugggcaccggccucaugugccgaguugggaggugcaaaggggaccccugccuccaggggggcugugggucgcacuguggauagugugaggcauuagugcaucuggacucagugauucacacacugccuccguuuaacugagcucucccaugagccagcuuaugacaucggcaaagcgggauguuuagguaaggccagagugggucagguauugagauuguugaccaaauaggguugacuauuuuguacuagagaauccugcaaccuagcagguaacauuaugugagugguuggaggauuugcaggaagccagcaucauuucuuccuccuucccuguguuguuuuauuccuuccuagucuguggaguccccagagaacccuuugaagaaaaacagaggauaauuggaggauccgaugcagauauuaaaaacuuccccuggcaagucuucuuugacaacccaugggcugguggagcgcucauuaaugaguacugggugcugacggcugcucauguuguggagggaaacagggagccaacaauguauguuggguccaccucagugcagaccucacggcuggcaaaauccaagaugcucacuccugagcauguguuuauucauccgggauggaagcugcuggaagucccagaaggacgaaccaauuuugauaaugacauugcacuggugcggcugaaagacccagugaaaaugggacccaccgucucucccaucugccuaccaggcaccucuuccgacuacaaccucauggauggggaccugggacugaucucaggcuggggccgaacagagaagagagaucgugcuguucgccucaaggcggcaagguuaccuguagcuccuuuaagaaaaugcaaagaagugaaaguggagaaacccacagcagaugcagaggccuauguuuucacuccuaacaugaucugugcuggaggagagaagggcauggauagcuguaaaggggacagugguggggccuuugcuguacaggaucccaaugacaagaccaaauucuacgcagcuggccugguguccugggggccccagugugggaccuaugggcucuacacacggguaaagaacuauguugacuggauaaugaagacuaugcaggaaaauagcaccccccgugaggacuaauccagauacaucccaccagccucuccaaggguggugaccaaugcauuaccuucuguuccuuaugauauucucauuauuucaucaugacugaaagaagacacgagcgaaugauuuaaauagaacuugauuguugagacgccuugcuagagguagaguuugaucauagaauugugcuggucauacauuuguggucugacuccuugggguccuuuccccggaguaccuauuguagauaacacuauggguggggcacuccuuucuugcacuauuccacagggauaccuuaauucuuuguuuccucuuuaccuguucaaaauuccauuuacuugaucauucucaguauccacugucuauguacaauaaaggauguuuauaagcaaauuuugugugacuuaccucauuccacaccaaacccucagaauuauagaaggggaaugggaugagaaggcuguuaugucacugaaauugggcauccagcaacuaauauuuaauuuaauugucacgaaaacagggaauucagcuuuucuucucucuuccaaaugagauuuacugaauauuguggguuaguaugaagaucgccaguguaaggcaucacauucugcuuuugaaacucauuaauauuuaccuggccaaaaaaaaaaaaaaaaaaaaaagaagaaaagaaaaauaagaaaaaaaagaagcucauuaaaugucauguggugcguggcucacaccugugaucccaacacuuugggaggcaggggugggaggauugcuugagcccagggauucaagaccagugugagcaacauagggagacccugucucuacaaaaauaaaaaauaaaaauuagcuaggcaugauggugcgugccuuagucccagcuacucaggaggcugaguugggaggaucgcuugagcccaggaggucaagguugcagugaucaugccacuguacuccagccugggcaaccagagugagacauuaucuggaacaaagcaaaauaaaaaaaccccaccucauucagaaauccauguacaauaguuugaguuggcuguuuaagaucuucuuuaaguagaaauuguuucaauaugugaacggaaaguuaauuuuccucuaauacucauuguaucaugcaauauuaugacaacaaaaaagaaaaacuaaagaaauugagcaugcuc

SEQ ID NO: 14887 - RNA, 6522 nt, Homo sapiens
gguucucucggcaguaaccuucagggagcccugaagaccauggaggacuacugaccaacaaccucugaccuucaccccucuggaugggggacgaaucacuaggcaaaggggaacaaugggaaggagacaaaauggcugccuuuacagcugcagcaagauguggaaacacugguucccuaggcaccuccauugucuucccgccuugggagcaugaaauaaauaaagugugaaggggaacaugaggaagacugauccaagucacuugaccugucuuuugucuaguuguuuaucucaucuuagccucccagcaacucaggauuggggcugcgacgucugcuuugucuuucaugauacucaaccccaagcagagaaaaauaucuuaaaaaucgaagcagauuaacccagucccucuguucagauccaccugcugcccuaucugcauuuggcaguuccuggacauacuuugcaccuauguuuugucugaguuccacaucuuccuugucuccccgcagggaugggaaaugggcaguagugggagauucagguauaaacgguggcucuguuucucuggugccugagauucgggaaggccugucuugggaagauaagugucagcuuaucuguggacugaacagacaggcaccuguucuguuggccccggaacugcgggcaugaaaagcccaccuccccaggggaggccuguuagcuagcagcuccucacgccuggugacugagaaauggagucuggggggccuacagcaggccacgcgauccacugggcuucugggcacagaagugccucaacaggcacaggcaggcuccccacagccacaaggaacccugcugccaaggaagcagcuccuguuggggucaucagauuuuuaaucuggcucagcaaagccauggcuguccagccuuaaaaaaaugggugaugugggagaaauggagggugugugaagagcacagcugggccucgagaacucagggccagccuucccagcuuggguccuguuucggagcccaggccuugcuuccccuuagccgccccagccagauucuuuugcgcccccugcuggcacacacaaagacagacccaggagcgcacaugugaacgugcgcaugcuugcugccaguuacccaguucaugaacacgugaagccuugacuucagguuaaguaauaaaaauuuauugagaauuccuggguugguguuuaucuccucccagccuugagggagggaacaacacuguaggaaaucacugagaaaucacgcacuguccccaacagccccaguuaacacagggaggaggaaaguaauuccccagaaaaggggcuagucuucagucuuccuuaauccaagagggguucagggaaccggugugggggaccaucgcaugauacuggggcgggguagggcugugcuggaccccuggcuggcuccucaaaaacuggagaagcagauccacuuccucuggggguggaguucuuggugacuaggcucauuucuuacccuugaugaggcugucacuguaggaaaaaaaagauagauaaugacauuauuaggggacauaaaugugagaggcaggacacucuaggccauucccucuacgacccuccuacccugauugaggguuugucuucggggaggugggaaaggggguaggguaggaggcggguacuggagaagguggccugcaggaccccacagaagcaacaacagcuuaccuuccccuguggugccagaucgccagaugaacaagaaacagagaagagaaaugcacauguuaauugacagcuucaggccccacucagcuuugaacccuccuuugcucccaagagaaaagauaaacaggguugacagccaggaaucucaggcucaugaaaggaggaggcauguucucauggccacugcuauuucucaucuccuuuccuaacaucccuccauucaccagaggaguuugagggcucuugaguaagaaaacugaguaucaucuuucaucacuuuuugguuagaugaaaacuuuauaauuaaagugcuuuuuaugugaauaauccuauuugaucucauaaaaucaauccuaugagaugcaagauagaaacugucaaccacccccuuuucuaauuuugguucaaugucucugagccauaugaauagcuguagcaggcuccagagcccaaacaaccagacucaggucccacguucuuggugauaccccacaguguggccacaucucucaccuggugaaacuuucauccuguagguucagcacaagguugucagcugugagauagauacgauucugugauguggcgaucuacagggcaggaaauaagacagaugcuugcauuaagcaaagaccucaauuccgaccccugcaauucagcagcuacuuaacauggaacacaugcagauuagggcaggggugcagcaaugaguaacacaugguuucugcucgcacuuagggauccagagcgcugagcagcagcuaugauuagaacaaaaggucagggaacccagaggaaucauucuugacaggaggaguaucggagaagccaauuuuuuauuuauuuauuuuugagacggagucuugcucuguugcucaggcuggagugcaguggcaugaucucagcucacugcaacuuccgccuccuggguucaagugauucuccugccucagccuccugcguagcugggaauauagcuaaacgccaccacagcgggcucauuaucuuuuguauuuuuaguagagaugggguuucaccauguuggccaggcuggucucgaacuccugaccucaggugauccacccaccuuggccucccaaagugcggggauuacaugcgugagccaccgcgccggccagagaagccaaucugaguagaaaccggaacaagcaagguucgaauucccucaccucaaugugccuuaacugaaagcacuuucucaaggcagccccaucagagacgcugggcugacacacucaccgucuuggagauauucugggcugcucgaaucuugcgaaguuugauguagccaggguucuugcucagugcuucuccaaggugaggaggguuaagguacacgcaagggcaggucucaaucccuggcccuguccuuaccacacucccuugcuccaguccuccucugggcugucagauccaagguugcgcucagguggcuugugcccagcccuaccguggaccccaccugugggccucccugcaggcugcugccaggaacuaggggcagcaccagaaaugaaggcaaggccaccaaugcuauugaucuggccuuacaguggggagucauggcucagguacuaccacuaagauuucagaucucaucuguaguccccacccccaacaaggagccaagggccagagagcacggagucgcauucgccuuagucucaucagccugcccaugaaggagaauggggaacucaggugcccuaggggcugggcugagaucucuccagcagaaggauaucaucuuggcagccucggccucacccucggccugcacaauuuucugccgcuguuccugcuuugcuuuuucuaccaagaauugggcccgcugggccuccugcugggcuguggugggagagagucagggagacccuguccugggucaggagccccacccauggagucuuuccuccuccugcaucucagaagcccucaccccacggcucuugcgacucacccacuuguuuggcuucuacagcagcuguguacucucggcuaaagcucagcucugugauggccacaucauccaggaugaggcugaaguccuuggcccucucugucagcucccggcggaucaacagggauaccugagggcaggggugaagaggggaagggaggggugguuugaggggacuggggagcugaaaggaagguugcgaccccuaacccuucacucucaauacaacaugcacugccuuagcuuccugucaggcaaaccuguaacauaagccucucugcucgaagaggugcaggaaaagccaagacuuggccauuuuccucugugcuuccuaacaccgagugcuaucgaguucuaaugcuggcucuccuuauuucacaguggcaauuagcacagcuuuuagguggaaauggcacuagggugacaaugcuuuucuaauaagcugccuuuccuaauucccaauacucugggccuaggaaggaaaggcugacaccacgcagaugguggugggagucagaccugggcccgcugggugaucagcugugaggcauugaacuuggccaccacacucuugagcaccucguugacaauggacggcaacacucguuccucguaguccagcccuaggcgcugguacaugcuaggaagcuccugagcauugggucgagacaacacucgcagggagauauucaccaucuguaggucugagauugaggucagcaguggcuggucaaggccaaacacccuuucccaagcauuuucuccuucauguuccucccuguaugcccugugcaaugguguacagccuggcacuacccuggggggaggagaguuaaucaggcugacaaggaagacaagacgcagcacagcugaaaugcacccucacccacugugaagccuugaacugcaaaccccgucaccagcagagcugacuacucuuucccccucuguacucugugcaaccucuaacgugggcgcuuucgugcuguaccguaaucaugucuccuguaaggacuugggggacaagaauuguguuuaaugaaucuuuuauucccagggcccagucuaguaaaugaauaagcgaccugcacuagguauagcacaaagaaguacauuacagguuacaggugagcuaccugacccaggguguauaugugugcguggguggggaggaggaagaggucuggggaacucaaaggcacggcuuuuauguauggucuagaaggagagaacaggugaacuagucaagcuuagggacaaacuucuccagaacagaguguacuaguggauguaacuguagauauaguaagucaagcaguuagaaaaaaaaggcuuuaaaacaaagcuuugaucuaggcagugaacaagacgagggacaaacaauacucuuauugaauacacgucagggaggagacaguaaaaagcacgcaaacacaguguguucagaauuugcugcuuugaccccaggaggcagguauuuuuguuacagcucuugcagauguggaaagaggccuaaaggccugacacuaccauauuccccugggguuucuugccagcuaccuugaucaucccaccugccaugugauuaccaagugcucagaccuaccuuuggagccuguaggggaggagauuuuucgaggucuggcccgaaugucauagauaaugggguacuggaaccaagggauccuggagaggacagggauagguauuaagaggccacaguuucggccgggcgcgguggcucacgccuguaaucccagcacuuugggaggccgaggcgggcggaucauuugaggucaggaguucgagaccagcuugaucuacauagugaaaccccgucucuacuaaaauacaaaaauuagccgggcgugguggcgggcgccuguaaucccagcuacucgugaggcugaggcaggagaaucgcuugaaaucaggaggcggagguugcagugagccgagaucgcgccacugcacuccagccugggcgacagagcaagacucccucuccaaaaaaaaaaaaagaaaaggccgcaguuucacuagccuugcccgguuuccccucaccacgcguuuuuuggccugcuccucuccacgaccacagacaaggagagauucucuugucccucuggaaaacaacaguuuguaugcugcuggagguucucgcagcacccacuauccuaggggcagggaugaggagggugggaaaagagcagcguugaauccuguugcacguccgacuauagccacugcugggucggcgucaagggugaaaggucagggucagcaggcucugcccgccauuaccugaagugaaggcccucggccaggauaguguccugcugcacuccaccgauccgauugaagaagauggcucugugcccgccuuccacuguggggagauggguggugaucaggccaggccgcugcucagaggaaaugcuaggcccguggaggggcgcggggacagggcaagggguuugggggagggacuggaagcguccggcgagcaggcggagguugcucaccggugaacacagauucgcgcacaccguaggccacggcgccggcccccagcaacagcuucagggccgugcccaugccccggggcccggcgggcagccgucccgccaaguccuucaaguucugggccaugucugaucuugaggccggcggcacuggaggucagaagggggugccggcccgccucuaccccgcuccggcuuagguacugcacccuucacacgaggguucgggcccguaaggcuggcgaaagaaagggcagcggaagugcgcucccuuugaaacccucccccuuag

SEQ ID NO: 14888 - RNA, 4024 nt, Homo sapiens
caggcggagaaggaaggaggaagagcggaggccagggcgggcucuaggccguggaaucuggggccuuaaagccccuucgucuccccagcacccacucucugggggcaggugggcccggugacagguaaaggccaccaggggagagguccugggcugagcuugggacugcagaggggggaugaggguggguaaaucggugugugucgcgggucgggaaaggcugccggggguaggggaagguggcucagaggcggcgggccgacggucgaggggcuucggagggccugcuuggacugcaaccugggccucgugaucagcgacccaggguguggcugguggcgggcagcagggcucaccaggaaguguccccagggacucgggugguggggggaugggagccagggaucugcagcuuuuccgcagggauccugggccugaagcugccugacccaaggugggcgggcugggcgggggcccucgucuuacccagcaguguuugggugcgguugggagucucuaauacugccggguaaugauggaggccccugucccugugucagcaacauccaucgccucagguccccagcccuuagcuggcugcagcccccuccccacuucccacgcaccccggaagccccucgucuugagcugagagcguugcacaaggggugguucuuguuggcuggcugccacuaagggacacaaugggccccagccccuccucccacccagugcgauuugucaccugguggauccagaacccacagucgaccuugagcuugggguuggcucgcccccucucaagagaccucaccuggccuguggccaggguccccuguagcaacuggugagcgcgcaccguaguucucugucggccggcccuggguccaucuuccaguacaguguuggauggucuaauugugaagcuccuaacacugucugguaaagauggcucccggguggguucucucggcaguaaccuucagggagcccugaagaccauggaggacuacugaccaacaaccucugaccuucaccccucuggaugggggacgaaucacuaggcaaaggggaacaaugggaaggagacaaaauggcugccuuuacagcugcagcaagauguggaaacacugguucccuaggcaccuccauugucuucccgccuugggagcaugaaauaaauaaagugugaaggggaacaugaggaagacugauccaagucacuugaccugucuuuugucuaguuguuuaucucaucuuagccucccagcaacucaggauuggggcugcgacgucugcuuugucuuucaugauacucaaccccaagcagagaaaaauaucuuaaaaaucgaagcagauuaacccagucccucuguucagauccaccugcugcccuaucugcauuuggcaguuccuggacauacuuugcaccuauguuuugucugaguuccacaucuuccuugucuccccgcagggaugggaaaugggcaguagugggagauucagguauaaacgguggcucuguuucucuggugccugagauucgggaaggccugucuugggaagauaagugucagcuuaucuguggacugaacagacaggcaccuguucuguuggccccggaacugcgggcaugaaaagcccaccuccccaggggaggccuguuagcuagcagcuccucacgccuggugacugagaaauggagucuggggggccuacagcaggccacgcgauccacugggcuucugggcacagaagugccucaacaggcacaggcaggcuccccacagccacaaggaacccugcugccaaggaagcagcuccuguuggggucaucagauuuuuaaucuggcucagcaaagccauggcuguccagccuuaaaaaaaugggugaugugggagaaauggagggugugugaagagcacagcugggccucgagaacucagggccagccuucccagcuuggguccuguuucggagcccaggccuugcuuccccuuagccgccccagccagauucuuuugcgcccccugcuggcacacacaaagacagacccaggagcgcacaugugaacgugcgcaugcuugcugccaguuacccaguucaugaacacgugaagccuugacuucagguuaaguaauaaaaauuuauugagaauuccuggguugguguuuaucuccucccagccuugagggagggaacaacacuguaggaaaucacugagaaaucacgcacuguccccaacagccccaguuaacacagggaggaggaaaguaauuccccagaaaaggggcuagucuucagucuuccuuaauccaagagggguucagggaaccggugugggggaccaucgcaugauacuggggcgggguagggcugugcuggaccccuggcuggcuccucaaaaacuggagaagcagauccacuuccucuggggguggaguucuuggugacuaggcucauuucuuacccuugaugaggcugucacuguaggaaaaaaaagauagauaaugacauuauuaggggacauaaaugugagaggcaggacacucuaggccauucccucuacgacccuccuacccugauugaggguuugucuucggggaggugggaaaggggguaggguaggaggcggguacuggagaagguggccugcaggaccccacagaagcaacaacagcuuaccuuccccuguggugccagaucgccagaugaacaagaaacagagaagagaaaugcacauguuaauugacagcuucaggccccacucagcuuugaacccuccuuugcucccaagagaaaagauaaacaggguugacagccaggaaucucaggcucaugaaaggaggaggcauguucucauggccacugcuauuucucaucuccuuuccuaacaucccuccauucaccagaggaguuugagggcucuugaguaagaaaacugaguaucaucuuucaucacuuuuugguuagaugaaaacuuuauaauuaaagugcuuuuuaugugaauaauccuauuugaucucauaaaaucaauccuaugagaugcaagauagaaacugucaaccacccccuuuucuaauuuugguucaaugucucugagccauaugaauagcuguagcaggcuccagagcccaaacaaccagacucaggucccacguucuuggugauaccccacaguguggccacaucucucaccuggugaaacuuucauccuguagguucagcacaagguugucagcugugagauagauacgauucugugauguggcgaucuacagggcaggaaauaagacagaugcuugcauuaagcaaagaccucaauuccgaccccugcaauucagcagcuacuuaacauggaacacaugcagauuagggcaggggugcagcaaugaguaacacaugguuucugcucgcacuuagggauccagagcgcugagcagcagcuaugauuagaacaaaaggucagggaacccagaggaaucauucuugacaggaggaguaucggagaagccaauuuuuuauuuauuuauuuuugagacggagucuugcucuguugcucaggcuggagugcaguggcaugaucucagcucacugcaacuuccgccuccuggguucaagugauucuccugccucagccuccugcguagcugggaauauagcuaaacgccaccacagcgggcucauuaucuuuuguauuuuuaguagagaugggguuucaccauguuggccaggcuggucucgaacuccugaccucaggugauccacccaccuuggccucccaaagugcggggauuacaugcgugagccaccgcgccggccagagaagccaaucugaguagaaaccggaacaagcaagguucgaauucccucaccucaaugugccuuaacugaaagcacuuucucaaggcagccccaucagagacgcugggcugacacacucaccgucuuggagauauucugggcugcucgaaucuugcgaaguuugauguagccaggguucuugcucagugcuucuccaag

SEQ ID NO: 14889 - RNA, 14805 nt, Homo sapiens
cccaccuguccuuuuccuggagacuauuaguccaggguuugucccugcagugccauuggccuggcaggcaggaucgaggaggaaguggcugauuacugagcgguucuuccucaccuggcuugggccacugugcacagcugugccgcuggcucagccccgcccccugcggcccucugccguggcuucccccucccuacagagagaugcugucccguggguaagucccgggcaccaucggggucccagucuccuguuaguuuuggagggagggagggcuuuguugaugcucacuccgacgugugugaacgugagugcgaucugccgcugcccugcgccuguuuccggucccuaugaacuuccccuucccgcaaggugugaggacccccggcucacucaugcuccucugcccccucuuuaacauuuuccccuggacaaguguguaucuguucucuccauugcauuucuacuuccagccucugggcuccugcuucugccuccugcuuaggaccugucccccuggguagcucacaacaccucaaacauagcagucagaggccacccgcgaaggcccucccacguccagccaacuucuccgcacuucccaacaucagacuuuggucccaucuucuuuguuuccuuucacuucccuuuccccugcaucauucauucaacagguacguguugagcaucuauuaugcaccaggugcuguuuaagaugcugguaauacuggagugaacaagacagacauggucucugcucucacggagcuuacauuccagugggagguuacagaccgaacaaauaacccaauaaauuggaucauugcagauucucagaaguauuacgcagaaaauagacagccuuggccggguguagugguucacaccugugaucccagcacugugggaggcugaggcgagaggauugcuugagcccaggaguuugagaccagccuggccaauauagugagacccugucucuacaaaaaauaagaaauuagcugggugugguggcacacguccugugguuccagcuauggagaggcuaaggugagaggcuugcuugagccugggaggucaaggcugcagucagcgaugauugcaccacugcacaccagccugggcgacagagugagaccuugucucaaaaaaaaaaaaaaaaaaagaaaaugaaccagcuucauaugcuagcaagugacugggugugcaggugacauuacuagcuggagggaucagggaggccuucccgaggaggugacauuugagcugagacccggaugaggaggaagaggagcuggccaugugacguagugaucaagagucaagcaucucugggcagaggagauggugagcacaaagcccuaaugugggaacaaacaaaaaaaggacagugugcccguggcagaggacccuaguggagcggaggcagggccacagcagguuagaccauguuggagcuaggauguugaaagugaaaaccugacgagaugagguggcgcacgucugugaucccagcacuuugggaggccgaagggggaagauugcuugagcucaggaguuuaaaaccagccugggcaacauagagagaccccaucucuauuaaaaaaaaauacuggguaugauggcccaagcaugugguaguccuagcaguuugggaggcugaggugggaggaucacuugagcccaagaguucaagaccacccugggcaacauagggagagaccucaucucuacuacgacuacgacuacuacuacuacuaauaaauagcuggauguaguggcaugcaccuguggucucaguuacuuggaaggcugaggcaggaggaucaccugagccaaggaggucgacgcugcagugaguuggauugugacacugcacuucagccugggugauaaagcaagauucugugucaaaaaaaaaaaaaaaagagagggaaggaaagaaggaagggaaggaagaaagaaaaagagaaagaaggaaaaaaaggaaagagcgagaaagaagaaagaaaaggaaggaaggaaagaaagaaaagaaaggaaagaaaaagaaaaagugacacccagucgaaagaagaaaggaaagaaaaagaaaaagugacaaccggucgaaagaaaaaagaaaaagugacaaccggcugggcaugguggcucaagccuguaaucccagcacuuugggaggccgaggcagguggaucacgaggucaggaguucaagaccagccuggccaacauggugaaacccugucucaacuaaagauacaaaaaaaaaauuaggcuggcacaguggugcgcaccugugagucccagcuacuagggaggcugaggcaggagaauugcuugaacccaggaggcggagguugcagugagccgagauugcgucacugcacuccagccugagugcagcgggagagacuccaucucaaaaaaaaaaaaaaaagaaaagaaaaagugacaaccugcuuacagaguacuggcgaguuuguggguggguggcucccuagcccugcugauucuugcuucucacacucaugucugccccugccccagugcacaucuugucacugucggccccaccgaugggguuccuacugagucuucuggucccugaucccgucuguggucauuuuccugccagguagcuuggccaggccuccccuggugcagauuucauccuugguuucucagccuggccuugaaugacccucuacagcaggguccccaccucucagaacaacuuugcuccagccacauggcuugcucacggccaggcacugcccauguggacucugugcgugccaccucuuugcccugacccauguugccucugggggagcacuucuuccuccaccuuccaucaugggcuguggcagugcccaucccaucugcccccgacgcugucugcugcaguaugguuguugggggaaagggcaccaggcuccggcgucugacagccguguuuuacccaccuuccuacucacuagcuugugaccuugggcaauuacuuaacaucucugagucuuaguuucuguuucuaaaauugggugaauaacaccuacuaaguaggguuggccugaggauuaauaguauaauguaaaagcuggcagcacugaaacccugccacuuaccagcuuuucacaucaguauuugggaaauauuguuaagcucauuugucaggcggggauucugaggcucagagcaguuccagaacuuucuacagauuauuuugccuuguuugcgcuuccagacugccuaucuucuuguaucaccauugaucuugaucuguaugguuuuuaauuuuuuuuuuuuugagacggaguuucacucuguugcccaggcuggagugcgguggcaugaucucggcucacugcaaccuccaccuccugagaagcugggauuacaggcaugugccaccacacccggcuaaucuuuguauuuuuaguagaguugggguuucacuauguuggccaggcuggucucgaucuccugaccucgugauccgccagccuuggccucccaaagugcugggauuacaggcgugagccacugcgcccggccaacuucacguuuauacacacccaugcaaacagcauccagauagagacaaagagccuucccuguacccuaaaaguuucccagaaauuguucccaguuagcauauuuauuuuuauaaagguaaugcaugcccaucauauaacauucaaaaagguauguagagaaccaagugucucccccagcccuguccuccagccacccaguuucccucccuaggggaagccaccaauauguguuucuuauguauccccuguugagcugcuuuuccucguuuugguuuggcgguguugauguuuguauuuggaauuacagguaggcagcaucauauaccuuaguguuuagggccucuaagaucaaccagcccugagaaaaucagccauggugaggaccuugucccccagccccccaggagauaggcccccuggugggagugcuggggcagggcagaggccuagggacaagaauuagaaaggacccauguugacagggcugcucagggucauguuguccaucccucugccacaguggcauggacaaacugcauauguugguuagaggagggcacccuucucucuugcaagcauuggcaaggucuuaacuauuagucuccugcucccauggcagccccuuuggacaaggaggcucuuaaucucuguucuuugaagcccugagggcugguguauaggaguucaaagcacuggcuuuggaaccggacugucuggguuugaauccuggcacugcagcugacucacugauggacucaggcaaugccuuaaacucccugagccucagguuccuugucuguaaaaugauaaagauagccccuguuucauagggcuguggugagaaaccaaucagacaaggcaugugaacgccauuauagcacagcgcccggcauccagcaggacucacucgaugacaguugucaccgccaucauuguuauuagcgugggccagggagggcugcguaaaagcagcugguggaggagggagagaugccgugggaccgucuggguucgcaugcgugaaguauuaucugggccuggagugugcaaggcacacauguguccuuacugcauguguugucacauaugugcaaugccaugcuccugagccuuugauugcagacgugugggaagugggccccguccccacccccagugccacccugcucugcuucucuucccuugcugugcucuaaaacgagaaguacaagugaguucccccaaggggucggccgcgccucuuccuguccccgcccugccggcugccccaggccaguggaguggcagccccagaacugggaccaccggggguggugaggcggcccggcacugggagcugcaucugaggcuuagucccugagcucucugccugcccagacuagcugcaccuccucauucccugcgcccccuuccucuccggaagcccccaggauggugagguaagggccugccacccacgguagacaggaggcaagggugccuggugcccacgggaccccuccucacugcccugccugggccgcccaggugguuucaccgagaccucagugggcuggaugcagagacccugcucaagggccgagguguccacgguagcuuccuggcucggcccagucgcaagaaccagggugacuucucgcucuccgucagguaggugggccccccgcaaccccgggcauuuuggccacucucuugugccauccaggcccugaaccacucauuccugguuccccguggcagugcugacuccccgucuguucccuugcccccaacccccacacuccccaucccugucugugcccacccaugcccaugugugcccccacccaggaccucagccgaucccugcccuccugccucuacuccugcaccgacuggccucaccgccuggugcccugcagggugggggaucaggugacccauauucggauccagaacucaggggauuucuaugaccuguauggaggggagaaguuugcgacucugacagagcugguggaguacuacacucagcagcaggguguccugcaggaccgcgacggcaccaucauccaccucaaguacccgcugaacugcuccgaucccacuagugagaggugagggcuccgcacccccgccauucccaagcagggaugagccggcucccacccugaacagccagggaggcagggagacuggcagccggcgcugccuacccuccauccccuccccucccugcaccagcuggggcucucaaugucccuccucccugcuguccugggaccuggugucucagagccuaaccuaccacccuuuccaccuaaccccgaggaagccacagaaagcugccucgcccuacuccgggagcccuggccgcugcaacccaggucccacuggagacagggaggccacugcugguggccagcaugucgugcaggccagcucuguuguuagaaagcucuucuuccucuggaaucgagccugccuuccuccgucugccccucaccccagcacauguuaggacagugaggagcugacacuggggugaagauggggaugaaugcuugccaagacacuugaugccuugucccagccgccccguggggaugggucuguccuguggggucaaauaggucuccggcccaaacagagaucauugagagcacgaugugaaguguucaccuguguaaagugucucacgcugucccgggcacagaguaauacuccaggcauuuccuuccuguggccuccccgacuccuccuguggucucccaaaggcaugggcugggggcugggggcucugaaugcuccucaugacaccauggcuccuuucagcagccgcaucucaaugccagauccccuuagaguaaagggcagcggaauaacgcuaggggguuuucacaugcaccccugggccaagccgacuugcccuugccguggaucccugcauucauggaucgguuauugaaaugaucgggaaccuugcuccugccagcuugcagccucucugagauucgggccuccaaacugcaucaauauuuuuggucaaggcacugauugaaacuuagagcuggauucggucacggugcagcccuguggcccaccugggaggccuccuuuccuggaucggccuccuucaaggccuucccucucucugugagccucacauggcuggcuccgugucugcccccugcccuuccucuuccccaccgcaacacucagggggcuuuuggcaccgagacccucuaaagcucauguccucucuuucuccuugccuccagccaggagaggaggacgggcugaccagugccuggagguggaagagaggagcagggccccaggaggccccugcagaggaggcugaggccuggguucaaggagaagagagaagagagagaaggaagggagggcagugccggggcgggagguuaagaccagggaagccgcacuggaggcccuuuugggugacccgucccaggagccagugucaccccugagccugggagugugugagaggcucuuucucccagguucugcuguguccucugccuugucugugcgccuccuccucugcgagaauuugcaucugucccucgguggcucugcgcuuccuguggucagccugacauuugcauggagacuuccucauccuggggccugagggaaggggcucagcccccuccccgcuaccugggguccuagccuguccccaggcggugggcugaaguagcccagugggguuaggaggcucugggggucucucggcuggagucaccuccgggcaggggugagauggguugggacagacugguccuccccuccuuccccccaucccugcgguuggaaaauuugcccgcccuccccucgucccugggcugaggaaaccucacaaccucacuucucacucucuccccagaaggaguuuuguguuuuuuccaucacgugguuuccuguggggcugggcuuuguggggcuacaguuuccuccugggaaaggggugugcuucggggaaagggcuuaguucugcuuucugcccugacagccccuucaaauccguuugaacccugggcuccccuucagugacaucauccagggcaccccagaacccccuacaccacucuuuccccagugggguugucuuccccgccucccuggcggagcgcaccccauccgccuuccuugugacuugagucuguguguccaucucccaccacucccugugguguggccucggucugcguuucucuuugccucuggucucugcuggggcacagucccauccuucacggagauucauccuuagcuucucuccuccaaauauuuugaauauugccagccuuucugccuuucagaggugggcucuggguucgaagcccgguuagaacucuggaggcuaggauggcuugaaccugggaggucgaggcugcagagagcuguaaccgcgccacugcacuccagccugggcaacagagcucuggaagcuugcccuagagucagucaagggcccuaggccagugaguaacagcucagcgucaguuuccucaucuauaaaauggggguaauaucauaccuagcucucagcauguuugugagagaccuaaaugaggugguggauuuggaagcauguagcgcagugccuggcacacaguaggugcuugauuuccggccccucucugugaaugucucugcucagcgccuuccccuguggccugggucuuaccuucccugacgcugccuucucuaggugguaccauggccacaugucuggcgggcaggcagagacgcugcugcaggccaagggcgagcccuggacguuucuugugcgugagagccucagccagccuggagacuucgugcuuucugugcucagugaccagcccaaggcuggcccaggcuccccgcucagggucacccacaucaaggucaugugcgagguaaggcagccaggcggcgggggagccucugcugaggcuccugucugugaccacaguguggguggcagggagggucugccugggcuugaauucaaggcuggggacccagggagggagacucaaguccugugaauggccuaauuuggcuccccccaggguggacgcuacacagugggugguuuggagaccuucgacagccucacggaccugguggagcauuucaagaagacggggauugaggaggccucaggcgccuuugucuaccugcggcaggucaggggugggcccagcugccuccccacuuccccugagcugucccccagaugugagcuucugggaucucugaguugcugacuucucgcucuuccccaccccagccguacuaugccacgagggugaaugcggcugacauugagaaccgaguguuggaacugaacaagaagcaggaguccgaggauacagccaaggcuggcuucugggaggaguuugaggugcaugguggggaccggcagggcuggggcagcugaggugguggcagcggccuggggccccaggcggacaccuuccccuccuugcccaccucugcuccugacccaccccacgugagcucccccgauggaugcccucuuugggagcugaugcucauuuccccacccacaucucagaguuugcagaagcaggaggugaagaacuugcaccagcgucuggaagggcagcggccagagaacaagggcaagaaccgcuacaagaacauucuccccugugagcacccaggcugccccauucacccaggauaccgccccugccccagcugccuccccucaucucacaggucuccacccuccacgccaggaggggccaucuccccacaccccccacagagccucccccuucuccaaaaggccucuacuccucccagaagugccuccccaccaccagcaggcagguugcccccugcucccaaccuccuugugaacucccucacucccuccauacagaugaucccccaccccugcugcccacagucccccgcaagccucauggcuucugagaccagaauggccuguuagcucaggagggucugacccagguguggugagucccuggcuaacccagaccaucucgccuccucuccgcccacucccaguugaccacagccgagugauccugcagggacgggacaguaacauccccggguccgacuacaucaaugccaacuacaucaaggucagcagugugggccacgugggaggagaggcugggcccugggaauucccugucugguggggggacccuagauccagagacagcugggcaaagccgaagcuggcuucuugcaugggugaggguggcagugguucagggccugugcugggccaaggggcucacugucuuggggugcgucucuccacgcuugcguccagaaccagcugcuaggcccugaugagaacgcuaagaccuacaucgccagccaggguugucuggaggccacggucaaugacuucuggcagauggcguggcaggagaacagccgugucaucgucaugaccacccgagagguggagaaaggccggguagggcgcccccccuuccccgcauccgcccccgugcuuguggucaugccauuaagucgaagagcagucagaugccagggcagaaagggaucucaggggugaggguccggcccuuguugggaaacugagggcuagugacaaagucucgacuacacaacgugacccccagaucccugcaugcaucccugggcucuucugagcuccagacccagguuccaggcuguccuccuuccuccuaccccugccccaccugucugcauccaggccccuccuguccucccugccccauagaucucucuggagucugccccuuacccugcaggcucccccuacacagcacccucugugcugccauugaagugaucccauccgugacacaaacugggucaaguuccuuccuuucugaaaucucuuccauggcuccuggucaccuuugggauaaagucgcacucuaaggccuggcauucaaggucugguggcuucccucugacccgcacgcuucucuugaaggcucaccgcccccagcagccccagcucuuucagguucccagccuuucuuugcacaagcucauuuucugcuaggaaaugacucucuccacacuaucucugccuggcagaugccucguuuuugaagacacagccggagcgcugccuccucugugaauccaggucuuguuuccuccaggaccuagagggagaauuacgucuuucccagccacgcuccucagcgcggugucucccccggucaccugucucugugagcuccucgaggcacaggggcacagacuggguguuauuugugucugugaagcugugugguuugcacagcuucggggacaaugccugcccuggcaacguuuguugaaugacaaacggauguaccggugaaguggcuggccaggccucaccaccuguuggugguugaucugagacgagagcccaggucuccugccucucugccagcccauccguccauccaacaaauguuugggccggugccaggcacucagaacauagagcaggaccugggaugggccacagugcccugcucugugccucauccccacccgacccucccuuuccagaacaaaugcgucccauacuggcccgaggugggcaugcagcgugcuuaugggcccuacucugugaccaacugcggggagcaugacacaaccgaauacaaacuccguaccuuacaggucuccccgcuggacaaugugaguggcccccacgcccugccccauuccgggagucccucccuggacuuguucuccucucuggucggguagggugagauggaugagguguuccgagagaggagggggcacugacccuauguccucggcuuagggagaccugauucgggagaucuggcauuaccaguaccugagcuggcccgaccaugggguccccagugagccuggggguguccucagcuuccuggaccagaucaaccagcggcaggaaagucugccucacgcagggcccaucaucgugcacugcaggugaggaugauaauccugaugguaguagugacagcugagaaguaaauacugcuaagugccaugagcuguuauaagcaauauaaacguuagcucgcacauugagugcccuccgcucacccccggcuucuccuggguccccucauggcuccagaacccuggguggaucguggcuggaaccagccccacuuuggcccucugccuguggguaucuuccucagagcccucuccggauguaccaucucgcccaacccugccaaauacagaggaggagcccgggacccaguugcuggccaggcccaagcuagucagggcaaggccgggcaggcacccacaguaggccugugucccggcugcuccgcuuucucucgaggucccauucuguugguuucuucucccaggaacaucuaugaggcaugugcuccccauuccuccucuuuuuccaucgguagccgcagggcuucggcuucuuccugacucugcccucucucccagcuuccccaggcagugccccauccuggcccccagggcuguguggggaugggugaugcuucuuuggggcugcacauaacuccucugucuaucuacccgcauguuugugaucaggagaccucugguaaggugcagaggugggggcugcaaggaggagcagggguuccacaggugagcccacugagcuggccuggccuggguggaugagaggcagugggugcagggccccuccgcuuaccagcuguguggucuuggacaaauuacuuaacuuuucuaacccucagcuuccucaucuguaaaaucaggaucucaggguugucgugagaacucaaugagacccuaucguuguggcuggaauuccgucagcccucaaaaacugggcgcuguuacuaguuuaguaacucacaucaggcagagaauaggggaaugggaaccugccuugccccggucccuucccacucccuccguggaccccaggccugcgacggccucuggcuuccuccucuucccccagcagcuguuuguccugggacagggcaagucggcugaaucuagaggugcccccgaugggcuguccggggacgcggcucuguccugugcucucucagggacaggcccauccccgagagcuacccuccugcucacccgccacacacacauucacacacuucuugaaagccccauggccuuuauuuagacguuacaggaaggaagugggugugggggguuauuuuugacaaucuggguuugaaauuagacagcgcgacucagggcaucagcuugcugggcucagcugagggugggccuggggucucccugaggucuguuugcccagggcugggaaaggagagaaacuuccuacugcacugcuccccugaguccccugacccugugcccccgcacccugcugucucagggcuauccuuucccugacgucaggguuugaaggaaaagggaagugaagccaugcugagagacgcuccauaacuccuucagggagaggcggggagggcucaggguaccugggagccggcaggacaguggugggauuugggggucccaggucuuccggggugggggcagccacucacuaggagugaggagucggcgcgaggaguggaggagggaaggaugguggcagcuggggagccagcgucagcaccgcagagcccgagguggagcguguccaugcagagcugggcaaaccuccaucaucacuugcccggugacccugggcacauucccucccaucacuggaggcucaggcugcuccuguggugccuggggcuggagcugagcgcuggguaccccccuucccggggagggcuugacuggccucugauggcacccccgucuuuccccagcgccggcaucggccgcacaggcaccaucauugucaucgacaugcucauggagaacaucuccaccaagggugaggggcaccuggggguuuggggguggggggugagcagccccucgguguccgccuaugccuggaccugagguuugacugccccccacccaggccuggacugugacauugacauccagaagaccauccagauggugcgggcgcagcgcucgggcauggugcagacggaggcgcaguacaaguucaucuacguggccaucgcccaguucauugaaaccacuaagaagaagcuggagguccugcaggugcgugcagagcagggccuggggggggggggggcugcagugcaggaugggugccaccuggcccugcugggaccaccaccuucccacugucccucugcccacagucgcagaagggccaggagucggaguacgggaacaucaccuaucccccagccaugaagaaugcccaugccaaggccucccgcaccucguccaagugaguggcccugacugccacugcccggcauccaccccuuuguccugcccagcccgauccucacuuucuggagaggacaaguguugcagcuggggggaccuggcuucaaguucaggcuugguucucaccccuucuguucauaagcauuuccugagugcccacacgugugggccucugcuagguaccagcagcgcacucguguaugagauguagccucuguccucuaggagcuuggagucuagugcagggaccguggcugcgucaccugugagacgggguggccagaggggacugccagugccgggucccccugugcugucuccugaccugcaccaacugccuguacuugccccccugcacccggcugcagacacaaggaggauguguaugagaaccugcacacuaagaacaagagggaggagaaagugaagaagcagcggucagcagacaaggagaagagcaaggguucccucaagaggaagugagcggugcuguccucagguggccaugguacagcucuucugccuggguguccucccugcccugcccuguguccuuggcuccacugccuucccuggguggaugggguggccgcagccucauucugugcuucccagcugccccagacccucuuguuccaccuccagguuccagcuacccucucacucccucacucccuucucuuggcagccucagcccugacccuguggaagcauuucgcgauggacagacucacaaccugaaccuaggagugccccauucuuuuguaauuuaaauggcugcaucccccccaccucucccugacccuguauauagcccagccaggccccaggcagggccaacccuucuccucuuguaaauaaagcccugggaucacugugugucgccucug

SEQ ID NO: 14890 - RNA, 18182 nt, Homo sapiens
aggcuaagucacaggcgcauuuauuauugucuggaacaucaaggccuuuccuccccuggcaguggcacaagggagggccaacucucaggaggcggccacgcugccaccagcagcaggcccaugggguggcagggucaugggcggcagaaacagcgccuucagcuugccugacaggcuggcgaucucaggauccugggcuucguaggacuugaccaagcgagcaaacuuaaggacaccugcaagagggaguggaaggucaacccuucuccuaaggaccagcgugccuaagacaccuggagggggugguagucuaagcaugaacugcucccccacuggcugggcagcuguuugccaaacaggacgcaugcaggccucugucccgugugguuuggaugaugacauuuggucuacacugggcacaacuagaugggaugcagugaaugaaaaugucccaaggcagugugcuucuugcucucaggugaaccauuuuagcaguuuagucacuggaaccccaagaaugaacacgagaccccaggucuguagcuggaacucaggaaggcuaugaggcagcagagcugaaucagucaacaccuuuggggaacaccaggaucucaccaaaaauuuaaccaccaaccccccccaaacaaaaauuagcugaaacacccuggagagacugcagccacugcugucaugcagacaugucacuaaaagguggcacaacagcauuuaaguccagcucugcuacucgagagucugcaccauuagaguuugcuuccucaucacaaaauggaauaauaaugugauuaacaguacagguugaccauccuuaauuagaaaauccaaaaucugaaauuaugagugccagugugaggccgaaaauggaaaauuccacaccugacuucauaguggggggugggggagacuguagucaaaacgcagucaaaacuuugucucaugcacaaaauuauucagacuauuauauaaaauuacccucaggcuaugugcauaaggugcguguauaugaaacaaaacaauuucguguucagauuuaggucccaucccccaagauauccauguauauguaaauauuccgaaaucugaaaaaacccgaaacacuuccggucccaaccauuucggguaagggauacagaaccucuacuguacaaaacgcaacucggacgcacaagcucaggguagacccugggcucugagugccaagaauguuagucagauuguggcugccgccguguggcgagaaaggggacaaccgcucaugggcccacagauccggcgcccucucccgacccaacucccgccuucccgcgucugacccgccuucccgcgucugacccaccuuccccgucgcagcugaagccauaggcuuugauaaccuccugcuggaucugcguggccacgggcagcacgaauugcagcaucuuacccaugucguugcaggcguuaucccgagccucguccaugcgcacugcauucuccggggcggagaacgccuggaucaccuccgcgaggaccacugcgcgccagaagcaucccagggaggcgucccggguaggcgucggagaacagacagcgggcccagcggagagcgcaaggaauuaguggauugaggcuguagguaacccaauaagaucccaagucuugggggcaagcgccccacuuagaaggacgguacccggcguccccuaccccauuuucccggcggacguagccagguuugucgccccacauccuccgcccgcauccuccccagaccagcagcccaugccuugacuaccccaggccagcagccuaugccuugacuaggacgauucucacccuuugcuugcucagcgcucaaggccgccgguugggucgaggcggacgccauagggcgucugaagcucuagguucagcggagguaaauggaaaacucacgaauaaagagccacguccuacaaccguucccaacgccccugggagcggaaaggaaacagcauccggcgcagccggaagcgcccaggcguggcccaaaccuucauaccccaagcuuacaacugcaucaagaccaccaaaacuacccauaauuuuugcacagugaaaacaaucuaucauuggcaacaaacaucauaagaggggcuuuccgguaaaaagccagaaagccuacuagacaaauucuaaaagagcuguaacacugcugcguauguguuuggagagaagaugggauauaaaggaacuccacaauugaugagggugagcuuaggugacuuuuuucuuguuccuauuacuguauaaacaacgacgcaugugguaacuuucaguaggaaaaauaauauucuaaggaacuuacuuaagucauucauuucuagaguucgcgaacauuuguucucagcccaugcaaaugaguucggugcugauugguugagaaagcagccagucacagccccuucguuguuguuaagcccggagaccuggauucggcaguaaaggcccagagcaaaagccguugucgcaguuuccuaaaggccuugucuauugaugagcgauggagccuaaugcccggcccgauuucccuucccuuccaggcuuuuaucacccacucccuucucaaacuguaggugguuaaggaugccagguacuaaucgccuggaccuauuaaaacuagcccaccccacccccgcuucauaaccggcuuuguuuuuuguuuuugagacggagucuugcucugucgccaagcuggagugcagcugggggggaucuuggcucaccauaaccuccaccucccggguucaagcgauucuccugccucaaccucccaagucgcugggacgacaggcgcgcgccaccaugcccagcuaauguuuuguuuuuaguagagacaggguuuugccauguuggccaagcuggucuggaacuccugaccucgugauccgcccgccucggccucccaaaguccugggauuaccagcgugagccgucgcgccuggccucauaaccguuucuuaaaguauuccacggaaagguuucaggacucugaagcccuuguuccggaggacucugguggcuccuagcagugagacccgucugaauagauuccuagaacugaccacgucagaggugggccugucccaggccucuaguguuugguugguuggggugucuuuuguuuguuuguuuugagauagggccuugcucugucacccaggcuagagugcaguggugcgaucaugacucacuguagccucgacccccaagugauccucccaccucagccuccugaguagcugggaccacaagugcaccacaacccccagcugauuuugucuuaagaugggguuucucuauguugcccaagcugguuuccaacuccugggcucaagcaauccacccgcgucucacaggcauaagccacagagcccagaccgaggccuccacuggcgcgcagcgguccugcccagccuuggggcaggagggggcaccagcacccaugguaccgccuccagcugagucaaggcucugggcucuucagggauccccucuccaauucuucccagcccccacaccccguuccuuaagaaggucuggucucuucccgcuucccugccaggcccuggcugcaguucucucuaagcaccgcugcacugagacccagccucacccccauaucccgcaaagaauagucacagccauguuccuggggaguugugaggauguuuuuguuugguugguuuugguugggauguuuuuuuaagagcgucauauagauauuuauauauauaaauuauuaguguggggaaggggcaaggggcauacauugcagagggggcgcgcacacagggaucggggaggggcagggguggcacacgaugcuacgcaaaacagccacaucuaacagaugaaauaaucacaccaacggggcaggggaggggcggcggccacagggguugggcaugggggaggagaaaagcaggggggacaaggaagagagaccugguccaagauucugugcgcuuucuguccccauccucgccaccuccccaccucugcacaccacaucgggccuuggccuucugucugucccucccucccccacucucuguccagcugcggaggcccugcaacugagcagcacccucuuggcucuggguggcaggccaagggcacgguggggggagggugggggugcuccaagguccaauguaggagccauggugcucucuugaucgcagguucuacaguggcuugucgcuuuccuucuucaggugacuagggaaggggcagugcauagcagagagguaagagacuugagaccaacucugaccuugcccccucuuaccgaagggguugggagaggagggguucccucccccaggagcacggugcccagccguaccaugcccacagcuccucccaggcucgcugagcccauguccccugggcuggggcacccuaggguaccuguaguaguccuccugggcaggcagcggcacacugugcagcgggugaugggcaugcagccacugcugcuguuccagcgccaagcgcugcagcucagcugacugugcgugcauggccugcagcugaugagcugcugacaucggggcagaaagggaggccggcaggucccgguaaggggcagcugugagcaggaagggcaaggggcauaugaccaacggauaacaaguaccugcucuggaccaggggauagccagcuccuuuacauacaaagguaaugaacuaaaaagugagguaacacacccaguucuguaaguugccagugguaggguggaauugggauucgaaccucuuaggcugacacuaaaacucgugcuucucuugggcagagcuccagcucuccuauucccaugcccagcuccucuaggcaccuccucaucccuccccaagcccaacuaggcccauccccccacccaaauaccuccuuucugcccuuuucucauuggagcugccuaccccaacuuccauccuuaccaaagagcuggugacgaagaacuucguucucgugcagagggugaggaagcaggggguuagggagaguuccagcuggguaggggauccggguaaggugagacccugaggccagggggucaaugagagggugcaccgaggcagaggcuggagggcagagaagaggaaggugucaccagaaggcagguuuggggcaaaccaugcauuugggugaagggauccaagccugggaacugagucagacaaacacaaggagguccaaaguggaacaaaggcagaguggaagaacuagaggccuggcagggguggacaggcugagcccuacuggaggagggacauauggaugacacaggacaggagauuacagucaucagaagggucugaggggaaggacagagagagguagacugcgugaagaagguggaagaugauagaaguuuagaaaauaagacaagaagaggccgggcacaguggcucaagccuauaaucucagcacuuugggaggcugaggcaggcagcucaccugaggugaggaguucaagaccagccuggccaagauggugaaacccuguuucuacaaaaaauacaaaaaaauuagccaggcaggguggcacacgccuauagucccagcuccucgggaggcugaggcaggagaaucgcuugaaccugggagguggaagcugcagugagccgagaucgcgccacugcacuccagucugggcaaaagaaaaaaaggaagccgggugcgguggcucacgcuuguaauuccagcacuuugggaggccaaggcggguggaucacaaggucaagagaucaagacuauccuggccaacauggugaaaccccgugucuacuaaaaauacaaaaauuagcuguacuugguggcacacgccugcagucccagcuacucgggcaggcagugccugcugaggcagaagaaucacuugaaccccagaggcggagguugcaguaagccgagaucgcgccacugcacuccagcuuggugacagggcgagacuccgucucaaaaaccaaaaaauggugaaaggauaguaaguaaagcucauuaucgccuaugacacccaaacccaaagcuacagggcccuuucuagaaaguuacagaucuagagauggggaaaaacaugaaagaccucgcagagggagaagaggagaaaauggcaaaaaaugaguugaauccagagaaaucagaagauagguuuguggguugggcacgguggcucacgccuguaaucucaggacuuugggaggccgagguggguggaucgcuuugagcucaggaauuugagaccagccauggccaacauggcgaaaccccgucucuaccaaaaauacaaaaaguagccagguauggugacacacgccuguaaucccagcuacuccagaggcugagguaggaggaucacuugagaccgggaagucgaggcugcagugagcugugauugcgccacuacacuccagccuggguggcagagccagaccaugucucaaaaaaauaaauaagaagacagguuugugaagggcuugggagaauggggcugugagaauagaaaaguguccuucaaaagcucccgugugggccucugucaugggaaggauacuagacuauggagagaacugggcuguggggcauacaggcuuuguggccagggaaggccaugagaagacaaggcugagagaacgucagggaggcaaaguucagggcagcaaucucaggaaagguucaugccaggccaggggaggaaagucuuggccauaggaaugaaagagcccagucaugauagggggaagguggccccaaagggccagggcaaggaaggaggggucucaccugcauggauagcaucuugcuggugcaggugcaggugcgaguggaugugggagugcugguggugauggggagucacauugagcaucugcagccgggccagugggucauugcccagggccgccacccuuucugcgugcugccucucagcugccagccgcucagcauaggacaugucaggccgcagggcuggcccagcugccagcgcuagacguucucgcuccaggggccccaggcucggaugaaaggggaaagggugcaggccaggugggccaggcugcagagccaggcccccaugucggggaaagggauccaagcccggcccagggaccccauguagggguuccagcucacuaggcuucaccucaaagccaggcuugaggcggucacggaggucucguucacgggcuucccguucccucucccgggcagcuggaucacugcuguacagggccgggacauuguaacccaggagccccggguccacugcccccaggggcacguagaauggaugguugcgauugccaggagacaugacaugaggccgggcauauucacugagagugcgcaaggcuggagugucaggacccagguaggggggcacuguagccaccgcacugcccgguucaaauggagggcgauggggcacugggcccagagaugggcauuccaccggagcacggcccuccugagccaacuucugugggauacagggaaaaguggagucaaagcggcaguuaugaaaagagguggcugguuuuaagcugcccauuuguuucgacagccgaaugccaaaaugccucaacucauugaaacucugcccaccuggaacuuaacugcggcccccgcucccgaauauuugcccuucuugggauccacagguagucccaucugagcaugccuuuucccaacccaggaaugcagauggcucucgcugaaaaccuuuugggcuccauuuccugggcugcagugguaccuccccuccgacagguggcgacgugacucgcccgcccacccagccacagccccgcagcguagcguagcgcagcgcagcgcagagggaaggaaggaaagagggaaagaaggcgguggcgcaggcagugacgcacucaccacgcugcguucaagcucgcgcuccuucucgcgcucgcgcucuuucucgcguucccgcucgcgcucgcgcuccuuuucuucgcgcgcgcgcugcucggccucgcgccgcaccuucuccaccaggucggcccgcuucuuggccagcuuggagcccuccaguggcacgaaguacaggucgcugcgcgcgcacgaguugaagccgcgauccagguguuuguugaaccugccgggcguggaagcagcgggcgcucaggcggugcgagcugcccgauggagcccgcagcgccgcggccccggcgagugcuuguagcccccgccucaaaaccaccccugcaggcugugagcugcugcgggccucacuggccacuaggccuggacggaggagaggggcgugcuuuucuaaaacacuacaccagcgcaaggccccucccugcuacucccucucucgucgccgccuugucgucguccccuuuccaggcccaccuccgccccaccuggccgcucaccuggcagacugacuggcauggcuggguacaucuaccaccuugggagggggcgaggggcugcgggcugggggcaccgggcucucgggggucucauacuccucagccggcuccuguuugaucugcguggcgcucaggggcggcccugaggcaggggccgcagguggugguggcagcgauggcaggccugagggccccgcagguggcaggggcccaggucccacggugggcgagcccggcuugaaggucccugggccugcagguggcgagguuccucgauagcccggugggguccccguucggaaggagggaggcgacccggguuuguauccgggugggguggcugucuuguaggcccccggggacggggcucucuuuccguacggugggggcccagguggggaggccguuuuguagccugcuggcgaggaagccacgguggcaaugaccguggaaaggguagccgaagagguggugaccguaggcaccggugggaaaggguagggcgccccuugagggcccugggaaggggaggggugugaacauggguaggacccuugagaaguggaagaggaagaguuggaagaggaagagacuggagggccauuggggccugcuuggcuguaggacaccuggcugugaggugggggcaggugugcuggcccugguggguagggccucagagaccccagggagggagacauggcguaagggugugcguggugggagcuaccgcccuccaguggguggggaaaugcuccaggaggagggggcccagaguuuccgugaugcugcugcugcugcugcugcugcugcugcugcugcugcugcugcuguugcuguugcugguggugauggugauguguugagacuggugggugggcgguggacugggccccaguagagggagggaaggggccuggaugggcauugcuguuggcuaagaggcggccauagggaggagguggugggggacccuggcuccacacagccugggaugggagagaaggcugaguauacuuggggggcugauuggagacagagaggcuuguugggggagggaaagaguggggguagcugggcaaugccugggaagcugggaagggggaggcagaggaagaggaggaagaacuggaagaggaggcugcugcagagcuacuacuagaggaugaauaaggaaaccucauggggggcgcuggagcagaagaggaagcaggaggcagagaguggggugaaggagccagaguugggcccuucucugggccaggaggaaguccacccauacccugucccauggcguggggagagggcagaugaccagguagugguugggcccccaggccagggggagaggcugaugcauuguugaggggucucagggcaggugggggaggcagguucggugucacaugggggaaguuggcuggugguggagcagaagguagguucccaccacccacuggagugguaggcggcuuuguugggggagcaccacuagccccagagcuugauacugaaaugggaguaguggguggggggugcugcuuacccccauuagggccccccacugaugaggcagccccuccccccuugggacccauuggggguccagacaaaacuccaccagugcccccaggauagagcugugggugagggggaggggccccaggaggagccuggaacauucgagauguggggggcuccaugggagcaugauauccagugggugucacagaaggaugggguucaaagcuagccucuggcugucgaggggugcugucuggcgguugaggggaaggaggaaagaguggaggugggugguaggggcgggcugggcccugggacaggccagaagaugagucagagucauucuccacacuuccagggcuguagauacugggggacgugcuucgguuguccuggucgauaucccuagggucgcugcugccaucaucauuaaggcuccgcccguccaagcuauccagaucggagggagacuguggccgagggaguuccugcuguagaaaagggaagacucauuuuuucucuuuuccuuuccugcuucccugagauuuggggcucucuugcauaaaaucauuuccccucacagcacacuguuguacugugauguggugaguacucuugcucaagcccaccucuuaccaucuggggauuucucacuuuccucacauucuuggcugcucccuagcagccagucuuguuucccgccuguaaaacccuauuccuuccucaaggauccaucucaagcaccuugucucuacccacagcugacuccaacucccugucuuccaccaucucauaaccaccacuuuaaccauccuccaucccccaagcccuugguuuuuauaccacuucuggccgggcacagaggcuuacaccuguaaucccagcacuuugggaagcugaagcgggcggaucacuugaugccaggaguuccaaaccagccuggccaacauggugaaacacugucucuaccaaaaauacaaaaauuagccgggcaugguggcucaugccuauaaucccagccacucgggaggcugaggcacaauuguuugaacccaggaggcggagguugcaaugagcugagauugugccacuguacuccagccugggugacagagcgaaacugucucaaaaacaaacaaacaaaaaaaaacaauaaaaaagaaagaccacuucugcauuuuccuuaagauuuauuuguuccuccgacuaagacuucucacccagagacuagaaucccccaacucuucugguccccuuuggcccugccuggucaucugguggucugucaaagcucuaagaaucucucuggcauauuauagacagaacugcucucauaagcacuaugaucuggccuuucucuuaugucccaggagagauccagcuaagaauagugagcauaagcaagucugagaaaagaauggucacaagaugggucaggauggcgacaaggguuucccaccucaguuuuggucuuuuuuggugcauuggucuccucacuuucacucucugagaucuccucacuccgacccugcuuguugaccuuugggguggaggcuuccucuacucgggccuucuguuagagagaaagagaaaauuccugucuuuucccuaccucccgagcuccaccguuacccucugccaaacaggaaguucccccacaacacacacacacccucagccccagugccuugggcauccugugggaggaccugaggacagaauaccuuggcugucugccuggacuucucagcuuugccaucacugcuggacgugcugaccccuccaggggaggcccggccccucgaucucaguucuucccggggcccaggggccucuuucuuccguccacuccucauugacaucuacaggaggaggaaggagguagguaacacuguucuuuacauugcaccuaacuuuauggugcacauuauuuguucuucuucucuagacccuuccuccuagcuugccugccccgccccucaucuuucaugucucucauuuuaacucaccgagucuuuauucugucgugucuucauucuucaggcuguggagaccccauucuccucugccugggcagcugaauacagaaacuucucugcuccaccccaaguuccccacagcuguggucugggaagcaggaucuccaaguuuccagugugggcaccuggaacuuuugcaggaucuguuuucaaugaaaccuguuagaaggaaaccaucagagucuccaacuuggagaacagagucacaaaggaauacuauucugcuugucagagaacugagcaagcggcccaacccuaagccuuugggccaagagguacagauaccacaagacauugcuggcaugccccaugggcuaccuuagcuaucuaaaagggaggcagauucugcucgaaguauaaucucuuucaucucuguagagggcagaaaauucggauguaccuacaagccccaauccaggagaucacacaguuuacccuucaugaucccuaaaggauauuugugaacacacacauuccacggagccuuacaaaggaacauaaagaaauggagcggggcaugguggcucaugucuauaauuccagcacuuugggaggccuagguggauggaccacaaggucaggaguucaagaccagccuagccaacauggugaaacccagccaggcgugguggcacgugccuguaaucccagcuacucaggaggcugaggcaagcaaaucacuugaaccugggaggcagagguugcagugagccgagaucaugccacugcacuccagccugggugacagaguaagacucugucucaaaaaaaaaaaaagaaaaaagaaaugacauugaaguaugaauuuauugaauaccuucuuuauaucaagcccuucacauacaugauuucauuuaauauuuacaaccaacccugaaugguaagcauuauuacccucauuauauaggugagggaacugaggcucaaagauugugauugugacuagcccaaccucacacagugaggaaccagugacagagccagaaucaaacccaugucggugacuucaaagcccaugcucuuucuucuauacuuugcuguauucuccucagaaguugcuggggagaauucucagaaggccuagaucagucacagagauaugaaaagaaucuuuucucacaucagaguagguagaagaagaaugucccauucuauaauacaaaggaacacagcccuaccaaucccaagacuaaaccuagguagccccaaauuguagaacuucauuuuugagagccccauaaaggacccauucucuaguacuugagcucccuaaggcuagaggaaaagucaggguuuucacaugaaugauuaaagacucaaaauauccgugagcaaacaacacagauguaccaguuuuuaagccuauccuccuacuugguguagacuggguuacacaguuucucacagccaauccauccguaucugucuaucagcagguaucuaucuuuauccaaaucccuauagccagcuguauucauuugcacuuguuuguauuucuugcuaagugucaagucccuccaaauuacugauuguaagaucuuuugagagcaaaaaugguauuuucuuacuguuuucuuccuuuccacugaugugugugcgcucuucuugugauugaccuuuaaacccacuaacaucaguaggucuuucuuccugaauuaagugcugcuagcuccagugggaacagacuaagcuuacccauguauucuauucugaguuggaggccugcuagguaaacggcauguccauauucuguaguguauuuuuucccaagaaacacaguaauucucacucaccuccacggaaccauacugaugcaggcaguaaggggugagucuaaccuuuccaggaaacuucacaauuuacuuagaaucacaaaauugcugggacagagccuaucuucugaacuuucaacugaugcucugcccaguagacuugucuuuuuuuuuuuuuuuuuuuuuuuuuuugagacagaguuucacucuuguugcccaggcuggagugcaguggcgugaucucacucacugcaaccucugccucccagguucaagcgauucuccugccucagccuccugaauagcugggauuacaggcaugcaccaccacacccggcuaauuuuuuguauuuuuaguagagacaggguuucaccauguuagucaggguggucucgaacuacugaccucaggugaucugccugccucggccuucccaagugcugggauuacaggcgugagccacugugcccggccaacuaguuuucuuuuuuuuuccuuuuuuuuuuuuuugagauggaucuuugcucuuguuccccaggcuggaggugcuauggcaugaucucagcucacugccaccuccgccucccagguucaagcgauucuccugccucagccucccaaguagcugggauuacaagcgcacaccaccacaccuggcuaauuuuuguauuuuuaguagagacggaguuucaccauguugaccaggcuggucucgaacuccugaccucagaugauccaccugccucagccuccuaaaguguugggauuacaggcgugagccaccaugcccggccuuuuuuuuuuuuuuuuuuuuuucaacuacagcuauuuucccacauuuuuuaguuguuauguagacugguuuuaaaauacuaucaaccaaaaaaaaaaaaaaauccgaagaacaacacccaccauagcaaaagaggaaaacaaucuuaaacaaaaagcacaacaaagaugacuauuugugauugguguauuuuugccagcccuccuagagaaggguguccaucucccuuccccaucacagaaccuguucaccaagucaguuagguuaggggauccaaaaggucagagaaacacaggaauguaccugaggaacacagcaaucauaguaugcccuucuuuuuuaaucaccugaaaucugauaaaaacuagcaaugagaagcuuugaaggagaaaagcagucauaaaagaacaaguaauccuggggauaaggaguggcagacgaggaaaggaguuagggguggauugugugucuuucuagaccugggucauguuuuagcaccagccuacacuccuagcaggcaaucacuguaacuaauauuacagagcaccuacucuguaucuggccacauacuaagcacauucaccuucauuaccuugcuuuauuuuauuuauuuauuuauuuauuuauuuauugagacggagucucacucugucacccaggcuggagugccgugccgcgaucucggcucggcucacugcaagcuccaccucccggguucacgccauucuccugccucagccuccugaguagcugggacuacaggcgcccgccaccacgcccggcuaauuuuuuuguauuuuuacuagagacgggguuucaccguguuagccaggauggucucaaucgccugaccucgugauccgcccgccucagccucccaaagugcugggauuacaggcgugagccacugcgcacugccauuaccuuacuuuaaaaagaaaaugauuaagaccagacuggguugggaggaaagugagaacuagaaaaagagccccuaaguaagaacaggaaaagaaauuaagagagaaauaugggaugucagaaggaauacaguggagucacaagcucucugggaggggcucgcaggcuaaauuucaggaucauuggcccagcccccaacaucauucuggaccugccagacuaacaaaccaguccaaagugacuccuagauaacaaugcagcccagaccagcagauaacgaugcacuggccuaagccuucugagaauccgggaccuucagagaggccucagagaucaucucaucuauagccccuucaucuuaacaaugaagcccaggcucaaagagaagugacuugcccaaggucacagaggcacagccaggucuagacacaggucuccuggcuccuguucuauaguauuuccccugcaugaagcuguuucacagcccucuguccugggccacccucaccugggaugggccugggagcccagccauuucuacaaggucagggaagaaggccaaagguuaguugagggaaagaggaaaaggguuacucaagaagggaggcucaaagaggaauucaaguuuuagaaaaugaaagaaagugcaaagaagcaaaaagacaacucuacaaaaaauaacauaauaagggagguagaggucagaaccaacugccaaaagaugguguaaccugaacagaagcguuuucauccucccaucaugcccagguggagagacuuggagaaacaccuaugaucugcaaggaacguaucuaccuguuccaacagacuucaacaugaaagggugcacaccguggggaaacucccaaccaccaacagauccagaaacaaccuccaaaacccagcccagagucccaaggacagccacaggcugagguccaauaaacauucgaagcccccccaaccaaucugacaucccacuggaucacuaccauagcaacacaguggcaaaaggugccccucaagagaccaucccagguguccaucuggcagcuacccccuaccccaguugccaaagcaacuccuacccuccuauagcaccucagguaagggagcuugaagguaccuacccuagucaaaauaagcccaugcacaaagggagaucuuugagcucaaagcaguaacuaaggccucccuauauagaucacagcuccaggggcagcggacgcuccggaaauuggaggguggaggguggaggucgcaacuugccuggagugccuguaagguugcucaauucuccauuuccauccucccagaaccccuuucuucccaacucccccuucuguguuccuguuuuccuccucacuaguuuugggauaacccacacuacugggccccagugcccucuccaagaaauaacuaugucugggauagggaaaacagggucagaggugaccugcaguaggggaaugaaaaccgucacaaagacauggccuucccucuuccacgcuggaaaaccuccggcucuucucaaaaauggaccucucuuugcccaagccuccgucucccccagguucaucagccacaaucccucuuuccaccuaccacaccccuuucccguuucccacuucccgucuauuccuaaagcccccaaccccaggcuccggaacccguguucugguccuuuggagcuuuuuccuggaggcuucaugccccaccucgcugccaucucuccuauccauucugccuucgcccggaaccccacucacagcaucccccguuuuccuccgccaaccccggccucgauguuccuccucuuuugagucugcgggucccggauacccucuggccccacaggccuccuccggagacccucccuccuuccccaccuucccgauccucccgaaacccuggcccccgacucuccucggcgggccccacccccugagcccccggcccucaggccaggcagagcccgcaguggggggacgggauugggaaaauaacaaauggaggcggcggcggcaggagggggaacugggagggguggggguggggagccgcaggccggagcccgggcgggacagaaccccgcgggcccggggcccaggcggccgcagaccuuaccugcugguagcucgggacggcuggcuggcuccgagcgggauuccgggcuccggcgccucuggggggcggcggcggcagcucccccgccccccucuccucuucucggccucagucgccgccgcgacgacggcggcggcggccccgacccccccggagggcggcccccauccccccuuuuccccgccuggccccaaucgcccgccggcccccggagcaaaccccgauccccgcucugcuccccaccuccccgggcucgccgccucccccuggccgcccggaaugccccgggccgcgccgcccgcccccgccgcgccgcccggccccgcggcccgcccggcccucggcgcgguuccgacccgccgccgcccgcgcccgccuagcgcagcccgcacccgcgcgaucccgggccccucggccgccucgcccgcggcccccgccccuuccccggcagucggcucccucuccccccuccuagccccuccccgaagccgcggucccuccgaaauggcccggcccgaggccccgacccggcgcggggcugcggacgggcugggcggugc

SEQ ID NO: 14891 - RNA, 9501 nt, Homo sapiens
ccuuccccacuccacccucgucggucccccacccgcgcucguacgugcgccuccgccggcagcuccugacucaucgggggcuccgggucacaugcgcccgcgcggcccuauaggcgccuccuccgcccgccgcccgggagccgcagccgccgccgccacugccacucccgcucucucagcgccgccgucgccaccgccaccgccaccgccacuaccaccgucugagucugcagucccgaggugaagcccccgccaggcccagagccccuguggcccccucccuucgccgcggcgccccugccuccuuuacccggugccgcugcgcaccucuccgcaucucuggcccggugcagcugcgcaccugcuccgccgcccgcgcccagggcgccuucccucccuggccuuccccgcccgcugccuucgcuuucuggcccucugcgcgccuaucucuaacugcgccucuccacccuugccugccucucucccggugcucgcccucaucuacgguucuauuuguuucuaaguugggagccucuccgggcggugcauuuuuauccuagagcgucccuuuugguuugcauuuggggaaaugucuucucucaccguuccucaccucccccagacuucccuuggacuccccucucuccugcucuuccccacggcgccccucuccguucgcgcuuccuccccucugcugcacgggggagagauggaagaaguggggaucugucgaggcgcagaggggaggacaggcccagcucgccuccacuccccaccggcucuuauccucuucacuucccgcugcaacccccagggacugcagggccuuucucaggacccucuuccccgacaccuguauugcaugcgccuuucgcgggaagaggagggauacacguuugggagagagugggaccuuggggaaggggcaguguucaggcagcugggguguuaaguuggggagguaugggggcucuggaagagaggcccaggcagcccauccucuucuuggcucccaggagaaaugcaagccuggcagccauuccgcucugaggagaucugggggaaccccaccggcuggccaagcugcaaagaggcgcgggaaccacugucgugccccuccccuccucacugcaguguucucccaucucaucauuugaucuuaccccgccccccacugcagugaccuccccuuccucacugcauugaccuucuccucuucccaggggggagggggaaucccuucuacagcccuagacugcagccagcgccucccuacccaccccccacccacugcaguaaccucuuucccaucccucccagccucccgccccgcccauugaucucaggcuccaccccucuaagccucuuaucuuucuccuuccuucccuuccacccgaggagaucccagccaucauguccauagagaagaucugggcccgggagauccuggacucccgcgggaaccccacaguggagguggaucucuauacugccaaagguaauggguguggcaugggccuuccuacagcccuagcuuuuccacggccaggcuggguucggccagggguucggaggccuuuuuugauacccagggguauggggugcugggccaggcucacaagccuggguuguggcgguuggauccuccuuguccggggagccaggguaggugggucuguguucgaguuuagcgugugaggcauguccugccuccgugugucugccugugcacuugcaugugugcagacgugugcugcaagcaauuuucuuucugcgggcucccacuugugcauguggggccucagauggguggaugaggaggccacuucuugugcaucugccucagugugugugugggguggggguggggggauguuagggagcaguguggggagagagcuagaugugguaggcaggcaguuuagagccagaaggcugaaggacucccuggccccuguguccucuucacucccucucauuccauguuccuccuuuaggucuuuuccgggcugcagugcccaguggagccucuacgggcaucuaugaggcccuggagcugagggauggagacaaacagcguuacuuaggcaaaggugaggucccuucucuuuuccagacucucccccaccucagccuuaugccccuaccucacaccaguccccaguccuccucuagcauggcuuccccuccucccauugaucccuuccggccccuccuggcccgacccaguccagccucuuccuuuccccagguguccugaaggcaguggaccacaucaacuccaccaucgcgccagcccucaucagcucagugaggccugcucuuugcuggggauagcagggccagaguucuggaaggaaucccggagcagggcaggaggaagggaagaaagaaggcccacucuuaggaaucaugguuacaagggggaaggguggggaacagcuuccuuaaugcacccugcucccaugggaguucagguccccuaauccagguaggccccugucacagggaccugguuggacccuggccaaaugugagcuugggugugaaugaggggacccucugccuuagggcucagccuccagccuggcccugggugauggaggcucugcccucagggucucucugugguggagcaagagaaacuggacaaccugaugcuggaguuggaugggacugagaacaaaugugagccggggccgggagaaaguggggaagcgucaggguggggaggcguggagcagauagagagcugaagggccagugcuguaguggcuuccucaggaaugacugucaggggcauucuccucucaaagccagagcaaggggagaugaguuuagcugcagagggaaggaccgacaguaggcagaaggaagaccuucuuugcagcauacagaggagggggauggccugagagagucuguggucucagggauauuuagaaagagguguggcucucugccguuuccaaucuccuccuccccacccauuccucucccugcuguuuucaagagagcauggaugagguguugcuggggcagggguggggagggaggagggggucuccuuuacuggcuccuuuuggagacuacagauggaggcaggagcuagaaaggagaaggggacauugugcucagcaccuuccucuauaaucuccuagccaaguuuggggccaaugccauccugggugugucucuggccguguguaaggcaggggcagcugagcgggaacugccccuguaucgccacauugcucagcuggccgggaacucagaccucauccugccugugccggugagcaauaagccagccugcggcucucccaggggcgggugggggagggagcaugcaacucaugaggaaugaugggaggaaagugaauugagggagguaaagaggaaggauggggacgugagacuuaguccggaaagcugggggaaguuugggaucuuggguuaacacuccuggggcgggcagggaggggcucuuugacccuucugucuuucuguggcuccccaggccuucaacgugaucaaugguggcucucaugcuggcaacaagcuggccaugcaggaguucaugauccucccagugggagcugagagcuuucgggaugccaugcgacuaggugcagaggucuaccauacacucaagggagucaucaaggacaaauacggcaaggaugccaccaaugugggggaugaagguggcuuugcccccaauauccuggagaacagugaaggugaggccaggagccccacucccagcucuaagucuuacccuauugugggacaucagaaagggugacacaguucaccaaguccugaguaggcguggaggguccuaggacucugcaaacuccaaaagguaccaguucuuagaguggauugcagagagccugccaaauucacaugcagaccuagggggacaguauuuuuuuuuuuuuuugagacggagucuugcucugucacccaggcuggagugcaguggcucgaucucagcucacugcaagcuccgccucccggguucacgccauucuccugccucagccucccgaguagcugggacuacaggcgcccgccaccacgcccggcuaauuuuuuguauuuuuuaguagagacaggguuucacuguggucucgaacuccugaccuugugaucggcccgccucggccucccaaagugcugggauuacaagcgugagccaccacgccuggccaggggacagucuuuuaccugccuagccagauguguuagcaucuguuaaguugccacuggaaggccgggcgcgguggcucacaccuguaaucccagcacuuugggaggcugaggcggguggaucaccugaggucaggaguuugagaccagccuggccaacaaggugaaaccccgucucuacuaaaaauacaaaaauuagccgggcaugguggcgugugccuguaaucacagauacuagcggggcugaggcaggaggaucgcuuguacccgggaggcggagguuguggugagccgagaucaugccacugcacuccagccugggcaacagagcgagacuccgucucaaaaaaaaaaaaaaaaaaaaaaguugucacuggagcccuugggaauacugggagauggucuggaugacuguuggauucaucccauccauucgaaaucuguccuguccccgucccaaccuccuaggccucuagaaucccuaauuuuucugugccuugggggaaacuguauagggaauggaaagaauauagguagugguuaagaguuaagguucuggggccaaauaaccuggauuuauuugaaccuugacuuguggaguuacugcuggugaacuuucuuacuucucucuggaaauaauaacagaaucuagcucaugguagugugaggcuuaaaugaaauauauauaaaaugcuuagaugacaugauaccaaugaaaguauaguaaguauuauuaagagaauuccauuccucuguguuccuagaagauggccucuccucccagaccuggggauaaccccaacagcauccccgccacacuucccucaggaacagcccuccaccucugcccugaaugucuuuucuuucccuccuccuccuugcccaucccuccugcuuguacuauaaucucacuguauucuguccccagccuuggagcuggugaaggaagccaucgacaaggcuggcuacacggaaaagaucguuauuggcauggauguugcugccucagaguuuuaucgugauggcaaauaugacuuggacuucaagucucccacugauccuucccgauacaucacuggggaccagcugggggcacucuaccaggacuuugucagggacuauccuggugagaggaaguggugugagggggaggucugggggcaggcagggacgugucccagcaacucuggaccuuauggggugcugacucaggcaccagguggggguguccuaagaagaaccugagaaccagggagagggugcaggagccaccugcaaagacugggcuuuguauguaguguaaaaaugcagguacccgugaccaaucuguucugucucagauccugauuaaagucauggguucugaaaacuacugggucauggggaaggcucuggaaggaaccagggaugauaugagugugacuggaucuagcagagaacuagaacauuucaguaucuuugauugaugaaauuguggaugcugaauggagcugggacugaugugugaguagaaagaaggcugagggggacugaauuagcuucugcaagucugcccagggccuuuaucucaggauggaggcaguuggucgccaucuuccugacacagagcgaaagaaaaucaacauaauugcagaauuaaggauuuggauuagcaaugaggaagggcuugcuggcagugagaacaggaaaaugcaaagcuagguugugaacccuuguuacuggaagauuuuuuuuggggggggggugggguuguuuuuuuuguuuuguuuuuuuuuuuugagacagaguuugacucuucuugcccaggcuggagugcaauggcgccaucucggcucaccacaaccuccaccucccggauucaagcgauucuucugccucagccucccgaauagcugggauuacaggcaugugccaccaugccuggcuaauuuuguauuuuuaguagagacagggguuucuccauguuggucaggcuggucuccaacuccugaccucagguaaucuauccaccuuggucucccaaagugcugggauuacaggcgugagccaccacgccuggcugguuugcuuuuaauuaacuuuuuuuuuuuuuuuuuuuuuuuguagagacaggguuuagccauguugcucauggcuggucucaaacuacugggcucaagugaucugcaugccucggccucccaaagugcugggauuacaggcaugagccacugugcccagccuauggaaguggcgugagaucucugcucacugcacgauucucuuagccucccaaguagcugggauuacaggcgugcaccaccaugccuggcuaauuuuuguauuuuuaguagagaugggguuuuacuauguuagccagggaacuccuauccucaagugauccguucaccucaguaucccaaagugcugggauuacaggcaugagccacugugccuggccucuccauguaagguuuuaugaaauaagaaucaggagccaggcgugguggcucaugccuguaaucccauuacuuugggaagccgaggcaggaggacugcuugaauccaggaguucgagacuggccuggcaauacagugagaccucaucucuacaaaaauuuuaaaaauuagcugaguguggugccacacaccuaaagucccugcuacucaggaggcugagguggcaggaucacuugauuggggagguggagguugcagugagcugagauugugccacugcacuccagccuggaugacagaaugaggcucugucaaaaaaaaaaaaaaaguuaagaaucaguuagggcaggcuuacacuggggggauuugucuuagcaaggaugagcagguguaguuaaccaagggccuguccauuucagggaauaaaggggcauguuccugccugauguagagacccagggaagaugaacaccuccccccuccccaccaugcucucucugcaguggucuccauugaggacccauuugaccaggaugauugggcugccugguccaaguucacagccaauguagggauccagauugugggugaugaccugacagugaccaacccaaaacguauugagcgggcaguggaagaaaaggccugcaacugucugcugcucaaggucaaccagaucggcucggucacugaagccauccaagcgugagugacuucuggcccucuccugugugguccucguuucuauaagacuccuuuugcaagugcuccagccuaauucuacccaggggugccaaagagagcggggaaccuggaaucauccucacaguucucucaccucugccccuccaccccugauucucugcuccccucccagauagcuuuccccuagauguuuccugacauagaccaagguuggggcugggaagagagugcccagugugagagcuggagaaucagugcuguguguggauacaggugcaagcuggcccaggagaauggcuggggggucauggugagucaucgcucaggagagacugaggacacauucauugcugaccuggugguggggcugugcacaggccaggugagugaggcagccuggugagugaagagaacucucugugggauugguauuucuagcucacccaccuggucucuccuuccagguguuugagggugucaggggaguuucaggagagcagaaguuuccuuucaggggugagagggcagucacugagcugcaaauccuuugaaauguuucagaucaagacuggugccccgugccguucugaacgucuggcuaaauacaaccagcucaugaggugagggucccuggggugggagccccuggcccagauggcuaaaggccccauuugccugccagaccaucuguagcaccaagggccuggauaacaguccauuuccuggauaacaguccaacagauaauauugguuuuugcuuccuggguuuauugauggccugauugacaaaucccagagaucacaugggaaagccagggaaugcuaagccuuggggcaggacacaaaagcagguggugugggggugguuggagucugggggaccccuagagagagaagcaggauccuccugcaucccugaccacuuccuuugugguucaucucucucagaauugaggaagagcugggggaugaagcucgcuuugccggacauaacuuccguaaucccagugugcugugauuccucugcuugccuggagacguggaaccucugucucauccuccuggaaccuugcuguccugaucugugauaguucacccccugagauccccugagccccagggugcccagaacuucccugauugaccugcuccgcugcuccuuggcuuaccugaccucuugcugucucugcucgcccuccuuucugugcccuacucauugggguuccgcacuuuccacuucuuccuuucucuuucucucuucccucagaaacuagaaaugugaaugaggauuauuauaaaaggggguccguggaagaaugaucagcaucugugaugggagcgucaggguuggugugcugagguguuagagagggaccaugugucacuugugcuuugcucuugucccacgugucuuccacuuugcauaugagccgugaacugugcauagugcugggauggaggggaguguugggcaugugaucacgccuggcuaauaaggcuuuaguguauuuauuuauuuauuuauuuuauuuguuuuucauucaucccauuaaucauuuccccauaacucaauggccuaaaacuggccugacuugggggaacgaugugucuguauuucauguggcuguagaucccaagaugacuggggugggaggucuugcuagaaugggaagggucauagaaagggccuugacaucaguuccuuuguguguacucacugaagccugcguugguccagagcggaggcugugugccugggggaguuuuccucuauacaucucuccccaacccuagguucccuguucuuccuccagcugcaccagagcaaccucucacuccccaugccacguuccacaguugccaccaccucuguggcauugaaaugagcaccuccauuaaagucugaaucagugcacuguugugucuaaggagucuuacucuagucccuaugaggggagagaagauggagcaccuggaagcuggugaaacuggauagcagagcugggggggcacaaaaagaggaagacaaacugaacaaauauggccgagaugauggcacugccuaccccauucuggcuagguggggugcauguggccccugcuuucuuagcagaaggcuuggcucccagacgcagguga

SEQ ID NO: 14892 - RNA, 2660 nt, Homo sapiens
ccucggggagggucacagcccgggacugagacccgagguuaaccgcccggggugggcuccacgggggcggggcaugcucuccgcggcugcugccgguauagagcgguaacugcccaggagggggcggggccccacaggggcguggccucggagcugcacggccgugggcggcgaugagaggguuaagccccagagggcccuggaggggcggggccgcgggacgggcucggcccaagggaggagcugggggcggaagcggccggcggucugcgcccugcgcgccucggcuucuuuccgcccggcuccuucagaggcccggcgaccuccagggcugggaagucaaccgagguucgggggcagcggcgagggcuccgggcgaguaagggggaugguccaugcugaggcccaaauggggcgaacucgcgagagucucuggcgaccuggaucagauggggcgagggcagaugaagggcccaggagcuuuggggcagcgaggagggaggagcgggcccguuggcaaacuugggugaaaggaugggguaccugggugacgagcccccgccaggauucugcucuucacgccccuuuucucccagcucccuuccaggucaauccaaacuggagcucaacuuucagaagagaaagacgccccagcaagccucuuucggggaguccucuagcuccucaccuccaugggccagacagcucuggcagggggcagcagcagcacccccacgccacaggcccuguacccugaccucuccugucccgagggcuuggaagagcugcugucugcacccccuccugaccugggggcccagcggcgccacgguuggaaccccaaagacuguucagagaacaucgaggucaaggaaggaggguuguacuuugagcggcggcccguggcccagagcacugauggggcccgggguaagaggggcuauucaaggggccugcacgccugggagaucagcuggccccuagagcagaggggcacgcaugccguggugggcguggccacggcccucgccccgcugcagacugaccacuacgcggcgcugcugggcagcaacagcgagucguggggcugggacaucgggcgggggaagcuguaccaucagagcaaggggcccggagccccccaguauccagcgggaacucagggugagcagcuggaggugccagagagacugcuggugguucuggacauggaggagggaacucugggcuacgcuauugggggcaccuaccuggggccagcauuccgcggacugaagggcaggacccucuauccggcaguaagcgcugucuggggccagugccagguccgcauccgcuaccugggcgaaaggagaggugaggccuggggcagacguggggagaacuuucugucccugguggcagugguuugggauggaaacucuucugacaagagcagaggggauggaccuucauccagccugccucaaccucuguucagugcugggaaaggcuaggggucuucacagcuguuauuuaauuuaacccaacagcaauagaggugaaacaggcuugagaaagcaacuuucucaaguucucuuggccaguaaauggugaaccuucagaauggagggaggaacugcagggaugagagaauucaggagauaucaaccccugagcaagaggugcaaagcguuagguacuggguuugauguacagguccaaaagaaggaugggcagagccagguacccaggcuguauaccggauucccugggcucuaaccugucucugugccacauaccuacuuccuuccucagccacaccucuggauggagacacuggggcccugggcaccagggaggagagcaguggaggaggcagggccuuaggguggggcagcaggggaggagccuccccaggaacugacuggguccagggcuuggagcugcucucugcaguugugugggcuguagaguggagggccaucccuccucaccucagccccagcucccaagccucuggagucaaagccugggccagcuccaccacugucagagccaccuuggccuguuguuuagagggccuuagccagcucuucacccccagcucugacuagggaugugugaaaucuuaucugggaggcagaacuuccggguaucucaaauuccccuuucagccaggugggcacacucgaagcaggaaagcagaaaggcaucugaguaggaccccguaguuugaggacaucuggcugguggcugcacccauacuuacauuccccuccuucucucucccagcggagccacacucccuucugcaccugagccgccugugugugcgccacaaccugggggauacccggcucggccaggugucugcccugcccuugcccccugccaugaagcgcuaccugcucuaccagugagcccugugauaccacagacugugcugaggucuugccaccaccccuccccuuggggagguggggaggcacugcuggccuagaccagcugcugaaagcuggugaggcugagccccuaccccaacccaagcucugcggaaaucaacagccccagagccacuuggagggaggaagaaagggagccggcguucaaggcuaugacagucugcuacgcaaaacauuuuuucaaguaaaaauaguaagagauguuguuauagaaac

SEQ ID NO: 14893 - RNA, 6059 nt, Homo sapiens
ggcuucuuuccgcccggcuccuucagaggcccggcgaccuccagggcugggaagucaaccgagguucgggggcagcggcgagggcuccgggcgaguaagggggaugguccaugcugaggcccaaauggggcgaacucgcgagagucucuggcgaccuggaucagauggggcgagggcagaugaagggcccaggagcuuuggggcagcgaggagggaggagcgggcccguuggcaaacuugggugaaaggaugggguaccugggugacgagcccccgccaggauucugcucuucacgccccuuuucucccagcucccuuccaggucaauccaaacuggagcucaacuuucagaagagaaagacgccccagcaagccucuuucggggaguccucuagcuccucaccuccaugggccagacagcucuggcagggggcagcagcagcacccccacgccacaggcccuguacccugaccucuccugucccgagggcuuggaagagcugcugucugcacccccuccugaccugggggcccagcggcgccacgguuggaaccccaaagacuguucagagaacaucgaggucaaggaaggaggguuguacuuugagcggcggcccguggcccagagcacugauggggcccgggguaagaggggcuauucaaggggccugcacgccugggagaucagcuggccccuagagcagaggggcacgcaugccguggugggcguggccacggcccucgccccgcugcagacugaccacuacgcggcgcugcugggcagcaacagcgagucguggggcugggacaucgggcgggggaagcuguaccaucagagcaaggggcccggagccccccaguauccagcgggaacucagggugagcagcuggaggugccagagagacugcuggugguucuggacauggaggagggaacucugggcuacgcuauugggggcaccuaccuggggccagcauuccgcggacugaagggcaggacccucuauccggcaguaagcgcugucuggggccagugccagguccgcauccgcuaccugggcgaaaggagaggugaggccuggggcagacguggggagaacuuucugucccugguggcagugguuugggauggaaacucuucugacaagagcagaggggauggaccuucauccagccugccucaaccucuguucagugcugggaaaggcuaggggucuucacagcuguuauuuaauuuaacccaacagcaauagaggugaaacaggcuugagaaagcaacuuucucaaguucucuuggccaguaaauggugaaccuucagaauggagggaggaacugcagggaugagagaauucaggagauaucaaccccugagcaagaggugcaaagcguuagguacuggguuugauguacagguccaaaagaaggaugggcagagccagguacccaggcuguauaccggauucccugggcucuaaccugucucugugccacauaccuacuuccuuccucagccacaccucuggauggagacacuggggcccugggcaccagggaggagagcaguggaggaggcagggccuuaggguggggcagcaggggaggagccuccccaggaacugacuggguccagggcuuggagcugcucucugcaguugugugggcuguagaguggagggccaucccuccucaccucagccccagcucccaagccucuggagucaaagccugggccagcuccaccacugucagagccaccuuggccuguuguuuagagggccuuagccagcucuucacccccagcucugacuagggaugugugaaaucuuaucugggaggcagaacuuccggguaucucaaauuccccuuucagccaggugggcacacucgaagcaggaaagcagaaaggcaucugaguaggaccccguaguuugaggacaucuggcugguggcugcacccauacuuacauuccccuccuucucucucccagcggagccacacucccuucugcaccugagccgccugugugugcgccacaaccugggggauacccggcucggccaggugucugcccugcccuugcccccugccaugaagcgcuaccugcucuaccagugagcccugugauaccacagacugugcugaggucuugccaccaccccuccccuuggggagguggggaggcacugcuggccuagaccagcugcugaaagcuggugaggcugagccccuaccccaacccaagcucugcggaaaucaacagccccagagccacuuggagggaggaagaaagggagccggcguucaaggcuaugacagucugcuacgcaaaacauuuuuucaaguaaaaauaguaagagauguuguuauagaaaccuguucuuguuuuuuuuuuuuucuugcacaaaugaucauuuauauagcugccucaaaaaggaagauuaucugggcaaguccagugaaggcagacaaaccacaagaccuagugccagguuuauucccucacaugggugguucacauacacagcacagaggcacgggcaccaugggagagggcagcacuccugccuucugaggggaucuuggccucacgguguaagaagggagaggaugguuucucuucugcccucacuagggccuagggaacccaggagcaaaucccaccacgccuuccaucucucagccaaggagaagccaccuuggugacguuuaguuccaaccauuauaguaaguggagaagggauuggccuggucccaaccauuacagggugaagauauaaacaguaaaggaagauacaguuuggaugaggccacaggaaggagcagaugacaccaucagaagcauaugcagggaaagggcaguuacugggcuucugggcugcuuagucccuggcuuggcaggaaggguagggaagauggauggggcucauuguuuggcauugaugauguccacgaauucgggcuugagggaagcaccacccacaaggaagccauccacaucaggcuggcuggccagcuccuugcagguugccccagucacagagccugggaagggagcagaacaagggcuuggucaagaaugggaugagucugccccauccccaccuccauguccgagggcucagucuaguccucagcccacuccaccucagccgggaaccaaagccacucaccuccauaaaugauacgggugcucugagccaccgcaucagagacguuggacuucagccauccucggagcuucucguguacuuccugggccuagaacaagaagcuggccuaaguaagaccuuuucugccucucuaagaggaaaaaucacuggcaccaguggacacuuagugugguuucugacugagucagaguaccagggcucugauccaagccaggcccuggacuggaugcccuuggacaagucacugucucuggguucaaggucucugugucuuugaaauaagggguugccccaugugggcugugucuguccaaaccuauugaggcaggcugggaugagggcagggcuccugggcccgguuaccuguugggguguugcagucuugccaguaccaauggcccacacaggcucauaggccaggacgaccuugcuccaguccuucacguuaucugcagggcagagauacagauggagggaagggugaacaagaaagagcucuccagccagguucuccggaguacgaagaacgguggccuacugcccccuaguggacauugggggauuuccagguggcaucuaccuuggggcuggagaagucauaggccccaagcaaagauugucacucccccuccccuuuuuccuuuucuggaucagcauggggaccaagacaggcuccagggccugacccuacccucugagucucuguggcccuggauaggcucaaaggucccuuucuccagagauaccugcgaugaccuuugucugcucgaaaacaaccuucucagugaugccagcuucccuuucaucuagcuucuccccaaugcaggcgauuacuccgagucccucugccagagcaugggccacuuucugcccaaucagcuguugagaaacagacuuggugagacauccuucuuggaaaaagacaucccuuaucuucucucuuggcuacuaaccucaucugacuccccaaagacaugccuucucucugagugccccaggaccacccacguggcuccgcagucuuugaucaugccagggcuaaaggaagagaugaagccaagguucagcagggagcccacccuguggcuuuccccucaacgaggaaagugagggaagggucccacacaccccucuccaccucgaucucaccugaucuccccaguaaaagccccauuagucacuuuguagcaguucugcgcagccacagcaaucuugggaucuagcuucugccgggcgaagucgauauaggcaguagggggagcacaaaccaccucugaggacaagaugguaccacagggggaugagacuaaagaaagccuucauuccccacaauuccuaaccagugcccuggagccccccagcccucacccucuucuucuugguucugcucucccccuuuucaccccagcaagaugaccuuuguccauuuuccagcccaggcugggucugcacucaacucgaagagccuuccagauaccccugagaggccacggcccucacccugcccucugcucuuuuaacagcuggggcuccaauuuccucgagcuauucucggcauaggcaccucacagacucagcauucuccagggagcaacccugcuucccuucuaaaauagcccauccucaccuccccuuugcaaggcaaggauuuguagcaaaaggagaggggccaacuccugggguuuguauugaggccucuggggaaugaacgagaaggggaugccucuuuggaucaggcccgcggcucuccgauuucgguggagggaggaaggaggauggaggagagcauccuuugcccguggguggcagagaccuaacugacucagaggccuugcgcuuugcuguuuccagguuggggaaagcgguaggauggcuccucacucccaaaucgcucagccuguuuggcacgggcucggucccuuccguggaaggcgggagucguucagguugccgaagggaaggggucagaucuggggcucagggagcccgagcagcucggcgcggggacgcggacgccggcgaggaaggggaggagucuggggcuacgugcggcggcgcacggcgcgggaggccagggcgcagggagcgggaagcccacgcggcccagccucccccggucucccgcagagccucgggcuccgcuccuaaccccgucgccuggcgggcacagccccagugcgcgccccggggccaccuuccuccaggagacccaaaacguccuuaccugccccauaguccaaggggcaucaugugcuccgcccugcccccucgacgcaccgacggggcugcggcugcgaggccccugcccggaccccagcggcccucgucccacagcccugcaucagguccgcgcggauaccggccucggggccucggggccucgggagagggcgcugccacuccugccccggccccggccccggcccggccagaccccuccucggcgagggcuuaccggugucggccggcaccuuggccgcguucagagugccgaugagcucccccagacucugcuuccgcccguucaucuuccaguuucccccaacgaagaacuuccuggagggcgccauggcgcuggagccgaggcgcugaaggucagugucugcgcgcagucgcggccacugcccacuuauauagagcgccgcgaaguggaacuccgccuccucgccguccuccgccauggcccgcccagucccccggagcccugccccccgcccgcccuccugccgccgccccggccgccgcccgaugaugcacuguuccgacguucccccuucuuguggcaacguucuaggagagucgggggcucggucgccuccgccucgauugcggggcuuucgggacaaggcgagaccugugagcuccggcgcucaggggaacccucgcu

SEQ ID NO: 14894 - RNA, 1015 nt, Homo sapiens
agggagaaauaaugagggaggccgagagagagagagagagagaagauggggcugagacccgauggugggagaggcccaugugaaaagauggagagagaagagugcugaguggacaaagcuggucuaguguggaauaagagggagaaacugggaggaggagggcaaaaggcgggaacuggagcaggccugggcauccaugaaggaugacuucagccccagcggugacuucagccccugaggucuggggguaacuacuggggcuguguucccuccacacacacgcuucuggguccagaaaaaggaguguggacgccgaucccccccucgcccccccccacccccccacacucauccaccccugcacucccacccccccacacucauccaccccugcacucccaccccccccacacacucauccaccccugcacucccccacacacacacucauccaccccugcacucccacccccgcccacacacacacucauccaccccugcacuccuuuggagaaagagcuuuaaaaugcagcaaggaggagguguccaggcccgggacacugcaucagccccaaaaccuuuccugcccauaaagugagccccugcauggauuugagguuagaaggagaguugggcacuggggcuggagccacgcucuaaaaccaccucaacaaaucugaacagagauccuucauaccccaaccaacgaagauguguguccucaagccccgcccccagcaggauaugcuccucccagccuucccugugcgaggcugccugguggagcaugugaucauuucuccauguguccuucugugccucugucugcugccccugcucugucguguccccugugagccacuccacccuccaagccccuuuccaccgcaguacacuggacacugagguuuccauggcaacacuucagacuuuaauacauauugcuaggggugauggaagcugaguagggcaucuggucacuuggaugggagagagcagggccuucugagcccca

SEQ ID NO: 14895 - RNA, 1015 nt, Homo sapiens
uggggcucagaaggcccugcucucucccauccaagugaccagaugcccuacucagcuuccaucaccccuagcaauauguauuaaagucugaaguguugccauggaaaccucaguguccaguguacugcgguggaaaggggcuuggaggguggaguggcucacaggggacacgacagagcaggggcagcagacagaggcacagaaggacacauggagaaaugaucacaugcuccaccaggcagccucgcacagggaaggcugggaggagcauauccugcugggggcggggcuugaggacacacaucuucguugguugggguaugaaggaucucuguucagauuuguugaggugguuuuagagcguggcuccagccccagugcccaacucuccuucuaaccucaaauccaugcaggggcucacuuuaugggcaggaaagguuuuggggcugaugcagugucccgggccuggacaccuccuccuugcugcauuuuaaagcucuuucuccaaaggagugcagggguggaugagugugugugugggcgggggugggagugcagggguggaugagugugugugugggggagugcagggguggaugaguguguggggggggugggagugcagggguggaugagugugggggggugggagugcagggguggaugagugugggggggugggggggggcgagggggggaucggcguccacacuccuuuuucuggacccagaagcguguguguggagggaacacagccccaguaguuacccccagaccucaggggcugaagucaccgcuggggcugaagucauccuucauggaugcccaggccugcuccaguucccgccuuuugcccuccuccucccaguuucucccucuuauuccacacuagaccagcuuuguccacucagcacucuucucucuccaucuuuucacaugggccucucccaccaucgggucucagccccaucuucucucucucucucucucucggccucccucauuauuucucccu

SEQ ID NO: 14896 - RNA, 6300 nt, Homo sapiens
auuugagguuagaaggagaguugggcacuggggcuggagccacgcucuaaaaccaccucaacaaaucugaacagagauccuucauaccccaaccaacgaagauguguguccucaagccccgcccccagcaggauaugcuccucccagccuucccugugcgaggcugccugguggagcaugugaucauuucuccauguguccuucugugccucugucugcugccccugcucugucguguccccugugagccacuccacccuccaagccccuuuccaccgcaguacacuggacacugagguuuccauggcaacacuucagacuuuaauacauauugcuaggggugauggaagcugaguagggcaucuggucacuuggaugggagagagcagggccuucugagccccaaaucuagcgcccgucuccccagagucuggaggcagcugcccuacucucggccagaaugagguguuacucacucaggcuuucuccucugaguucagcaggccugcuugggcucacagggucagcuggggaaagaugggguugccugggccccaggauccuccccaagcccuugcacuuucuucaccccccgucagggagcagcgucucccugcgcuuagucccaaaggaaguccaacggcucugcucucaggggacccaagggagagucggcggggugagaggcccaguggccggggccgacgaggagagugcccuggugaggcagucggagaaggcagaggugucucaucgaugaagguggugaucuccucccggaagaagccaggaccccgugggggucccccaccugaccccagaaccccacucuccaagaauuggcgaaggcuggccagccccccaccuucagccucuuccucguccuccucguccuccaaccugugucuuugucccagguacucaggaggacccccgagggcccggcucugggcugggaggacccggaugucaucagaggaugaccacuugugcaggaaggagccugguucccgagggguagagaagauguuugucucaucaugggacagacgccgggauagggggaccugggaagaggagcggguaagaccugaaggugcugcagggacagaggcagaggcaggaaccaaguggggacuccggaagauggugccaccuucuuaaccuucaaaacguuugcuccggugggcaaaccuggccccacgaggucugaagggaugccucucuugcuauagcuuucuuucacccagcucuauggugcccugaaagccagggcuagggaagaggggauuggggugccuaacagacacuggagaaaagugaugagcggcaccaaggguaggagauguaucccccaguuccauaccuguaaguaguggacucucucaagaggagggaagagcaugugccuuccaggcagcagcuucaccugggcggggucccggcucccugguccuguggcuccguuagcaucaaagcgaacuuugcaaacucggcccucugcauagucgucacagcccccaucuaggagagaaaaugggcagagugguuacagguagggaaugccuaccgcggccucccaccacugccuuuauaagcucccagagaccccuuuaguucccauuagcauguauguuccaagaggacagugagaguggcuagcauuugcugcguucagugcuaaauccugaguggagugcuucauacauauagaugaaguuauugaaacaauugccugcacucccccaagagccgucccuauagcuggggggccucucucgggaagcucagguuccccauagugccagagcugggcaguguggguuucuggaggggagccuaggcccagugaagggagcccugagugcugcgggaagcagugaguggacagcagggugccugcuuagggaaaggggagcccaggguggugcagauucuguccaguagggggcacuccagggcagcccauccucuggcugagaaggagcggcagaaaagggaauagacagauguccaggaaagccaaagcccagccccuccucugaccgucaucuccauccuccucagacaugauggccacgcauugcucccacacugugcgcacgucggcgcgguagcgcucgcaggaccagaugaaggagggcagcagcagcgucugugccauggagcaccacagcacagccagcaccauccaggggggcgccgaguccgacuugagggagaagaagcucaccaccuggggaagggugggagcgggcugggucagggccagagcugaggagcccaccugaaccccauauccuagugcagcuggugggcaagacgucagaaguaaugccugaucccugugcuccaacagaggcgaagcggagguggagauggagugaacagagggaagggacugacucagaggaaggucggggagagugcuggagacaaagcccugcggucaggagggagaggaacagagguggaccaggaaccguagagacagacaggaacccaggaacagugacuagauggggugguggggugagcccugugggauuuccagccaagagugcucagagaccauguggcagcccgagggaaggagggaauggagaguggagcccagcggcuggaugagaggucugcggcugaaccguggagcugcaggauggaugacggagcuggaggacaggucguggaacugaaggacggugauggagcugaggagugggaacugaagcagaugcuggagcugggguaaacaggguagugggaacuaaaagacagaugaucaagaugggggccacaaauggagugggggauggacagaggagaggaagauggaugauggaacuggaggagagaugacggagcugcuguauggcugaugaaguuggaggucaggugaugaugcuggggccuggauauuggggagaacagguggggaggaccccgaucucaccaagaugggcaccccugugagugagucauagagaaagacgauggcgcugaccaaguuggugaccugcagggaugucuuggcagacuccgagccauccagcgaggaccgccgcuucccucgggcauccuccaccacaauggcugguaccucaaaagcuggccggguacccaaggccccuggcccacccgcuuugguccccccaccaccccccacucuccgggccugccgagcccuccggggccgggcccacagugucugguagaaggugauggccacacagaccagacccaugacaauucccccaaguagcaagaggcugaagcaaacgccaaagccgaggccgaucuuggagacuaugaacuggcagccgcgggcauaguagcgcucgccguuguugugccagccaauggagggcaguguggagaggaugaagcugaccauccagaugcccaugacggcaugcagugccugcuucuuggcguugcugaggcgguaguugacgggccagcgcaccauccacaugcgaugguaggagagggaggcgaccgugaagcagguggccagcgccaggguguaguagguggacacgaagaccuugcagauacucucguuccagucauagucggaggaagccugacgacgcagcugcaccacggcaaagguggugaggggcacagcugccaugaguaugugugugcccgcuaggaagcagagcagcagcuccaguggcuugugcuucugcugcuuggccgagaugcugaggaugauccaggcauuggccagcagcgccaggagcccacaggccagccaggacaaugcguuggagcgcagggaggccuccucugcccccgccccgccccgagccauccuauccucagccccccacccccuugagcucugugggggugggggcuaggucucacccaggagccccacucacaaacacucccaugauccccacaauccucgcccugucagcaggcaggcugcccccaggcucaccccagugcucagcauugcaugauggacccagcugagggcagauguagagggcaggggaggagacugagggucagcagaggcaauccucagcuuucauacugggcggggccuuccuuaagcaucccugcaauugauggggcaggcaagcuggcuacuuucccaacuaugaggcuggcugggggguucugguccccaugcugggacuuccaggucucuuuugccucugguucuugaccagucaggaaucuucuggaugccccagggauuuggggguggggcucagcccccuggacaggcugcaagggaaagaugagaugugggagggagagggcaaagguagggccugggcuggucuccaaucagccuccugugcccccuuucuugaaacuauaggcaugacugauuacuaaggcccugagggucauucagaacauuccuuugccuuaacucugacagcuaaacaccccacacagaugagagccgcacucuuccagaccucuagggaagaagguauucccaccucccugucuccuuuagcccuuccuccucccgcuggaacucccagguuccuucuuagaacauccccugcucagcacuacuccaccccuaucuucaagucccuaaaugucucuucagaacuacugaugggagacacaagacugguuuccucuugaggguucacagugaacugggauauggcaucacagccuuccuccccuaccugccggucuccuggaugcaggggucuuggugcuuagccccuacuuccccaaaccugggugaucacccuccagcuacccauaucugggaaaaugggagaaaggagucugggaccgaagggggugcuagggaaccugaaggcggggaaaccgcugacaucagaagcauccagaaauggaaagagggggaacuagggagaaggaggagaguuugagcagaagagaaagagggggcaaagugguaguaucugaaaauagcaggaaaagcucaaacccccuggagaggaggcuuuggagggaggagggacuggaggagggagggagggagggagcagggaauaggaggcugagaagaaaagccaaauguucaauaaggugcugacuccccguggggagaccuugacucuuccucccuggcccagagccucaguuucccucucaugggaggaaggauggucccaguuuuagugcgugaugcugagcuucagugagcccugggaagggggguaagggaaucgggugaaacccugaacagaguggggcuguaaggaagcacauaauggcuuuaggguaagugggguaaaaauggggcacagcagugaaagggucuguuucccauggaagcagcucagacccuugcuuuccccaagagguccugguccacccccacccuuggcuucccuccggagcccaguacacccuaguugccauggcaauggccagccagagggagguggagggacuuggccaagagcagcccccaguguccucuccuacagcccuggaccccuucccacccaccuccacccaggcccagcuggugggcucaggaugaaagagauagggagucagagagggaaggaggcaggaaagaugugaaggacagagagagggaggugaaggacagggagagaucagaggaaggugggaagggggaucugggagguucccuggccgacggggucccucgcccuuuggggugaagggguaaggucaggcggcuccucccuccugucccccuccagguucuccagggcagaaacagcagguggcuggggaggaggggccggccuaggggagaggaggcagcuugagggggaaagggaggcaacacaggggacggggcaggcaggggucgucuuaccucucuccggcugcgcccagcacugccauggagaccgcacucccgacgcggcucucucgggcucccgcugccugccggcuccagcucgcccgcccuccucccuccuucccucucucccucccucccuucccccgggccucccuccucccccucagucccggccucccaggcucagcccacggcucacucggucucugccccucucacucuccaggacccucucucccggggucguccugccagugagcccaggccagagggaaggcaggacagcuuuguggggggcgggggggggcgggaaacgagugcaggguggggaacuggacgguggugacucggggaggaggggcaaggaaggcgcugagagggagggcggugaggaggauggcugggaaccggcuucauuggugaaaugguucauguccugcccccaccccuucccguuuucaacacgaacacaagcuccaagaggcagcuggugu

SEQ ID NO: 14897 - RNA, 21546 nt, Homo sapiens
caccggucugcaucucccagcagaaggcgcagccaugaauccguuauucggccccaaccucuuccuccugcagcaggagcagcagggccuggccgggccacugggggacucacugggaggcgaccacuucgccgggggaggagacuugcccccggcgccucucucgccggccggcccugcugccuacucgccgcccgggccgggcccggccccgccugccgccauggcccuccgcaaugaccugggcuccaacaucaacgugcucaagacccugaaccuccgguuccgcugcuuccuggccaaggugcaugagcuggagcgccggaaccggcuguuggagaagcaacugcagcaagcgcuggaggaggguaagcagggccggcggggccugggucgucgcgaccaggcagugcagaccggcuucgucagccccauccggccccuggggcugcagcugggcgcccggccggccgcugucugcagcccuucggcgcgcgugcugggcucgcccgcgcgcuccccggccggcccccucgcgcccuccgcggccagccucucgucguccuccaccuccaccuccaccaccuauuccucgucggcccgcuucaugcccggcaccaucuggucguucucgcacgcccgccggcucgggccgggacuggagcccacucuggugcaagggccuggcuugucgugggugcacccggauggggugggcguccagaucgacaccaucacgcccgagauccgcgcucucuacaacgugcuggccaaagugaagcgggagcgggacgaguacaagcggagguagggauugggaaagggggacaggucucucugugucauaccacucacaacgggccgcgaguugguguggguuccgaagaaucaggggugaaaagaaugagaguaaaguuugugcuguguaaugaggagcuuggaagcaauuggaugcagggagacuagaauccgcagagaaugcagaagcccugcucgugacaggaagaaggacgcugggagcggaacacggggggauuccuacuuuuccggcuugucucugccauccaggcuuaacugcggguuuugugcggugugaaagggacuggggcucugcccuaccggucucagcccuggggcagguuagggauauaaacuucaaaaguaggaggcaaggauauagcguaaauuugggagacuaaauugagugaaacuggaaggggcuggugagggaggggcuguaccuugcaacgagugauucuuucacaccccaagguuucccaaagaauauugauggaaaccagguaccugcugugguuucauaggaaaagcuccgggaccucaagccauugcuugaguaggucaacaaacugggaaaagaaagagugaagggaauucacuagggugaggguggagagcagggcugacaggggaaucuuggcaguauaaagcgccaguggggagggagaguggagagccagcaggggacugagcagggagaagcugggauaugggcccucccuaggaccgcgaggccgcggggcgggcccggugcauucuguggaugaagauuuggcugucugagaggagcccggccccaaggggcaagggaaagggaugugaugccaggagugcuggcuguauaccaaguggauuccuuagauggcugauaaccaagccgauaggacaggagugagagcagagguagugucuugcagacuccaacccaagccuugaggagggagcgggugacugacaggcuuugguuuggcggccuccccucucaucucagcuauuaugaccccuugugggcgggccugggaacuaccuaugcagcccaguguggcggagauucagcacugggugaggauuggccgaauguucuaggaaaugaccgcugggucuaggggcgaccuucagggaucuccacccugcuggaguuuaccagaucacagaucagcaggcuuucuuuuuuuuuuuuucccauaaaugauaauauuuuauuauagaaaaagcaucccaaauacaggauuucguaaacacugguaggugaacaagugcaauuuuagaaguaaaugcaaaguaaagaggcaaaaccuacaagcauuuugccuucagaagaagauguaguguucuccugcacuagugaucccacccagaacacaaauguggcucugucucccgugaaagcaucagauuugcuuucugagcucaguaugcccauuucaauaauugcaaagugauggcaagaaguggcguugaacacaugacuacagacccuugacuuaaaauauugagacagggacuugcucugucauccgggcuggagugcaguagcgucaucacagcucacugcagccucauccuccugggcucaagcaaucauccugccucagccucuugaguagcugggacuacaggugugcacuaccauguccaugccuggcuauuuuuuuuuuuucuuuuugcguuguccaggccagucucaaacuccugaccugaucagcaggcuuucugagcuugaguccuguccucgugcuggcuuccuuaguugugguccauguuauguguccuugggaguuucaguuguccugaaaucaucguucugccacccagaaccagccugcucugccccugcaggaguuaacuacgcgcucagcaguggcacaggcacaguucuggaauacauccauaaccacaggaacaacugcuguucucaggagcauuuuuuuuuuaaacugaaggagcguuuguccuugguccagcuguccaggacaggaaggaguuauuccuuggggacugauuagcucaucgcucugcagcacgcugcuguguagagagccuuagcuggauucggauggugcgugauacuggcagugacucuucuuccucccuagauucccugcccucauucuggucucuuuauagcaacacuguaacuccugucuucugccuggaaggccugggauggcuugagcgcuacacugggagguagcuaaaggccuccugcguucuauuuucagcuccccugccuugugcgugaccuuuuuuugagcccccauuuucccaacauaggaauggucccugcuuucucucuucaacccagggauacaguuuuuuggaagagagauauuugguccaugcagaacacauggauaucgcucucaaauucugcccauguuaagggaaccuuauaagugagaccagauggaaauggaggugaaaaugaaccugucugugugaagucuggccaaagaacaaauagaacuguagugggcuuccagaugauucauuuguagauuuuuuuuacccuguaagauuuccuuaggcuuaaccuuuagcuauaacugccuuacuuaaguuucuuccaggcucuguugagcucacugucagauagccccuccugcccucuuucacacaucuuguccaggguuagcgugcccuugacaggcuuacugucucccuccagggacucgugggcucccggcgcaugagggcaccacaguucaugccuucacaucauagaugaagaaaccaagacccagaaaagauaagggucuuagcuaagaaaacauaaucugaugcgacugguucccuuaguggccugacuguaugcaugagaaugccagggaggaggggagaagcaccuacgggacacacagggaagggggcugggagccaggaaggcugggagcugggcuguguggggagccagcagggugguggcugggcuggcugccuccuccugcucugcccagcagggaggggcagucgaggugauguggaggaguuauuauuaggaauacugcagugcggcugugaaugaggagaugggacccagaggcugacacaggaaggaagauggagggaaggggaagaaagggcuucacccaaggcuucagaagcugcccacucagauuuuaauuuucuugcugucuucuuggccccuuccuaaccaccuuucuuguguugaaguuucucucuuggugcaguuccccucccuucucggguugacagaagugaugagcucacaggaacaggauuugagaugugcugcuacgccagcuagacugcagggcccuggaaugccgggcggguccuaagcagcacguugcccuggcuuccaucucugugauggaauagaauaugcacugccugccauggcugaugagacaugacaaagcuggcucugggaagcaugcccuaccuaggacccugcccuguggcccagggugucguccggcccacuugcagucuuaaucucugaauucugggcccuggaacaggcugugucuaguucucauuugccguacucaccgggccccuuuacauacucuacuuucucuuucccucuggguuugagugcuaguaaccccaggcucguguguccacugcugucaugcugcugugggacuuccggccucugagccagucuggucaccucucugugacucccuuagaggaggcucuggguggguaguuucuggagcuaguggggaaggacuuugagugucuccuaccaggcucuugacccacucuguugauacacuauguguccugcagaugcuuuuacaggguuaaaugauaccacaagaggcagggcagcgggcucgacgagcucuguucuggugcgggcaggaggcgggagcccggaucugugcgacugaaggugggagacugggccggguggaccugguggucuggugugggcaggaggugggcaaugaggccagccggacagcuggcugagcuggggccugagcagggaugggcaucacggaggaccggagccucagcacuugcccaaacagagcuccuggugcacagcccggagguuccgggaaggcagcuggcgagcucgacgcccaucaggaagcacagagccgcgugacagcugcaguuggucaccagcuggcuggccaggcauuccugugcccugcuccuccccauccagggaaccagaacuggggucugaggccugagccagagagguggggacagggagccaugggggcagggaaggacucuguaccuaagcucucuccgcccuucccaugucugucaggugggaagaggaguacacggugcggauccagcugcaagaccguguaaaugagcuccaggaggugaggguggcgccccacuugcugcuggugcuucccuggguaccccugucugcccaugacccugcugccgucucccugucccuccuuggcaucuuuaucuuccucccaccucggcagugccaccaacaucaggguuucucccaacugcaggaagcccaggaggcugaugccugccaggaggagcuggcacugaagguggaacaguugaaggcugagcugguggucuucaaggggcucaugaguaacgugagugcagccccaggcuucccgagggucgaagugaggcuucugaggccagaagaguaggcccuucuaguguuggccuguuggccucccguccacggcuccuccccuucucuuugcuuuccuucccuuuuuccccuagccaccccuaacuccagagaaagacaagcaacaaaagucucgguguugcgucacagagguggcgcagcuucugagggccugggguugcagagcaguuagugagcagcuucugggguggaggcucugcagcuggcgccggggcgcugggccgauuccucagccucugaggccucaccuuuggcguggggaaauaaacgcgugcgcucugcaggaguauugugaggguggucauguacucgggacagugcccagcaugcaguguuagcuggaagaguguuagcuguugcgauuauuauaguccuuucuccacucuuauaauucccaggagucucuuucucucugggaauguaaguucuaggaggaugaggaccgcuagucguuccagugagcccccugcaugucccaggcacuggccaugcccuccagggcuuccguuuggccagggagcaguggcccgagccgccccaugcccagcauauucacacagugcuguggggaggccaccgcuacccaggaagaggggugcagucagcucagggagacuccacagaagaggcaccggugcaauguggugggaaggaugaggaccuugccaggccuaauucguccuugucuggagaacugggcgccuccucacuguucccugggcucccuggacagaaccugucggagcuggacaccaagauccaggagaaagccaugaagguggauauggacaucugccgccgcaucgacaucaccgccaagcucugcgauguggcucagcagcgcaacugcgaggacaugauccagauguuccaggugaggacggagcugcccucugcucucagggguggguggggcagguggaugcuuccguggcggcuggccuggaacgcaggcccugccuccugcuuggggagccuuaccuggcaacuggggcccucacggggcuagacugggggguaaggagcagcaucaggaggggcaucguggaagcugucucuaacgccgucucucccuucccccucucucuccucugucugcuuccucuccucucuuccucucaucuucucucuugcuuccuccacagaagaagcugguuaguuugaucucacgcaagcuuauuaaugucccagucccaguuucuaagcugccuaggccuccuggcccucaguuugggcccgcugggcucuugagcacggauuuuuuucugcccuuucccuuuuccuugcucuucccccuuuuucucucuaucucuuguucucuugacugcauuucuuucucucccuucucccccggcuuuccagaucuggaugugauucagguucucuuuuguacacauugcacacucauccuccuugcguccuaaagcuuuuuuuuuuuuaguugagucauuuaaucaaaaagacuuuuuuuagaaaaaaauuuccucuugagccaucaugcacaucugacugcagccccagcgagcccuuccuuccuugucugacugcucuucuucucgauuucuucuuguucugccuucucgguuugcagcccugacccccgcugugugucuggcccuuggugacuguccguguuucuguuccugucauuguaacugugacuuuucucucugucugcccccccuuccuacugguucaugcuucucccccauucccacccucucugcccggccucccgcucccgcccuuucuccucaugcacccggccucgucucuguagucucugcacuugucucccauuaaggucccauccaugggggggcggaagcgggagcgcaaggcugccgucgaggaggacaccucccugucggagagugaggggccccgccagcccgauggggaugaggaggagagcacagcccucagcaucaacgaggagaugcagcgcaugcucaaccagcugugaguccgcaggccgugcucccgcagcaccgacgccacagcagcccaggaggccggagcuccccagucccccgccaggacgaggccccgcccgcccugacacccggguucccugucucuaggagggaguaugauuuugaggacgacugugacagccugacuugggaggagacugaggagacccugcugcuuugggaggauuucucaggcuaugccauggcagcugcagaggcccagggagagguaaccucugcucccggccucagggcccucuggcucugccucuccagccugaagcccacucccccgcuccucuccuugcucuguccccccauguggcugucauccucuaccugcgucuccccucuuccuuuauccuuuugcuuuucuuucuccaguuucuuuaaccagacuuccucucucucucucucccugacuuggcccuuuggaaugcgucccaucccaucccuccuuggcuggccucccccgcuucccuuucuacuccagcagcaggaagauagccuggagaaggugauuaaagauacggagucccuguucaaaacccgggagaaggaguaucaggagaccauugaccagauagagguaagggcaggagcggaagccaggggcguggugucccagaggguuuugaguggggcugcaggcgcaguggccucaucccugcugcaggacccuagagaccaaggucuugggaggaggagugaucucucagcuauaguccuccuggugggcucugaagaccucaggcucuggaaacagacagauaucgguucaaaucucagcucuguuacuuacaaccacccugaacuuguaauaaguuacuuguucccucugagccccuccuuuccuuuccuuuccuuuccuuucuuuccuuccuuccuuccuuccuuucucucucucucucucuuccccucccccucuaucccucccucccucucucccuugucuuucuguccuuucuuuuuugagacaaggucucacucuguuucacucuguugccuaggcuggagugauccucccaccccagccuucugaguagcugggcccacaggugugugccaccauacccagcuaauuuuuauuuguauuuuuuuguagagauggugucucccuguguuucccaggcaggucuuaaacucuugggcuuaagugauccuccugccucggccucccaaaguacuagaauuagagacaugagccauguguccagcccuacaccuguuucuuuuucuuucuuucuuucuuucuuucuuuuuuugagacagggucuugcucugucacuccaggcccacugcagccgugaucuucuggauccaagcaauccuccuaccucagccucccaaguagcugggaccacaggcgugugcuaccacgcccggcuaauuuuuugauuuuuuuuacagagaacagggugucacuauguuuuccaggcugcccucaaacuucuggauucaagcaguccuccuaacucggccccacaaaguguugggauuacaggcaugagccacugugccgggccuuuuuauuuguaaaaugaggaauuuaauaauaccucaccuauaggguuguuuagaagaucagaugaaauaaugcauauauagagcuuagggcagugucuggcucauagcgaguguagcauaguggggacuguuuuauuauuauuaacacuaucagugccauggcacucagagauggacugggacuuuccuguuucuuccacucagccuuugagauaacagagaaaucuccaugcuuuuucccaagccuugaaguaccuucuagagguaccuagaggcaaguggagcuggugcuuuagcucaaacucuaggcuuuaggagcugcaagaaggauuuguggaggccgggcgcgguggcucacgccuguaaucccagcacuuugggaggccgaggcgggaagaucacgaggucaggagaucgagaccauccuggcuaacacggugaaaccccgucucuacgaaaaauacaaaaaaaaaaaauuagcuggccgugguggcaggcaccuguagucccagcuacucgggaggcugaggcaggagaauggcgugaacccgggaggcggagcuugcagugagccgagaucgcaccacugcacuccagccugggcgacagagcaagacuccgucucaaaaauacaaacaaaggaagaaggauuuguggaaccacagaauggagguugcuguugcugugggaggagggauggacgggacccccgugagcucuccuggccuggugaggugguccuuucccgacgcucugacuuugggagaggcauggagccuucucugcgucucagccucucuucaggcccacaugggagauucauacguaguccccccuuaucuucagggcauguguuccaagacccacaguggaugccugaaaccaaagauagcacugaccuccugauagcuuggguccaguugcugucaacuggaacguguuucuguucaugucucccacccacacauucaaugccuuuucuaucuuaacuaagcacuuagcgugcgcuguggcgguaccuuuugcaguucgaggugugacagcaaaacuggcacaaauuucuuuuuccuucuuuacaauuucacggauagaagauucauucuuacuguagagcuuaccaaccucagcaucggauucuuuuucuuauuaaguugaaaacuuuuaccuuuucacuuaaagggagcauauuuuggcuucucuuucacauauccaaauugccagcaucacuacucuugugcuuuggggccauuaugaaguaaaaauaaggguuccuugaacacgggcacugccauaccacgacagucaaucucaucacugagauggcuccuaaguaacuaaugggcaggcaguauagacaguguggauccuugggacagagggaggguucauguccuggucuggauagagugagguuuuuuuuuuuuuuuccgagacggagucucgcugugucacccaggcuggagugcaguggcuugaacucggcucacugcaagcuccaccuccuggguucacgccauucuccugccucagccuccugaguagcugggacuacaggcgcccgccaucacgcccggcuaauuucuuuuguauuuuuuaguagagaugggguuucaccguguuagccaggaugaucucgaucuccugaccucaugauccgcccaccucggccucccaaagugcugggauuauaggcgugagccaccgcgcccggcagagagagugagauuuuaucaggccacucagaacagcgugcaauuuaaaacuuaggaauuguuuauuucuggaauauuucauuuaauauuuucagaucaagguucaccuuggguaccugaagccguggaaagugaaaccaguggauaaggagagagugacuuuauucuuuucauuuauuuauuuauuuauuuauuuuuuugagacguagucucgcugugucgcccaggcuggagugcaguggcgcgaucucagcucacugcaagcuccaccucccagguucacgccauucuccugccucagccuccagaguagcugggacuacaggcgccugccacuacgcccggcuaauuuuuuguauuuuuuaguagagacgggguuucaccauguuagccaggauggucucgaucuccugaccucgugauccacccgccucggccuuccaaagugcugggauuacaggcgugagccaccgcgcccggccuugacuuuauucuuauugcugucacauuggagguguuugagaaggaagucgagaaauuauuuuccuauauacucauucucccaacacacaucaaacuguccugcuccugcaucaaaccugguuuucuuggccagguagaugagguuuccuggauuugugcugcuagcuaaagacauggcaagggaaaccaguacuccccacccucccgucuaccgcggcucacuguuuccuccuccugccugaccugauucuugucucccucuuuuggaugguggauuuaagguuuguguuuucacugugccuucaaccaacuaggggccuuugugcggccaucuucgugagaagagaucucgggcugccaucucucccuagucuucccuggaccucaagugcccaguguaaaacaugaucugaaagaacgaaaauaauaucuuaaauggaaucaugccuuuuaagcuauuuuuggcugggcgugguggcucucgccuguaaucccagcacuuugggaggccaacgcgggcagaucacuugaggucaggagugugagaccagccuggccaccaacaugugaaaccccgucucuacuaaaaauacaaaaaguagccaggcauuguggugggcaccuguaaucccagcuacuugggaggcugaggcaggagaauugcuggaaucugggagguggaggcugcagugagcugagauugugccacugcaccacagccugggugacagagcaagauuccaucucaggaaaaaaaaaaaaaaaaguauuuucaaaucaucugacuccuccucucucccagugcaaugacuuuaggcagcaguccccaaccuuuuugguaccagggacugguuuguggaagacaguuuuuccacugacccgggggaaaugauuuugagaugauucaaacauuacauuuauuguguacuuuauuacuauuuuuaaaaauuauuauuauuauuuuuagagacagaguuuugcucuuguugcccaggcuggagugcaauggcgcaaucuuggcucacugcagccuccgccucccgggcucaagcaauucuccugccucagccucccaaguagcugggauuacgggcaugugccaccacgccuggcuaauuuuguauuuuuaguagagaugggguuucuccauguuggucaagcuggucucgaacucccgaccucaggugauccaccaccucggccucccaaagugcugggauuacaggcaugagccaccgcacccggccugugcacuuuauuucuauuauuauuacauuauaauauauaaugaaauaauuauacaucucaccauaauguagaaucagugggagccaugaacuuguuuuccgcaacuagacggucccaucugggggugaugggagauagugacagaucaucaggcauuagauucucauaaggagcacacagccuagaucccucgcaugcacaguucacguaagguaggguucaggauccugugagaaucuaaugccgccgcggaucugacaggagguggagcucaggcuguaaugccagugauggggagcagcuguaaauacagaugaagcuucacucacuugcccacugcucaccuccugcuauuuggccugguuccuaacaggccacagacagguacugguccguggccugggguuuggggacuucugcauuaggggaaccguuaggaggacuugcugaccucaggaguacccaaggugccuuuaucuuugugaccuuugaucucucagggucacuaagauggagcaagguaaagccaaggcccagaguggugggcgggaggcaguucuuccccaccgcuccucaccucucucugucuccucccgucccacccccaagucuguucacacagcgagccugcaguuuucaagguggcuugucaaggacaucuccugacaugcacguucaccuccugaccuuguuccugcuguaaauuugugaauuaaguggggacauagacauaugcagagacuacugguggcaguacuagccuuguauuucaguagaauauauuugguucauuuccuucuucccagucucccugagugaugguuccagaacccagcucccugcacuccgguucuuccaagguggagaaauugggguguaggcagcugaucugaacaagggcugguggcacuguauuuucccccuggguugaacagucaccguguccugcuccucccacuacuguggggccccagcuguggauccaagccugccagggaagcuguccccacuagggcuucucacccagccagccgccaucucaccccaaaugucacuguccugaccaucucugcugucuggcccuguaaccuguuuccuucuuucucuaaguucccacccucucuguccaauccacauuauggcagcugguauccuccccguucucuucacucaggcagucacgaacgucaucuccaggaaguuucauuuugcuuccccuugcggccccugcccuuuguacccaaaacaaagagaggcagucgacugucccuggcacugaguuugugcugccugggcccugccucuccgccugccucagagugugggcugcagaaugggcccggggagggagaccggauuucuuugauucugagccccguguuuuccacgugugacauuucugaaaucaggacaggucucagaaucaauggcaccuccaauaugggagucuuccuuuuagugucugaaaauggcuuuuaggugagaaaauaaagugauaaggagagaaugguaagaggauugggccccuuucagcaguuagccaggcuuguaugccacgggucacagagagaguuaauucccuucgaggucugggucugccaggaugaggaaaaccugucgcuaacccuuacgggagcucacagugcagugaggggacagcccaggaccagcgcaguacaggggaugaggggugagccgggccccauaggaaccuguguggcccugggagccuguggaucugcuccaucccgcccacacugacuuuccucaccacucuuaucagucuuaaaagaacacagccugcagcaguaccuuugcauuccuccauaggcaaagauuuccaggaaaagcagaggaaacaaugguguauucgcugccuucugccuuggucugguuuauuuuaaaaucugagccuucaguaauggcugccugggcccccggcccagccacugcucuuggcguguuggccuccuggcgggggcaacagaggcgcugugaacgccaccuguuaaccccgauggcccugccugccccaccacagcuggaguuggccacggccaagaacgacaugaaccggcaccugcacgaguacauggagaugugcagcaugaagcgcggccuggacgugcagauggagaccugccgccggcucaucacccagucuggagaccgguaggcgccuccccugggcauggggccuuccagggggacacagcggggagaaagguuggaacacagccccagagacccucaggcaaugacugggucacaucuugcuguggggcugcccuuugggaguuaccugguggggcuggcccagacccacagcucucucccuuggcaguuggaugagcuauguccauucaugacgggagggcugaaaccucccaaggccaccagcucuggugguuccccugguuagaggcaguuuaaaaacuggcaaggaacagaaggguugugggggcagauuuuuaucuaaagucagggccaugauuugugcauuugacccuguguaaguuacaccgcaacaagaaagugaauuuuuaaaaaucacaaaaauacugcagauagacauaaagccaaggcccuagagucagggugcuggaggcucagcagcuucucuccuacugugacuucagcuauuucuuuuuuuuuuuuuuuuggcucacuacaaccuccgccucccagguucaagugauuaucuugccucagccuccaaggcgcccgccaccacaccuggcuaauuuuugcauuuuuaguagagaugggguuucaccauguuggccaggcuugccuugaacuccugacgucgugauccacccgccucugccucccaaagugcuggaauuacaggcgugagccaucaugccugaccucagccucugaguucccaagacacaggcggggcccauuucccugucaggguggguuuggagagaguucagucccugccgcucccucgccaucccgcggccccgcccucgcuuccgguacuucucacgggcugccagagggugaggcagcaggaggaggagugccguccgucuucaggauuccugccugccccaagguugacaacugguguuuuuuucuagaaagucuccugcuuucacugcggucccgcuuagcgacccgccgccgccgccaagcgaggcugaggacuccgaucgcgaugucucaucugacagcuccaugagauagagaccugccucccccuugcacccgaggcccucgcagcagggagcucagcgaggcagaggguggggcugcacagaggggaacaucagcugcagcucugcaccaggccggucccuggggacuggggcgcuccucccucaggcuuucucccucagucuuggcuucuccagggcucuggggugucuggagcuaggcuuggcccuaccauucuggggccauuuccaccacaguuggggcucuccugccuucacgcgugggugucugcuacuuccccaucuuuaaaaugcugccagagcgauugcggccccucaccuuguccacguaucaggaaugugaaugugggaccuuuccuccaucccuguuguccggagccagcucacugucuuccacacuggugcuaacuggcccaggcacuggaguggaauagaaugcagcuggaggcuacgcauggccucugcagcacacgcagcuggagagggcuucugucccugucagcggcagagggcguuggggcuggccggggcaccuugucccugcuaugguccacgugcucacgcuguccaccugccagguggaguguauguggcuguggcccucccucguggaggugccgugcuuuaaagaggccuuagugcccgggaugggcacaguguuuugaagggaggugggagcucuugcucuccuggucacugcagaaugacagagaaggugaagcuccaugcaugugugcgcggguguaugugcgcucagggucucuguuuaaguaucagcuaaagaugugcuuccuccgugucugucauacacugagaccaacaggcuacagugucccugauucuuggaaaagccuggagaagcuggggagaugcgguucacaaugccucgguauaggaggcuguguugagcugacauucaaauggauucuuuaauaauaaugaaacuggcgaguauuuauugugcacuuuggugucacugucucaagcacuuccuaauauucacuaguuugaacucugagguagguacuuuuuuuuuuuuugagauggagucucauacucuguugccuaggcuggagugcagugguguggucucagcucacugcagccucugccuccggggugcaagcgauucuccugcuucagcaugccuguagcugggacuauaggcaugugccaugaagccuggcugauuuuuguaauuuuaguagagacggaguuucaccauguuggccaggcuggucucaaacuccugaccucaggugauacacccaccuuggccucccaaagugcugggguuacaggcgugcgcgcucuaccgagguauguacuuuugucuccacuagguaagcacacgugcaaagugaggcccgggaguaacugcccaaagcaacugagccguucaguggcagagccaggggucuggaccuaggucccagcuacacgccuugccccuacccaaguuccccuaaggacgaugauggaaauaagucacccugacacaucucaguucaucuuccucaaaacuaugcgaggugggcauuuuuaccgauuuuuaaacauuauauaguccuuaccgccuugggcaugguuuuagguacuugguuuaccuagaugaauccugcuugaagaccuuaggggcuggccacgauguccucagauaagacacgagggcacagaaagcaauagagcacgugcucaagaccucacagcugcggaggccaagcuggaauugcccgcugcagcucagcuccaggcugagcuccacuaaccagucagcgucagagcccagugcgagcccugacuuccuccaccugucagccucccuggggcugcccacagaauagcuucuuccauguuuggccaacagcagauagccuaggacuggagcgaggagaggaaaaggccuuguucucugaaguaguggugccagcuuccuguagcacucaagacgucugagcgggaagcaaaugguucucgaagcaagcaaggcuguuuggaggcccuacccucagucugaggagaacauaccaggucccuccccagcaagaaugucucaccuugacacaagcccagcuucccuccccucugccccagacccuagaauaagacaggacaaguaacugguugagcacaggguacuuuauugaugguacaugacaaggugcggcucccuaggccccuccccucuucaaggggucuacauggcaacugugaggaggggagauucaguguggugggggacugaguguggcagggacuccccagcagugagggucucucucuuccucuugugcucuugcuggggcuggugguccaggggucuuacuccuuggaggccaugugggccaugagguccaccacccuguugcuguagccaaauucguugucauaccuagaagaugaaaagaguugucagggcccuuuuucugagccagccaccagagggcgccagacccugcacuuuuuaagagccagucucuggccccagccacauaccaggaaaugagcuugacaaaguggucguugagggcaaugccagccccagcgucaaagguggaggagugggugucgcuguugaagucagaggagaccaccuggugcucaguguagcccaggaugcccuugagggggcccuccgacgccugcuucaccaccuucuugaugucaucauauuuggcagguuuuucuagacggcaggucagguccaccacugacacguuggcaguggggacacggaaggccaugccagugagcuucccguucagcucagggaugaccuugcccacagccuuggcagcgccaguagaggcagggaugauguucuggagagccccgcggccaucacgccacaguuucccggaggggccauccacagucuucuggguggcagugauggcauggacuguggucugcaaaaggagugaggcccugcagcguacuccccacaucaccccucuaccucccuccccaccuugaaaggaaauuaugggaaagccaguccccagaacccccaaccccaggguugcacgcagccccggcagggaggagccagucuuggaugagaaaggugggagccucagucccauuccccagcucucauaccaugaguccuuccacgauaccaaaguugucauggaugaccuuggccaggggugcuaagcaguugguggugcaggaggcauugcugcaaagaaagagggagcggggcgcaagucaggggagcguguccauagggugccaggcuggccgcuucuccacgggcccugccuuccucaccugaugaucuugaggcuguugucauacuucucaugguucacacccaugacgaacaugggggcaucagcagagggggcagagaugaugacccuuuuggcuccccccugcaaaugagccuacagcagagaagcagacaguuaugaacccggguccugccuuugcagggcugagucagcuuccccucccgcgggcccuccugcacucaccccagccuucuccaugguggugaagacgccaguggacuccacgacguacucagcgccagcaucgccccacuugauuuuggagggaucucgccuaugggggugggggggagauggggacaggaccauauugagggacacaagguuaccauauacccaagggagccacaccauccuaguugccuccccaaagcacauuucuuccauucugucuuccacucacuccuggaagauggugaugggauuuccauugaugacaagcuucccguucucagccuugacggugccauggaauuugccauggguggaaucauauuggaacauguaaaccugggggaauacgugaggguaugaaggggcugcccaucagccagguggcuccucccacaccagcuuuggggcucaccauguagcacucaccauguaguugaggucaaugaaggggucauugauggcaacaauauccacuuuaccagaguuaaaagcagcccuggugaccaggcgcccaauacgaccaaaucuaagagacaagaggcaagaaggcaugaggaggggaggcuccuccagaauaugugagcagcccuaggccaccuccccauuaagagggcgaaugcagcaucuccuuacccccaggagggcccaagagguugaauuuuaucucccuugagcuucccugccaggcuggccuggcuuaaggcauggcugcaacugaaggcuccagggcugcccaacacccccagucauacgaagcccuuccaggagaagcggccauguggggcacugccacccacagucugggcacaagcuuuguacaugguauucaccaccccacuaugccaccccaggaaugcuugcugcugccuagcucagcugcacccuuuagggagaaaacgcuuguacacucagcaucaucaaacucaaagggcaggaguaaaggucagaaauuaacuggacagggcaagcccaccccuucucuaagucccuccuacaaaagggacagagacuggggcgggugggaagaggggaagcuguauuuuaacccccuagucccagggcuuugauuugccaaguugccuguccuuccuagcucuuuuccagaaaucaggagugggagcacagguaagugcauguguguggggagaagggaugggagagagccccagcccaggcccccagcuacagaaaggucagcagcuauauuuaaccucagaccagggugcggugggagaucugguuuccggaagacggaauggggagaagggcagguuccccgaggcgcccagacacccaauccucccggugacauuuacagccuggccuuuggggucgggucaacgcuaggcuggcaggggaagggcggggccgugaggugagccggcgcugcaggaaggggccaccaccagaggggccauuuugcgguggaaauguccuuuuccaacuacccaugacucagcuucucccggcuuggcaccaugccacagccaccacaccucugcggggaggggacacaagaggaccuccauaaacccacuucuuugauuuaccagagaauaaucuaggaaaagcaucacccggaggagaaaucgggccagcuagccucgcuccaccugacuuccccgccacacgcgacuccacccaucgaggcaggagcgcaggguuagucaccggcaggcuuuccuaacggcugcccauucauuuccuucccgguugcaacauggcggccgcucuaccgcaggcgcagcauccggacagggaugcacccgcugcgcacuagcaucccggggccugcggugccggaggccgugggggaggggcuccucugcgacacgugaccccgcagagcgcgaaaggaaagaaagcgucccccaccuagggguccgggucgggaucucgggcgggaguagggaccuccuguuucuggggacuaggggaaggaggcuccgggcagauggcgccgcaagggcggagcugcacagggcgccacagccugggugcggggcuccgccagguccgagcgcugaccuugagcucuccuugcggggaacagcuacccugcccccauacgacugcaaagacccggagcccgcaaggcucguagacgcgguucgggggcggucgcagcccagggccccccagccacccgcgaacucacccguugacuccgaccuucaccuuccccauggugucugagcgauguggcucggcugcgcggagggagagaacagugagcgccuaguggccccggccgacacacacgccuccccuccccucccccaccaggccuccaugcccagcccgcgccgcaucacguccuccgcccgccccugcaaugcggaggccgcccgggcccaccccgcagcggcgcgaacacauccggccugcgcccgccccugccgccuucaggccgucccuagccucccggguuucucuccgcccgucuucaccuggcgacgcaaaagaagaugcggcugacugucgaacaggaggagcagagag

SEQ ID NO: 14898 - RNA, 4714 nt, Homo sapiens
agaauaagacaggacaaguaacugguugagcacaggguacuuuauugaugguacaugacaaggugcggcucccuaggccccuccccucuucaaggggucuacauggcaacugugaggaggggagauucaguguggugggggacugaguguggcagggacuccccagcagugagggucucucucuuccucuugugcucuugcuggggcuggugguccaggggucuuacuccuuggaggccaugugggccaugagguccaccacccuguugcuguagccaaauucguugucauaccuagaagaugaaaagaguugucagggcccuuuuucugagccagccaccagagggcgccagacccugcacuuuuuaagagccagucucuggccccagccacauaccaggaaaugagcuugacaaaguggucguugagggcaaugccagccccagcgucaaagguggaggagugggugucgcuguugaagucagaggagaccaccuggugcucaguguagcccaggaugcccuugagggggcccuccgacgccugcuucaccaccuucuugaugucaucauauuuggcagguuuuucuagacggcaggucagguccaccacugacacguuggcaguggggacacggaaggccaugccagugagcuucccguucagcucagggaugaccuugcccacagccuuggcagcgccaguagaggcagggaugauguucuggagagccccgcggccaucacgccacaguuucccggaggggccauccacagucuucuggguggcagugauggcauggacuguggucugcaaaaggagugaggcccugcagcguacuccccacaucaccccucuaccucccuccccaccuugaaaggaaauuaugggaaagccaguccccagaacccccaaccccaggguugcacgcagccccggcagggaggagccagucuuggaugagaaaggugggagccucagucccauuccccagcucucauaccaugaguccuuccacgauaccaaaguugucauggaugaccuuggccaggggugcuaagcaguugguggugcaggaggcauugcugcaaagaaagagggagcggggcgcaagucaggggagcguguccauagggugccaggcuggccgcuucuccacgggcccugccuuccucaccugaugaucuugaggcuguugucauacuucucaugguucacacccaugacgaacaugggggcaucagcagagggggcagagaugaugacccuuuuggcuccccccugcaaaugagccuacagcagagaagcagacaguuaugaacccggguccugccuuugcagggcugagucagcuuccccucccgcgggcccuccugcacucaccccagccuucuccaugguggugaagacgccaguggacuccacgacguacucagcgccagcaucgccccacuugauuuuggagggaucucgccuaugggggugggggggagauggggacaggaccauauugagggacacaagguuaccauauacccaagggagccacaccauccuaguugccuccccaaagcacauuucuuccauucugucuuccacucacuccuggaagauggugaugggauuuccauugaugacaagcuucccguucucagccuugacggugccauggaauuugccauggguggaaucauauuggaacauguaaaccugggggaauacgugaggguaugaaggggcugcccaucagccagguggcuccucccacaccagcuuuggggcucaccauguagcacucaccauguaguugaggucaaugaaggggucauugauggcaacaauauccacuuuaccagaguuaaaagcagcccuggugaccaggcgcccaauacgaccaaaucuaagagacaagaggcaagaaggcaugaggaggggaggcuccuccagaauaugugagcagcccuaggccaccuccccauuaagagggcgaaugcagcaucuccuuacccccaggagggcccaagagguugaauuuuaucucccuugagcuucccugccaggcuggccuggcuuaaggcauggcugcaacugaaggcuccagggcugcccaacacccccagucauacgaagcccuuccaggagaagcggccauguggggcacugccacccacagucugggcacaagcuuuguacaugguauucaccaccccacuaugccaccccaggaaugcuugcugcugccuagcucagcugcacccuuuagggagaaaacgcuuguacacucagcaucaucaaacucaaagggcaggaguaaaggucagaaauuaacuggacagggcaagcccaccccuucucuaagucccuccuacaaaagggacagagacuggggcgggugggaagaggggaagcuguauuuuaacccccuagucccagggcuuugauuugccaaguugccuguccuuccuagcucuuuuccagaaaucaggagugggagcacagguaagugcauguguguggggagaagggaugggagagagccccagcccaggcccccagcuacagaaaggucagcagcuauauuuaaccucagaccagggugcggugggagaucugguuuccggaagacggaauggggagaagggcagguuccccgaggcgcccagacacccaauccucccggugacauuuacagccuggccuuuggggucgggucaacgcuaggcuggcaggggaagggcggggccgugaggugagccggcgcugcaggaaggggccaccaccagaggggccauuuugcgguggaaauguccuuuuccaacuacccaugacucagcuucucccggcuuggcaccaugccacagccaccacaccucugcggggaggggacacaagaggaccuccauaaacccacuucuuugauuuaccagagaauaaucuaggaaaagcaucacccggaggagaaaucgggccagcuagccucgcuccaccugacuuccccgccacacgcgacuccacccaucgaggcaggagcgcaggguuagucaccggcaggcuuuccuaacggcugcccauucauuuccuucccgguugcaacauggcggccgcucuaccgcaggcgcagcauccggacagggaugcacccgcugcgcacuagcaucccggggccugcggugccggaggccgugggggaggggcuccucugcgacacgugaccccgcagagcgcgaaaggaaagaaagcgucccccaccuagggguccgggucgggaucucgggcgggaguagggaccuccuguuucuggggacuaggggaaggaggcuccgggcagauggcgccgcaagggcggagcugcacagggcgccacagccugggugcggggcuccgccagguccgagcgcugaccuugagcucuccuugcggggaacagcuacccugcccccauacgacugcaaagacccggagcccgcaaggcucguagacgcgguucgggggcggucgcagcccagggccccccagccacccgcgaacucacccguugacuccgaccuucaccuuccccauggugucugagcgauguggcucggcugcgcggagggagagaacagugagcgccuaguggccccggccgacacacacgccuccccuccccucccccaccaggccuccaugcccagcccgcgccgcaucacguccuccgcccgccccugcaaugcggaggccgcccgggcccaccccgcagcggcgcgaacacauccggccugcgcccgccccugccgccuucaggccgucccuagccucccggguuucucuccgcccgucuucaccuggcgacgcaaaagaagaugcggcugacugucgaacaggaggagcagagagcgaagcgggaggcugcgggcucaauuuauagaaaccgggggcgcggcggcaggcggugacucggaccccgccucccgccaggcucagccagucccagcccaaggucuugaggccugagcuacgugcgcccguaaaaccgcuaguagccgggcccuacuuucuccccgcuuuuuuuuuuccgcagccgccugguucaacugggcacgcaccgagcgugugggccccgacguaggggggaagggacugagauuggcccgaugggaggugaucggugcugguucccaggacuggacugugggcagcaggacacuagggagucaaggacggggacccuuacacgcuuggaugaaacaggaggacuuugggaacgacugagauggggaauuggagccggagcccagcaccgcucgcggcugcacgcggccugcccccuccccuuucuuucuuucaaaggcugagaggcgggaaaguuggggaacuucuccucgaggcucugcgguagugacaccggacugcucaggcaaaggccuaggaggggcccaugggccucgggcgggggcccgugguuccuucccagcccccacuucccccuccccaucuccuggcuccuggcaucucugggaccgaggccugggcugggcacugggcacugggcacugggggccuggagaggaaggaggcucgggaggcggcuugagggggagggggagguuucugcacggaaggucacgauguccugcagcccuguagccuggaccugauaauuagggcagacaaucccggcccugugugcaccagcggcucucuccgggcuggggccccaggcggaggacaggau

SEQ ID NO: 14899 - RNA, 4714 nt, Homo sapiens
auccuguccuccgccuggggccccagcccggagagagccgcuggugcacacagggccgggauugucugcccuaauuaucagguccaggcuacagggcugcaggacaucgugaccuuccgugcagaaaccucccccucccccucaagccgccucccgagccuccuuccucuccaggcccccagugcccagugcccagugcccagcccaggccucggucccagagaugccaggagccaggagauggggagggggaagugggggcugggaaggaaccacgggcccccgcccgaggcccaugggccccuccuaggccuuugccugagcaguccggugucacuaccgcagagccucgaggagaaguuccccaacuuucccgccucucagccuuugaaagaaagaaaggggagggggcaggccgcgugcagccgcgagcggugcugggcuccggcuccaauuccccaucucagucguucccaaaguccuccuguuucauccaagcguguaaggguccccguccuugacucccuaguguccugcugcccacaguccaguccugggaaccagcaccgaucaccucccaucgggccaaucucagucccuuccccccuacgucggggcccacacgcucggugcgugcccaguugaaccaggcggcugcggaaaaaaaaaagcggggagaaaguagggcccggcuacuagcgguuuuacgggcgcacguagcucaggccucaagaccuugggcugggacuggcugagccuggcgggaggcgggguccgagucaccgccugccgccgcgcccccgguuucuauaaauugagcccgcagccucccgcuucgcucucugcuccuccuguucgacagucagccgcaucuucuuuugcgucgccaggugaagacgggcggagagaaacccgggaggcuagggacggccugaaggcggcaggggcgggcgcaggccggauguguucgcgccgcugcggggugggcccgggcggccuccgcauugcaggggcgggcggaggacgugaugcggcgcgggcugggcauggaggccuggugggggaggggaggggaggcgugugugucggccggggccacuaggcgcucacuguucucucccuccgcgcagccgagccacaucgcucagacaccauggggaaggugaaggucggagucaacgggugaguucgcggguggcuggggggcccugggcugcgaccgcccccgaaccgcgucuacgagccuugcgggcuccgggucuuugcagucguaugggggcaggguagcuguuccccgcaaggagagcucaaggucagcgcucggaccuggcggagccccgcacccaggcuguggcgcccugugcagcuccgcccuugcggcgccaucugcccggagccuccuuccccuaguccccagaaacaggaggucccuacucccgcccgagaucccgacccggaccccuaggugggggacgcuuucuuuccuuucgcgcucugcggggucacgugucgcagaggagccccucccccacggccuccggcaccgcaggccccgggaugcuagugcgcagcgggugcaucccuguccggaugcugcgccugcgguagagcggccgccauguugcaaccgggaaggaaaugaaugggcagccguuaggaaagccugccggugacuaacccugcgcuccugccucgauggguggagucgcguguggcggggaagucagguggagcgaggcuagcuggcccgauuucuccuccgggugaugcuuuuccuagauuauucucugguaaaucaaagaaguggguuuauggagguccucuuguguccccuccccgcagaggugugguggcuguggcauggugccaagccgggagaagcugagucauggguaguuggaaaaggacauuuccaccgcaaaauggccccucuggugguggccccuuccugcagcgccggcucaccucacggccccgcccuuccccugccagccuagcguugacccgaccccaaaggccaggcuguaaaugucaccgggaggauugggugucugggcgccucggggaaccugcccuucuccccauuccgucuuccggaaaccagaucucccaccgcacccuggucugagguuaaauauagcugcugaccuuucuguagcugggggccugggcuggggcucucucccaucccuucuccccacacacaugcacuuaccugugcucccacuccugauuucuggaaaagagcuaggaaggacaggcaacuuggcaaaucaaagcccugggacuaggggguuaaaauacagcuuccccucuucccacccgccccagucucugucccuuuuguaggagggacuuagagaaggggugggcuugcccuguccaguuaauuucugaccuuuacuccugcccuuugaguuugaugaugcugaguguacaagcguuuucucccuaaagggugcagcugagcuaggcagcagcaagcauuccugggguggcauagugggguggugaauaccauguacaaagcuugugcccagacuguggguggcagugccccacauggccgcuucuccuggaagggcuucguaugacuggggguguugggcagcccuggagccuucaguugcagccaugccuuaagccaggccagccuggcagggaagcucaagggagauaaaauucaaccucuugggcccuccuggggguaaggagaugcugcauucgcccucuuaauggggagguggccuagggcugcucacauauucuggaggagccuccccuccucaugccuucuugccucuugucucuuagauuuggucguauugggcgccuggucaccagggcugcuuuuaacucugguaaaguggauauuguugccaucaaugaccccuucauugaccucaacuacauggugagugcuacauggugagccccaaagcuggugugggaggagccaccuggcugaugggcagccccuucauacccucacguauucccccagguuuacauguuccaauaugauuccacccauggcaaauuccauggcaccgucaaggcugagaacgggaagcuugucaucaauggaaaucccaucaccaucuuccaggagugaguggaagacagaauggaagaaaugugcuuuggggaggcaacuaggaugguguggcucccuuggguauaugguaaccuugugucccucaauaugguccuguccccaucucccccccacccccauaggcgagaucccuccaaaaucaaguggggcgaugcuggcgcugaguacgucguggaguccacuggcgucuucaccaccauggagaaggcuggggugagugcaggagggcccgcgggaggggaagcugacucagcccugcaaaggcaggacccggguucauaacugucugcuucucugcuguaggcucauuugcaggggggagccaaaagggucaucaucucugcccccucugcugaugcccccauguucgucaugggugugaaccaugagaaguaugacaacagccucaagaucaucaggugaggaaggcagggcccguggagaagcggccagccuggcacccuauggacacgcuccccugacuugcgccccgcucccucuuucuuugcagcaaugccuccugcaccaccaacugcuuagcaccccuggccaaggucauccaugacaacuuugguaucguggaaggacucaugguaugagagcuggggaaugggacugaggcucccaccuuucucauccaagacuggcuccucccugccggggcugcgugcaacccugggguuggggguucuggggacuggcuuucccauaauuuccuuucaagguggggagggagguagaggggugauguggggaguacgcugcagggccucacuccuuuugcagaccacaguccaugccaucacugccacccagaagacuguggauggccccuccgggaaacuguggcgugauggccgcggggcucuccagaacaucaucccugccucuacuggcgcugccaaggcugugggcaaggucaucccugagcugaacgggaagcucacuggcauggccuuccguguccccacugccaacgugucagugguggaccugaccugccgucuagaaaaaccugccaaauaugaugacaucaagaagguggugaagcaggcgucggagggcccccucaagggcauccugggcuacacugagcaccagguggucuccucugacuucaacagcgacacccacuccuccaccuuugacgcuggggcuggcauugcccucaacgaccacuuugucaagcucauuuccugguauguggcuggggccagagacuggcucuuaaaaagugcagggucuggcgcccucugguggcuggcucagaaaaagggcccugacaacucuuuucaucuucuagguaugacaacgaauuuggcuacagcaacagggugguggaccucauggcccacauggccuccaaggaguaagaccccuggaccaccagccccagcaagagcacaagaggaagagagagacccucacugcuggggagucccugccacacucagucccccaccacacugaaucuccccuccucacaguugccauguagaccccuugaagaggggaggggccuagggagccgcaccuugucauguaccaucaauaaaguacccugugcucaaccaguuacuuguccugucuuauucu

SEQ ID NO: 14900 - RNA, 38600 nt, Homo sapiens
ugucuaaaaguauauaaaaacauuuauucauuagaaaacaaggagauuggcaaacauauauuccaaaguugaagcagcucaacgcaguucaguuaggcuaauuuaagagaaagccuugcauuuuaaagagcguguaggcauuuuuuuuuuaauuugagauggagguucgcuauuguugcccaagcuggagugcaauggugugauuucggcucacuacaaccuccgccucuggguucaggcgauucuccugccucagccucuugaguagcugggauuacaggcgcacgccaauacgcccggcuaauuuuuuauuuuuaguagagaugggguuucuccauguuggucaggcuggucucgaacucccuaccucagguuauccacccgccuugguaucgcaaagugcugggauuacaggcgugagccacagugcccggccuuuuuuuuuuuuaaaaaaaagagacagacaaauauuuuacaagggaaacagaauucgaauuccaggucacccuacaggauacccugcacagggaggacaggaacagacuuccuaggaucugugccugcgagccgaugcucugagaaugggaguuguuuucuugggugucucgucuucugucaucucugcugaaagaucuaugcaaagaauuaaaggaauaagaaaaagcugagucacaaagauggugaaaaaauagauaucagagaacaagugagacaaucccacaccgcacagaagaaauaaaauccaagcuguacaggagaggcccuucugcggcaguggggcagagcaucuacacucaggcccccgcagcagguccuauggaaaccagcccucugcacccuagcugugugccuucucggccgggaacaggcgggagcaucauaccuuccucacuggacucaucacuugagaagacaacuuuggguuucuuuuuggaagcucgcugcuggguguuuggaugccgacggguaguacggcggggcucuggugugacaaagucauugucugaggcuguagaagccagaggcugguaccuagaaccuagaaaaggcaggaaaacgugauuuaaaaaagaagaagaaacaaaucacugcaggaggggagggcccagucuggucucgcccgcacaggcugccuuacguaccaguggaugguuucuuggcugauggcgcucucuggcuaccugcuuggccaaucucaagcuccuugauuccauccaaaccucugguaugacaggcccgaagcuucugcucaaauucaucuauuauagccuggagggagaaaaggagauucagagcaggccugaaaacaguuacuucugauuaaaaagaaacaaggccauggaagacauggaggccuuaaacgcacauuacuaagaagccaaggugagaaggcuccauaccggaucauuccaaugauacauucuggaaaagacaaagugauggcaacaguaaaaagaucagggguuguggggagagagggauaaauagguggagugcaggggauuuguaaggcagugaaacucuucuguaugauacugcaaugguggguacaugucauuacgugcagugaacuccaagguaaaccaugacuuuaggagaugauguguaaguguagguucagcuguaacaaaugugccacccuggugcaggauguugaagguggggaaggcugugauguguaggggcaagggguagaagggaacucccuguacuuucugcucaauuuugcuuugaaccuaaaacugcucugaaaaauaaaaacuauuaaaaacaaacaaacaagaauuggaugagaugcugcuuugguuguguuuuuggaguaauaaaaaaagaacuggagacaaagaucuggucuuaggucacucuggcaauuugguugcaacccagcuggggauaaggaggacgggaaggugacugcaagagccguaugcugcccagggccggcagaugucuuagccagcccagaacccaacaggcauugaaguguccugugcugcucaccuugcccucaggcuuggccccacgucgcagcuugccuacaacugacaaaaaagcacugaagauggacucaucugacaguuugucuccaaaacagucaaaauugucaagcaucuuacggaggccucgcucugugaggggcagcugugacacacaguaggccaggucucgcugcugccgcucaguucugcagauaggaagggcuuugugaggaacugggagauccagcuaguaaaggcucaaccuuccccaucagccuccccagucccagggaugccacagugggggcauugaaggggugagggaugggccuuucuccccugcagggccccgcucagcacaaagaacccucagggagggcagcauaccgggaugugcggaaccgcugacacagcuuuuccaccaggcucucugucugcuuguccuuggugauguaggagaggagcugucugcaggaaggggagaugaggauguucgauggcccagggccagcucugccauccacuaagaccaacccuggacccucccccagcacucgucuucucugauguucucugccacggccccugucugccucaccacuccccuugcccugucccauucagcagagagggaccccaccccgcccccggcucaggaauuuucacugugaauggaaauuaacaggagcagcugcuagggagugagugcuacuguaugucugccaccauguuaggaacuuuaucguauuuaauauuuucaagaacuaaggguuaaguaucaucagccucaaaagaagaggaaauaggcacaaagagaggcuaaguuauugccgaaggcuguacagcuaaagaguagccgagguggaauucaaauacaggugugucugauuccuaagcccgugcuauguggaaaaugugccccagggcccggggagcaauacuucaugaugguguggaaaggcucuuccuccacccccagcucggggucugacaggcggcugaugauaucuggaaggagauuauagauugcguugcccuguaagacagagagagccauguuaaggagaugaggugaccuacagauucccucugcagccagcccucagugccucucugccucucaccuugugggagagcucauugaagaaguucuuggccagggcagcaaucugaggcucggggucgaugagcagcaccgccaucucgcugaccugccccuucaccuucaccauguccuugaggaucaggugggucaucaccagccccgcuguuuuccgcacuugcugagcagggucccggagacuaggaauggaauugcgggucauggggaccgagaccuccgggcuacacccuaacacugguagaaaaggcccucagcaggaaucaauuaucccaugcucugccacuccagaagcagucagaaagcugucuagaguugaaagcuggagugggggaaagaggugaagcuucuaaccagaagugucagucccacuggggugacucuuagccaggggccuguacaggucaaguaucaagcagauguucgcggugaugccaaagccuaggggaagagcccuggugauucucacacugacucucaacagacuccggggcuccugggaacugccaccacguugugaggggucucuuaccgagcauacagaugaggaguccagggguccaccagauugggaaagcggauggccagauccccaguggcaaccaugagguuagaccggacaaugggaaguggagacuuuuccagcauggugaacagaagacgaagcugggagucgcagaaaguggcacuaagagcaagaagaggaucauuagggaagccauuucauccccaucuuccuugagaaggggguaccaaccccacggccuaccugaucaugcagaacuugccaagggcaagugaagcagcugcagagaggucuggguugcuauagaggccuggguuguuacagacuuuaagcaagaguggaacaaaggcagccagugucuguuugccuguuggaagaguaacugcagguuugggacagguuaucuuaauugggaagaaacugcugagugcagccauuuuucuuaccauccaacaguuccaucucgcagaugccacggauuaguucugccucugugucaucugcuguugccccaaccagccccagcuccuccuccaugguggucucagagcucguauucuaaagggaaugaaauuggggaucauggauaagcagagacaacauuuuugauuccagcccauacuuuguuuugcaugaacaaagugaggaagggcaaauucuacaaaaacauuuagagaauugucaaaugugucuguaaagagaaaggauuccugaauuaagcaggggaacaaugagguccccauuuguuuuaaguugccaaagcguguuucugcaccucuuccucauggaagacaucguuuccuauauaugguaaacagauggaucacgccagacaaugguucaaagucacagaggucagacuuuucuccagcgcugcaaggcucugugucuuauuugucugcaagacaucauugccucuaguggagggaacacagggccccauccggggccaggccagcaauggaagcugauggaaaaggccggcggguacgugcguguucuaacaaacccugccucagacacaaagccucuguuuuaugcugaggucucuaacuccacacucugcauuuaccuaaaucuuuccuuccugggugaucacugacaguuucgucauuguucacacgaaccuuuccuacgguaguagccacagagaggcagaaacucuucgcuucauguaauagcagaggagcagagauugccggaaggggaucagcucaguucugagcugagguaugaaauaaaucugggaagugcugaggacauucacacaccuucuccuugggaucuuuggucuugugcuccuguucuucccggagaacucggcgccggcagagcucuccacucacugccugcuccaaguggaccagcugcugcagagccacauccccagccagggacagcagguucaucaacaggaaaguggggagcauugcgggggacuccucuggaggagagggagagggaagguggggcaaagagacauuuuuaagucccaucaaaccugaauccgauuuuuacugaucuuccccuugcucacgugcuauucaaacuagugaaguaguaagaguugggggugggaacuggcccaacuucaacuuagacaaaaacgacacaguguacacuaaggguuguugcagauaguggugguggcaguggcuccuggcccugcagggagaacagaagcuggcugccgcagugggucaaccccugcccacuuacucggguccuccugacugguucucuucucuucuagcuucuccagggccuguuuugcacagcccugcaauaucugggcacagaucacuucggggcccucugccaguugguaaaugagggucacugccaccucuuugaaugggauccagagugggucuggguggacaaagccugcagaggaggagggagaaguuguuuacugcaacaaagggcccaauucugcccaaggccuucccugagagcucaccuuuugugacugucucccgcagucgcucaaacaaccuguguuccugaggcagccggaagggggggugacguuugcccagagaaggcuguggagagcaagacaacguggguguguguacaggguggacacgagaaucuccacucuccuuaguuuggaaccacccccacauaccuuucuccuguccgagauguuggcaauggcauggcacaccugcugggccagccuguaguccuguggaaacuucucauccagcccuaugcucaccagugugucuaaauugcuucccacaauuucuggcuuuccucuaggggaaggaagccacagaguuaaaggcagucauggauuggacucaucgggggagaaagggccaauagggguagguaccagcaccucauguggugucuagagccguggagcacuauagcguggcucugccgcagggccagccucuuggguccuguugcuuuacugaaucccacuacuacuaggcaggagggcugguccucucacuauuugcuuuuccauuuagguggcguuauaacucacagcagagcucaguugggccucacugugacaaugucacugaaggaaaaggagcccucucagaaccuuccuuugcucucccaccccauugccugcuagauuugagccucaccgugccaucaugccaagaagcaugacagaggaacagcgcuccagaggacagcaggcgaccuucucgguggcccgcucccacagcagcugggucacugcugguuucaacucauccuucugcacaaacucacagagcuaaagagaaaagaaaaagggcucaagccaaaaaugaacaauuccuugaucuuuggucugcuuuucugaagaugauauugcgaaccugaaguagacaaaaguaauacuuaggaagagaaaaagaaaagaggagguucaaaauguacagcagggucuugagaggcuuuccauucucuacuuuucuacucucaugccuucaaaacuauuuuauucaagugacauaucgaaacugaccuuuugaguuccacguggguccauaguucuaagucuggagauuucuaacagguuuucuugccguuaccacaaacucaacauguccaacauggaagccaucauccuuccuugccuuuucauuuugccagugguaucaacacucuaucaguaauaugugcuuaaaauuucggucaucuaauuuuuuuacaaaucagucacuauuuuuccuuuaaaaauuugucuuccauuaagcccauucugcagugauuucuccaauccucaaguccagccccucguuacugcccacugcagcagccuccacgggccuuccuucccauggguuggucuccucagccucugcuuccccacgucccuucuguugcaccccaguuugcaggugcucuccccugccucuuguagggcuuuugccgguaacugaccuaugacaucauggccaaucaccaccaccaggcucuuuucuuuuccccagugaggagaaaaauguggcuggcaggagcacgcuucccagcgccaccuccacucucugugcccgcaaugcaaaugcuacaaagcagaaugucucacuaaaaugcugggugccuggcuaacacaguuaaaguccuagacuccugaagucauucagggacuuccacaguuuaguuccaaccuacauucacaacuuuauuaucuuuuccagauuuuuuuuuuuuuuuuuuuuuuugagacagagucucccucugucgcccaggcuggagugcaguggcgcaaucucggcucacugcuaccuccaccuccuggguucaagcaacuguccugccucagccucccaaguagcugggacuacaggugcccaccaccacaccuggcuaauuuuuuuguauuuuuaguaaaggugggguuucgccauguugaccaggcuggucucgaacuccugaccucagaccucagguaaucugcugccuuggccucccaaagugcugggauuacagacgugagccaucgcgccuggucuuuuccagauaauuugaaccagaacacagucuucuuuguucuacaaugugaacugugcucuuucuuggguucuguuugaaaugcccucccuccuugcucugauucucuaaauccuacucaucuuucaagacccagcuuaaguccuaccaccuucaggaagcuuccuugaccauucuaccccaaaccgcucucuuuccuacucuguaucccucaguagaacacagaaguuaagaguauguuuucuagagcucuuauugccugaguuugaaucucaaacuuugccacuaacuagcuguaaccagccaaguucaguaacuucucugugccucagauuucucauuguaaaaugcagauaaugcuaccucacagggcugucgugaggauuaaacaaguuacugugaguaacgugugagugccugucauauauucaauaccauauaagugagguuguuauuauugcuaugacaaccauuacccguacaacucauucuggcacuuuauuaucuaccugcugcauuguucuaaaaauguucugugguuuuucacuaccaacuagacuguugguuccuuuaaaguugggaacaugaaagcaaauagucuuauacuucuuucuggagcuaaguaaauugcuaaauacauaguaauaacucaauaauacuuguugccgggcgcuuuggcucacgccuguaaucccagcacucugggagguugaggcggguggaucacgaggucaaggguucgagaccagcucggccaacauggugaaaccccgucucuacuaaagauacaaaaaacuagucgggcaugguggcacaugcauguaauuccaguuacucgggaggcugaggcaggagaauugcuugaaccugggaggcggagguugcagugagccaagauugugccauugcacuccagccugggcaauggggcaugacuccgucucaaaaaaaaaaaaaaaaacaaccaaaauacuuguugaaugaauaaagaaagagaaagcaggaagccuuacaauuuccucaagacacugaauggucccaaccgaggcauccacuagcagcagagagagauucugaaucaaagccugggccuuggcucugugggaacagcagagaucagcggucacuauaagauugggaagcugaacuuggcaaacagugauuagggcuaucccaccacagugcuacaaaacugcucucccuggaaaccgagccccacccuaagccccacuaugauggacugccuauggaucuggaacuccccuggagaaaugcaccucuuccuuuaggagacaagggaaguccugugagaagcugaccuuggaaaagucagcaaaggcaaaagcaccccauauaccuggcagaguccccuuugggguugagguagaguuggcgguaggcauuaagcacggcuucccggacaccaggcuccuuagaccagaugagaggcagcauacggcgcaccccaaacagggccugggguaccccaaauuggaagaccaucacaaagaauucaaucaccuccugcaccacugagagaacauguacaaaugucaccuaucuacuucacaaaacucccccaauaccuaacgacagaaccuuucugaauguagcaagaugcaaauggaggccuuccgcauuuucccugagaaugucgacuccuccuaugaugccuuaucaugaaauacuauaugcauuaaaauguauaagcuguaaguggcuagaggaagcaaacagaaaaaaagaaccccugccuuuuuuuuuucuuuucuuaagacacagguucuuauucuguugcuccggcuagagugcaguggcaugaccacagcucacuguagccucaaacucccgggcucaagcaauccuccugcccagccuuccgaguagcuggaacuacaggugcgugccaucacgcccaguuaguuuuuguuucuuuguagagauggggucuugcuauguugcccaggcugcucucgaacuccuggccucaaccugucuuccugcuuuggccucccaguuuuguagggauuacaggcaugagccaucgcgcccagccgagaaccccugccuuuuaaaggagcagauagauauaucaauaaaauauggaaaagaacuccaagauccauggccgggugcaguggcucacaccuguaauaccagcacuuugggaggcugacgcagaagaauugccugagcccaggaguuggagaccagccugagcaacaaaggaaggccccaucucuauuguuaauaaaaauuuaaaaaauuaaaaaauccaaaagaaccccaaggcuguccuuauagaaagggacucuggcauaccuguaguuguguuuucauacaucaucuugcugaugaugccaauggccucuguaaucuuccgggagaagcuguaggcauccugcagauacuguaccagcaucuccugcuucacuaguucaucauuuccccuggauuccucaggauccgacauauuggguuuauuuuuacagacagucuguccugugaccauguuuccuguagacucccggggauucuuuucuuguguggaagcugcugggccuaaggaguuagagaaguacaggaugguuucguucaaggggauacaggggaauccaacagcugucaacauuccuggauauuuacuuauuuauuuuccuucuucuuuucuuuugagauggggucucacucuguugccuaggcugugcaguggcaaugaucaccgcucacugcagccucaacuuccccgggcuaaggugauucucucacuucagcuccugagcaguugggacuacaggugcgugccaccgcaccuggcuaauuuuuuuuugguaucccuuguagagauggggguuucgucauguugcucaggcugauuuucaacuccugggcucaagcaauccuccugccuuggccucccaaaguguuaggauuacaggcauaagccacgacaucuggcccuggauaucucuuuucacaaugugaagauaugaaauuaaaacuuacucuaaaauaucuaaauuucucaaaaaccauaccuaaagaccgcuauggucuggacagucacccugugacuaucaaucuuaggcccgugggcugcuuccauuccagagcaaaaguaaugccaauucaucucugggcucuucagcaccagguucuguuaaccaggccaaugauggcauaaaguuaaugcucaguaaauaccaguugacauguguuauuuauugacugaagaaggaaaaugauuaccuuugaagauaaguccuaagauauucaagagccuggucuccucugacuccucugggucuauaugacugaaggguucggacuccuggaaguggccuguggcuucucgagugagaaugauggccuuucugaaagaacaccagccugucaguacccagaagaaugucacugcagccguuuguaagggagcuuaccucaugauucuaucaagucccuggaccuacugcccagagaaaaggagcacuuaacaugcuuaaaaaguuguuacagcaccuacuaagggguagggcucaaaacacuuugccuauuuuuuuccccugacugcucaucugcaaacacuuuuccuauuucugaaccuacaaggcauuacuacagucuucaaaaaaacuccaauaaggcuuuuuaaaguuuuaaaaucauaaaccuacuccaaacaccuguuuaaaaacuuuccuaaguuuagaaacaauaaacuuucaauaauuaguuaauucaggcacauccagacaauaagauucuauguagucauaaaaaauaauggggacacgugagcccaggaauuugagaucagucugggcaacacagggagacccaacuauacaaaaaguaaaaaaaguuagccgggugugauggugugugccugugggugugaugguguaugccugugggugugauggugugugccugugggugugauggugugugccuguggguguaauggugugugccuguggucucagcuacucgagggagcugaggugggaggaucacuugagccugggagaucaaagcugcagugaguugugaucauaccacuguacuccagcaugggcaaaagagugagacacucucucucucaaaaaaagaggagagugggaaacuauuuauguauaaauauauauguguauauauauauauauauuuuuuuuuuuagagacagagucuuguucugucacccaggcugaaguguaguggcaugaucuuggcucacuauaaccucugcuuccuagguuugagugauucucaugccucagcuccccaaauagcuaggauuacagguacgugccaccauaccuggccaauuuuuguaauuuuagcagagauggguuucgccauuucgccacguuggccaggcuggccucaaacuccuggccucaagagauccaccagcuuugggcucccaaggugcugggauuacaggugugagccacugcaccuggccaucuauaaauuuuuuuuuuuuuuugagauggacucuuccucugucacccaggguagaguguagcggagcaaucucagcucacugcaaccucugcuuccuggguucaagcaauucuccugccucagccucccaaguagcugggauuacaggcaugagccauugcacccagccauaaauauuuuuaaaaaccacugagacacauaguuaagugaaaaaaacaagaugguagaucagugggcagagaauucuaucagucauauaaaagggggaaaaaaagaauacauguuugacugcuugucuacauguuaucuucuugccacguugcccaggcuggcaaaggccaggccuggugguguguaccuguaaucccagcuacaaauuauaaauaaauuaaccaggcuacucaggaggcuaaugugggagaucgcuugagcccagcaggguugaggcuacagugagaggcugcagugagcugugauugcgcuacuguacuccagccugggcaacagugagauucugucucaaaaacaaacaauccuuuucuaauugacaggagaaaauacuagaaugcuugguggaacaugcacuuauaaaacuauagucucuauuuuugcuuuagcaaaauaaaaagagagacacuaaaguaacauaagggagucauagggcaaacaagccacucucuagccuucuaaaaacagcccaagccgggcacgguggcucaagccuguaaucccagcacuuugggaggccgaggcaggcggaucacgaggucaggagauugagaccauccuggcuaacacggugaaaccccgucucuacuaaaaauauaaaaaaaaaaauuagccgggcgugguggcgggcgccuguagucccagcuacucgggaggcugaggcaggagaauggcgugaacccaggagguggagguugcagugagccaagaucgcaccacugcacuccagccugggcaacagagcaagacuccgucuccaaaaaaaaaauucagcccaauuagguaagaaguaaauaaauaacaaauaacuuguggcugagguuuaagaauacuuguuggcagccgagugcgguggcucacgccuguaaucauggcacuuugggaggcugagauggguggaucaccugaggucaggaguucaagaccagccuggccaauauggugaaacccugucucuacuaaaaauaaaaaaauuagugcggugugguggugcgcgccuguggucccagcuacuugggaggcugaggcacgagaauugcuugaaccugggaggcagagguugcagugagccaagaucgugucacuguacugcagccugggcaacagagugagugagacuccaucucaaaaaaaaaaaaaaaaaaaaaaaaaaaaaacuuguugacggcuguaagggcuuuuguuguuaaguucuagagucacaaaaacacuaggagaaaucuuuucucuaagaucaggauucauacuagguuugaagauuaagguaguauuaagcauguuugauauuauuaguucaugaaauuuagaauuagaaaguccuuagagaucauaagaucuaaucaauuucuuauuuuauagauaaugaaaccgaggcacagaaaguuaagcaacuuauucaagaucauacaacuagaacuuauuuauaggugcucuucuucaauugaaggaggacucauguuugauuauaauacuguuaacauuuaauuguuucaguaguuuuuuuaaacauuuauaaaguagaaacacaugcuuaauuguggacuaggccuauggucagaccauuacuacaugaaaacaucuaccaucaccugguggcagcauaucugugugcaguuaauuuaaaagacacauuauguaaguuucucaaagguuaacucuaaacauaaacagaucacgaagaauaucccauucuuuugccuacuuguaacuagcuuuggcaagcaguugauagaugcguccuuucacaucuucaguugucucuguauuggcaauuugcucaggaaucuccuccucucccuggggaagcuguagaagcugcugcaggguagacuucaacucuggcagcauggcuucccacuccuccucuggguccagcacugcagcuaaaugagagugucacuuagucucuuucacuagaguuucugacugcaaggagaagccugucuggcauuaggacuccaaggcaguaacuacuuacaagcugcugcaguucgccucugggcccucaucucuuguaauuucugggucuccuucugcagugguccggcaaggucagcaucacuaagcuaucagguaaaaugaauagcagggucaguaaaugacauaauuucaucccuguuuccauuuaauuccuucucuuuugguggaccaagucuacuuaccuugcaggagaaaggauuauuggcuagaaaacuggccagcagcuggauggcauuuuuacauacuagcacugacuugucugccagacgucccacagcuaaagccaccacugccuggaaacgugucagggggagagccuguguaggguaggaagagaagaaucugcucaagucccacaucauccauuuuguucaagaugaucuuuaaguauacucuaaacugagcuacccacucacucuaaaaacccuuucuacagaauauagauuaggaguacuccuuguagugguaagacacauuacaguccuuaaagggagccagauauccucguccuugguagaggaagacuuuuacuacugauaauaaaaaugugaauucuagaccucuuuggggcagauauuuaucuucaacacuggauuccucuuuacacugguauauggagagguaccauauguuuuugccacauagaaguugguuaccuucugcuggacaauucgggugaagagcugcaaaacacggcuccgcacaaaggaguugacaucauggccaugggcuuguaaaguauccaagaacuggucucuggugucucgggcugcugcuuccaguugaucgccacugagaaccugcagcaccaucuccgccauggcugccagcacagcauuacgcaucauguaauucuaagagagagaagcauagaggggucaaaccuuuagucaaggcgaagcuugcuugugcuuggccauaacuuuuuccauuaacugccuagguauucacucccaaggucacaggagaaagcugaaucccaaagaggacuuguugcucagagaaugcuagaacaagggccaaaaccaauuuuuccucauagggcucacacaggaaagcaugguaguagcugaauaaaaaaaucacauccacucaccaacacacauuugaaaagcauuuauuaacuacccuucagcugaggucucaaagccuuuguuauugugguuguuuguuuguuuuugagacggagucuugcucuguugcccaggcuggagugcuguggcgccaucucggcucacugcaaccucugacucccggguucaagugauucuccugccucagccucccaagcagcugggauuacaggugcccgccaccacacccagcuaauuuuuguauuuuuaguagagacaggauuucaccauauuggccaggcuggucucaaacuccugaccucgugauccacccuccucggccucccaaagugcugagauuauaggcgugagccaccgcgcccgucugugugguuuuuuuugguuuuuuuuuugagacagagucucguuuugucacccagguuggagugcaguggugcgaucucggcucacuguaaccuccauuucccagguucaagcaacccucccacuucagccucccgaguagcuaggauuacaggugcgcgccaccacacccagcuaauuuuuuuuuguauuuuuaguagagaugggauuucaccauguuggccaggcuagucuuaaacucuugaccucaagugauccacucaccucagccucccaaagugcugggauuacaggcgugagccaccacaccuggccucaaagucuuuaauccuuacuaauaaauauccccuccuuucccucccacucuccuucagaugcuuuacugacagaaaaugagacagaaacauggaaaucagccuuaagagugccagcaaguccaauacauaaucuaguggagagcaggguuaagguuuugccaggcuaagaaccagagaauagggucuugcacaaaaaguuaaaguaaaugagaugaacaaguggacugucuuuguccuugacauucaccuaggagugcccaacaucaguaugggaaucagccagguuagcauucaggcauaaaagagaauugagagagaugacauggguugauuugagaaaguucauuguuugaggaagcaaggcaagccagcuggugggaagacgcuuuauccugaggaacagaugggacucagaaucaaagcugaaggcuaagcaugguagcgccugcaaucccagcacuuugggaggcugaggcaggaggguugcuugagaccaggaguuugagacuagccugggcaauauggcaagaccccaccucuacaaaaacuaaaaaaauuagccaggcaugguaguaugugccugaagucccagcuacuugggaggcugaggugggaggauugcuugagcccaggagaucgaggcugcaaugagcuaugaucaugcuccagcaugggugacagagccagauccuaccuccaagaaaaaaaaaaaaucaaagcugaguugcucuuacuagacuuaagcugcagaaaugucaucucccuuaccagaacuggauaaaagcaaugugaauugaaagauuaacagauuaauaaagagcuccuuauucaacaaacuugaccugcuucucuacagaaaggaaaugucacaaugauaaaucuagacaacuugucaaagcuacuuucuuguucuguuaagaaacagccuuucaacacuggacuuaaaauccccagaaaaagcucagugaccccuaguggaccaccuacuucuccauccaggugaucuagcaaaaugcacaugcuggacaucaggauagcugggacacguucugcuaguucugucaggaaugcugcaaagcccuuugucccugaagggucucgacucagcucuuggggacacuuuuguccaaucucucuacacagggaagaaaacacagccauagcaacauagaucaauuauucaguucccaguaagggaagguaagacagguaucuaauaucugaaggaaucuacuguugcacagauaauguauuuccaaucuuucuuuauucccuccccaaggaaaauaagcaugagaaacuucgagaaggaagagucaccuuacaaucucucccacuaugcucuucauuccauagucaguugcccauagacucacggcugcaaccaguacaggugccagguguucaaagugcugcagcaucuggaugaucuucacuguagcaccuguggaagcauuaaacaugagaaauuaugggcaauacaaaaaaggcggggcaaagcgacugguaacuuacugagcauaugguuauaacgggucaaggcuacaccaagcagguguguuauggcuucccgaguggggcgguucuucuggugauuaauggugggauucuccagaaggcgguagcaacagccaguaaccaaacugagaaaggaagaguuugagaugaugaaagcagcugucugaauccaauuguaucagagcccugccucauucauucuaucccuacugcucccaaagucaggguuuucuuuauucuagccauuacuuucuauaacaaguugcuuugcuuugcugaccccaguuagguacuccuuccuucaagauuaccaacuuucaaccaguugugaugcugacaaagaaccuaaauauaucauaaaaauaugauagaguuggccgggugugguggcucaugccuguaaucccagcacuuugggaggccgaggcagguggaucacgaggucaggcauucaagaccagcuuggccaacauagugaaacccugucucuacuaaaaauacaaaaaauuagcugggugugguggugggcgccuguaaucccagcuacuugggaggcugaggcaggagaaucccuugaaccugggagguggagguugcagugagcugauaucaugccacugcacuccaggccaggcgacauugcgagacuccaucacaaaaaaaaaaaaaaaaaagacaaagucaccaaugacuucucauuccuaaauauaacgacugauucaaucugcaucucaaguggucuuucacagcugcaugugauacaguuaaucacucacuuucuccuugaaauauaugcuuuaucucgcuuccaggacacaagaacaagacuccuuucucaguuucuuuggcuaguuccuccucagacucuuuuuuuugagacagggucugccucuguugcccaggcuggagugcaguggugcaaucacggcucacugcauccuugaccuccucauagcucaggugaugcucccaccucagccuccaccaugcccagcuaauuuuucuauuuuuuguagagacacaguuucacuauguuguccaggcugaucucaaacuccugggcucaagugauccuccugccucagccucccaaagugcuaggauuauaggcgugagccaugcacccggcauccucacucuuaaugcuggagugcccuaggguaccaguccuuggauuccugcucuuuuagcuacacuuacugauuugguaauuucauucagucucacggcucugaauacuauuauauucccaaauguguuaucucuagcucagaccucucuccugaacuccagaucuauauauucaacguccaaaucugacuuuacguggcuaauaaacaccucaaacuuuguauguccaaaacagaacaucugaucuuccucccaaaacaccuauucacagccuucucccuaucucaguuaccauuaacuccagucuuccaaaugcucagaccaaaacccgggagagucauccuugacugaacucucccucccaccucacacccagucuguuagcaaauccuguaagcucuaccuuaaggaaaaaguauagaauccaacuacuucuccccaucuccacugccacgccuuggucuaagagaccaucaucucuugcuugaguuauuggaacagccucuuaacuggucucuugcuuccccuuucccuccauagucgauuucaauacaacagcuaggauggcccuguugaaguacaagucaggucaccucaccucccugcuuguggcuccccaguggcuccacuucauucugaggaaaugccaaagucaccaugauggcccacaagaaccugcggucuggcuccccacugcucccauggccucacggccuaacccucguaccugcucucagcugucagcucucuggccuccuugcuauugcucguacgugcuggacaugcucccuccucaaggucuuugcauaugcuauuccuuuucccugcccuugcuauuccuccacauauucucauagcucucagucaccuccucugggucuuugcucaaaugucaccaucucaaagaagucuuacuagaguagcuugucugucuguuugucugucugucuaucuaucuaucuaucuuuuuuuuuuuuuuuuuuuuuggagauggagucuugcucuguugcccaggcuggagugcaguggcgcgaucucaggucacugcaagcuccaccucccggguucacgccauucuccugccucagccuccugaguagcugggacuagaggcgcccgccaccaugcccggcuaauuuuuuuuuguauuuuuaguagagacgggguuucaccguggucucgaucuccugaccucgugauccaccugccucagccucccaaagugcugggauuacaggcgugagccaccgcgccuggcccuaucuauuuuuuuugagacgggauuuugcucuugucgcccaggauggagugcaauggugcgaucucagcucauugcaaccucccucucccagguucaagugaugcuccugccucagccucccaaguagcuggcauuacaggcacacaccaccaugcacagcuaauuuucauauuuuuuuaguagagacaagguuucaccauguuggccaggccggucuugaacuccugaccucaggugauccacucgccucggccucccagagugcugggauuauaggcgugagccaccgcaccgggccuagaguagcugauuuaaaaucacaaccuucuuccaucaaacuuauuuuacuuauuuuaaaaauagacuucuggcugggcgugguggcucacaccuguaaucccagcacuuuggggggccaaagcagggagaucaccugagguuaggaguucaagaccagccuggccaacauggcaaaacccgucucuauuaaaaauacaaaaaucagcuugugguggcgggcaccuguaaucccagcuacucgggaggcugaggcaggaaaauugcuugaacccaggagguagaggcugcagugagccgagauugaaccacugcgcuccagccugggcgacaagagugaagcucuguccccccacaaaaaaaaaacaaaaccaaaaaaacggcauaucuaucaacagagccucacucucacagcucaguauuaucuguagccauccucccuacccaccugacaaauucuucuucaauuauugagugguuccacaggugacggauguccaacugaaguagcuguguuaaaagcugaagaauugguugccucucuucuucccagucaaagccaugggcugccuugguccgagcuuucuuacccuaaaaaggaucauguauacauugaggaaaaaauaagggaaaaaagugggucaagaucugucagucugagugcccaaacaaucuaguaccaagacaacauagaagguaauacggaagaaauauuacaaguuccacagcgcuacuuguccaggaagaaaacgugugacacuuuugaguucuuucuccuaaauucucaaugaggacagaaaggauuuguggaucauuggauucccuucuuuuccaucuauuccccuaucuccccagaccccauauaacgugagcccaaaacuccaaauuaccuucccaccaagguccagguccacaagguuugucuggcuggccauggucucaaaggauuccaggagacguaucagagcauaacaguucauuuugagggcauuuagaugggcguuucuaucugauccacucaaaguuguaucauccaggauagcuggaagcuccugggaguggcgggauaccacugugaggggcagaaucuuggagucaguuucacucacuucuuucauauaccccaacuucaaaacacccagcacuugcagccaucagauuaccaaagaucuguguuucaucucucaguggccauaacacaagcuaaguccuuuaggacccuuggcccugauacccugaacaugcccuguuccuacucucucacuccaguuaccacaauuucucuccagcaacuggaagaaucaccccuauuaaaaagagguagcucaaaaguaggaaaaaguucuuguuggucugcccuuacagugaacacacauaacucuguaucgcccaccaagauuacagaccuuuaacaggccaaaggucccugggcuuagccaaaccaacugaaucacaacagccuugauaucaucauguggcugacaaaauguaggaaaaacaaacaaacagacaaacaaacaaacgauaacaaacaccuuccauccccuacccccugacccauaaacaccuuuuaucaggaauugcagaguaucuucuuugaggccaggaucuauacuucgaaagugacuaugagggaaagaaagugugggggugagacaggaaggagccugcagagccccuucuaacagaucagaucuaacccguggaaucgaauguuuaaaaauacacgugaaauuguucaacugaauaaauacgguggcaagcuggguacaugcucaucaguagagauaucaauauccagaggcauuuaucagugaaccuauaacuuggaauuucaggacuaacaugcacaguuaggacaaacagucaccaguucuuuuuaaaguaccaguuggguguuucacuuacugcaaaaugcuguagauaguaucaaagugcugcagcauagccaggggccccugagcucgaaaggcagccugaaaagcuaugaagauggaaaaaacaaaucaauuuggagggaagagaaaccuuuucaguaaauucuauccauggcagaaaacuagguuuauugcuuuuauugguagaaucacaaaaaagagacaaacaguucacuucaauguaaccuauaaugacgaugagagccgggcaugguggcucacgccuguaaucccagcacuuugggaggcugagacggguggauuaccugcggucagaaguugagaccagccuggccaacaucgugagaccccaucucuacuaaaaauacaaaaaauuggcugggugugguagcaggcgccuguaaucccagcuacuagggaggcugaggcaggagaauugcuugaacccaagagguggagguugcagugagccaagaucgugccauugcacuccagccugggcaacaagagcaaaacuccgucucaucucaaaaaaaaauaaaauaaaauaaugaugaugauaucuuauauuuguguuacaauuaaagccuuguuugagcuucaccacaccugagcaaaagcagacaguaccacgccuacuuuacaccuuagaguaguuauaugacuuguccaacuuacaguaguuaggagggaacacaaacucaggaucuuuuaaaaaaaaaaaaaaaguuuauccuauuuguguccuuuuucugcuucaggaucccacaaugcacuuaguugucaggucuccuuccucuccuccagucuuuaucuuucaucaucuugacacuucuuugaagaguacuugucacuuauuuuguacaaugucccucaauuuggguuggccuguuuucucgcgauuauauugaaguuauguauuuucguaagauuacagcagaagggaggguugguccucaggcaucguaucaagaggugcaugaagugaaugucuuauuacugcugauguuaacuuugaucacuucguagugucugccacauuucuccacuguaacauuauuauuuuccccuuugcaaccaguauuuuugugggaagauacuuucagacuacguaaauguccuguuucacaucacauuuuugcccacuaauugaagcauccaugaaugauucuugccugccacaauuacugcugugguguuuacuaaauggugauuuucuaucucuauuauuccuucuacauuuacuaaugggaaugcuauuguaacgauuagcugucccuuucccuuuauuuaguuauucacuuauuuauagcagaauggacuuagggauauuugucuuauucugugcuuuaauccauuacuauuacuauuuauuuuccugcucaaauugucccauacuuggucucugcgaucuccuucaacuuggccuguguccuuugaacaugcuuccauuuuuuuguuuuuuucaagauagggucuugcuuuguugcccaggccagaaugcaguggugcaaacauagcucacuguagccuugaccuccugggcucaggcgauccuacugccuacucccuacugccucagccucccacguagcuaggacuacaggugcgugccacaacgccuggcuaauuuuuuuuauuuuuaguagagacgggguugcaccauguuagccaggauggucuugaucucaugauccaccugccucggccucccaaaguucugggauuacaggcgugagccacugcgcccggcccagcuaauuuuuuuuucuguuaauuuuuuguagcgacagggucucacuuuggugcccaggcuggucucgaacuccugggaucaacugaucugcugccucagccuccugugggauaugaugagguuucucuucaaauagccugaucaauccucuauucuuuaauucauagcacucccccacaaccuuuuuuccuuuuucucuuuuuuucguuucugccuuuguuacaugccuggacacgccacaguaccaggcuuaucaguaccagcucacauuccuuuccuuauuuggaaagaagacuagcuuuccuuuauuacuauuucuuuauuuucuuucuuacuauuucuuacuauuacuauuccuucccuuauuuggaaagaagacuagcucucuagaucauugcagacaccccuucaccuuuuccccucucucccuuaugugcccaccuuaucuaaagaaaguucagauguuuagccaauugggcuaauugugcaacccgaccccggcaaaugggaaaaggguacaggggcaggacuugcgucaggaauaaaggcucucgugccccuuuguucaggugugcuuucacggcgacuggccaaggagaggcaccccucugcagagaaguaaaauugcuuuccuaagaauccuuuguuugaauguucauuuuccuuaggauuuugaguguuauucccaacacucccaaaguacucggauuaaaggcaugggccacugcacccagccucccuucauuuuuguucccugacugucuuguaucaugagaugggcugggcucaagccuguaaucccagcacuuugggagguggaggcaguagaaucgcuugggcccaggaguucaagauccgccugggcaacauggugaggcaccaucucaaaaauaaauaaauaaauaaaauaaaagauguucugggcucaucuuguauuuucccuggcccaguccuguaaucaaccauucuugguggaauccuggcuauuacggaauaaugguauguagaagccaaauucuaggcauuacuugcacucauuucuauuagaguauuacugccuuuaggcccucucacuggagaaaaguaaggcaccuauguaugucuacaauuaaucuucgaacaauacgauuugaauuguguagguccacuaauaugcuaauuuuuuucaguaaauauacuggaauuuuuucuuucuuucuuuugagacaaagucucacucugucucccaggcuggagugcaauggcacaaucacagcuuacugcagccuuaaauuccugggcucaagcaaucgggcugccucagccuccugaguagcuagaacaacagguaugcucuaccauaucuggcuaauuuuuuuuuaaagcuacauaugucaugaacgcauaaaauuuauguagauccuagucuauuuuaucauuuacuaccauaaaauauauaugucuuuuuuuuuuuucuugagacggaaucucucucugucgcccaggcuggagugcaguggugcgaucucggcucacugcaagcucugccuccuggguucacgccacucuccugccucagccucccgaguagcugggacuaccggcgcccgccaccaugcccggcuaauuuuuuguacuuuuuuaguagagacgggguuucacgguguuagccaggauggucucgaucuccugaccucgugauccgcccacuuuggccuccugaagugcugggauuacagggguugagccaccgugcccggccaaauauauaugucuauuauaaaguuaaaacuuaucaaaacuugaugcaggcuggaugugauaguucacacuuguaaccccaccacuuugagaggcugaggcaggaggaucacuugaggucaggagcucaagaccagcuugggcaacauggcaagaccccaucuccacaaaaaauaaaaaauuagcugagcacaguggggugcaccuguaguccuagcuguucuggaggcugaggcgggaggauugcuugagccuaggaagcugaggcugcagugagcugugaucacacuacugcacuccaggcugggugacagugagaccccauguaaaaaaaaaacaccaaaaaaccucacacacaaacacagacaguacaugacaucauucacagcccaagagaaacggaaauaaauauaaagaugcaauauuauuuguuuuuguuuuucugagacagguucuugcugucacccaggcuagaguguagugacacaaucucagcucacugcaacuucugccucccagguuccagcgauccucccaccucagucacccugggagcugggacuacagaugcaugccaccacacccggcuaauuuuuauauuuaccacaccuggcuaauuuuugaauuuuuaguagagacaggguuuuaccguguuggccaggcugaucuugaacuccugauuucaggugauccaccugccuaggccucccaaagugcuagaauuacaggcgcgagccaccacaccuggccuaaagaugcaguauuaaaucauaacugcauaaaauucacuucaguacacacuguaguacuguaauaauuucauagccgccucuugucgauacuauggugagcucaaauguugcaaguaucugcuuaaaaacucugagauguuaaucaucuuccagugagcaguucgucucuccaguaaacugcauauggcagaccgggcacgcuggcucacaccuguaaaucccagcgcuuuggagaccgaggcgggugaaucacuugaggugaggagcucgagaccagccugaccaacauggggaaacccugucucuacuaaagauacaaaauuagccaggcaugguggugcaugccuguaaucccagcuacuugggaggcuuaggcaggagaaucgcuugaacccggggaggcggagguuccagugagucgagaucaugccacugcacuccagccugggcaacaagagugaaacucugucucaaaacaaaaauugcauauggcagcaagaagugaucuccugugguuccucagguauuuuucaugugucuaaagcaguaucauaaaccuuacauaacaccaugggacccauaaugaagugccacuagugaugcuggaaguguucccaagaagcagaaaagagucaugacauuacaagaaaagccaaauugcuucauaugguaccauggacggaggucugcagcugugguugccugccauuuuacaugauucaucauguaaacuuauggugucgauaaauacagcacaauacugaacauguauuuuccuuaugauuuucuuaauaacauuuccucuagcuugacugcaaaaauauaguaaauaauauacauaacauaaaaaacauauguauuaaggcucgacgcgguggcucacaccuguaaucccagcacuuugggaggccgagguggacagaucacuugaggucaggagauugagaccagccuggccaacauggugaaaccccaucucuacuaaaaauacaaaauuagccaggugcaauauugcaugccuguagucucagcuacuugggaggcuaaggccggaaaaucacuugaacccagcagguggagguugcagugagccgagaucgcgccaccacacuccauccugggccacagagcaagacucugucaaaaacaaaacaaaacaaaauaaaaaaacuguuauguuacuuguaaggcuucuggucaacaguaggcuauaaguguuuaaguuuuggggcagucaaaacuuacauaugcagauuuuugacugcacagggguugucaucccuaacccccacguuguucaaggaccaaugguauauauauauauauauaucuauaucuauauauauauauauauauauauauauauauauauguauauauauaugucaaaacugaaugagauaguccaugcaaaccagucagaacaacacuuagcacgcuguaugguuugaaugugccccucauaauucauguguuggaaauauaauccccaacaugacaguguuggaagguggagucuaaugggagguguuuagguuaugagggcuccacccucacaaauauauauacauauuuuugagacggagucucgcucugucgcccaggcuggagugcaguggcaugauguuagcucacugcaaccucugccuccuggguucaagcaauucagugccucagccucccgaguagcugggauuacaggugccugccaccacaccuagcuaauuuuucuauuuuuuaguagagacgggguuucaccaucuuuuuuaaaaaaaaaaaaaaaauagauggagucucgcucugucacccaggcugaagugcaguggcacgaucucggcucacuacaaccuccggcucccagguucaagugauucucccgccucagccuccugaguagcugggauuacaggcacgcgucaccacacccggcuaauuuuuuguauuuuuaguagagacgggguuucaccauauuggccaggcuggucucgaacuccugaccuugugaucugcccgccucggccucccaaagugcugggauuacaggugugagccaccgugcccaaccccucaccgauauauucauacuauuauaaaaagggcucuggggaguggguucacuugugcccuucugccuucugcccugugacaaugcagcaagaaggcccuugccaguuacuggugcauugauuugggacuucccagucuccagaaaaaaaugugagccaauaaauuucuuucauuauaaauauccagucucaggcauucaguuauaacagcauauuuuucucaguccauuuucuauacaucguauuuccauuguugagcuuguaucacauauucacuucucugucaugcuuuuuaaaauuuagcauuacaguaaguguauuagaaaccuuuguaggccagacgugguggcucacgccuguaaucccaacacuuuguaggcugaggcagguggaucaucaggucaggaguucgagaccagccugaccaacauggugaaaccccgucucuaauaaaaauacaaaaaaaaaaaaaaaaaaaaagccaggugugguggcaugcgccuguaaucccagcugcucaggaggcugaggcaggagaaucgcuugaacugaggagguugcagugagccgagauagugccacuguauuccagccugggugacagagugagacuccgucucaaaaaaaaagcaacaacaacaacaacaacaaaaacaccuuuguaaacaauuuuuuuugagacaggguuuguuguguugcgcaggccgaagugcagugcaggaucauagcuuacugcagccucaaacuucuggguucaagcgauccuccugccccagccuucugaguagcugggacuacaggcagugccaccacacucggccuuauaucuaucuuaauuuacuauuccccuauuguuagauacugugauacuuguaacuuauuccacuaauuaacaacaacaacaacacauacuccccuggcaaaucuagguuaaaccaacuuucugguuacuccauucaugugaccacacaaauaaaaauggccugagaaaaacacagaaacaagcugacuagucuuacguuaaacucaugacuacuaaccugaagugggcauucguacucccaagucuauucguuuucuucuaggcaauuauuucacaccuauccucugcucauaacaccaugaccuucuucccaaacucacucucaguuaaaggcuuucccuuccuauugaggaaacagaagcagacagaagagaacuuucaacugccccaagcucuauauuuaccugcacuaguugcaucuaugcccauacauacacucugccuuuuuuuuuugcuacuguggauaaacuguccauguucugauaaagccaucuccuccccguguaccagaucacguacucucuuaccuacuaaaggcacugcuccaacaacuguucccucuuccuucugcagcaucagcuuuucccucucugaucauuccuacucaauauagacacacauaaugcugcccaucuuaaaagaaauacauuauguaaauucaucaucucuaaucucugucauuccauuuucuuaaaaaccuauuccuagcaggcuuuugcccccaccaucuccugaaacagcuuugucaagguuaccagugacuaugacaucaauaaauccaguaguuaaucugcaguugaccucucuuuuguuuuugaaacacucucuuuauuuagcguccauuuagcuccuucauucgcuuucugccccaaugacugcuucuuaauuucuucuacugguucuucuucauccuccuagccucuaaaugcuggacugucucaggucuuggucuucaaacugcugcucuucuccaucuacacucacugcaaucucauggcuuuaagugcugucuacacgcugaguauuaaauccuaaauguguaucuuuagcugacaaccucucccuugaacucugcacucacauaaccaacaaucuaaaccucucccucccauaugcuaccccaucucaguaaauggcaacuucauucuucuaguugcucaagucaaaaagccuuguaaggccgggugugguggcccacgccuguaaucccaacauuuugggaggccgaggcaggcagaucacuugaggccagaaguucaagaccagacuggacaacacggcaaaaccgcaucucuacuaaaaauacaaaaauuagccaggugucgugacccugggaggcggagcuugcagugaaccgagauggugccacugcacuccagccugggcgagagagcgagacucugccuaaaaaaaaaaaaaaaaaaaaaaaaaaaaaaaauuagccaggcgugguggugcacaccuguaauccuagauacucagguggcugaggcaugagaauugcuugaaccugggaggcagagguugcagcgagccaagaucacgccacugcacgccaaccugggugacagagccaacagagcaagacugucaaaaaaaaaaaaaaaaagccuuguaaucauucucaucucagauuccuuuacuaacccuauaauccaauccaauccaucagcauuccuguaaaagcucuacuuugaaaauauauccugagucguuuuaucaccacuuccccugcuaucccuccaguccaaucuacuugguauuacuguauuagccacuuaacuaguaucccugcuucucuccuugccucuuauagucucugcucaacacagucgccagugaaucuuuuaaaaugucagaccaugucacucccaugcucaaaacccaauggcuuucaaguucauucacacugaaguucaaguuuuugccaugaucuacgaggcucuagagaucagugcuucucaagcuuauaauugcauccaaauugccugggggaaucuucuuaaaauacagauuuccugauucagcagcuuugacauccugggccuugacauccugcauuucuaauaagcucccagaucaugagauccugauauuaacacugcugaucugaggaccacauuuugaggagcaagauucuagaauaaucuguaccacuuccuaccuaaucucuuuuuccuagcuuaaugcacuccaacucuauuggcauuugcccaccucaaggccuuugcauaggcuuuucuguuugcuuggaaugcucuucccuaacaaucugcauaguuuauuuccuuacuuucuuaaggucucugcucaaacgugacguaacagcaagccuucucugaugauccaacaugaaaugacagguccuacuaucuucuucuuuauauuauuuauuuuuaagcuuuguauaauuaauuuuagagacuauguugcccaagcuggucuugaacuccuggccuuaacaauccugcuucugccucccaagugguugggauuacagggacaagccaccauucccaguacacuucuuuuuuuuucuuuuuugaaacagggucuagcucuguggccagguugcagugcaguggcaugaucauggcucacugcagccccugccuccugggcucaagcaauucucccaccccagccucccaaguagcuggaacuacaggugugcaccaccacgccuggcuaacuuuuuuguaauuuugguagagaugggguuucaccauguuggccaggcuggucucaaaccccugagcuugagcaauccaaccaccuuggcuucccaaagugcuaggauuacaggugugagccacugcgccuggccacacugucuucuuuauuuuucucuuuggcucuuacaaccaucuuacacacagugguccucaccaaucuguguucucacuuucugggguuucaguuacccguggucaaucucaagucugaaaauauuaaaugaaauauuccagaaauaggcugggcacaguagcucacgccuauaaucccagaacuuugggaggccaaguugggcagaucaccugaggucaggaguucgagaccagccuggccaacauggugaaaccccagcucuacuaaaaaauacaaaaaaaauuagcuggaugugguggugggcaccuguaauuccagccacuugggaggcugaagcaggagaauugcuugaaccugugagguggagggugcagugagccgauaccuugccacugcacuccaaccugggcgacagagcaaaacuccgucuccagaacaacaaaaaaaccccccaagaauuagccaggcgugguggcacuuaccuguagucccagcugcuugggaaacugaggcaggagaauugcuugagcccaggaggugaagguugcagugggcugagauugagccacugcacuccagccuggucaacaaagcaagacccuuaucuuaaaaaaauaaaaagaaagaaagaaagaaauauuccagagauacacaauucauaaauuguagguugugugucauucugaguagcauaaaaucuggugcugcccugccgccuccugccugggaugugaaccaucccuuuguccaacauauccacacuguauaugcaacccuacucacccauuaguagccaccuugguuaucagaucaacuguugcagggcuucuguucaaggaaccuuuauuuuacuuaauaauggccccaaagugcaaggguagugaugcuggcauaguuacaauugcucuauuuuauuaauauuauuguuaaacaggccaggcgcaguggcucacaccuguaaucccagcacuuugggaggccgaggugggcagauccaaggucaggagaucgagaccauccuggccaacauggugaaacccgucucuacuaaaauacaaaaaauuagcugggugcgguggcucacgccuguaguuccggcuacucaggaggcugaggcaggggaaucucuugaaccugggaggcggagguugcagugagcugagaucacagcacugcacuccagcccggugacagagcaagacuccgucucaaaaaaaaaaagaauuguuguuaaucucuuacuguaucuaauuuguaaauuaaacauuaccauagguaggcagguagagggaaaaaaccauaguauauacagggguugguacuauuccaguuucaggcaucuaauaagggucuuggaauauaucuccugggauaaggguccuacuguacuacauauuuacuuguuuauuacuuguuaagaaccuugaaaggaagaacuuugucauuuugucuguuuuguuuacuguuguauuaucaaugcuuagaacaaugucuggcacacagcacaugaucaguaaauacuuguuaaaugaauuaaaugauuugaucuuauuuauaggagaaguuguauucaggauucuaaacaccaaaaucaucaaagcaaugcaauuguuuuaaaaaggacucuuggcugggugcaguggcucacaccuguaaucucagcacuuugggaggcugaggugggcagaucgcuugagcucgggaguuugagaccagccugggcaacauggcaaaaccucguugcuacaaauaacacaaaauuagcagugcauguuggcacaugccuguagucccagcuacucgggcggcugagcccgagagguugcagugagcucggauggagccacugcacuccagccugggcaacaaaaugagaccuugucuccaaaaaacaaaagacucuuuaaaaaaaaaaaaaguggcugggcgcgguggcucacgccuguaaucccagcacuuugggaggucgaggcggguggaucaucaggucaggaguuggagaccagccugaccaacauggugaaacccugucucaacuaaaaauacaaaaauuagccgggcgugguggcauugccuguaaucccagcuacuuaggaggcugagguaggagaaucacuugaacucgggaggcggaggcugcagugagcugagauugcgccacugcacuccagccugggugacagaaggagacucagucucaacaacaacaacaacaaaaaagugacaggaacaagaucauguccuuugcagggacucagcaaacuaaugcaagaacagaaaaccaaacacugcauguucuuacuuacaagugggagcugaacaaugagaucacauggacacagggaggggaacaacacaauggagccuguuagaggguggaauggggggagggggagcauaagaaaaaaauagcuaauacaugcugggcuuaauacccaggugauggguugauaggugcagcaaaccaacacagcacguuuaccuauguaacaaacuugcacauccuguacguguacuccagaacuuaaaaaaaaaaaggugaccauuuaaaaaaaugaugcaucauuauaauaagugaagaguaguuugucauaguaugcagcauguucaauuggugacacauauauccacaugauauggacagaauaguauaccuguggacacuguugguuugccauccauuaggcaaccuccacacucugccuucuuccuugcuuaccaaaugguugauaugcucaaguuuagggaggcuccuagguaauaagcuugaucaguuaaaccagucuggguaauucuauuucucuuaccuguacaguccugugcccuguaacauuuugguaaacaauagaccacauaugcgacaguggugucauaaaaauauaauacagcugaaaaauucccaucgucuagugacuucuuggugaccuugacccuguguaggccuaggcuaauguguguagguguuuuaguuuuuaacaaaaaagucuggccgagcauggugccucaugccuacaaucccagcacuuugguacaugucuguggucccagcuacuugggaggcugaggugggaggacugcuugagccugguagauugaggcugcagugagcugugaucaggccacugcauuccagccugcaaucccagcacuuugggaggcugaggcgggaagacugcuugagcccagaaguucgagaccagccugggcaacauagggagacacuguuucuacagaaaauuuaaaaauuagccagguaugguggugcaugucugugaucccagcugcuugggaggcugaggugagaggauugcuugagucugggaaguugaggcugcagugagccgugaucaugccacuggacuccagccugggcaagagagucuuuaccuugucuuucaaaauaaaauaaagaauaaaaaguacaaaaagaaaauuccuuuuuccacuucuggacauuagaggaagaagcugccaucuagacuggugcaguggcucacgccuauaauccuaacacuuugggaggccaagguggguggaucaugugaggucaggaguucaagaccagccuggccaacauggugaaaucccgucucuacuaaaaauacaaaaauuagccaggugguaguggcgugcaccuguaauccuagcuacuugggaggcugaagcaggagaaucgcuugagccuggggaggcagagguuguggugagccgauaucgcaucacugcacuccagucugggcaacagagugagacccugucucaaaaaaaaaaaaaaaagaaaaacaaaaagaaguugcaaucuagcaaccaugaaagaaaagccaagaggagacaagcuaggaccauauugucgagcugcugcauuaaccaacccuucuucuuguaggugauaacaaaggaauugguuauuaucucuauauuuacagaugacgaaaccaaggcacugagacaauuaaguaacuugucuaaggucagagugguagaaccaggauucaaauccaggcagccuggcuccagucuuuaaucucuauaccucuccaaagcaagcuaacugcuacaagaccgcucccaacaaguacaaggacauuaugaagucuuucugguaaugcaaaaggugcuuuugaucauuuacagguuucaguaggugacugcacuguacauauauugcucaguguugcagugguacauauauauuauggguuuuuguccccauaauugcacauccaaaaagacuccaaaaagguauuaccaaaaacaggucgaguuaaguccgagacauucugaaaaagcgauccacuccuauaacucuuaaauccaccaggacuuaauuuugacacacaguaagggguaaagauggaaaauaacuuuuccccaaagaguaaucacauacaccaagacuguuuuugacuaauccagaaaaggaaguuaaugaauguacucuuugggucaugcaucccaugcaauuuuaggauaaaacagcaaaauaggaaaaacauguuucuugcucuuaugaugcuuccugguguaguggaacagaaaugacaauguagcaauuccaugugagaugguccuuugaaagagcuagguacagugacagcuauggacucuuaccucuaagcugugguggaagauguuugauggacaguaccucuugcacaacauacugauucaccccuccacuuuucaacaacuccucuggggauaauggcagauggaacucauacauuuggggagccauucuacuccuacaggcucacagggcuagaaaccaaacagugaaaaagucagggucuauauucaagaccugucuucguaucugguucuauuacuuucccauccccaacauauauaauggcuuuuaguuuuauagcaagcuaguaacaucaucugguuuuguuaguuccccacccccaacauauauaaugguuuuuaguuuuauagcaagcuaguaacauuaucuuacgggaucugagauugacccuggacuagaaacuaauucuaguagugacuuuggcacuuggucuugacacuuaaaccucugggcuuuaucuguaaaaacaggguuacuaaacucugauuacuucacaaaguugcucugaugaucaaacaaaucaagcaguacgaagguguuuaaagaacuauaaaguggcauauuaaugugcaaaguacuauuauuuccauuuuuaugugcaaagcuccuuaaguauagagagaauggucugaucucgucugaggccaaaacagugccccagcaugggcuagugggcuuccugcaccagaaugguaagagcauuaacaaugaugauuuauuuauccugugccaagucuguuaggcuguuugcauguaucauaucugaucuaaguauccuaaccucaaucccaugaggugcauaauaauacaaaugaguuuacagagcggaaauugaaguaagaaaguuaagcgauuugcuuaacaucuuccguugcggaucuguuaagcgauuugcuuaacaucuuccguugcggaucuguuaagcgauuugcuuaacaacuuccguugcggaucugucagacuuacaguuucucacacaucgcgccccagggauauacuuacuaggccuauuguauuuugcccaagacugggucacacugccauguacucgacuuuccuacucuuuuacgaccugcaacaccacaucuuaccuggggaucucacccgcggcucugauuccggcagucaggcugaaaugaaaaggaaaaaacacgcgugcacaacacgcaccaauuagcaaggcaguuuucaagucggcggagaauccggccaauccccggcaggcagaggcaaagggccgccucugagucuggcaacgcgcgggcaaagccacaaauaccgaguucaaaucucaacggcugcaggacggccaaucgcgacgcccgccggagcggccggccaaucacagcgccgcccgggggcgggccaaggcuccggcuccggcccccgcucccacccccggcccgccugcgaaucccuccuuggccgcaaggucccccuuugcccagucggcggggaggaggccguauuucugcuggccagagacgucgcgucccuggcugggcauucagucacccccaggaaaggaggcaaguccacgcugggaguuagaaggcaucgccucuaauccagguuucgccaucuccucugcuaagugacguccagcaagucacuucacuuucaggaccucaaaucuccuccccaguaguaaaauagggguaauaaaaacagcuacagcggaagacuguugugaggcacagagaaagggcuuggucauuggaagcggguuccagguucucaaccuucauuuccuucacgguugaaggacgccaaagaaagcggaaagggugaauuuucuugaaaucucaguuuuggggaaucuuagcgacgagucgcggaccucagcuuguccggcgcuccaaaacuuccggcaggcggaccggaag

SEQ ID NO: 14901 - RNA, 36429 nt, Homo sapiens
uuuccagcccugcuggcuugaaauccuaagcuggcuggagcaguaagaugggggcuccccauaggcccacaggaccuucuaccuagaagccaggaggaggggacaggagcccagauaggaaagaacucugucucuccaagacccaaaaaaugacuaaaaguaaugacugggccucaccccaguaagucaguagugguggugcggugguuaacagccagcucucggagugggaagcccuugaucuauggcguuugcugauguaugugguuguaaguauuccuacuauggccagcuggccaauuucaagcuaccaacgaguaaccucacaaaauuccugaaaauguaaggaucgggcuuuggcuaggcaguacuagcaggcuccagcacggcccuaggaaggaagcugcccuaagagcucaggcucagacaccgcaccacggacuagcaggggaaacaaaggucuuaggucccucucagggcucacagucaugaggcucagaaacagcuggggaaaguggggcgugccucccuccccgccacagggaggaucaccagacuggcuccaugagccauuucccucaucuggugagcaagggaagucacucagaagagcaagaauggcccagccacccagcacgguggcucacaccuguaaucccagcauuuuaggaggcaaaggugggcagaucacuugagcucaagaguucgagaccagccuggggaacauggugaaacuccaucucuacaaaaaauacaaaaauuagcugggcuugcagggcacgguggcucacgcuuguaaucccagcacuuugggaggccaaggcuggcggaucaccugacaucgggaguuugagaccagccugaacaacauggagaaacccugucucuacuaaaaauacaaaauuagcugggcgugguggcgcaugccuguaauccuagcuacucuggaggcugaggcgggagaaucgcuugaacccaggagggagagguugcagugagcagagaucgcgccauugcacuccagccuaggcagcaagagcggaacuccaucucaaaaaaaauaaauuaauuaauuaucugggcuugguggcgcaugccuauagucacagauauuuuggggggcugaagcaggaggauugcuugaguucagaaggucgaggcuacagugagccgagauggugccacugcacuccagccugggugacagagcaagacccuguuucaaaaaaaaaaaaaaaaagcgaguagaaaaugccaggggcaguugggcacaguggcuuacgccucuaauccuagcacuuugggaggccaaggcggguggaucaccugaggucaggaguucagaccagccuggucaacauggugaaaccccgucucuacuaagaauacaaaaauuagccaggagugguagcgcaugccugugaucccagcuacuugggaggcugagacaggagaauugcuugaaccugggagguggagguugcagugagccaagaucuugccacugcacuccagccucggugacagagugagacuccaucucaaaaaaagaaagaaaaaaaaugccaggggcccaggagccuacugugagaggaaacgucccgucgccuugugaaaucaugauucugcgugaugaagaaccgaguaugaauaauacauacagagcagacauaucgccuaugcacagcuuguucaauuuagugagucguucugucucuuucacacuccuuugguuucguucccagguuaacuagcuguucccucaaccccauuucuugggacuugcagccucaaauaccaaggaagagagaggaggaaugaauauuuauugaguacccaaacaagacaagaccagacauuucauuucuauuguuacccuuaauugucccaacaugcugcaaagugcacgacacuauccucaagcagaugaggacucagucaagagguugugggacaugcuggacaugaugcggguaguagccggcagagaggcauuuggaccaccaaccugucugguugugaaagucaagcucucuccaccuaucccaggauccuccugucucaguggguuugggcccuggaaccacccuucaguuccaggucaagacugcucccuucauagcgacaucuuucccucacuguuucuccccuugccugguaucugagaaauuccuuuuauaggucuugcccuucccuggcuacauagacugagagucagaaaaccucaguagucagcacucaaaccuuacaccuaacaauuuacauaauaucugauuucagaaauuagcuuuaccucagaucaaaauuaauccuauaaaucacagaucacguaaaaucacaagugugacaagucccaaaaaagaaagugugaccaggcucacgccuuguaaucccagcacuucgggaggcaaaggugggaggauugcuugagcccaggaauuuaaggccagccugggcuacauagcaagacuuugucucuacaaaaagauaacaaauaaaaaaaaaaauuagccagguguggucccagcuacucgagaggcugaggcaagaggauugcuugagcccaggagauugaggcuguauugagcuguguugccacugcacuccaaccuaggcaacagagggagacccugucucaaacaaacaaacaaacaaaaaaagaggcugggcaugguggcucacgccuauaaucccagcacuuugggaggccgaggcaggcggaucacgaggucaggagauugagaccauccugaugaacacggugaaacccugucucuacuaaaaauacaaaaauauuagccgggcgugguggcgggcgccuguagucccaucuacuugggaggcugaggcgagagaauggccugaacccaggaggcggagcuugcagugagccgagaucgcgccacugcacuccagccugggugacagagcgagacuccgucucaaaaaaaaaacaacaacaacaacaaaaacauaacuauaggucugugcucggccagguauggggguaaaauuuauauuacccacgugguugggaaaccuccuuuauccccaagaaaagaacaugaaaacuggucucaagccagugacaucccuggggcgucugacaaaagcaacugcaaaaacacugaagggacauguacucaacccaaccaccaagguggcccacagaaaaagccuguugaauaugcacuuucuuucccucucucucucucuuuaauggagauggggucacacuccgucaccggcacuggaguacaguggggucucacuguguugcccaggcuggucucaaacuccuggccucaagccauccuccugccucagccuccccaagugcugagauuauggugugagccacugugaugggcuugaagaugcacuuuugauucaaaauuagaaaacacaccugaaacagucugaccuagagaaacuuuuucaucuaagucagucauaaaaaucaaauauuugugcuuagacucagaucaaucuauauaaaguguugaggaaaguuuuuuaauaacaaaacacauuaaaucauauugcucuuacuaaauauauuacuguuaauguuuuauuauauuguggaaaauuuuguuaccuauuaauauuuuaaugagagcaacuagaucuuuuauguugcaaauaaguaaaugugauaucuuuaaaaauuguuuuuccuauccuuaucucauuguuuuuauuuuacuuuuauuauuuuguuguuguugcccacacuggucucaaacuccugagcucaucgauccucccaccucagcuucccaaagugcugggauuacaggcaugagccacugcaucuagccaaucucauccuuuuuauguuucuguaugugacuauguaauucgaucucauccuuuagaacuuuagaaugucuacauauacuuacauagaaccuauuugaguauauaauauaugauuaauuuauuuaaaauauuguggggagucgagccagcgucgccgcagugaugucguuggagagcaagcaauuccugacggagcugaccagacucuaccagaagugccggacguugggcagcgucuauaucaccuugaagaaguaugauggucgaaccaaacccauuccaaagaaagguucuguggagggcuuugagcccucagacaacaagugucuguuaagagcuaucgaugggaaaaagaagaugagcacuguggugaacuccaaggaagugaguaaguuucagauggcuuauucaaaccuacugagagcuaacauggacgggcugagaagagggacaaaaagagcaaaaggaaaaagaccaaagcagcagcacaguaaagggcacaaauucccugcuuucaccaauuaaccacugaauugcuauuuuuuccuuugguuuuuacuuuuggccacauagcuagguuucugguucccccacaguagguguuuucacauaagauuaggguccucuuggaaagaauaguugccauguuuacaggguaguugugguaagaaucuaguuuauuuuacaugugacuaauuggucugugcugcaugguuauauacuccuggauuauagauuagaagucuccgaagucaccucugugaaaagcaagcuaucauuaaacaugucuguuuaucaaucaaucaauaaauaaaauauuguuuauuuggggauacaugcugaaaaucauuuuauugaugggguacaaaauaaaaaaaaaaagcagagacuacugaauuagaaauauacauuuuuucaggcacagauggaacauuuacaaccacauacuaggccauagagcaaaucucaaacaaaugccagaggauucauauguauucauuuucuacagcugcuacaacaaauuaccacaaacuuagugguugaaaacaacccaaauguauuauguuacagcucuacaggucagaagucuaaaacaggccucaccaggcuacaaucagugauggcagguacagcugccccuggaggcugaagggucaaauccaucuccuugccccuuccagcuucuagaagccgcccacauacugaggcucauggccuucuucuuccaacuucaaagucagcaacaucuugauccuucucaugcagcugccucucuggcgcugucuccucugccucuuugccacuuacaaggaugcuugugauuacacugggucuaccuggauaaugcagaauaaucacccauugcaaggccaaccuugauuccaucugcagccuuaacuccccuuugccauauuaacaugcaguucaggggcgcagauguccucgggggaccaacgugcugccugccaugcuacacagacagagugcucgggccacaauaaauuuaaaauuaaaauaauaaacaacaaaaaguuaagccccacagaucuggaaaauuuguaaugcauuuauaaaugaaauauagguaaaaauaaauaauaacgggaaaagcaaaucaacaauaaugaaaaaaacaauauagcaaagcugaugagauguagcuaaaguagaucuucaagggaaguuuauagccuuaaaugcauauauuagaaaauaagaaauuucuaaauuaauuaagcauccaauacauuagaaaaagaauggcaaaguaugccgggugcaguggcucacaucuguaaucccagcacuuugagaggccaagguagguggaucacuugagcucaagaguucgagacaagccugaccaacauggugaaaccacgucucuacuaacaauacaaaaauuagccaggugugguggcgcacaccuguaaucccagcuacuaaggaggcugaggcaggagaaucacuugaccucaggaggaggagguugcagugagccaagaucaugccacugcacuccagccugggcaacagagcaagacagccuaaaaaaaauaauaauaauaacagugaaacagcuacacacaagcaaaucaaguucuaccaggcuuucaaggaacagauuaucccuauuguauauaaucuguauauaaaaaaauaaaaaauagcacuuaaaaaacaaguggucaaagcaaggaaaauagaaucgugucacagaaaccaagggaaguaauaauucucauguagguggagagcugccagaucccacauaucucuguuaaacuuugcuuccuggaugaggcacucccuaccccuuaaaucccccuauuagggguauagacaccuauauugcaccccaacucucuccuucauagcaauaaugaccauuacuaacuaauuuuaauuuuguuuuguuuuuuggguuuugugagaugaggucuugcucuaucucccaggcuugagugcacuggcaugaucauggcucacugcaaccucgacccccugggcucaagugauccucccaccucagccuuccgaguggcugggaccacaggcacgugccaccacacccaguuaauuuauuuuuauuauguguagagacggggugucacucuguugcccaggcuggucuuaaacuccuaggcucaagcaauccuuccgccucggccucccaacgugacugggauuccaggugugagccgccucaccuggccaauuuuacauuugucuuugagauuauaugaucgaugucugacucucacacuggugugucaacuccgucagggcagaaaccacauauuugucuguuuguuuuucaucuuugugccccauuacuuggcugguuccuaacacaaaaugaaugugcaaaaaacgcuugucaaaugaaugaggaggucuaaggggccuugagcccucugacguuuccauuuuauaauuguggacagagccgcuacagcacaaagcugagcuggaccauccaauguuuagccagugccuuacgugcuaggagacacugggagcugugcugggcuucugaggagugggcagaggcuggaaauacccauaguuggucagucuccugugucacccagacuggggaggugcagaaaugaaaauuacagagcugcgaggacccagaaccucauuaaugagcuuaacucacuguccugaccagguggccucucaaagccuugcugggaaggaggcuuuaagguggugggggcagcagugcuggugguggucaucgaagaaagugggagucggggaggaagcaauggggagcaggggacaaagagggccagacaaacucagagcuucaggugaugagacucaggaagccuaagucaggaacagugauugcggacaucuuugucccauaacagaacuuccuccuaaggaaaggucuugcagagacugguccugcugagcgcuuuaacagguuauugauucauaaaaauuggagaaaaaagacaaagucugccacaccuaacagccuucuguuuagagcugguuuagaggaaacuuuaagcaagucuuguguccaacaauuugggccugaggcaggguacagguaagggaacagacaggagacacggaggcaagaacaagacuuuagcugaaagagaaaucagagccagaggcagccacaagaacacccaaccuacuggaacucaugcagguggacagccugcccaggacuugcccugagugggaagcaaagagcaucuuaucuagauuuuaaggagcagggugccccuggcugacaucuaggcuacagucacugggccagguggaggguuggucaggcccucucaaaagucaugagaggccaggcacaguggcucacgcuuguaaucccaacacuuugggaggccgaggagggcagaucacuugaggccaggaguuugagaccagccuggccaacauagugaaaccccgucucuacuaaaaauacaaaaaauuagccggguaugguggccggugccuauaaucccagcuacuugggaggcugauguauaagaaucgcuugaaccugggaggcaaagguugcagugagcugagaucaugccacugcacuccagccugggcaacagugagagacccuuucucaaaaaaaaaaaaaaaaaaaagaaccaaaaaaagucaugagaguccucagaguucucaagaagggcugcugugggccuguuucuggaaaggaaagaaaagcagggagcuguugagaaaauaccauauguuuuuaugccccagccaggcaugggggagaggcugaccccaaaagagaaagugguugugugagauuucaaggaagaugucagcgggcugcaucccagggccucuagacaaaaggaagggcccagccaggcaugguggcucgugccuguaaucccagcacuuugggaggccgaggcaggcagaucaccugaggcuagguguucugguccagccuggccaacaugacaaaaccccaucucuacuaaaaauacaaaaaauaagcugggcgcgguggcucuccccuguaaucccagccaaggugggcggaucaacuugaggccagccugaccaacguggcaaaacuccaucucuacuaaaaauacaaaaauuagcugagcgugguggcacgcaccugucaucccaguuacucaggaggcugaggcgugagaauggcuugagccugggagacagagguugcagugagcugagauugcaucauugcacucuagccugggugacagagugaaauggagggaggaaaaaaaaaaaaaaggaaggucccguccagggagccagccuaggauggggaaggcucaccagaaguggaugcaaagagugcuggagaugagcucauucuauuugccuaggaaagaaaaacguccagaaaccuggccuuccuccucuuggccgaggcccuccaggaaagccaggcagacccugcuccugcucugacccccuggagaagugauauguagaaaagaggagaugggcuuuggcccagaggacagcagcguuaggcuagugagcaguucccagucgguucaagguugcuaggcucagcgaacugcaagucccuguucgacaaguuucuuccuaaagguccccaguuccucaugauucuucugagggucucauccacccucccagggccugcagucagcuagccaccccacugccccaugccugcagugaacacauuuaccacaaccuggaaauggcuggugacagaaaaguccucacggccacaacacucucugcggugggaauucaggugccuugccugauggugacaaagcugguuuugcauaaacagcucucugaaucacacccaaauguggcuucugacuugaguggacccccaugaagagcugcagagggggcugggaaaagacaagagaauggagaaaaugaggagaaaggaaacuacagagugagauagagaacauaucugacaggugugaccacagcagugugacauuuaugaacaguguggaaacaacggcaaagccccuaaauuaaaaacuuccuggggaaauaagccacuccacauaucgguugcugaggaaagaguggaggaggcuguugacccguguguguccccaugacucaaagagggaaaagucuagcuguuuccaauaucccgaaaucagucuugcugggagaacugggaaaauaaaaaagagaugacccccguaggaagcuaccuuuaaucccaagugcccaaggcuaggagagaagaugcuccaggcgauccaggacaccagugacugacacagccagaggugggaaaggggaggauaaagauggcacaaaagugaggagugagcaagggucugagagggaaggccaugugggcaguagguggcacccacaucagagacugacaugaggauuaaaggagagcauaggugaucggucagagugugacagaagagaggcagcucuacaccccuugcuugcaauucugagcauucuguagcaaacucguuuggccaucaaaccagaccucaauugagacaaggcuauuuaagcuuccucccaguugguguaaauauucaauaguuuugcugcagaaauguugcguuugauuaugagacuaccccaacuccccaaggguguuuuguggugcugguuucuguauaaaccugaaaaauucugaauuccaaaacuuaucugacccccaaaguuucagauaagagcuuguggaccugugcucaauucugguucuccuuccuucuuucaacuguugucugugaaaggagggaugcagguaugggagacaggaguccugcgaauucgucuguaaacuguggacggggggguggguggggggggguaacgugggcaccuuugugcacaagugcaugaauaggaggggugagcaacuguguguccaucaccuuuuugucaaagaagcaggagucagugggcuacgugcuucaugagcaggagaggcggaaacuaaggaaggcucauguguuggaggaagcauguuugaagagcagcaggucucacagaguuugcucuuuaauacucuccccagcacacggaaggggaaggggguggagguugcugcuaugagagagaaaaaaaaaacagccacaauagagauucugccuucaaagguuggcuugccaccugaagcagccacugcccagggggugcaaagaagagacagcagcgcccagcuuggaggugcuaacuccagaggccagcaucagcaacugggcacagaaaggagccgccugggcagggaccauggcacggccacaucccugguggcugugcguucuggggacccugguggggcucucagcuacuccagcccccaagagcugcccagagaggcacuacugggcucagggaaagcugugcugccagaugugugagccagguaagagggggccuugguaagggccaggugaguggcgaaagagagaggacugggguuaauacaguaaauaggcgcagggugagacugagcucaagcaaggagggaaauccugcagcuguggggaggcaccaccuugaagagggcagagaaccagcccuucucaggccuugaucccuuacccucuccucccaggaacauuccucgugaaggacugugaccagcauagaaaggcugcucagugugauccuugcauaccgggggucuccuucucuccugaccaccacacccggccccacugugagagcugucggcacuguaacucuggugaggugggcaaggguguguagguggggacgauggacaagcaucugggggagcaaggcuggugacggguuugggggugcaaggaggaugacggggccaaagcuuuggccuucuucaaggcucacagcaaguggagccaaugcugggaaaugcggcacccuagguggggcaugaauuaacgugggcagacaucuaguauuccaggaaagggauaaauagaauuugagggauuggugagaacgggucuauggauaggaucaagacaauaaaaugagagaaguggcucuaugaccccagauuucgggcaagcaacccccaaccaauaaacugacuguguucccagagugcacaugugcagguuggccauugggaauuuggaauacaucuuucuaaggaaauaacaaagcaacccaauagguaacaaccuuuuuuugcacaaaagccaauuugagaaaaugaguauguauguagccuguguuuuuauuuuauaguuccaaaaaaaaagguuuuuuuuaaacuaagaaguauaauaucugcaguugugcuuaugaaugcuguuauuauuucuccaucuucgcuacaauuucagaaacuacggccaguauacacuagaauagcaggcuuuaaaguggccccuuugaacaaauguucucuagcaagacacuuuuuagaaccagguaacuguaacuauuaaacuaccuacuugcaaaacguguuuggugucacugggucucuugguacuggguuuuguuuuguuuaguuuagagacaaggucuagcucugucacccaggcuggagugcaguggugcaaucauagcuccccacagccuugaacuccugggcucaagcaaucuucuagucucagccucugaaagugccaggauuacaggugugagcuguagugccuggucccguaaaaacaaaaacaaaaaccaacaccagaugugguggcucaugccuauaaucccagcacuugggaggccaaggcagaaggguauuugcauauuuuguagagacuugagcccaggagcuugagaccagcugggcaacauagugagaccuugucucuaaaaaaauuggcuggucaugguagugcaccugcagucccagcuacuugggaggcugagaugggaagaucacuugagcccaagagguccccaagagguccaggcugcucacaucacugcacuccagccuggguaacagagcaaaacccuuuuucacacacacacacacacacacacaaaaagccagagcaguggcucacacuuguaaucccagcacuuuaggaggccaaggcaggcggaucccuugagcccaggaguuuaagaacacccugggcaacauggcaaaacccugucucuacuaaaaauacaaaaaguuagccaggcgugguggcacgaaccuguagucccagcuacucagaaggcugaagugagaagaucacuugaguccaggaaguggaggcugcagugagccgugacuguaccacugcacuccagcuugggagacagagugagcagagugagacccuguuuccaaaaaaaaaaagaaaacaaaagcuuuuccauugcaaaucaaccaaaaaggaacgucuuuaauacacaagaaauauucuucagucuacuuaacuuaaaaauguaacuguaauagaugcuuuucucuugacagcggccccggcaggguuggaacuuuuccuagucaaaaccccccuacucacucugcagacccuuccugaaggucuucgccccauacugagcccaucuucagucccuucacuuguuccaaacuagcccaauccaugacccuucucugggagcucagccaauagaucccaaaguaccacagcagcaccuggcugcagaaggacccccgggaaaugcagucaggggugagaagaugggugggcugaaugagcucggcccucucugggccuuagugcuggcaucuaugagaugaggacaugccugaagucagccuggaauuuugagcccagguuauaccugguaaauagaacucccaggucuccggauacucaccacuaaaacaauagcaccucauuguuuuuguuuuguuuuguuuuguuuuuuaauuauacuuuaaguucuaggguacauguacacaaugugcagguuuguuacauagguauacaugugccauguuggugugcugcacccauuaacucaucauuuacauuagguauaucuccuaaugcuaucccuccucccuccccacaccccacgacaggccccagugugugauguuccccuuccuguguccaaguguucucauuguucaauucccaccuacgagugagaacacauuguuuuuaacccuccccagcagcuucuuuaaccccuccauuucccuuuuggcggagacccuugucaucacuccucucuaccaccagugcucuccccuccugcacugucccaggcuuccucauucuucccuugcagguccuuauccaacauggcucacaauuccugggaagccacaaggaaaccaaauucuaguagcaacucagagucagcauucauuagcaggucacagggccauaaggaugccaagaaggaauuugucccucuccuuguccugacaaaaggcauaaguagaagaaaauuguuagguuugguuaugaccuuugacauucucucuuugacauccucccuuucugcaccccucuuccaccugucagggcaccuagggcuccccggguccccacaagugucugcccuaaggcccaccaggcuuucuugcagccugucccacaucugggugucacugccuuccucugaaucacccuccucucaaaccagccgccagcgagcccagcccagcccagcuagugcccuaccacacccgcccccaggauaauuaacacccagccacccagcaucggaccucuacacuugagcaaaauguauauuuuaaaggcaaauucucacgccuguaaucccagcacuuugggaggccaaggcgggcggaucacgaggucaggagauugagaccauccuggcuaacacggugaaaccccgucucuacuaaaaauacaaaaaauuagccaggugugguggcacacaccuguaaucccagcuacuagggaggcugaggcaggagaaucacuugaacucaggaggcggagguugcacugagccgagaucgugccacugcacuccaaccugggcgacaaagcaagacucugucaaaaaacaaacaaacaaaauaaaggcuaaguaacuguaaucaaguaacuauuuauuauuuauuuauuuuaguguauccacagguugugcagccaucaacacuaucuaauucuauaacauuuucguuaccccagagaaacuuguaccccuuagcaaugacuccccauuucuuccccccaaccaaccccagccccagccccagccccugggaaucccuaauauacuuuguuuuguuuuuuguuggugguguuugagacaggaucucacucugucacccaggcuggagcgcaguaucaugaucucagcucacuguaaccuccaccucccgggcucaagcgauccucccaccucagccuccccaguagcuugggccuacaggugugcaccaccacacccagcuaauuuuuguauuuuuuguagagacgggguuucaccauguuggccaggcuggucucaaacuccugagcucaagcaauccacccaccucaaccucccaaagugcugggauuacaggcguaagccacugcaccuggcuauuuucuuucuuucuuuucuuuuuuuuuuuuuuuugagacggaguuucacucuguugcccaggcuggagugcaguggcgugaucucggcucacugcaacuuccaccucccggguucaagcaauucccugccucacccggcuauuuuauauuuguugaucugcugcugguuaugccugugagccaaauuuguacaaauucuuaagcuuuacaaucaugcgugccucucuguacguauauuauacuuuaauuaaaaguuauuaaaguauuggggccgagcacaguggcucacgccuguaaucccaacacuuugggaggcugaggcuggugcaucaccugaggucaggaguuuaauaccagccuggccaauacaguaaaaccccgucucuacuaaaaauacaaaaaauuagccgggugugguggcacacaccuguaaucccagcuacuugggaggcugaggcaggagaauugcuugaacccgggaggcagagguugcaacgagccaaggucacgccauugcacuccagccucggcaacaagagcgagacuccaucucaaaaaaauaaauaaaaaauaaaaaauguaucagggaguacaagagaaagucauauaagcucuuucuacuuuucaugguuucuaugucugaacccaugaaucuuccuucugaaagguccaacuuucuucuuuaauaacaauaauaauggcaaaggcauugggggaccgugagcaaagggcaggccuuugcaggggugggaauggaaagggaagcacgucccuagaggugggccugggauggggguugggggaugaagcaaguggaccuugaaggucuccacaggucugaguguccuaugcucccugggccucucuucccccaggucuucucguucgcaacugcaccaucacugccaaugcugagugugccugucgcaauggcuggcagugcagggacaaggagugcaccgagugugauccucuuccaaacccuucgcugaccgcucggucgucucaggcccugagcccacacccucagcccacccacuuaccuuaugucagugguaaguuccaggcaacucucugugccaucacgugggguagcggugauaccccaaccaguacuccccacuccuaccccuagauaaggucagccuguuucugccuucccaucccauccagcaccucucaggccuucagaugugcccuaugggguccccugcugcuacucauucugucucuguuuuuccagagaugcuggaggccaggacagcugggcacaugcagacucuggcugacuucaggcagcugccugcccggacucucucuacccacuggccacgugaguuuucuccuuaauccccaccgcuagagagaaugcauacacgaggggccaggagggaagccagacagaaagcuccuaggauuagggauaagaggaggggaaaaagcagaguccacuguuuaggagaggaguuggccaacgguggcgggugggauagaauaaggugggggaaaggggagaggcaaggugacaggagggcugggcugagggagccaagggcuagacccuccccuaaccccuguguguccccuccuauuacagcccaaagaucccugugcagcuccgauuuuauucgcauccuugugaucuucucuggaauguuccuuguuuucacccuggccggggcccuguuccuccaucaacgaaggaaauauagaucaaguaagagacagaacacaggccuccgguccugccccugcaccacaccccacuggcucaaccccacugcccacgccuggaaucucacugaaacccaccagcuccacuucaccagccuugguccuaccccuucucuccccuuagcuggcgugcuccugacaccccucccccaagcgcacccgccucuacccaucuccuucucccgucucccccugcccccacugcuggccaagacucaucggaucuccuucugcagacaaaggagaaaguccuguggagccugcagagccuugucauuacagcugccccagggaggaggagggcagcaccauccccauccaggaggauuaccgaaaaccggagccugccugcucccccugagccagcaccugcgggagcugcacuacagcccuggccuccacccccaccccgccgaccauccaagggagagugagaccuggcagccacaacugcagucccauccucuugucagggcccuuuccuguguacacgugacagagugccuuuucgagacuggcagggacgaggacaaauauggaugagguggagagugggaagcaggagcccagccagcugcgccugcgcugcaggagggcgggggcucugguuguaaaacacacuuccugcugcgaaagacccacaugcuacaagacgggcaaaauaaagugacagaugaccacccugcagcucuccagcuuccucucugaaaucccagucccaaaauccaguuuccuggccgccuccuggcucaggucaggaucuggcagaggagguuucucagccgguuauguuggggccugcuuaagggcgggggugagaaagguccccaggcuacuguggauccugugucugacuucagauccccuuuucccacaguuauagcuccacuuuuuugggacagguggggagcaaaagggugcagaggucaggucuugaaaucaccaggggauuuccgggugagguggguggugagaaaggaaacagcaagcagggcucuggcagcugcugcagacggcuucacacagggacgcgggcugccaucuugcucuaagugaaagugaaagaaaagucggcagcagagggaacagggaagaaaccuaaaggcugcaggcugccaggugugcuuggagagcccccuucuuccgccgggccucgcaagcagcguaggacuguggagaagggcggugggcaaggagggaacucgagagcagccuccaugggcacacaggagggcuggugccugcugcucugccuggcucuaucuggagcagcagaaaccagugagucugggagucggggagagcuggcugggagaagagcuacugaagccccagggugccacccuccccgagauuccagaagagcaaaggggccggggaugaccccaucgccuucuaagcccaacaggggaaaggcucagcggcuggcaaaggaaggaaccaauaguguguguggagggaggguggggacuccacagggaaaaugcuaaagaggggcugccucuguggcuguggucaggagccacuguccuacagagagggcacuggccugggagcugacacuucagaagaggaaaggacuccccaggugaggaaaucacuuggaaggugaccuugaaggcgggggaggggaaggcuacccgaaaugggagaaagcagugcaggcugucagugccccagcaacaguaacuguccagucuccucucucugcgguggcacuugcuuguuuucugagaauuccuuugacugaaaagauagucuuuuauucaacaguuggaaaugcaagcauaaacuccucugagcaaggcaaauccaggacuuuaacucucaccaagaaguauuugccuggacuagcaggugcucuccagaaagcugguuuggggaugacgggagaauagagggacacagaaacagcuaggaucuuggauggcaacuuuuacccuuugaugacuccacagcuugagggcgggggcaggaagcaaguguggaguagcuuucuggggaaggcggugcucaccccagccuuugucugcagagccccacccagcagaggggcaguggcgggcaguggacgugguccuagacugcuuccuggcgaaggacggugcgcaccguggagcucucgccagcagugaggacagggcaagggccucccuugugcugaagcaggugccagugcuggacgauggcucccuggaggacuucaccgauuuccaagggggcacacuggcccaagaugacccaccuauuaucuuugaggccucagguaaaagccuuccaccuguguccuugguccucccgggcucccuccaccaggacagcccaggucccgauuacagccacacauacugccucccguuggcccugguguucucacgcuaauuugcccucugugugugcccugcuucuccccaguggaccugguccagauuccccaggccgaggccuugcuccaugcugacugcagugggaaggaggugaccugugagaucucccgcuacuuucuccagaugacagagaccacuguuaagacagcagcuugguucauggccaacaugcaggucucuggagggggaccuagcaucuccuuggugaugaagacucccagggucaccaagaaugaggcgcucuggcacccgacgcugaacuugccacugagcccccaggggacugugcgaacugcagguaagaaaaugaaaagcaaggccaggugugguggcucacgccuguaauuccagaauuuugggauaccgaggucgguggaucaccugaggucaggaguuugagaucagccuggucaacacggugaaaccccgucucuacuaauaccaaaauuagccgggcaugguggcgggugccuguaaucccagcuacgagggaggcugaggcaggagaaucgcuugaacccggaaggcagagguugcggugagccgagaucacaccauggcacuucagccugggcaacaagagcgaaacuccaucucaaaaaaaaaaaagaaaagaaaagaaaagcaagucacagaaaguuuugcuuuucuaaagugguaagauauggggcacagaagaagaaagggaacaaauccaccuccauccacacuggucaccucagggcaccccuaggccuugguccuuucuuccuaaaaaccccugagucaggccaggugcgaaggcccaugccuguaaucccagcacuuugggaggccaaggcagguggaucaccugaggucaggaguucaagaccagccuggccaacauggugaaacccccucucuacuaaaauacagaaauuagccgggcaugauggcaggugccuguaaucccagcuacucaggagacugagacgggagaaucacuugaaccugagagacggugguugcagugagccgagauugcgccacugcacuccagccugggcagcugagugagacaccgucucaaaaacaacaacaacaacaaaaacccugaguccacaagagaaugcuucgcagccccuaccugaacguccccaggcacacagacaaccuguguuauuuccaaaauggagaucguucucaucucacugggcugccaugaggaaauaagacacaugaugcuauucuguacaugggugcuguccacuguagucuuaucgagccaaaacccgguuuucucccagugaaaugcuaggcugcucuggugcuucagggguaaagcucagggaugcaucauuuguucaugaucuuauuaguaaacccaguacuugcccucuccagcucagcacauccucgagggcacaagaaauugagaacaugaugacaggguuccccagagcccauuaauccaauacucugugcccugcuucuuugagucuccaagaagaaacagccaaguccagagaaaauuaggggcaaccguccuauccuuggaaaaccccagaacacucuaaccucucugugguccaaccuaaaucuauccugacccauuagaaaaaggucuucaugucuguccagugucuaccauacuccuggcaugcguagguauuucucucuuuuuauuccaaaccuacaaaaaaaggugaaauaauaauauaaugaacaccuauauacccuacaccuagauccaccaguuguuaacaauuugccacauucucucucccccgacuccucauguguguauauguguacguguguauuuuccucugaacugagaguaaguugcagaagauaacacuugaaccccaaacgcauguuugaaccccgaaacgcauguuuaaaccccaaauacauccauagcauguauuaguuuacaaugaaggacaaggauguaauccuucauaguuacaaagccaucaugucagaaacaaaccaaaguggggaaguagucuacccguagcgcaggcaauaagggagugcagacuguaaaauauuucagaacaaaaauaaaaucagcuaaaagucagauggcuuuauagucucaccaucucccgacacuggcaauucugaauauuaucagugauaaaauacuccucucugcuagggcagacugucccuaucuccccacacgacugccuaguaugccacagaucuucauacuuuuagauauuuuuuaauugauaugauaauagucucaacuauaaaguccagggcaugguggugcacaccuguaguccagcuacucaggagacugaggcaggaggauugcuugagcccaggaguuugaguccugucugggcaacauagagagcgagacccucuuuuuuuuuuuuuuuuuuuaacagucucauucugucucccaggcuggagugcaguggcaugaucuuggcucacugcaaccucugccucccagguucaagugauucuugugccucagucucccaaguagcugggauuauagacgcccgccaccacaccagcuaauuuuuguauuuuuaguagagaugggguuucaccauauuggccaggcuggucuugaacuccugaccucaggugauccacccaucucggccucccaaaguguugggauuacaggcgugagccacugugcccaaccuaagacccuucucuuuaaaaaauaauuaaaugucuccaaauucaaauuucuccacuugucccaauauuuuuuuuuuuacugcuuuuucuaaguacacaauucaaacaagaaucaugcagugcauuuaguugugcuguuccuuguuuuaaucuagaacauguuucauagaauugacauuuuugaaggguccaggcuaguggucuuguagaguaucccaacauuuagauuugucugauuguuuuccucauuuccucaugacuggauuuagguuaagcauguuuggcacagauacuacuaucacaugcuuuuuuuuuuuuuuuucgauauggaguuuuacucuuauugcccaggcuggagugcaauggcucgaucuuggcucaccacaaccuccgccuccuggguucaagugauucuccaccugagccucccaaguagcugggauuacaggcaugcgccacgacacccagcuaauuuuuguauuuuuaguagagacgggguuucuccauguuggucaggcuggucucaaacucccaaccucaggugauccacccgccugggcuucccaauaccacguguguuuuuuuguuuuguuuuguuuuuuacauuuuuuuugagacggaguuucacucgucgcccagacuggagugcaauggcgcgaucuuggcucacugcaaccuccaccucccggauucaagcaauucuccugucucagccucccaaguagcuggaauuacaggcaccugccaccaugcccggcuaauuuuuguguuuuuaguagagacaggguuuuaccauguuggccaggcuggucucaaacuccugaccucaggugauccacccaccucggccccccaaagugcugggauuaccggcaugagccaccgcacccagccaccacguacuuuuuaaacuauuguuucuagucuucacagcauccuugcuuaagcaggugagcuugguaacaccaagugacuugucaaaggucacggagccaguaaguggaacaaccaggguuucagagcuuuuucugcuacucuaguaguucuuaccugaagauugaugguaacucuuaauuuugcauguguauuuuuccuggugggagauccauagcuuucacuaaauuauccuagaguaagugaucccaaaauggugauggccaucauguguaccaugcuaccuuuccagagccccauuucuuugugguuccaugugauggaaaauaagcucaaccggccugucaggcgaggaagaggcagguguaugcccacaacaugcccacagcuuggagaucaggugaccucaaggaggaaguagcccacaaaucaccccucuuuuccucuucacaguggaguuccaggugaugacacagacccaaucccugagcuuccugcugggguccucagccuccuuggacuguggcuucuccauggcaccgggcuuggaccucaucaguguggaguggcgacugcagcacaagggcaggggucaguugguguacagcuggaccgcagggcaggggcaggcugugcggaagggcgcuacccuggagccugcacaacugggcauggccagggaugccucccucacccugcccggccucacuauacaggacgaggggaccuacauuugccagaucaccaccucucuguaccgagcucagcagaucauccagcucaacauccaaggugaggccaggacaugguuaucccagggaaggggauauaacaugucuacugggagcguuuccagauugggacccaaaugcaagaaugauuuccugagaagcaggcuucaaucccacaacuuaaaugccaucuucaccauggaagcacagauggcaucagauaaggagucccguuggacuccaggauaauuccaccaagagauuuccagcccaggauccugcugcccugcuguggcuggcugucuccaucaccccaguccuuuuggaccacauccugaggagcagcagcagcaaaccaaggcagagcaguggaagcgguucugaccauuaucacugcuauccuuuaaaaucucuggcuuagaggccgggcgcgguggcucacaccuauaaucccagcacuuugggaggcggaucacgaggucaggaguucaagaccagccuggccaauacggugaaacuccgucucuacuaaaaauacaaaaaauagcuaggcaugguggugcgcgccuguagucccagcuacucaggaggcugaggcagaagaaucgcuugaaccccggagguggagguugcggugagccaagaucaugccacugcacuccagcuugggcgacagagcaagacaccaucuuaaaaaaaaaaaaaaaacuggcuuagaaugacaguaagaagccagccaaucuuuaguuggcuuuacuaucuguuuucuggaaaauguaacccugcccccuuacggccugcauccaggugggccccucacacacccccgccuugguacaccaccaagggacacuguagccuccacaaucuacucucaucuuggcaggaagaaaaggcuucaggcuccuccgcuguccccaguuagauccauguguaaucuuauuccucauucuuucuccagcuuccccuaaaguacgacugagcuuggcaaacgaagcucugcugcccacccucaucugcgacauugcuggcuauuacccucuggaugugguggugacguggacccgagaggagcuggguggauccccagcccaagucucuggugccuccuucuccagccucaggcaaagcguggcaggcaccuacagcaucuccuccucucucaccgcagaaccuggcucugcaggugccacuuacaccugccaggucacacacaucucucuggaggagccccuuggggccagcacccagguugucccaccagguacugggaguguccuccuuuuccccaccuccacacuagggcucauggcucuccugccccagcucaucuauggccuuguucugcugcccauccacuuuguucgcagcccuggcuucaugcuccugccucugcuccugacuauuuucccaaggcggcagcugccacagcuucuaccacacauccccugagacuucauuauacuccagccuccagggugucaggcaaugugcuuaaggcuggagaucacagaugaauaauuccugaucaugcccuccaggagcuuaguccaguaauagagacaagacuaaguagacagagaagauggcauuugagccaaguuaacuagcuuagagggaagggaacacucaagauagaaacaauagcauauaugaaagccaaaucauaaaacagccuaaagagaauuuggagaauugcaaguaauucagcacagcuagagcuuaggguauaugggaaaaagggaaaguggcucugaagcuucggagguaauucuauuuauugagcauuuacaugaaucaagcaguguagaaagcacuuaaauguaugauuucauggaucaugacucccauuuuacaggugaguaaacuggcacuugcagaugucaaugaauuugcccaaggucaccuaucaaucaaugguaaagagagaaugugaaaaacaggcaaccggauuccccuuacgggcuuaauuaaacccuguagaucucacugggccuucaagcuggaacuuccugagagccauagcaugcuguugaaagguuuuauuuauuuauuuauuuauuuauuuauuuauuuauuuauuuuauuuuauuuuacuuuuuuucgauacagaaucuugcucuguuccccaggcuggagugcagugguaugaucucagcucacugcaaccuccauauccuggguucaagccauccucuugccucagccucccaaguagcugggauuacaggcgcgcaccaccacgccuggcuaauuuugcguuuuuaguagagaugggguuucgccaugauggccaggcuggucucaaacuccugaccucaggugaucuguccgccucggcuucccaaagugcugggauuacagauaugagccaccgcacccugccugucgagagguuuuaagcaggaaagggacaggaaagaacccgcaacuugaaguggaaacauccaggagcacugggcauuauuugguugcucauuagacugugaacuuccccaaaacugagguuucacuucagcucacaucauuccccaacuauuuacaaaaucccaguuaacuggugguuuuuuguuuugcuuuguuuuauuuuguuuuguuuugagauagggucucacucugucgcccaggcuggagugcaguggcacgaucucagcucacugcaaacucugccucccaggcucaagugauucucccaccucagccucccaaguaccugggaccacaggcgcacaccaacaugcccaguuaauuuuuuguauuuuuuguacagacaggguuucaccauguugcccaggcuggucucgaacuccugaccucaggugauccaccuaccucagccucccaaaguucugggauuacaggcaugagccacuguguccaggcaaguuaagugcuaacaaauaaacccaccuaaaucucacuugcaaagcaauuuuuaaaaccuuguccuuaggugggaagagguagagaauucuguguggaguaacucacaaguauccagcaaccuugaauaagaacaaaugcugcugagugccuuguuccaggcuccucaaccagggacucacacacacaauccuuagcuccuccucccugggguggacacugcaggugagggcucagcucaugauuccugcgcacgaugauccccgcccacguugcucucaccuacagagcggagaacagccuugggagucaucuuugccagcagucucuuccuucuugcacugauguuccuggggcuucagagacggcaagguaagagccugggugcccuuggcucuggcccuggcccaccucacccacucuaaccacccccccgcccagaccaggguggaagcccagaugccccaagcuccagccacccacccaucacagccuccugcuuuugaguuugcccuaaaugaaaaugaaaccagucguguucccucguuuucuccuagcuaccucacuaaagucugucacucuccugccucagaguagaaagaaagaguagucacgugcucccagaaggacucuaagucaagucacagagcuaaaaauacaugaagguggcaccagcucauggggcacugggccuggcucugcagaggccucugccuuccuucacugugcacccugggcucaugcaccaaggcagagaacaggaagaagugaggggacaagaagaaggcagaauguccagauggaggauaagaccaaagagccagguugguggugugacgguaggaaaacaaagcuggaggaaauggagaaggaacaagugagggacaaugaggcauggguuggggcugggcuaccccucccaaacucagcucugucaaaauaaaaggcccuugugucugcugcgaccaagcuuuuccacuuuccugucuuucuccacacuggucccaacugagcccugucaccaagccuagcggcuccaacuugcaaaguguuuaaguaugaaacaaaggcccucagaggcacccccguggcuccaucucaguugcaccucagcugcaauuaggguucugcucccucgggugacugcugggagguucaggauaccugcaaaugccucacucccucagcugcaaggagagacuucuccuuuuuauucguuucuaaaaugugccuaaucaauacgguggaacucagcauaccaaaacuguacgugaggaugauggggaaaaggggguaaggggguguucacugacagccuuaucugggcacauccccugggacaggacaagcaggccaaggaccuaggaaggagcacaggaggcagauggaagaggccugagggaaccugugcuuguuugccagugugagaugcccacgcaacuuccugucuucacuuccucuuaccagcaccuacaggacuugggcugcuucaggcugaacgcugggagaccacuuccugugcugacacacagagcucccaucuccaugaagaccgcacagcgcguguaagccagcccagcugaccuaaagcgacaugagacuacuagaaagaaacgacacccuuccccaagcccccacagcuacuccaacccaaacaacaaccaagccaguuuaaugguaggaauuuguauuuuuugccuuuguucagaauacaugacauugguaaauaugccacaugccuuugguggaaguacaacuguuguuauuacucuauacaaguaugagaucaggguuaggaaaaaaagacaaagaggugaugacagacacacaguggaaaccccacaucgucucauggcaaaccgaagaacgggaugugggaagcucagcuucauuugacugcaaagucccaggguuuuguugcacauuugcucaugcacauggguggugggaggaaagggggauagcagagacacacagaagaggguacagggugggugagaaagaaaguagaagggcuaauacccccaaagaacaaggccaacuacaccuggugagccucagagggacagaaacccaggaaugauuccugugauagggcugggagagccaagaggacggauucgcuccaggcuugggacacaucgaggacaguggugguucuucuccagcggugacccccugcauuaggcaaggaggagcccagaggagaguggagaccuucgaggggggccguugggaggguacugacugcuuucuuccagcucuucagucccgcccuugggcaggacgaagggaaugugggaaacaagggcgaaaggaaaggaaggaugguuuugagcaaugaaaugcugcugcauggaaagugggcauccagacccugcccagcauggccucagccucuuccuguucguggaccgagggaagaaggaauaaagggccaugggcauucuccgcucuguucccagccugcccuccuccccuugcaccugggcuuaucccacauuaauagcccauccugaagcucagcaauugccccgaagauaggcugagcagaucccauccucagguuccacugucuauacacacaaaccaugcaaagaggaggaagagaaaggaggcaaaguagaauucagacaggaaagggugguucaaaggggaauauacuacaggaagaacagagaggcggcucucaaggagagggccccaugacagcacagcaauacacaagcacaccugacacaggcuggcacgccuccccccaagguggggcuggugggucuacaugacuucucugcauccugaggaucggccgggccccaggaagaaccacuugccucaucccugucuuuggcaagugcacgggugguguggaggaaaggauuccauggguguccaaagaucucacacugcuaacacccucacgcuccuucaucaacaggaagagaggaacaggacccucuuuaacgagggcaaggaguggcuuccucugagcuuguuacuuucaaauuaagcacuugacucacuguuucucuauaacuaacaggcaaucucucucuuuaugccaacaauuaacugggagcuagguuaaauuauuuggcuagauaaaacuaccagcuagauggauuuauuuggugcccucauacagaaugcuguagaaaauguaaagaagagaaagcuccuuccagcuagaagcacaugggacugcuucuaggauggaaacaaguccugcuauuuucacaaucccuaaguguucuccaggccucuggagaacaaaguaaaguuguaagauccccaaagacacggaaaauccuggacgaacagauuagaaauaacuacaaaaaacaaguuuuuacuuucgaaaaggguacugcacugaaaccaaguuggacuuugguccacccccaggacccucuucaggccugguccaggaaggaaagcuccacaugaccaggcaguacugagugagcugccaucuucccagccccucccuagcuccuaccaguggccagguuuucuagaagucaccaugggcaccgauacucuucuccucccaagucugggcagcuucauggguacuucgccucagccacuccccucccugccccuucccuuggccuccaacucuuuggggcuuugggggaacuugagaguacagaaaaagcaggcagggaggaggcgccagcuguugcucuucggguaaugacuuagauugugccacgagcagcauuucuaguguugagggacagagugcaaaugaacgcaacgaaaaaggaggaaugggugauggagaagccugggcuggaauggaggacgguggguggggaaguguguugagagagcaaacagagggcagaggacaugaauguggauggcaauggacaacagggaaggggugguacauucucaaguaaaaaaguagacuggacacaggaaucaggaagucccagacggaaaagagaaagagacaggagaaaacaagagggugaauuacaccaaguuaccagacauucaggucucuccauuguuaagugccccauccccauggucucccuccaacccaagccagugacacacagcauagccccacuuccucagaacaggaggcgccaucucccugcaaugcguugcagggggaaggcuuguccaucaaagaaaucccuugucucugcccuucccccgucccgaaccaggugacgaucccauagcagcggucuccauaccucagucagagcagccccacuccccaggcaggcaggcaggcagggagaagacuccaggaccuucccaccucuucaccccaccagcaacuucagcgauacuuacuuacaauaacuaccacgaugauggcacagauggcucccagcaugaucaucaucugaggaaacauggacaaaaaaugagcccuuggauuucaggaaugaggaaaagagccacaucucuagugggaaacagaauuccuuccauccuugggacaauggaaaaaaccacccaucacccaggagaccugcaggccucuuagagaggcccuacccuucugcuucccaggggaucauaaccacaguaugucuguagcuuuucagauucaucacaggaccugcauugagcuccuuuuugcuuaguuccuggugucuuggggcuuuagaaggcauuccaauagagauacagacucuggauauuuaaccaauuaguucaauuuucacugugaaguguucagcucauucucaaaaguugcaguuauuuaaaaauauauauuucaaucugagaaagcugauuuaaaagaaaaagaaaaaaguauauauauauauaaauguauauauauguauauauauauauaaauguauauauauguauauauauauauaaauguauauauauguauauauacauauguguauauauaguguguguguguguguguguguguguauguauauaugccugagccauugugcugauguugggugugucugaggaugagacaggugaaauuuuuugcaggcaacuccuuugggguaaagcuccuuaacuaaccauuccaaacuccucaggguaucacuuuuucccugauagcgguucuaaauacucuagccuacccugguggccaauucuggguaaugcaaucucaagaggaggcuuuccagauuuccucccaagcguuaugcuggucagagagauccugcaccauuagagggaagaaauguagaagcugaggguuuucuugccuucuaccaguggaagcccaggaaaagauggaggaggggacaagaaaauucaccuugcaguuuuuccaccaauacuuccucuuuagcuuggcagcacugcucucaaauugugaugcuccugccugcaaggcaucagcucggucauccagcucugacagcuucuggucccucuccaggaccuuguccacguucacacguaugauguccaccaccugaggagggcacagaaacaaagcagcuaagcuuccugccagagacagaggaaaggacaacaaccagagaaucacaagucuggcccugugcaacucuaaagggugcuuugccucucagggccuuugacuauucuccuacgaaaaaaggagaaaagauaagaaguucccuuuuguuuccaaacuccuagauuuggaaacuuucagagaaacagcuaucuaccuaccuccuccacuugugccuggguuugcuguagucgucuguuacuggucauguuaggaggagggccagggggacccccaccuggggcagucccuucugucccuucagcagguggcugagcuggagcagaccuguggaaagacaugugcagaguacacaaagugaccaagacaagaaaggagcugggcgugguagcacacaccuguagucccagcuacucaagaggcugaagugggaggagcgcuugagcccaggaguucgaggccagccugggcaucauagcgagaccccaucucuaaaaaaacagacaaaaagaaaggacucacaugcauccucaccccaaaccacuuaaacaauuaugauuaggcuauacaaaacuagaauggauucuugcuccuuggcaaucugaaguagggagacaaaccauagaggcaagaaguaaaagaugaaagacucugcaacaacauuuggaugggguucagggacauccaggauggcaucaagacaucucaucuggggcuauccuuugacucaacucaaacaaguccucugccaugauggcuacagggacauauggccuagccuuguccuaaauggcauuuccccgcugauaugguuuggcuguguccccacccaaaucucaacuucaauuguaucacccagaauucccacauguugugggagggacucaggggagguaacugaaucauggggcccaucuuuccggugcuauucuggugauagugacgaagucucaugagaucugauggguuuaucagugguuucugcuuuugcuucuuccacauuuucucuugcugcugccauguaagaagugccuuucaccugccgccaugauucugaggccuucccagccauguggaacuguaaguccaauuaaaccucuuuuucuucccagucuuggguaugucuuuaucagcagcaugaaaacagacuaauacaguaaauugguaccaguagagugggguguugcugaaaagauacccaaaaauguggaagcgacuuuggaacuggguuaacagggagaggauggaacaguuuggagggcucagaagaagacaggaaaaugcgggaaaguuuggaaccuccuagagacuuguugaauggcuuugacaaaaaugcuguuagugauaugaacaauaagguccaggcugagguggucucagauggagaugaggaacuuguugggaacugaagcaaaggugacucuuguuauguuuuggcaaaaagacuggcagcauuuugccccugcccuagaaauuuguggaacuuugaacuugagagagauaauuuaggguaucuggcagaagaaaagacgcaguacuaaagaaaaaaaccauuuuuuugagaagaaauucaaggcagcugcagaaauuugcauaaguagcaaggaaccuaguguuagccccuaagaccauggggaaaaugucuccaggccaugucagaagccuucauagcagccccucccaucacaggccuggaggcccaggaggaaaaaguuauuuugugggccaggcccaggguccccaugcugugugcagccuagggacuuagugcccugugucccagccgcucccacuguggcugagaggggccaaugcagggcucgggccguggcuucagaggguggaagccccaagccuuggcagcuuccacaugguguugagccugcagaugcacagaaggcaagaacugagguucgggaaccuccgucuagacuucagaagauguauggaaacgccuggauguccaggcaaaaguuugcugcaagggcagggcccucauggagaaccucugcuaguguaguacagaagggacaugugggguuggagcccccacacagaguccccacuggaacacugccuaguggagcuaugagaaaaaggucaccauucuccagaccccagaaugguagauccacugguagcuugcaccgugcgccuggaaaagccacagacacucaaugccaguccgugaagggagccaggagggaggcuguacacuguaaugucugucagcucaccccuuuuuauauucaaguuauugguuaugguuauugguuuauaugcccaguuauugguuaugcuucacacaagaugaggaaaucagggcugccauaagggcagcuuggaaaaucaccaaaggcaaagucuauguagguggagugagucaggacuguuuguuugcuuuguuuuuggcagagaaaauggggguuucacuuagauagaaucuggggcccaaagcaauuacauuaguuauggaaacuguuccaagagcauagacaggaagcaaaaaugcuagaaauuguccucaaugugcaugcauuauagacauucugucccuuccuuuucuggauuugacagucucagaugacucccuugguuacuuacaucccaaagagagaucuugguuuacuguacuauacacacagagaauguucucucauucuguaccacucaaaguuaguguguggucuucaagacaaacuccucuccaugucccaaaacauggaggcuaaacucaccuccuaaagaauucccagaaguauaaccuaagucaugagauguucucggccaaggaagcacccacaggcaggggggagaucucucaaauuugauggagaauagaaauuacaguaagaacuccucaaacagaagcagaaucucaccaaacauacuucacaggagcaguccaagaguaaaugcaacaaaaaugaaaccacaaagucaccuaaaaggaaauuauuugacuaauuacaauagaacuaauacccagaagcucauucuccuugauuaagugaauuucuuuuagucuaaaaagauagagaauaacuccucagagaggcuaugguagcagauuacaccugacucauuccccauuugaagaaucacuuuuccauuucccucuaaggugcaaaggagguaaagcaaagauagacacaaagucaugggagccacaagacucuuguccugccacugagcuagcuaagcaaucuagcucucgacuuaaggcagaaaauucaaugaguagguagcagccaguguuggaagcaguccaggaugguagcaccaaugacaagauuaaggucagagaccucgugaugccccgcuagccaccacgauuuuucuguugccuucuguucaucccacguagauacuaucuggaagcccccuccccaaaaugaaaacaacuggaauucuacggcuugcccaaaaugcauagaacacucauaucugguuaaaaccauagaaaucaaaaagaaaaagugaaauggcuaugaaguauuugcaaggccaauuucacuuacuacuuguugggaguuggaaacacucaacaguaaaauaucuagggauaauuacaacccuuauguaacacaaguaaaucuuucccuuuuuugucacuuagagaagcaacauaaauacaucuaggaccaggccaggguaguaaucagaaagaaaaaucuguauuagacauauugaggucuugacagagaaguacuucguuuguuuagccguaguuuucccucaagaucaugcgaagggggugauguugaagacugcuggagacuaaacuguguguguuggaggaaagggggaaagcucagcucucccuauuucuccuccaacuauuugguaagacucggugauagaaaaacaucuccuauacgaauggccuugguaugaacagccgcuugggaugacaggccacuaucccacuaccccuugagucuuucugagcugcucaccuggugccagagaacuggcagauaaguuucugcagcuuugcucacugccaugaggggggcuagacaucacacuuugggugagggguaaacaaauccagagauuguagggcaacauaaguuaccaacuggcaguugcacccaugacugucuuuccugaggcgcugaguagugauuuagccagaugacagaaauaccuuucgaguccccugcccaguugucuccauccaccacccccagcccccgcccucuccgagucuccacuauaccaaaaccagaaugaggcgccacucagacgagaggagagggugcaaugauugugggaccccugcgccccugccccgcccguggggugcuagcuguggcuggugcgagaauggggugcuggccccccucccuggggguggcccgguccggaagcggcgcgcggugguaguuccccgcguugcugcagcugcugcauugcgccauuuuccgucccgcagaaucgggagcuuggggcgagaguugucaaggaggugccgagcccccacaccagagucaacucacauuuuucugacagagagagugagggucuguuccucuccggaggcugcggcgagacacccggugagggacgcugcggcugaaguggacggaacugccaagcuccgccucgcgccgacuaccccgcggucuagcugcgcuggaacuuacugcagcugccgcgccggccuccgccuuuauuagugcugaccacgccucccggauaacggugacaaccccgcggcccaauccaugcccaggacggucgcccagcgcuacaggccuagcccgccccgccccugccaauugccagucacaacucuccucucauccgacuccggaaaggagcgguugcugugaggauccuucagugaucaaugcgaccauaguuugcgcuccagucuggcggagggacggggcgggguggagaugaggucu

SEQ ID NO: 14902 - RNA, 9966 nt, Homo sapiens
auccucacguacaguuuugguaugcugaguuccaccguauugauuaggcacauuuuagaaacgaauaaaaaggagaagucucuccuugcagcugagggagugaggcauuugcagguauccugaaccucccagcagucacccgagggagcagaacccuaauugcagcugaggugcaacugagauggagccacgggggugccucugagggccuuuguuucauacuuaaacacuuugcaaguuggagccgcuaggcuuggugacagggcucaguugggaccaguguggagaaagacaggaaaguggaaaagcuuggucgcagcagacacaagggccuuuuauuuugacagagcugaguuugggagggguagcccagccccaacccaugccucauugucccucacuuguuccuucuccauuuccuccagcuuuguuuuccuaccgucacaccaccaaccuggcucuuuggucuuauccuccaucuggacauucugccuucuucuuguccccucacuucuuccuguucucugccuuggugcaugagcccagggugcacagugaaggaaggcagaggccucugcagagccaggcccagugccccaugagcuggugccaccuucauguauuuuuagcucugugacuugacuuagaguccuucugggagcacgugacuacucuuucuuucuacucugaggcaggagagugacagacuuuagugagguagcuaggagaaaacgagggaacacgacugguuucauuuucauuuagggcaaacucaaaagcaggaggcugugauggguggguggcuggagcuuggggcaucugggcuuccacccuggucugggcgggggggugguuagagugggugaggugggccagggccagagccaagggcacccaggcucuuaccuugccgucucugaagccccaggaacaucagugcaagaaggaagagacugcuggcaaagaugacucccaaggcuguucuccgcucuguaggugagagcaacgugggcggggaucaucgugcgcaggaaucaugagcugagcccucaccugcaguguccaccccagggaggaggagcuaaggauugugugugugagucccugguugaggagccuggaacaaggcacucagcagcauuuguucuuauucaagguugcuggauacuugugaguuacuccacacagaauucucuaccucuucccaccuaaggacaagguuuuaaaaauugcuuugcaagugagauuuagguggguuuauuuguuagcacuuaacuugccuggacacaguggcucaugccuguaaucccagaacuuugggaggcugagguagguggaucaccugaggucaggaguucgagaccagccugggcaacauggugaaacccugucuguacaaaaaauacaaaaaauuaacugggcauguuggugugcgccuguggucccagguacuugggaggcugaggugggagaaucacuugagccugggaggcagaguuugcagugagcugagaucgugccacugcacuccagccugggcgacagagugagacccuaucucaaaacaaaacaaaauaaaacaaagcaaaacaaaaaaccaccaguuaacugggauuuuguaaauaguuggggaaugaugugagcugaagugaaaccucaguuuuggggaaguucacagucuaaugagcaaccaaauaaugcccagugcuccuggauguuuccacuucaaguugcggguucuuuccugucccuuuccugcuuaaaaccucucgacaggcagggugcgguggcucauaucuguaaucccagcacuuugggaagccgaggcggacagaucaccugaggucaggaguuugagaccagccuggccaucauggcgaaaccccaucucuacuaaaaacgcaaaauuagccaggcgugguggugcgcgccuguaaucccagcuacuugggaggcugaggcaagaggauggcuugaacccaggauauggagguugcagugagcugagaucauaccacugcacuccagccuggggaacagagcaagauucuguaucgaaaaaaaguaaaauaaaauaaaauaaauaaauaaauaaauaaauaaauaaauaaauaaauaaaaccuuucaacagcaugcuauggcucucaggaaguuccagcuugaaggcccagugagaucuacaggguuuaauuaagcccguaaggggaauccgguugccuguuuuucacauucucucuuuaccauugauugauaggugaccuugggcaaauucauugacaucugcaagugccaguuuacucaccuguaaaaugggagucaugauccaugaaaucauacauuuaagugcuuucuacacugcuugauucauguaaaugcucaauaaauagaauuaccuccgaagcuucagagccacuuucccuuuuucccauauacccuaagcucuagcugugcugaauuacuugcaauucuccaaauucucuuuaggcuguuuuaugauuuggcuuucauauaugcuauuguuucuaucuugaguguucccuucccucuaagcuaguuaacuuggcucaaaugccaucuucucugucuacuuagucuugucucuauuacuggacuaagcuccuggagggcaugaucaggaauuauucaucugugaucuccagccuuaagcacauugccugacacccuggaggcuggaguauaaugaagucucaggggaugugugguagaagcuguggcagcugccgccuugggaaaauagucaggagcagaggcaggagcaugaagccagggcugcgaacaaaguggaugggcagcagaacaaggccauagaugagcuggggcaggagagccaugagcccuaguguggagguggggaaaaggaggacacucccaguaccuggugggacaaccugggugcuggccccaaggggcuccuccagagagaugugugugaccuggcagguguaaguggcaccugcagagccagguucugcggugagagaggaggagaugcuguaggugccugccacgcuuugccugaggcuggagaaggaggcaccagagacuugggcuggggauccacccagcuccucucggguccacgucaccaccacauccagaggguaauagccagcaaugucgcagaugagggugggcagcagagcuucguuugccaagcucagucguacuuuaggggaagcuggagaaagaaugaggaauaagauuacacauggaucuaacuggggacagcggaggagccugaagccuuuucuuccugccaagaugagaguagauuguggaggcuacagugucccuuggugguguaccaaggcgggggugugugaggggcccaccuggaugcaggccguaagggggcaggguuacauuuuccagaaaacagauaguaaagccaacuaaagauuggcuggcuucuuacugucauucuaagccaguuuuuuuuuuuuuuuuaagauggugucuugcucugucgcccaagcuggagugcaguggcaugaucuuggcucaccgcaaccuccaccuccgggguucaagcgauucuucugccucagccuccugaguagcugggacuacaggcgcgcaccaccaugccuagcuauuuuuuguauuuuuaguagagacggaguuucaccguauuggccaggcuggucuugaacuccugaccucgugauccgccucccaaagugcugggauuauaggugugagccaccgcgcccggccucuaagccagagauuuuaaaggauagcagugauaauggucagaaccgcuuccacugcucugccuugguuugcugcugcugcuccucaggaugugguccaaaaggacuggggugauggagacagccagccacagcagggcagcaggauccugggcuggaaaucucuugguggaauuauccuggaguccaacgggacuccuuaucugaugccaucugugcuuccauggugaagauggcauuuaaguugugggauugaagccugcuucucaggaaaucauucuugcauuugggucccaaucuggaaacgcucccaguagacauguuauauccccuucccugggauaaccauguccuggccucaccuuggauguugagcuggaugaucugcugagcucgguacagagagguggugaucuggcaaauguagguccccucguccuguauagugaggccgggcagggugagggaggcaucccuggccaugcccaguugugcaggcuccaggguagcgcccuuccgcacagccugccccugcccugcgguccagcuguacaccaacugaccccugcccuugugcugcagucgccacuccacacugaugagguccaagcccggugccauggagaagccacaguccaaggaggcugaggaccccagcaggaagcucagggauugggucugugucaucaccuggaacuccacugugaagaggaaaagaggggugauuugugggcuacuuccuccuugaggucaccugaucuccaagcugugggcauguugugggcauacaccugccucuuccucgccugacaggccgguugagcuuauuuuccaucacauggaaccacaaagaaauggggcucuggaaagguagcaugguacacaugauggccaucaccauuuugggaucacuuacucuaggauaauuuagugaaagcuauggaucucccaccaggaaaaauacacaugcaaaauuaagaguuaccaucaaucuucagguaagaacuacuagaguagcagaaaaagcucugaaacccugguuguuccacuuacuggcuccgugaccuuugacaagucacuugguguuaccaagcucaccugcuuaagcaaggaugcugugaagacuagaaacaauaguuuaaaaaguacgugguggcugggugcgguggcucaugccgguaaucccagcacuuuggggggccgagguggguggaucaccugaggucaggaguuugagaccagccuggccaacaugguaaaacccugucucuacuaaaaacacaaaaauuagccgggcaugguggcaggugccuguaauuccagcuacuugggaggcugagacaggagaauugcuugaauccgggagguggagguugcagugagccaagaucgcgccauugcacuccagucugggcgacgagugaaacuccgucucaaaaaaaauguaaaaaacaaaacaaaacaaaaaaacacacgugguauugggaagcccaggcggguggaucaccugagguugggaguuugagaccagccugaccaacauggagaaaccccgucucuacuaaaaauacaaaaauuagcugggugucguggcgcaugccuguaaucccagcuacuugggaggcucagguggagaaucacuugaacccaggaggcggagguuguggugagccaagaucgagccauugcacuccagccugggcaauaagaguaaaacuccauaucgaaaaaaaaaaaaaaaagcaugugauaguaguaucugugccaaacaugcuuaaccuaaauccagucaugaggaaaugaggaaaacaaucagacaaaucuaaauguugggauacucuacaagaccacuagccuggacccuucaaaaaugucaauucuaugaaacauguucuagauuaaaacaaggaacagcacaacuaaaugcacugcaugauucuuguuugaauuguguacuuagaaaaagcaguaaaaaaaaaaauauugggacaaguggagaaauuugaauuuggagacauuuaauuauuuuuuaaagagaagggucuuagguugggcacaguggcucacgccuguaaucccaacacuuugggaggccgagauggguggaucaccugaggucaggaguucaagaccagccuggccaauauggugaaaccccaucucuacuaaaaauacaaaaauuagcuggugugguggcgggcgucuauaaucccagcuacuugggagacugaggcacaagaaucacuugaaccugggaggcagagguugcagugagccaagaucaugccacugcacuccagccugggagacagaaugagacuguuaaaaaaaaaaaaaaaaaaagagggucucgcucucuauguugcccagacaggacucaaacuccugggcucaagcaauccuccugccucagucuccugaguagcuggacuacaggugugcaccaccaugcccuggacuuuauaguugagacuauuaucauaucaauuaaaaaauaucuaaaaguaugaagaucuguggcauacuaggcagucguguggggagauagggacagucugcccuagcagagaggaguauuuuaucacugauaauauucagaauugccagugucgggagauggugagacuauaaagccaucugacuuuuagcugauuuuauuuuuguucugaaauauuuuacagucugcacucccuuauugccugcgcuacggguagacuacuuccccacuuugguuuguuucugacaugauggcuuuguaacuaugaaggauuacauccuuguccuucauuguaaacuaauacaugcuauggauguauuugggguuuaaacaugcguuucgggguucaaacaugcguuugggguucaaguguuaucuucugcaacuuacucucaguucagaggaaaauacacacguacacauauacacacaugaggagucgggggagagagaauguggcaaauuguuaacaacugguggaucuagguguaggguauauagguguucauuauauuauuauuucaccuuuuuuuguagguuuggaauaaaaagagagaaauaccuacgcaugccaggaguaugguagacacuggacagacaugaagaccuuuuucuaaugggucaggauagauuuagguuggaccacagagagguuagaguguucugggguuuuccaaggauaggacgguugccccuaauuuucucuggacuuggcuguuucuucuuggagacucaaagaagcagggcacagaguauuggauuaaugggcucuggggaacccugucaucauguucucaauuucuugugcccucgaggaugugcugagcuggagagggcaaguacuggguuuacuaauaagaucaugaacaaaugaugcaucccugagcuuuaccccugaagcaccagagcagccuagcauuucacugggagaaaaccggguuuuggcucgauaagacuacaguggacagcacccauguacagaauagcaucaugugucuuauuuccucauggcagcccagugagaugagaacgaucuccauuuuggaaauaacacagguugucugugugccuggggacguucagguaggggcugcgaagcauucucuuguggacucaggguuuuuguuguuguuguuguuuuugagacggugucucacucagcugcccaggcuggagugcaguggcgcaaucucggcucacugcaaccaccgucucucagguucaagugauucucccgucucagucuccugaguagcugggauuacaggcaccugccaucaugcccggcuaauuucuguauuuuaguagagaggggguuucaccauguuggccaggcuggucuugaacuccugaccucaggugauccaccugccuuggccucccaaagugcugggauuacaggcaugggccuucgcaccuggccugacucagggguuuuuaggaagaaaggaccaaggccuaggggugcccugaggugaccaguguggauggagguggauuuguucccuuucuucuucugugccccauaucuuaccacuuuagaaaagcaaaacuuucugugacuugcuuuucuuuucuuuucuuuuuuuuuuuugagauggaguuucgcucuuguugcccaggcugaagugccauggugugaucucggcucaccgcaaccucugccuuccggguucaagcgauucuccugccucagccucccucguagcugggauuacaggcacccgccaccaugcccggcuaauuuugguauuaguagagacgggguuucaccguguugaccaggcugaucucaaacuccugaccucaggugauccaccgaccucgguaucccaaaauucuggaauuacaggcgugagccaccacaccuggccuugcuuuucauuuucuuaccugcaguucgcacaguccccugggggcucaguggcaaguucagcgucgggugccagagcgccucauucuuggugacccugggagucuucaucaccaaggagaugcuaggucccccuccagagaccugcauguuggccaugaaccaagcugcugucuuaacaguggucucugucaucuggagaaaguagcgggagaucucacaggucaccuccuucccacugcagucagcauggagcaaggccucggccuggggaaucuggaccagguccacuggggagaagcagggcacacacagagggcaaauuagcgugagaacaccagggccaacgggaggcaguauguguggcuguaaucgggaccugggcuguccugguggagggagcccgggaggaccaaggacacagguggaaggcuuuuaccugaggccucaaagauaauaggugggucaucuugggccagugugcccccuuggaaaucggugaaguccuccagggagccaucguccagcacuggcaccugcuucagcacaagggaggcccuugcccuguccucacugcuggcgagagcuccacggugcgcaccguccuucgccaggaagcagucuaggaccacguccacugcccgccacugccccucugcuggguggggcucugcagacaaaggcuggggugagcaccgccuuccccagaaagcuacuccacacuugcuuccugcccccgcccucaagcuguggagucaucaaaggguaaaaguugccauccaagauccuagcuguuucugugucccucuauucucccgucauccccaaaccagcuuucuggagagcaccugcuaguccaggcaaauacuucuuggugagaguuaaaguccuggauuugccuugcucagaggaguuuaugcuugcauuuccaacuguugaauaaaagacuaucuuuucagucaaaggaauucucagaaaacaagcaagugccaccgcagagagaggagacuggacaguuacuguugcuggggcacugacagccugcacugcuuucucccauuucggguagccuuccccucccccgccuucaaggucaccuuccaagugauuuccucaccuggggaguccuuuccucuucugaagugucagcucccaggccagugcccucucuguaggacaguggcuccugaccacagccacagaggcagccccucuuuagcauuuucccuguggaguccccacccucccuccacacacacuauugguuccuuccuuugccagccgcugagccuuuccccuguugggcuuagaaggcgauggggucauccccggccccuuugcucuucuggaaucucggggaggguggcacccuggggcuucaguagcucuucucccagccagcucuccccgacucccagacucacugguuucugcugcuccagauagagccaggcagagcagcaggcaccagcccuccugugugcccauggaggcugcucucgaguucccuccuugcccaccgcccuucuccacaguccuacgcugcuugcgaggcccggcggaagaagggggcucuccaagcacaccuggcagccugcagccuuuagguuucuucccuguucccucugcugccgacuuuucuuucacuuucacuuagagcaagauggcagcccgcgucccugugugaagccgucugcagcagcugccagagcccugcuugcuguuuccuuucucaccacccaccucacccggaaauccccuggugauuucaagaccugaccucugcacccuuuugcuccccaccugucccaaaaaaguggagcuauaacugugggaaaaggggaucugaagucagaca

SEQ ID NO: 14903 - RNA, 9966 nt, Homo sapiens
ugucugacuucagauccccuuuucccacaguuauagcuccacuuuuuugggacagguggggagcaaaagggugcagaggucaggucuugaaaucaccaggggauuuccgggugagguggguggugagaaaggaaacagcaagcagggcucuggcagcugcugcagacggcuucacacagggacgcgggcugccaucuugcucuaagugaaagugaaagaaaagucggcagcagagggaacagggaagaaaccuaaaggcugcaggcugccaggugugcuuggagagcccccuucuuccgccgggccucgcaagcagcguaggacuguggagaagggcggugggcaaggagggaacucgagagcagccuccaugggcacacaggagggcuggugccugcugcucugccuggcucuaucuggagcagcagaaaccagugagucugggagucggggagagcuggcugggagaagagcuacugaagccccagggugccacccuccccgagauuccagaagagcaaaggggccggggaugaccccaucgccuucuaagcccaacaggggaaaggcucagcggcuggcaaaggaaggaaccaauaguguguguggagggaggguggggacuccacagggaaaaugcuaaagaggggcugccucuguggcuguggucaggagccacuguccuacagagagggcacuggccugggagcugacacuucagaagaggaaaggacuccccaggugaggaaaucacuuggaaggugaccuugaaggcgggggaggggaaggcuacccgaaaugggagaaagcagugcaggcugucagugccccagcaacaguaacuguccagucuccucucucugcgguggcacuugcuuguuuucugagaauuccuuugacugaaaagauagucuuuuauucaacaguuggaaaugcaagcauaaacuccucugagcaaggcaaauccaggacuuuaacucucaccaagaaguauuugccuggacuagcaggugcucuccagaaagcugguuuggggaugacgggagaauagagggacacagaaacagcuaggaucuuggauggcaacuuuuacccuuugaugacuccacagcuugagggcgggggcaggaagcaaguguggaguagcuuucuggggaaggcggugcucaccccagccuuugucugcagagccccacccagcagaggggcaguggcgggcaguggacgugguccuagacugcuuccuggcgaaggacggugcgcaccguggagcucucgccagcagugaggacagggcaagggccucccuugugcugaagcaggugccagugcuggacgauggcucccuggaggacuucaccgauuuccaagggggcacacuggcccaagaugacccaccuauuaucuuugaggccucagguaaaagccuuccaccuguguccuugguccucccgggcucccuccaccaggacagcccaggucccgauuacagccacacauacugccucccguuggcccugguguucucacgcuaauuugcccucugugugugcccugcuucuccccaguggaccugguccagauuccccaggccgaggccuugcuccaugcugacugcagugggaaggaggugaccugugagaucucccgcuacuuucuccagaugacagagaccacuguuaagacagcagcuugguucauggccaacaugcaggucucuggagggggaccuagcaucuccuuggugaugaagacucccagggucaccaagaaugaggcgcucuggcacccgacgcugaacuugccacugagcccccaggggacugugcgaacugcagguaagaaaaugaaaagcaaggccaggugugguggcucacgccuguaauuccagaauuuugggauaccgaggucgguggaucaccugaggucaggaguuugagaucagccuggucaacacggugaaaccccgucucuacuaauaccaaaauuagccgggcaugguggcgggugccuguaaucccagcuacgagggaggcugaggcaggagaaucgcuugaacccggaaggcagagguugcggugagccgagaucacaccauggcacuucagccugggcaacaagagcgaaacuccaucucaaaaaaaaaaaagaaaagaaaagaaaagcaagucacagaaaguuuugcuuuucuaaagugguaagauauggggcacagaagaagaaagggaacaaauccaccuccauccacacuggucaccucagggcaccccuaggccuugguccuuucuuccuaaaaaccccugagucaggccaggugcgaaggcccaugccuguaaucccagcacuuugggaggccaaggcagguggaucaccugaggucaggaguucaagaccagccuggccaacauggugaaacccccucucuacuaaaauacagaaauuagccgggcaugauggcaggugccuguaaucccagcuacucaggagacugagacgggagaaucacuugaaccugagagacggugguugcagugagccgagauugcgccacugcacuccagccugggcagcugagugagacaccgucucaaaaacaacaacaacaacaaaaacccugaguccacaagagaaugcuucgcagccccuaccugaacguccccaggcacacagacaaccuguguuauuuccaaaauggagaucguucucaucucacugggcugccaugaggaaauaagacacaugaugcuauucuguacaugggugcuguccacuguagucuuaucgagccaaaacccgguuuucucccagugaaaugcuaggcugcucuggugcuucagggguaaagcucagggaugcaucauuuguucaugaucuuauuaguaaacccaguacuugcccucuccagcucagcacauccucgagggcacaagaaauugagaacaugaugacaggguuccccagagcccauuaauccaauacucugugcccugcuucuuugagucuccaagaagaaacagccaaguccagagaaaauuaggggcaaccguccuauccuuggaaaaccccagaacacucuaaccucucugugguccaaccuaaaucuauccugacccauuagaaaaaggucuucaugucuguccagugucuaccauacuccuggcaugcguagguauuucucucuuuuuauuccaaaccuacaaaaaaaggugaaauaauaauauaaugaacaccuauauacccuacaccuagauccaccaguuguuaacaauuugccacauucucucucccccgacuccucauguguguauauguguacguguguauuuuccucugaacugagaguaaguugcagaagauaacacuugaaccccaaacgcauguuugaaccccgaaacgcauguuuaaaccccaaauacauccauagcauguauuaguuuacaaugaaggacaaggauguaauccuucauaguuacaaagccaucaugucagaaacaaaccaaaguggggaaguagucuacccguagcgcaggcaauaagggagugcagacuguaaaauauuucagaacaaaaauaaaaucagcuaaaagucagauggcuuuauagucucaccaucucccgacacuggcaauucugaauauuaucagugauaaaauacuccucucugcuagggcagacugucccuaucuccccacacgacugccuaguaugccacagaucuucauacuuuuagauauuuuuuaauugauaugauaauagucucaacuauaaaguccagggcaugguggugcacaccuguaguccagcuacucaggagacugaggcaggaggauugcuugagcccaggaguuugaguccugucugggcaacauagagagcgagacccucuuuuuuuuuuuuuuuuuuuaacagucucauucugucucccaggcuggagugcaguggcaugaucuuggcucacugcaaccucugccucccagguucaagugauucuugugccucagucucccaaguagcugggauuauagacgcccgccaccacaccagcuaauuuuuguauuuuuaguagagaugggguuucaccauauuggccaggcuggucuugaacuccugaccucaggugauccacccaucucggccucccaaaguguugggauuacaggcgugagccacugugcccaaccuaagacccuucucuuuaaaaaauaauuaaaugucuccaaauucaaauuucuccacuugucccaauauuuuuuuuuuuacugcuuuuucuaaguacacaauucaaacaagaaucaugcagugcauuuaguugugcuguuccuuguuuuaaucuagaacauguuucauagaauugacauuuuugaaggguccaggcuaguggucuuguagaguaucccaacauuuagauuugucugauuguuuuccucauuuccucaugacuggauuuagguuaagcauguuuggcacagauacuacuaucacaugcuuuuuuuuuuuuuuuucgauauggaguuuuacucuuauugcccaggcuggagugcaauggcucgaucuuggcucaccacaaccuccgccuccuggguucaagugauucuccaccugagccucccaaguagcugggauuacaggcaugcgccacgacacccagcuaauuuuuguauuuuuaguagagacgggguuucuccauguuggucaggcuggucucaaacucccaaccucaggugauccacccgccugggcuucccaauaccacguguguuuuuuuguuuuguuuuguuuuuuacauuuuuuuugagacggaguuucacucgucgcccagacuggagugcaauggcgcgaucuuggcucacugcaaccuccaccucccggauucaagcaauucuccugucucagccucccaaguagcuggaauuacaggcaccugccaccaugcccggcuaauuuuuguguuuuuaguagagacaggguuuuaccauguuggccaggcuggucucaaacuccugaccucaggugauccacccaccucggccccccaaagugcugggauuaccggcaugagccaccgcacccagccaccacguacuuuuuaaacuauuguuucuagucuucacagcauccuugcuuaagcaggugagcuugguaacaccaagugacuugucaaaggucacggagccaguaaguggaacaaccaggguuucagagcuuuuucugcuacucuaguaguucuuaccugaagauugaugguaacucuuaauuuugcauguguauuuuuccuggugggagauccauagcuuucacuaaauuauccuagaguaagugaucccaaaauggugauggccaucauguguaccaugcuaccuuuccagagccccauuucuuugugguuccaugugauggaaaauaagcucaaccggccugucaggcgaggaagaggcagguguaugcccacaacaugcccacagcuuggagaucaggugaccucaaggaggaaguagcccacaaaucaccccucuuuuccucuucacaguggaguuccaggugaugacacagacccaaucccugagcuuccugcugggguccucagccuccuuggacuguggcuucuccauggcaccgggcuuggaccucaucaguguggaguggcgacugcagcacaagggcaggggucaguugguguacagcuggaccgcagggcaggggcaggcugugcggaagggcgcuacccuggagccugcacaacugggcauggccagggaugccucccucacccugcccggccucacuauacaggacgaggggaccuacauuugccagaucaccaccucucuguaccgagcucagcagaucauccagcucaacauccaaggugaggccaggacaugguuaucccagggaaggggauauaacaugucuacugggagcguuuccagauugggacccaaaugcaagaaugauuuccugagaagcaggcuucaaucccacaacuuaaaugccaucuucaccauggaagcacagauggcaucagauaaggagucccguuggacuccaggauaauuccaccaagagauuuccagcccaggauccugcugcccugcuguggcuggcugucuccaucaccccaguccuuuuggaccacauccugaggagcagcagcagcaaaccaaggcagagcaguggaagcgguucugaccauuaucacugcuauccuuuaaaaucucuggcuuagaggccgggcgcgguggcucacaccuauaaucccagcacuuugggaggcggaucacgaggucaggaguucaagaccagccuggccaauacggugaaacuccgucucuacuaaaaauacaaaaaauagcuaggcaugguggugcgcgccuguagucccagcuacucaggaggcugaggcagaagaaucgcuugaaccccggagguggagguugcggugagccaagaucaugccacugcacuccagcuugggcgacagagcaagacaccaucuuaaaaaaaaaaaaaaaacuggcuuagaaugacaguaagaagccagccaaucuuuaguuggcuuuacuaucuguuuucuggaaaauguaacccugcccccuuacggccugcauccaggugggccccucacacacccccgccuugguacaccaccaagggacacuguagccuccacaaucuacucucaucuuggcaggaagaaaaggcuucaggcuccuccgcuguccccaguuagauccauguguaaucuuauuccucauucuuucuccagcuuccccuaaaguacgacugagcuuggcaaacgaagcucugcugcccacccucaucugcgacauugcuggcuauuacccucuggaugugguggugacguggacccgagaggagcuggguggauccccagcccaagucucuggugccuccuucuccagccucaggcaaagcguggcaggcaccuacagcaucuccuccucucucaccgcagaaccuggcucugcaggugccacuuacaccugccaggucacacacaucucucuggaggagccccuuggggccagcacccagguugucccaccagguacugggaguguccuccuuuuccccaccuccacacuagggcucauggcucuccugccccagcucaucuauggccuuguucugcugcccauccacuuuguucgcagcccuggcuucaugcuccugccucugcuccugacuauuuucccaaggcggcagcugccacagcuucuaccacacauccccugagacuucauuauacuccagccuccagggugucaggcaaugugcuuaaggcuggagaucacagaugaauaauuccugaucaugcccuccaggagcuuaguccaguaauagagacaagacuaaguagacagagaagauggcauuugagccaaguuaacuagcuuagagggaagggaacacucaagauagaaacaauagcauauaugaaagccaaaucauaaaacagccuaaagagaauuuggagaauugcaaguaauucagcacagcuagagcuuaggguauaugggaaaaagggaaaguggcucugaagcuucggagguaauucuauuuauugagcauuuacaugaaucaagcaguguagaaagcacuuaaauguaugauuucauggaucaugacucccauuuuacaggugaguaaacuggcacuugcagaugucaaugaauuugcccaaggucaccuaucaaucaaugguaaagagagaaugugaaaaacaggcaaccggauuccccuuacgggcuuaauuaaacccuguagaucucacugggccuucaagcuggaacuuccugagagccauagcaugcuguugaaagguuuuauuuauuuauuuauuuauuuauuuauuuauuuauuuauuuuauuuuauuuuacuuuuuuucgauacagaaucuugcucuguuccccaggcuggagugcagugguaugaucucagcucacugcaaccuccauauccuggguucaagccauccucuugccucagccucccaaguagcugggauuacaggcgcgcaccaccacgccuggcuaauuuugcguuuuuaguagagaugggguuucgccaugauggccaggcuggucucaaacuccugaccucaggugaucuguccgccucggcuucccaaagugcugggauuacagauaugagccaccgcacccugccugucgagagguuuuaagcaggaaagggacaggaaagaacccgcaacuugaaguggaaacauccaggagcacugggcauuauuugguugcucauuagacugugaacuuccccaaaacugagguuucacuucagcucacaucauuccccaacuauuuacaaaaucccaguuaacuggugguuuuuuguuuugcuuuguuuuauuuuguuuuguuuugagauagggucucacucugucgcccaggcuggagugcaguggcacgaucucagcucacugcaaacucugccucccaggcucaagugauucucccaccucagccucccaaguaccugggaccacaggcgcacaccaacaugcccaguuaauuuuuuguauuuuuuguacagacaggguuucaccauguugcccaggcuggucucgaacuccugaccucaggugauccaccuaccucagccucccaaaguucugggauuacaggcaugagccacuguguccaggcaaguuaagugcuaacaaauaaacccaccuaaaucucacuugcaaagcaauuuuuaaaaccuuguccuuaggugggaagagguagagaauucuguguggaguaacucacaaguauccagcaaccuugaauaagaacaaaugcugcugagugccuuguuccaggcuccucaaccagggacucacacacacaauccuuagcuccuccucccugggguggacacugcaggugagggcucagcucaugauuccugcgcacgaugauccccgcccacguugcucucaccuacagagcggagaacagccuugggagucaucuuugccagcagucucuuccuucuugcacugauguuccuggggcuucagagacggcaagguaagagccugggugcccuuggcucuggcccuggcccaccucacccacucuaaccacccccccgcccagaccaggguggaagcccagaugccccaagcuccagccacccacccaucacagccuccugcuuuugaguuugcccuaaaugaaaaugaaaccagucguguucccucguuuucuccuagcuaccucacuaaagucugucacucuccugccucagaguagaaagaaagaguagucacgugcucccagaaggacucuaagucaagucacagagcuaaaaauacaugaagguggcaccagcucauggggcacugggccuggcucugcagaggccucugccuuccuucacugugcacccugggcucaugcaccaaggcagagaacaggaagaagugaggggacaagaagaaggcagaauguccagauggaggauaagaccaaagagccagguugguggugugacgguaggaaaacaaagcuggaggaaauggagaaggaacaagugagggacaaugaggcauggguuggggcugggcuaccccucccaaacucagcucugucaaaauaaaaggcccuugugucugcugcgaccaagcuuuuccacuuuccugucuuucuccacacuggucccaacugagcccugucaccaagccuagcggcuccaacuugcaaaguguuuaaguaugaaacaaaggcccucagaggcacccccguggcuccaucucaguugcaccucagcugcaauuaggguucugcucccucgggugacugcugggagguucaggauaccugcaaaugccucacucccucagcugcaaggagagacuucuccuuuuuauucguuucuaaaaugugccuaaucaauacgguggaacucagcauaccaaaacuguacgugaggau

SEQ ID NO: 14904 - RNA, 6725 nt, Homo sapiens
aggaaguguguuuuacaaccagagcccccgcccuccugcagcgcaggcgcagcuggcugggcuccugcuucccacucuccaccucauccauauuuguccucgucccugccagucucgaaaaggcacucugucacguguacacaggaaagggcccugacaagaggaugggacugcaguuguggcugccaggucucacucucccuuggauggucggcgggguggggguggaggccagggcuguagugcagcucccgcaggugcuggcucagggggagcaggcaggcuccgguuuucgguaauccuccuggauggggauggugcugcccuccuccucccuggggcagcuguaaugacaaggcucugcaggcuccacaggacuuucuccuuugucugcagaaggagauccgaugagucuuggccagcagugggggcagggggagacgggagaaggagauggguagaggcgggugcgcuugggggaggggugucaggagcacgccagcuaaggggagagaagggguaggaccaaggcuggugaaguggagcugguggguuucagugagauuccaggcgugggcagugggguugagccagugggguguggugcaggggcaggaccggaggccuguguucugucucuuacuugaucuauauuuccuucguugauggaggaacagggccccggccagggugaaaacaaggaacauuccagagaagaucacaaggaugcgaauaaaaucggagcugcacagggaucuuugggcuguaauaggaggggacacacagggguuaggggagggucuagcccuuggcucccucagcccagcccuccugucaccuugccucuccccuuucccccaccuuauucuaucccacccgccaccguuggccaacuccucuccuaaacaguggacucugcuuuuuccccuccucuuaucccuaauccuaggagcuuucugucuggcuucccuccuggccccucguguaugcauucucucuagcgguggggauuaaggagaaaacucacguggccaguggguagagagaguccgggcaggcagcugccugaagucagccagagucugcaugugcccagcuguccuggccuccagcaucucuggaaaaacagagacagaaugaguagcagcaggggaccccauagggcacaucugaaggccugagaggugcuggaugggaugggaaggcagaaacaggcugaccuuaucuagggguaggaguggggaguacugguugggguaucaccgcuaccccacgugauggcacagagaguugccuggaacuuaccacugacauaagguaagugggugggcugagggugugggcucagggccugagacgaccgagcggucagcgaaggguuuggaagaggaucacacucggugcacuccuugucccugcacugccagccauugcgacaggcacacucagcauuggcagugauggugcaguugcgaacgagaagaccugggggaagagaggcccagggagcauaggacacucagaccuguggagaccuucaagguccacuugcuucaucccccaacccccaucccaggcccaccucuagggacgugcuucccuuuccauucccaccccugcaaaggccugcccuuugcucacggucccccaaugccuuugccauuauuauuguuauuaaagaagaaaguuggaccuuucagaaggaagauucauggguucagacauagaaaccaugaaaaguagaaagagcuuauaugacuuucucuuguacucccugauacauuuuuuauuuuuuauuuauuuuuuugagauggagucucgcucuuguugccgaggcuggagugcaauggcgugaccuuggcucguugcaaccucugccucccggguucaagcaauucuccugccucagccucccaaguagcugggauuacaggugugugccaccacacccggcuaauuuuuuguauuuuuaguagagacgggguuuuacuguauuggccaggcugguauuaaacuccugaccucaggugaugcaccagccucagccucccaaaguguugggauuacaggcgugagccacugugcucggccccaauacuuuaauaacuuuuaauuaaaguauaauauacguacagagaggcacgcaugauuguaaagcuuaagaauuuguacaaauuuggcucacaggcauaaccagcagcagaucaacaaauauaaaauagccgggugaggcagggaauugcuugaacccgggagguggaaguugcagugagccgagaucacgccacugcacuccagccugggcaacagagugaaacuccgucucaaaaaaaaaaaaaaaagaaaagaaagaaagaaaauagccaggugcaguggcuuacgccuguaaucccagcacuuugggagguugagguggguggauugcuugagcucaggaguuugagaccagccuggccaacauggugaaaccccgucucuacaaaaaauacaaaaauuagcugggugugguggugcacaccuguaggcccaagcuacuggggaggcugaggugggaggaucgcuugagcccgggagguggagguuacagugagcugagaucaugauacugcgcuccagccugggugacagagugagauccugucucaaacaccaccaacaaaaaacaaaacaaaguauauuagggauucccaggggcuggggcuggggcugggguugguuggggggaagaaauggggagucauugcuaagggguacaaguuucucugggguaacgaaaauguuauagaauuagauaguguugauggcugcacaaccuguggauacacuaaaauaaauaaauaauaaauaguuacuugauuacaguuacuuagccuuuauuuuguuuguuuguuuuuugacagagucuugcuuugucgcccagguuggagugcaguggcacgaucucggcucagugcaaccuccgccuccugaguucaagugauucuccugccucagccucccuaguagcugggauuacaggugugugccaccacaccuggcuaauuuuuuguauuuuuaguagagacgggguuucaccguguuagccaggauggucucaaucuccugaccucgugauccgcccgccuuggccucccaaagugcugggauuacaggcgugagaauuugccuuuaaaauauacauuuugcucaaguguagagguccgaugcuggguggcuggguguuaauuauccugggggcgggugugguagggcacuagcugggcugggcugggcucgcuggcggcugguuugagaggagggugauucagaggaaggcagugacacccagaugugggacaggcugcaagaaagccuggugggccuuagggcagacacuuguggggacccggggagcccuaggugcccugacagguggaagaggggugcagaaagggaggaugucaaagagagaaugucaaaggucauaaccaaaccuaacaauuuucuucuacuuaugccuuuugucaggacaaggagagggacaaauuccuucuuggcauccuuauggcccugugaccugcuaaugaaugcugacucugaguugcuacuagaauuugguuuccuuguggcuucccaggaauugugagccauguuggauaaggaccugcaagggaagaaugaggaagccugggacagugcaggaggggagagcacuggugguagagaggagugaugacaagggucuccgccaaaagggaaauggagggguuaaagaagcugcuggggaggguuaaaaacaauguguucucacucguaggugggaauugaacaaugagaacacuuggacacaggaaggggaacaucacacacuggggccugucgugggguguggggagggaggagggauagcauuaggagauauaccuaauguaaaugaugaguuaaugggugcagcacaccaacauggcacauguauaccuauguaacaaaccugcacauuguguacauguacccuagaacuuaaaguauaauuaaaaaacaaaacaaaacaaaacaaaaacaaugaggugcuauuguuuuaguggugaguauccggagaccugggaguucuauuuaccagguauaaccugggcucaaaauuccaggcugacuucaggcauguccucaucucauagaugccagcacuaaggcccagagagggccgagcucauucagcccacccaucuucucaccccugacugcauuucccggggguccuucugcagccaggugcugcugugguacuuugggaucuauuggcugagcucccagagaagggucauggauugggcuaguuuggaacaagugaagggacugaagaugggcucaguauggggcgaagaccuucaggaagggucugcagagugaguagggggguuuugacuaggaaaaguuccaacccugccggggccgcugucaagagaaaagcaucuauuacaguuacauuuuuaaguuaaguagacugaagaauauuucuuguguauuaaagacguuccuuuuugguugauuugcaauggaaaagcuuuuguuuucuuuuuuuuuuuggaaacagggucucacucugcucacucugucucccaagcuggagugcagugguacagucacggcucacugcagccuccacuuccuggacucaagugaucuucucacuucagccuucugaguagcugggacuacagguucgugccaccacgccuggcuaacuuuuuguauuuuuaguagagacaggguuuugccauguugcccaggguguucuuaaacuccugggcucaagggauccgccugccuuggccuccuaaagugcugggauuacaagugugagccacugcucuggcuuuuugugugugugugugugugugugugaaaaaggguuuugcucuguuacccaggcuggagugcagugaugugagcagccuggaccucuuggggaccucuugggcucaagugaucuucccaucucagccucccaaguagcugggacugcaggugcacuaccaugaccagccaauuuuuuuagagacaaggucucacuauguugcccagcuggucucaagcuccugggcucaagucucuacaaaauaugcaaauacccuucugccuuggccucccaagugcugggauuauaggcaugagccaccacaucugguguugguuuuuguuuuuguuuuuacgggaccaggcacuacagcucacaccuguaauccuggcacuuucagaggcugagacuagaagauugcuugagcccaggaguucaaggcuguggggagcuaugauugcaccacugcacuccagccugggugacagagcuagaccuugucucuaaacuaaacaaaacaaaacccaguaccaagagacccagugacaccaaacacguuuugcaaguagguaguuuaauaguuacaguuaccugguucuaaaaagugucuugcuagagaacauuuguucaaaggggccacuuuaaagccugcuauucuaguguauacuggccguaguuucugaaauuguagcgaagauggagaaauaauaacagcauucauaagcacaacugcagauauuauacuucuuaguuuaaaaaaaaccuuuuuuuuuggaacuauaaaauaaaaacacaggcuacauacauacucauuuucucaaauuggcuuuugugcaaaaaaagguuguuaccuauuggguugcuuuguuauuuccuuagaaagauguauuccaaauucccaauggccaaccugcacaugugcacucugggaacacagucaguuuauugguuggggguugcuugcccgaaaucuggggucauagagccacuucucucauuuuauugucuugauccuauccauagacccguucucaccaaucccucaaauucuauuuaucccuuuccuggaauacuagaugucugcccacguuaauucaugccccaccuagggugccgcauuucccagcauuggcuccacuugcugugagccuugaagaaggccaaagcuuuggccccgucauccuccuugcacccccaaacccgucaccagccuugcucccccagaugcuuguccaucguccccaccuacacacccuugcccaccucaccagaguuacagugccgacagcucucacaguggggccgggugugguggucaggagagaaggagacccccgguaugcaaggaucacacugagcagccuuucuaugcuggucacaguccuucacgaggaauguuccugggaggagaggguaagggaucaaggccugagaagggcugguucucugcccucuucaagguggugccuccccacagcugcaggauuucccuccuugcuugagcucagucucacccugcgccuauuuacuguauuaaccccaguccucucucuuucgccacucaccuggcccuuaccaaggcccccucuuaccuggcucacacaucuggcagcacagcuuucccugagcccaguagugccucucugggcagcucuugggggcuggaguagcugagagccccaccaggguccccagaacgcacagccaccagggauguggccgugccauggucccugcccaggcggcuccuuucugugcccaguugcugaugcuggccucuggaguuagcaccuccaagcugggcgcugcugucucuucuuugcacccccugggcaguggcugcuucagguggcaagccaaccuuugaaggcagaaucucuauuguggcugu

SEQ ID NO: 14905 - RNA, 17949 nt, Homo sapiens
acucagcccucauuacugcagcgccucgcgggggucuggcccggaguggagggcgcgcggucccagcccucccgcucggccggcgggugucgaguucaggugcgaccgaaaaggggaaaggagggcaccgccacgugagcuguccucuccggggaaggcgguggcugcgugagggcgggggcugcucgguccccagggccccgccccucugccccucugccccgagcggugcuggcgguagggaggggccagcccgguccccgcccuccucgcccggacccgcgcugcccggcucccgcgggccgcucgaucccagucccaggcugggcaucggggcuggcuggcaucgccggggagccgacggcgacggggagccccgcgggcggggagggcggcgcagggcagcgggugcggugacaccugugggcacaggugagcggcgggagggcuacgcggcccgggggcggggcggccgggacccggggccuggaagccggggcgaaggggaaggaaggccuggccucccgaaggcgggaggaggggagccgggggcugggcugagacaggacccuggguagggagcagugcgagggagacagcgcccucagagggaggacuauugggaggcggcaggagggacagcgaacguuuccuccucugcuccugaaucggaggaagguaagggagggcugaggcaggaccucaggcccacccggucggggcacaaacaccugcgcagccuucuugagcccaccgccccuuaggaggccucuccucuuccaggcccugcccacucgagggcgggcccucccuccagguuuaggggggagggauggagccccacgccuggcccccagcuccauggugguauucccagagucuggggaggaccaaauauauagcccgaaacuggagaaacucuaauucuauuuggcuggucucuaagggcaguggccggacagcuggccccacucaccucccugucuguggucaggaggguucagguaggagaugggcaagccuuucaguaaaggccagacaguaaagauuagagacuucgcggccuacaccgucugucccaacuagcaagaagcagucacagguuauuaggagaccagcagaagaggauggauuccaacaaaacuguguuuauggacacugaauuugaauaucauguaauauuuacuugucccaaaauauugguggcuuuuuugcagggggggcagcaguuguuucaacuauguaaauauguaaaggcuuacaggcuguacaaaaacugguggcagacugggcugucuccagccacccccacucccagcccaccccacccaccauggccucccuccagcuuuuucccaagcuuuauauggggaaggggaugggguuauaucuaggugcaaggagaacccucccaccuggguguauccagaaagcccgagaccugucugugacccuuguucccauuugagaccagugcaggagcuuguaccccaaauaugcacacaugugagagaggagguacaucuccaaggggcuuccuacccaauauguaccuggaccuacccuacucccaccaagucauagaugaggcagccauguuccccccaacaagugaccaagcccuuggcccucuccucccccacuauacccucccucccaggcccccuaccagccuuggucucccgccuggugccauucacugauuggggauggcccuuccauuccucuuuucucucuugcagcccuaggggaccucuuucuccuggacauugaagauauggcccuuuggaggugacccaggagagaagggaugaaggccuuugguccuccacaugagggcccccuccaaggacucguggccucccgcauugagacuuaugggggccggcaucgagccucugcucagagcacugcuggcagacucuauccccgaggauacccugugcuggugaguccaggcugugccccaaaagugaccugguggggcaggagggaagacaccuaggcuguggagucucuguccccuuacagguucagagguugagcuauuccugccccuuacccuacucuucuuuccuggguugcgggaaagaggagggcagugacagggccaggcuccagggauaucacaccccagucccagcagcugggcaggagaggcggagccaggagaagccaggcccuccgaggagugcuguuagacaggucucagacaaagagcugcggguaaggucaucaaaccccagagcuggcgccucccaggcucccgccucugcuuggcaggaguuugaggccuuccugagaucugccucucccugagucaggaugaagaugagcaaagguucagggugucccuacuccuccagugguggguagggacaggagggugccugccuuggcuccaccccuggcuccaccugccuggcucuccuccaguccuaaccaagcagagggguguggaagccaggucugucccucagccugcagguuuccccuccaccuugaggacaguucugcuuguggcugggacauccccugccucaaugcacgauaauuuugccuuuggagaugggacuuuccuaggcugugggugagaagggagacuagaaaguaugugggguaauucaggccacaggcaaaugaaggaaugugaccaggccugcccugggaggagcuguguggcuguggcuucagccuuucacacagaagggcagccacucccagcuggaugggaugcaggcugcacgccccuggggagaaggcugcacaugugagugcccucguccccaugugugagggaggcuggucauagacaaggagaguuacgagagaccagaaugcugugugcaccacgccuuguccaugcaccccccaugguacggagagcaggaggcagugggggcacacacaccagagcccaggcaugugugugcugugcaccugcucggcaggaggccccacuucuuccccaggcccacucagggagccaggcugucuugccucugcccacucagcuuagccuugccggcaguggccgcugugacucagggcaggagcaguccacaccaaacugguuugcagggagaagugagccagcccgacuuaccagggugggggaacaacaucuagagccaagccugccccccuacuaccucucugggguuucuggggaaagggaggcacccccagaacuuccccugcuccucucccaggaucccagucgccgacgccuccagcaguauguccccuuugccagggguucuggccaggcccgaggccugucacccaugagacugcgagauccagagcccgagaagaggcacgggggccaugugggggcuggccugcuucacucccccaaacucaagguaagggggucccucuccucccauccccacacauacggccccaauugugauggcuccgcagaugaccagcaagcuccgggagcugagaacacagguccaggaggcugcugccugccagucagacauggcucugccuaggaccucucagggauauaucucucuuugguccaugcauggcaaccagggacuuugacuugagacacuuugauuaaauguggauaaacgauugauauugagcuuucaguuuuugaaaacuaccaagucaaauuaccaaguugcugagagucagguaugcucucucuauccucagugccacaucauccuucacugccacugugagccucaccucuccucccaagccacauccagauggagugagugagggucaggagugucuauugcucacauucuugguaccaaagaaaccuguaaaaugggccgggcgugguggcucacaccuguaaucccagcacuuugggaggccaagacgggcggaucaccugaggucaggaguucgaaaccagccuggccaacauggugaaaccccgucucugcuaaaaauguaaaaaaaaauuagcugggugucauggcgggcaccuguagucccagcuauuaaggaggcugaagcaggagaaucgcuugaacccgguagguggagguugcagugagccgagauugcgccacugcacuccagccugggugacaagagcaaaacucugucucaaaaggaaaaaaaaaagaaaccuguaaaauguaagccaugcugcuucauaaaaaaugccauuuuauaggcaaaugucaaaguggugccugagaccacugguucucuaagucuuguucugauucacuugaaggucccucugaagugucuguuucugucccucccccaccucauucugauucaggagacccauggaaggccucuuuccugucagggagccuagaucagaccccucuccagggaccuuuccacagaccagggugccucuucacccacauuccagcaaugccuuuuucccuggaauuccagcuggggccgaccccuguucucuaggccuccauguccccacucauacucagugcugcuugccaucucccauuccagacacagacacacgcacacacuuuaacacacaugcacacacacacagcccucccggggcccuguggcugggugccaaggaugugaccagagcugaugcccuucucggcucccccaggaacucaccaaggcccaugagcuggaggugaggcugcacacuuucagcauguuugggaugccccggcugcccccugaggaccggcggcacugggagauaggagaggguggcgacaguggccugaccaucgagaaguccuggagggagcuggugccugggcacaaggugagccugaaacucacaaggugagucuguccccacggcgugaaugcacacacagauucugcucuagaggagggaaaggccuugggaaguggggucauguggaaaaaacaucuggaaacgcguugaucuggguucagaucccagcucugccacuuacuagucagaccuuggucaagacaguaaaguucucugggccucaguugccacauauguaaaguggggauaauaccaccuacacaucagagcacugguuugaggauuaaaaggucauggucaugcacaaagugccuagaaccuaugaaguggauccggucgcacuuaacagcugguacuugccauucuaauuaucauuccccaacugaaccagcauucuccccaccccaggagaugagccaggagcucugccaccaacaggaggcccugugggagcuccugaccaccgagcugaucuacgugagaaagcucaagaucaugacugaugugagccccccucagccccagccccggccccaucuucccugcaugagcccccauccucccagacuggaaggcaggucacugggggagggaggggcaggauuucaggccagucugggaugcagggagauaggucagcaguacugaaguugguggggggugggaggugacgacacugaagggcugcgcuggguccugagacccucgucucccucccugcagcugcuagccgccggccugcugaaccugcagcgagugggacugcugauggaagugagugggugcucaggaggggacccuggcacagcccgaccucugagccuggggaugagggugggcccuccagccaucccugucugaauucccacugccccguuuuuugggaugccuugcccucccuacuucccuguuacuggggacuccaagcaggccacaggccccccauuucucagacugacauccuugagaucuuccaggcccagugcccaguucauccuucuucacccccgccccugcuguccaagcuuaagguccucaccuuuccucagccagugccaccccuggggaccuuccaaaagugugcugcucagcucugcucccuccuccaggugucagcugagacccuguuuggaaauguccccagccugauucgaacccaccggagcuuuugggaugaggugcuggggcccacccuggaggagacucgggccucgggccagccucuggaccccauuggucugcaaaguggcuuccugacggugaggccugugaagggcugugucuggauggggcaggacucggagcccucggggguccuguguguagggcaugcccacaguaugcaaaucucugugauuugaggggccgcaggacacagccccuaccccuaauaucaccucaccuccucccuucaugccacaagucugaccucugugccacaggcuccuuguucuucuggaggccuuuaugaaaugaaaaugcagcugucucagagaagggucacaccuuggcucccaucaacuacaaaagcugggugcagcaaaugaggccuaagugaggggacccuuaggaggaccuggguggguguaaaaggccacaggaggcacccggggcacggagaagagugacaagagaaagcaagagggccuaggauccgacuuucuucuacaauguuaccuagccaggaaaaugugggcccugcaggaaaaaguugcagugggguagagagguaggcguacugccccugggagccuuagguacccccuccauaggagcaaggcuucugagccaacucuuaggucgccaccccacccccagggugaaaugggaucugcaauguccugacaacgguccagcugaauuaucgauggugggagaguaaguccagagcagcaggccccaguagcacuguggauagagggagcucagagagcucugggucagugucgggaccucaggcuccuucguggaauccagagaaaggggcguagccucgagagcauuccugggaggauccugggagggagggacugucaggagcugggcuaagggccccugcgaggcucucuucaccugcuccuggguccugcagcuagagccuguauucauggccuucuccccaugccugcuccccaccucccguaucugucucuccaguuuggccagcgguuccaccccuauguccaguacugccuccgagugaagcagaccauggcuuacgcccgagaacagcaagaaacuaacccucucuuccaugccuucgugcaggugggagaaggggugcuggggagggggacgggugcaucuuagccggccggucuccagcugagccugaggcugaguucaccacuaggcagggcaggagggagcaaacccugagccccacccaccuucccugcaguggugugagaagcacaagcgcucugggaggcagaugcucugugacuugcuuaucaagccccaccagcgcaucaccaaguacccacugcugcuccaugcugugcucaagaggagccccgaggcacgagcccaagaggcccugaaugccaugguaggugccccaguggggcugggacucuggugaaucggggacugggaggggggucucuuucuuagugugucugugacaguguggcgcugugcuguggcuggcauugguugggaggggacggcugagccgucccuccucccacacccccaaccccaccuagauugaagccguggagucauuccugcgacacaucaaugggcagguccgccagggcgaagagcaagagagcuuggcggcugcagcacaacgcaucgggcccuacgaggugcuggagccacccagugaugagguggagaaggugagagggcaaagggaagggacccaggaaaagcaaggucccagggauacuggugaaggggagggcugcaaggccagaacaccccguacuugggugcuacaaggguguccaucauuccuaccugguggugacaguccaagggguacaggucagaagagcaaaaaggaggcccugggaggcuuucucuagcccaugggggaaggauacaaacagaaagguguugguggcagaaccaggagccgcccuuggccaggaaguccaggcagacugccgagcgcccugaccccuccccucugugucccucagaaccugcgcccauucuccacccuggaccugacgucccccaugcuggggguugcaucugagcacaccagacagcugcugcuggaggggccugugcgagugaaggagggacgagaagggaaggugagggugcugcggacagaguggaggggauggggcacggugggagaagguaagaggcagaaacgccggaagugggagaagagggguuuggggaagaggaugugguucuggcuaagccccagucauuugugugacccugagccagccacuuugccugccuguaaagugagagaugugaccaaagcgacgccccuggccacucccgcauuugggcucugcgugugucccugugugccugcgcaccaugccugagccuccucccggaccagcccugccccuggcuccagcugacccugucucuuuccccuacgcccccacccccagcuggacguguaccuguuccucuucucugaugugcuccuugugaccaagccccagcgcaaggcggacaaagccaaggucauccgacccccucucaugcuggagaagcucgugugccaaccccugcgagaccccaguacguccuuccuucagggagucuuuucuucucccucuucucagcgaggggaaggaggagcugggacggagaucaaauaaaggcuggccucuugaagguugucuccuccauccagacagcuuccugcugauccaccucacugaauuccagugugucuccagcgcccuccuugugcacugucccaguccuacagaccgugcccaguggcuggagaagacccagcaggcccagguaugggaaagccagcaacggggaggcaugggcagggguccccggagcucagaaaugggagcacagugguggaucacaccuguaaucucagcacuuugggaggcugaggcagguggaucaccugaggucaggaguuugagaccagccuggccaacauggugaaaccccgucucuacuaaaaauacaaaaauuagccgggcgugguggugugugccuguaguccccauuacuugggaggcugaggcaggagaaucacuugagcccgggaaguggagguugcagugaccugagaucgugccacugcacucuagccugggugacagagugagacccugaagaagaaggaaaaaaaaaagaauguaggaaggaaggaaggaacgaaugaacaugggagcgcagaggggaggaggagagaggcugggguggauucaguuucagacuggacaaucugaugugccccagagagggaggcagagccuccaccauccaucagaagacagaaaaagccuuuggccagcuacugugccagccacugggagagcccaagauacagcauccccugaagguuuguacagccugaaaugauuaacuucuagaagucaucuuccauucgcagacauuuacagggcacuugcugaguacggcaggcacuagagcuaggugcuagggaaucagaaaagaguaaaccaccauuccugcccucaaggccuaggugcugcagccugguugaguaauuaguauacaaacaauagagagaaguuauguagaaugaagcugggacagagaagggagcaaggcauugucugcugggucuguuuggaagggacacagaggagcugaugucugagcaccauuugggaggauaccuaggaguaugucagggagucaggguggaagggaagggcauuccacauggaggagcagaacgugcaaaggcgggaacugugaaacaguuguguguguugagagaacugcccccauugguauugcuacaguaucaaguacaagaguagacgcagcagggagaggcuaggggguaggugccaccaggucaugcccaucucugcaugucaugauaaagcauccuauagaugagcuuuguccuuuggaugacagagggccagugaaggagucgggcaggggagugaugugagcagauaaaaagcaggaggaguucaaaagaagagagaugcaaauggagcuguauuaggucccacaaacuugguggccuaaaaugcaucagaagcuuacucucucacaguucuggaggccagaaguuucaaaucaagguguuggcagagcugaguuuccucuggaggcucuagaggagaauccauccuugccucuuccagcuccugguugccccaggcguuccguggcuugugguaacaaaauuccaaacucuuucucugucuucccauggccuuccucucuguaugucucuguguccaaauuucccccuccuuucucuuacaaagaugugaguauuagauuucgagcccacccuaaauccagggagaacucaucuugagcucuuaggaucucugcaaaucugcgaagacucuuuuucgaaaucaggucacauucacagguuccagaggguaggacuuagauauaucuaucuuuugggggggccacuauucaacccaccacaggaacggaauggccaaagagaagugaagauuugaguuagacuuuuaaggauaggaagaccaugagcagcagaaucagaggaccagcugggcuggauauauuucuggaaugacggccauaucugccuaaguauggagcacaguguuugugugagugcgugguaagaggccagauucugcagaaucucagagcugcagaacccuguggccuggaugcgcuugaguuaaauagggucaacaagagacagccaccgugaauucuuuuuuuuuuucuuuugagacagagucuuacuccaucacccaggcuagagugcaguggcaugaucacagcucacugccgccucaacuuccugggcucaagugagucucccagcuuagccucccaaguagcugggacugcagguguguaccaccacaccuggcuaauuuuuugcaucuuuuuguggagacagggucuuuccauguuguccaggcuggucuugaacuccugagcuuaagcaaucugcauaucucggccucccaaagugcugagauuacaggcgugagccaccgugcauagcccugccaugaauucuugagcaagggugaaaucaguguguuuccucuugaauuagguuuucaggaaaucagguagcagugugcugggugggcuggaggagggagaaauuggugacaggagguuuauuguacuaguuugggugugaaacauggaagguuuagugccacagccuuagggagacauugcaaaaagggacaaaaaacaaaggagaagaaaggaccuaaagaagagggaagaggccgggcgcgguggcucacgccuguaaucccagcacuuugggaggccgaggcgggccgaucacgaggucaggagauugagaccacggugaaaccccaucucuacuaaaaaagacaaaaaauuagccgggcgcgguggcgggcaccuguagucccagcuacucgggaggcugaggcaggagaauggcgugaacccgggaggcggagcuugcagugagccgagaucgcgccacugcacuccagccugggcgacagagcgagacucugucuuaaaaaaaaaaaaaaaagaagagggaagagaagggggagccuuagggauacuuugguuaaagucuauacugaauucagaaaaauccagguucagacaccgguccuaccagguccuagccaugugaccuuggguaaguuauaugaccucccucaacuucaauuucgucaucugcaaaacagauauacacaaugacuaccugcuuccuagggagauucaaagcugucauucggcuuaggcacacagccuggggccagcacugggcacaggcucaggaacuccagauacccagcggcaaagagcacaguuggccucccgaagcuucaguuuggaacacugcauuggcaaugggaccccagacagaaaugcagucauuagaaagggaaagggaaauguguuuguuuaguuauugcuuccucagugagguggcuuuacuguaggaauauuuaaacagcagcgcuuugaaauugaggcagccaagauauaaccuaguggagauaucuuaggggcuuugggaacaaaagaaacagaaacaaagaccuggaauucaagugaaagaggaggacaaaaaacacaccccaaggggaggcagguggguuuugugaugacaguggucucccaucugcccuguccccugcuuccggcucgguucacuguccccucugcauggcagggacuucucuccaccacuuccaccuaagccuaaacacacuuuccacuaggcuggacugacuggcaagugacaucauucuggugguuaaucaaauuuucuuggccaggcguaguggcucaccuccucuaaucccagcacuuugagaggcugaggcaggcagauggcuugagaccagaaguucaagacccagccuggccaacauggcaaaaccccaucuuuacaaaaaauacaaaaauuagcugggccugguggcgcaugccuguagucccagcuacucgggaggcugaggugggaggaucacuugaacccgggagauagagccugcggugagcuauguucccaccacugcacuacaacccagacaacagggugagaccuugucuaaaaaaaaaaaaaguuaaauaaaacauuuuccugaaggcuagaggcucaagggggagcccagggacaaaagcgcaagcuaguggcaucggugucccuagagccccaacuccccaggauagccaguggggcuggcagugaauggcaggcugccuuuuuuccuucggaacugccaccuccaccuucagaacuuucuccucuuuuuuuugguuuuuagucacagaacaacagccagacucucaccuucucccuuucagaaucccaagagcuacugaaaauuacggguauuuuacuaugcaaaacaacucaguccccugguagucucacuccaggcuaacaggaaagaucugucaagaucuauaaccaagauaugcaccaaggcucccuggccuuccuuagcaaaacaaagaaaacugaaacuuugaaaugacuuuuccugcuauugucucacaccagauuauuagggaauccucucuagagccaucagucuuuauacacugaagagggcaguagaaacucuguuggucccuuucauagagcaauccccagggggcagacuauuguuuucucacccuggcagaaacguugacuugcagauuuauuccuagcgggucuagcugugaugacucacacuuuuagagaaaguaagcuucuccagggagaagagacugaaucuuggggaaugcccagggacugagaagaggaaaaggaacagagacaggaacagaaagagccgucagagauggcgaccaagaaauuaaagcagggagacugaaggaggcagccgaggcuaagagccagggucugaaggagaggcccgagcagcugucagggaguuacuucaccucuuggggaguugcagugcacgcaggacagacaguccgcaaguggccaggcacaaggcccagcacuguaugggcacuccauaaauguuugccguugucaucauuagaagaaagggguggucuuuggggccuggguagggccugcugcugacuggggaaacgcauccgcaucuguugcucaggaagucagugggcacguuucagaguucgguuuuaguccggcacuggggaguucugggaggagagugggugaaucuaggagccaccccagagacagcagggaaaggaggcauuuccucuccauggguacaaaggaagaagaauccugcuaggggcccucccuuccucuucucaguuuuguaggggggucacauucuggcuuaagcgccaauuuccuuuuccuuucccguccccucugcccccaugugucucuccucuuaaccaagccgagaaaauucucccaggguugcuggagaggcuuugggcucgcugggaggcaccuccaagagccccaucccgcccauucccccgacccccuaccccguacucggggcucccccucgccccccucccccccccgccgccuccuccagccucuuccuggggucgggcaaggggcaaguuuagcagagaugauggcauugaacgucccuuacagaaacccugcuuccuuccaguucuucuuucccguaacaucccuuccuuggcacccgaaacacaaaccugaauuuggguccuguggggcaaaagggcaccccagcaggacaagcagaucggcccagcgccuccacccucucuuuucucacuucuucccucccuucacauggaguugggagaugaggccugggaaagagggaguccugccccaggucccggcccuggcagguuuccuacccccagguacccuccccugcuccggccaacagaccacaucuuaugagaaugcugucagccuugggaauaagugacuggagagccagaaaaagcagaaugggaacuauaagccuggugucauuuuccuaucccuguucauccauuucgucucuuguccugacccagcugcuccccggguuucuugagaggcuuugggaaaguccaggugcccaggaguugcuggcucauauacuucaagcuggggagauaguggaaauauuuaacaauuaguauagcaugggcaucaaccaaucagaaaggagcgcugcacuagagguccucugcugugccagagguuaucucccuuaguugcuagaucauggggaugggggaagugguugaggcccaggcagcagccauucccuuaccagcauggaagacuucaauauuuuaacaaggauauggccauaccagcaaguccugauaucagugcugcccacagcagccaccaguaccucccuuuugccaaggcuugccuccgccuccaaccucagcucugccaccuucucuucccucucccucccccucccccuccccaagccaacaaccgaccuucuguaacucuuuacccuucaaggcuguccuugaaaguguugcagugacugaacuaggacucaaagagcaaggcccugucccagcucugcuucuccauaccuguggcaccuugagcaagucacuucaccucucuaggucuagguuucuugucuguaaaaugggcuaacauucauguucuccacaccacagggcaaugauguguaucaaaugaccacaugugcaaaagugcuuugaaaauuuuuucucagguggcgcuauuuccuuuugaugguaccuguaugaaaucgcugagggagggagaaggcagauaauauaaugcguccucuccucagccuucuaggaacuuuccucccucugaaggacagcagaguccucagccugggacaaagcccaccucugcccacguucugcccuccugcuccucccagcuucagggcagaggcccaggugguaggagagggaugcucuugaaggagcaaccaguaccaauucagaacacuuauucuaccaucaccaccaaccagggagggcuuccugaaggagggggaagaccugauaacaggucugccaaugggacaugagaagcaggaagaccuguacagguaggaaaagggccauucuguucaccccacucacccccaacacuagcuccagaguuuggugccaccaaaucccggcaccaccccacuuucuuaugguaagaaguacccccucagacaguuacuuaaccuuagagucuccaugucucaguaguaaggugggguaaaaauaucugguucaugggguuuuuguaaagauuaaauaagguaauguaggccgggcacgguggcuuacacgucuaauuccagcacuuugggaggccaagggggguggaucacaaggucaggaguuugagaccagccuggccaagauggugaaaccccaucucuacuaaaaauacaaaaauuagccgggcacguuggcgggcgccuguaaucccagcuacuaaggaggcugaggcaggagaaucgcuugaacccaggagguggagguugcagugagccaagauuguggcacugcacucuagucugggugacagagcaagacucagucucaaaaaauaauaauaauaauaaaauaaaauaagguaauauauguaacgcacuuagcagggugccuggcaaacagcaagugcucaauaaaugagagcucuuaauaacgaaaguguccugucccaggccgcccuacagaagcugaaggcagaggaguauguucaacagaagagggagcuccugacccucuaucgggaccaggacagggagucccccagcaccaggcccuccacgccuucccuggagggcucucagagcagcgcagaggggagguaaggcucacacggacuacaaggucuccccgagcaggaggagggagccauaaggcugagaaauggcauuacugcacauuuuugguggaauugggaauagauagaggaacgcaggcguagggcaggguagggaagcucgguaccagcuguguugggucggaagguugguaccagccguguuggguuggaggugggggauagggcacagacagccuacagaguuagccugccuagagucacacaggagcacugugagaggagcaagcucgagagugaagguagguguggaucugcagaauauuagagcugccaaauccccggggagugugagguucgucuaggauagcaccacugcuuggcagcagcuuaaggagaaaagaagaaucgaucauugaggauaauaucagguaaguucaggaaccacucagcaaaaaccugacuacccacucgauacaagauccuggaccagaugcuauggauaaaacaguauagaggcagcccguacucucuuaggagcuuaaaaucuagccagccagaugagaaaaacaaucacagugcgauggaaagaugauaccaaaauaaguuuggaggaggggccauuucuggauguagugaucaagggaaacucccuggacuugaacuugaccccuacgcaucugacucuuugccauuaacuguaggacuccugaguucucgaccauuaucccccaccugguggugacagaagacacagaugaagaugcuccccuugugccagaugauaccucagacucuggcuacggcacuuugaucccaggcacccccacggggucccgcuccccacugagccgucuacgccaaagagcccuucggcgggacccucgccucaccuucuccacccuggaacuccgggacaucccucugcguccccacccucccgacccccaagcuccucaacgccgaagcgcccccgaacugccggaaggaauccuaaaaggaggcagucuuccccaggaagacccaccaaccuggucugaggaagaagauggggccuccgagcgagggaauguggugguggaaacacuccacagggcccggcuucggggccagcuucccuccuccccaacccaugcugacucugccggggaaagccccugggaguccucaggggaggaggaagaagaggggccucuguuccugaaagcuggccacacaucccugcgcccaaugcgggcugaggacaugcucagagagauccgggaggagcuggccagccaaaggauugagggggccgaggagccccgggacagcaggccacggaagcugacucgggcccagcugcagaggaugcgggggccccacaucauucagcuggacaccccucuguccgcaucguaagugcuggagggaagcuggccugggagggggcagacggggaugucuguaugguggugggguguaguauagaaagagggcaaagcaggaacaggggcugaggcaggaagggcucuccgccucacucuucaccugacccucacccguugccacugaaugucgccuaacacccccuccugucuuuucagagagguaugaggaaugcagaggaccuuuggcaugcaucucucccagaggagaucucuccccaguagugcuggucacccuccggcaucugugacucuaccucaaggaccacauuucccaaaggaagccuggcccaggcacccugccuccugcucuguuuggggaucaagaacuguaaauuuauguaucauaggugcaccugagccccacagaaaguugugcauaaaaauga

SEQ ID NO: 14906 - RNA, 37930 nt, Homo sapiens
cgcaccgcagcgggucgcgcgcccuaaggaguggcacuuuuuaaaagugcagccggagaccagccuacagccgccugcaucuguauccagcgccaggucccgccagucccagcugcgcgcgccccccagucccgcacccguucggcccaggcuaaguuagcccucaccaugccggucaaaggaggcaccaagugcaucaaauaccugcuguucggauuuaacuucaucuucugggugagugagcgcgacugccgcgcgcuccucucagggcccaccuguucgcgggccccggacacuggccgcggccgcgagugccggcagcuggcacugcccgcaccgggcaggcaccgggcgggaagagagagcgcccugcggcugccagcuggcuccaaggccggguccagagccgggcgggacggccgcgacgggcgcauucgggugggggcucaucaccgcccagccggcguggggagccgggcccucuugagaugaggcgugcgggaggguccugagcacuuuagcucgccuaggauuugagcuggggugugugucugcucccagcucaagucccuccgagugccagagaggaaggcagggagaagcggagcaccccucuuugggccaaggccaaggaggacuguggugagcaguauggcuugugaccggguggggucucccagguaguagggggcgccaggaagggagggugcgggcacggcgagagcucagccaagagcggcucucacuuuuacgcaggagcggcaggggugccucggccgcggguccggccccgggacccagucccugagagucgggggccccuccacccuugaggaggaaccucgcaggcccccguucccucagacuuugauucugagccaccgugagagcgccgaacucccugguagcucccugaaagacuagcuugucuugauuucuuucaaggacgauaaguaucuucacuggagagaacucagaguucgggagaggagggggcagauaccuaucugcgccucuagugggaugaguccugugugugcauuuccgggagagaucaggugccagccagcugcccgcccaggagagccuuggccuugcccucuccccuccccgccagcccaggcggcccacccaaggccaggcagggcgcagagcggacguucaucuggagaggccagcggggccaggagcuccagagacaccugcugcaggccacucagccucuacaaaugggaaggcugagaggcgacagaagcaaggaauaggaaacccuuguguccuuguuucuauagccacauucccugcacacacaugacaauacuugccgcucugcaggcaggaagagagucucuaugccacucucaagauagauggauguagaaacaggugcaugccaccagagucuuguaacaaaaaagugcacuuggccaggcacaguggcucaugccuguaaucccagcacuuugggaggcugaggcaggaggaucgcuuucauccagguucaagaccagccuggguaacauagugagacccccaucuccacaaaaaaauaaaaaauuagcugggcguguuggcaugcaccugugaucgcagcuacucaggaggcugagaugagaggauggcaugagccugggaggucaaggcugcggugagucaugauugcaccacugcacuuagccugggugaccuagugagcccugucucaaaaaaaguagaaaagaaacaaaugcacuuauucccccuggagcuggucacugagguccccacaagccuccuuagggaaaucuucuaagauucacuccuccccagagcugaaggggugguugaacaguuuuuccaauuugcagagacugacuucccccagugcaucagucaccauaacacacaccccagugaggacggcauauaggugugcuccuucccaacccuugacuugcuuuaaaaagacccugcuggccgugggcaccccuccuccuguguugccacccaccccagcaaccacccagcugccacgcuuagcuucuuucuuucaccaaucccuggcagcagaaaaguaugcgggaaggcagcuggccucacccacccuugaacuuugggaguuuuccucuccccucccagguacagucucucccggcugguguguugguuaguccucagcugucugccuagacugcauccagguuugggacugcagggaaacacagacugccacagugugccucccuacccccaucugccccauggcauaugcaggaagcugaugcgaggcucacagggccacugguaucuacucugucuguggccugcuggccugcaaucuguccguacuguccucagccugccaccccacucguauucagaacccccuaugccuggccccagccuaggugcagcugaugaccuauguagucugaaacagaaaucacucacacuggaaauguuuggaaugacuuuugaagaucaugcaguccagcucucuuauucauagugaggcagcagaggaagagagauggggugauuuacccaggaucgcagagacagagccaguauuacaauuccuggggccccuacuuuacuucuguccucuuccaucuucaucagaggcaggaagaugggcaguagcuauguuuuccugaauuacuguucauuuguccuguaucugggucccuguggagaugaagcccucaucccuaggagaugauguaaugaaaaggaagacuguggucgguccacuugugcagaguguuagucuuuagagccuuucuuguucuagucccaugauguagccaagagcaggaagcauuguccccacuguacugaugaucaggaaaccauuucccagagagguuaggugacuuauccaaggugaugcggcaggguggucucagaacuagguuacuuuacccaacugguuuuggcugcugagugggaaugggagaagggugggaagaagcucccaagacucccuuaaggaaagguguaaccuaagggaacugcuugggugauuauguugucaccacguccguuucucucuugagaccagacauuuauaaacuuggcauucggaaccugaugugggccuugaaaagcaggaauugugaggccagugcccagcagcacuuugcacagaggcugcugagaggggguguccaacaggcauccagagagaggccaaccucaguggaguaggaugguuauuggggggcugugccucuucccuggccugaucucaucccugugggucacucccugauggccacagccaaaccagcaaaucagucuguucuuccaccaccuccagaaccggcccuccuagcucuauuuugauuguuucuacauuuccuucagaccucccugcccgccugcccaccccccaaaaaacaguugagagggaaaacaucuugcugauguccaugugguagacacacaaguauuucuccagcugaaauggggaaccaggguuagggccaguccagucugacacaugcaugucugcccucuuucuggucagagaaggggaggaacuccuuagggcaaaagagggaaagguuuggcuauacugacagagcccaauccccuccccaccucccucagccccuuugcuuacugucucucaugccucgcucacugauggaaacagcaguguggggcugggaggucucuuucccaagaaaccauauccccuagaccuaggggaggcuggugcgaaacacagagaccuacacugggaauucagagaccuggaugugagcccagcucuguccucaacucacuuugaaaccuuggguuggucacuucugugcucuaagccucaguuuccucaucuguaaaacaauagcuuggaacaaauggucucaaaagguccuuucaagcucagucuaugaacccaacaccccuacacauaccacauacaacaauagaacucuccuacacaacccaaaauaggaaccaauauuggguacgauguauacuauguuggugauggucacauuaaaagcccagacuucaccauguguaacaaaacuacauucguguccccuaaaucuauaaauaauaauauaauaaacaaaauacaagcccugaauuggaaaugggagauggauaccaaggcuugaguccucagaacuuagcuuuucuuggccuuuaccucuggagcaagagcccagcuggugcuuuucuuugcuguugcuucucaguucccucuccucacccuggguggggucucucucagggguguucauugcccguauaccuuaguacuuggccuagugaucaaagcaccaguccuggguuccaugucucaucaccagauggggcuggugaccaccccacauggugcugugagaguuaaauggggaguauguguagugcacuuagcauaguagauugcaccagacauaucuuccaacaguagcuauuguuauucacuaguggagaguagaaugaggcccuggggagggugagagcaguucucuaagaaguguggaagucuaaaccgcagauguggccaggaggacccucccaauccacacacuggccucccugccccuuccuguaucagugccaacuuuguccugugcaucaaaacccugacuccauuucauggguugcuacugcucauuuggcugcgggaaggccccgcuucugaaaauaaaauugccugucagagaaacccuaaggaucaggauuccggaucugggcagggcauggacaaguuggguggcaguggcaaaagccccuccccauggucugccuuuucccccagaagcaaguugcugggacuguugcauaaaauggcucccaccuccagugcccagacagccugcgcuggggugaagcuggcuacacgugcacugaagcuggcaggcuuggggagaggugagcugaggccagguaucugcuuccuuugcccaggauuuugauggucucuccccuacacccacagugggugugaacaacaaagacccaaucuuuugaugguggugaggauuccucugcacacgcucacacucacguucucuacccccuucuuuucaacguggcccacagcacgauuccagacccugcucuauugugcucagaggaagcagcugcuggcuccagcccgaauuugggagugcuuugauaugcagcccucucuggggcccugccaguacugacucuagaugagcccucugcggcugcugggcucacaaaucagccuucucaccccuuccuccaggagcaguguuggaugagaaucucccccuuacacacauagauccuguguuuguuuugucugcuuuuguuuguuuguuuguuuuuguuuuccuguucuguucaauuuuauaaggaggcauagcuuuuggacuugguugcaggguuggguuuggaacuuaauaauaccuuggauugacaaaggcgccuuuucuucuaaagaacacaaaccuugaugguucuugccugggugugguucucaccugggugagccuggcugugaggguagggggccugaggucaccccaaccacagcuucugugguccuacuggcagcauguucuagacagaccuguguggagcuggggaaaggagaguggagaaguuugaggaagcugcauguuuauguuuuguguuccucccucccccagguuggggucagcgggacuuuauuuggauccaccacaggucuuuucaaccaaagccuugcagaaacaggcuuuaccccauacacacagaagagcaacgacuuccuuguuaagagucugaaaaucugggugagagccugucagacccauggccucagagagcaggaaaaauccuuugcaacugggaaggaaauucagaagacaaaaaaaaaaaaaaaugcaggggaauagggggcgggggcuagucuuuauacauuucuuucuuucuuuuuuuuuuuggagacggugcucacucugucacccaggcuggagugcaguguuaacaaucauggcucauggcucacugcaaacucaaccucccagcucaggcgauccucacaccucagccuccugaguaacugggacuacaggcaugugccacuacacccagcuaaccuuuuaauuuuuuuguagagacaggaucucacuauguugcccaggcuggucucaaacuccuaggcucaagcgaucugccaaccuuggccucccaaaaugcuaggauuacaggaaugagccaccgcgccuggccuacauuucuuaaauuuauguuuuaaggccugacuacagauuacuugccuguuuuauuccauggaaaaagucaugcugguccagggacauucucauuuuccaucaagugauggcaugcagccguagaaagcaacauccuguccccagaugagauaauuuuuuugugauaauuuuauaauaauuguaucuaucugguaauuuccuccccccgccucuccaaaaauacuuaguuguggauaguuuuaagugcuauauccugucauccuagacuaauacaucuuaacguuuuuagggaaauuccuuuuuagggaauuccuuggaaucaguacgaccugccuccagaaaaauguuaugucuguuucuggaggcccauagacauuuuuuuuuuuuuugccuuuuucuccauugcccaggcugcaguauaguggcaccaucauaguucacugcagccucaaacuccugggcuuuacacaauccuggccucagccucucaaguagcugggacuacagcacacaccacuauacccggcuaauuuuuuuguacagagagggucucucuaugucgcccaagcuggucuugaacuccugggcucaagcaguccuucagccucggacucccaaagcacugggaucauaaaugugagccaccacgcccagccugagcucacgcuauaaaugccccauauugguuuuucucccucaguuuccagacaaccccugcucuguccugagucccauauuucugccauaagaagcagguugccucaccguuccccgggggcugcaaugggggcaucacaggggacuuugugaaaggcauuagaaaugauaaauucccuagugaucaagugcagcucagaugggacagcuggccucccacccaucccucugacucucagcuuaaucauugccuaaggagugguuuucacucgguuaauuuaaugagugcucuguauuucuaguacacacgaaaaaugcaacuguaugaucuuccagccagguugggccucuuggcuuagcuuuucccagagcuuggugcuucaucuuuguucaggaagaaaggaggucugucucucuucuccuucccuccaaaugcagacggaaagucucguccucugaggacuugcagaaaggaggaaugucucaggagggaucauuuggggagcugcacucccaaggaguugagaagcagccugguugaguaacugggaaaggcaaagcagccugacuuggagaggggcccggauuaaugugauuccagaggaggucccgguagagagaaguuuggggacuacugacuuggagaaaaaucagaaacccgggucuuaagagcccuuccucuucaauccuuaagccaggcauugugccugagggaagaaauaguggcucuuaugagcucugcuagaaaaguaacccuucaggccaggcgcgguggcucacgccuauaaucccagcauuuugggaggccgagacaggcggaucaccugagguugggaguuugagaccagccuggccaacauggaaaaacccccucucuacuaaaaaugcaaaauuagccagucaugguggcaggugccuguaaucccagcuacuugggaggcugaggcaggagaauugcuugaaccugggaggcggcgguugcagugagcugaaaucgugccauugcacuccagccugggcgacaagagugaaacuccaucucaaaaaaaaaaaaaaaagaaaagaaaaguaacccuucacagcuuacccaaugcacauccaaguuuccagugacaccucugagcaggcuaagcagcugguggcuccugccaagcccucuccucggaacugagcuucacagcuucaggugccagucccuugcugacacucccagucuaagcuguguguuagucuccaaguucagaaacaacacaauacaugggucauaggagaagaaccucgacugaggcuaaaaauaccauaaaguuaaucaggcaguuuuauuaauuaugaauuuauuaauucaaaaccuauucaaggauuuuaguuuuuuuuguuuguuuguuuguuuuuguucuuuuuuuuuugagguggaguuucacucuuguugcccaggcuggaguguaauggugcgaucgcagcucaccgcaaccuccgccuccugaguucaagccauucuccugccucagccuccugaguaguugggauuacaggggugugccaccaugcccggcuaauuuuuaguagagacgggguuucuccauguugaucaggccggucuugaacuccugaccucaggugauccacccgccucagccucccaaagugcugggauuacagguguguaguuuaaugucuuuuaaaccuaaguugauugaauguaguaugauaauacaguguacugauuuauuaaaacucuaaaugaaaugaucagcaaaaucauacuauuugugaacucaucauugcuuuuuuuguuguuuguuuugagacagagucucgcucugucacccaggcuggagugcaguggcgcaaucuuggcauacugcaaccucugccucccagguucaagugauucucccgccucagccuccugaguagcugcgacuacaggcacaugccaccacgcccagcuaauuuuuguauuuuuaguagagaugggauuucaucauguuggccaggcuggucucaccucaggugauccacccaccucugccucccaaagugcugggauuauaggcgugagccaccgcaccgggcucgucguagcuuuucaagucaauagaaaucugguguuugaauccacaucaugucuucccuuguaggugggcaguugcaguguguagugugcaugcacaccccagauuuaugcccaacuccacuggauguuuucuggguggggagucauccauaccucccucagcggccccguuccuagagacgggaggcccuucccacuaagacauauuccuccugcucuccauggugcaauguaaacaucuucuuucucacaaugugggacuguggauuuaaauuuauuauugcuaagcucagauguuuuaaagcuuccugucuacaagccugagaaaaucucuucauacucuccuuuccuccucucuagucaaauuguagcccuggcucccuaagacacaacccuuuagagacccagacugcaaauuucuuuuuuuuuuuuuuuuuuuuucugagauggagucucauucuguugcccaggcuggaguguaguggcacaaucucggcucacugcaaccucugccuccuggguucaagcgauucucaugccucagccucuugaguagcugggauuacaggcauguaccaccaugcccggcuaauuuuuguguuuuuaguagagaugggguuuugccacguugaccaggcuggucucgaacugcugaccucaggugauacgcccaccucggccuuccaaagugcugggauuacaggcgugagucaccgcgcccagcugggacugcucauuucaaauagaaauuagauuaucuucuaggaugaggagggacacuuuggccuucuuugucaugggaggcuggcacucuccucuaggacccuggggugugucuugagagcucgugcccagggcuauaacacagagaggccugugcugaugucaucuuguucugcccuuugcuggcagggugguucuggggaagggcagaggcuccgggucccacucuggggcuguuuucacgggggauggaaggaccauggccacugaacgggcugcggucccgucuauggacacaaugccaaugggcagcugcaacagugcagccaaggggaaaggaggaugugcgaguugcccuggagagucccuucccagagcgccgccucuguccacccugacuauaugaccaguggaaccaaggguguggcugaagcucucaggacaaaggccagggagaggaagcaccggcuguuuuuuuuagacucucuucgagcacccacuacccccacugcccccaagcgaggccagguguagguggcaucuccagcccagguggccaugcagcugcccugcugucagggaggaggcgcgucugcaagcugccuuccuuccggugcagaugggcucccuuguggccuuuaaagaucgaaaacaccacuuugaaaugggauuagauaugaaugggggggaaacaggcaaaagggaaaaaauucuggcuucagaauagaagaaauggaucaaaaacacaaacagcuuaacaaaauaauugagaauuggggcucugcagucagaccauucuggguucaaguucuaacucugccacuuacuugcccugugaucucaguugagcaacuuuuuuuuuuuuuuuuuuuugagaaggagucucgcucuguugccaggcuggagugcaguggcguggucuugggucacugcaaccucugccuccuggguucaagcgauugaacagccucagccucccaaguagcugggauuacaggcacgcaccaccaugccuggcuauuuuuuuauauuuuuaguagagaugggguuucaccauguuggccaggcuggucuugaacuccugaccuugugauccucccgccuuggccucccaaagugcugggauuacaggcuugagccaccgugcccggcccgagcaacuuaacuuuugugccccaguuuuuucaucuaaaaaauagaagacaauauuaccucuuuggugggccuauucugaaaacuaaauaguucuggagaagugcuuagggugggguuguggaacauagauagcaaauauuugaguacuugcugcuaguaauuaggugaccuaauaugaagaaggagcuccuggcagagggguagggcagguugauagguuagacaagaguuuggggaucuuggccucccuugcuggcuugggguuugcaagaucccauguuggagcaggagggccguuccaccaagcggugccggaagugcuuuuagccgacccugccacuccaggcaccaccuggcauugcuugaaaacugucaaggaaggagcaucucccaccacucagggccacgcacgcacguggcggccaacucugcagauggaaugagagcaagcugcugcaaguggcuagagugugucagcaagagugugugcagucaucgccagacagcucggcgaggcauacacaacggaaaacaaaugugugguauucuggaauuuaaagcaaaacauccaaaacaaucccccacaucagaugauuuugguuaagaucagaaugccugcuuucaguggaaaagggauuuaugggcuggccaguguaugcuacgcgucuggcaagcaggcaguggaaacuugaaaugggauuucuuguuuagaaagagguuaccuugggcuggggccucccucccaaucagccccaacauccuaacgccaguacacuucacugaagcuuuucuccucuccagggcagaggaagggcuccagguuuuuaaaugaugcugacuuuguccuugaaaggagggaagauuucucaacucgaacuuguucagaccagguagcugccuaauuuccagaaagauaugcugagaaaaagcuuacggaguuccucauccucugccacacccuggagaggggaccaagcugucucccuucuaucagggaggagacaggucagcaaguaaccgaucucugcauggcaugugcugugcaccgucagaggaagagugcugacagcugggucacucaugccugcucugugaccacgggcaagucgcuuuaccucucggagccuguuucuucaucucucacagggaugauucuaacuagcucucaggcucuaaggcagcccacuaagaaucagaaggggcagcagggccuuguaguguaauucuagucuccucccugggaaaccucucaugcauugcauuacuguugcucccacagggaauguucucuuguaaaguaauggccugcaccagccugaggccaggcucgaacauuuacacacaacgagccaggcauagcaaggugguggcacccccaggcuguagcugucuagggccaccuucacccuuccacccaggagccccccagcugcacuagcaccccuggaaagggaggccacagagucaguaggcaggcuaagcaugugcuuagggcaccaacaaugcaggcagcucaaggaauccagggaaauaggcacuuuuuuugagcuuuaucuuacaaguucaacuuuuuuuauguugaauuguauggguugugggguagguaccauaaucaucucagugucuagagcacuaaauggccacagaaggcagaaguuggccuccccagggacccagcuugucauggaauguuggguuuaaguguauguguggaccccucuccccagccugcccuuaugguauaaaagagugacauauaauagcaggggccauuuaugacccagggacauugcugggguuggggggagugggccaggagcgggcaaggaguugucuugauagaaacgcugauucccguggggagacagcaaauuagucacucuccuuaagccuuacuuuccuuaucuguguaaugaagguaauaacacaaccagcgucuuacgauuguuacugggacuaaggggauauuuaauguaaagcuauuauaugggccuggcucacaggcagagcuucuguguuagcuucugcugcuguugcuguaguugcugcuacugguaccucuccuuaacauuuuucacagauugagguugucuaaguguucacauucauccauaucuucucacuucaguucaugaaaccacaucacacaagaucagucaaugcugaaauuuaccuccagucuuucucccucucgaacacgaauuggaggacguaucuuuccaccugucuauaaaacacucauuucugagacuuccccaguuuggggaagacggauaaagaagggaaucaguuuugcacuuugcuggaagcgccuguaagaaugccccauuggcagagacucgcuuuguggagcucaacuuggaaauuaauuuacaauggaaauugaaggaaaaucuacuucauguccacaccaagaaggguggccucaaugccucuccuucaguucacuccuugugccuuccaaaaggaaguugauucuucguauguagaauuuucuggacaccuagaacaccuacacccagaaaccaggucccagagagaugcagagccacggucaccauugcuuguguagacaccagggguaggaaguggaaggaagguagcgccugagggugcagcuucccagggaccaccaccucucccagccucaauggcgggagagaacaaacccaagggagaagcuacgggccagcaucuucccucccucccucuuggcccccaccagggcuagggucaacaccccaaauugaaagcaucuguugucaagcugcagcaggcagggaaacccugucaccagguuaaggcuuaagucagagcauuuugccaaauucaacacguccaagccucccacuugucccccaagaaaauuucucagggauucacaucuuucccagucacccccuggccagugaggaagcaccgugcaucgagaagagcauagcuuugagucgucuauguggagcugguuccaucugagcucugccucuuccuggcugugucuuuuugagucaguugcuuaaaaucucugagccugauucauccauaaaaugagggugaugagaggauucagugagagacuguacauaaaccaccuccuguaaugugucgggggcguggguccuuguacauaguaacuucuacuguuaaauugcuacugugguguuauuuucccuaagcuagacaaccugcaacuugaccauuagccucuuuuuuuuuuuuuuuuuuuuuuuugagauggggucucugucacccaggcuggagugcaguggcgcagugucaacucacugcagccuugaccuccuggauuuaagccauccuccuuccucagccccccaaguagcuggaacuacaggcgugugccaccauucccagcuaaguuuuuguauuuuuuaguagagacuggguuuuaccauauugcccaggcuggucuccaacuccugagcucaagcauuccgccccccucucagccucccaaagugcuaggucaggucagaggccugaccaucagccucugaguguauucuuuuaaaaaauuguuuuucuagaguucggggagguuugaggagaaguccagucucaugcauaacagcgagcuggccuagggagcacagccggcugcagaauucaggggggagguucuuaccaggagugcccugcugcagguugugggagccucucacgggcccacugagucaccagggccuguuaccagaggagaguucacgcaggcagggccugggugguggaugugcauuugggagccaaacgcagguuccaacuugagcccuuuaccaugacuuccuggcucaguggguucagcacagaguuguccagccguucucucuccuuucuuaccucuuccugccuucccaccucucugcauccucacccuuaauggucacaaugccgcauuuccagggugaccccagguucccuccccguggcucacagugcuggucaaagcauuugagcccccaaaugccccacucuccagaucggaguguaaaguaguaggugccaguccugcucccucguggggcugggcagugagcucucccuaacacacacaaagcaccuccagcucagaggaagcucacaccucccauccaugccuucaggcuuuucggcacuggcauuuagaaagcuauucucuggauucagaacccccagagagagcuuuucucuguccuuccugauuauugguguguaaaugaaggccuagaguagugguucuuaaacuugagcgugaugagagucaccuggggagguguuggaaaacagagugccggcccagucccacuccaguuucacugagugagucuaggagggaacugcgaauuugcauguccagguuccugggucauccugcugcuggucuggggucauuucgagagcugcuggacuggcauagagaagaguuuccuggguugccuuugaagauaagaauuucugaagguuugagcacugccuucagacaguggcucgguagaagucccaagagcagaaguugucuggagaggagagauggcccccaggaugcgccugaccaaccagucauaccuacaaaagggaguucugguucucuagggcugugaucucuggggcuuuucaacuuggcuguaguaaaacuaaaguuaguaauaugcccuguugucaucuagaaauuccgccaugagcuauuacaguaguuuaguugggacgcuuaaggagagcaagucguggcaauuucuucugcugauuacagcggaguuuugguuuucuuguucccgguguuuacugugugguggagcuggauaagggagcaccccaaagccucuaguccugcccaaguggcuuugcccuuccaaagacaacagccccagccuucauuuggaggugggagaggaggacacagagaggguuggaggaggcugugggcaucgggauccuguuuguucuugcuggcacugccuggcccggcuuccugaggagugaaucagcccauccaaggcuuggcaugcaguagugagccaaggguugccauggagaugggcgaggcccagagcccacaggucuggguggccugacuuguuuuuaaauguugaagucugugcgaagagggagggccuaucuccacuucuguggcuuucuuaaagcgugacugguauuuuggggccuggaaaacugcuggugugggaaacuugcauccccaguauuugguguguugcuuacuuccugggugcuauggacaacuaugacuaaugcucucccaaguuuaguagaugacaaaaacaaaaaccagggcugacaagcaucuuauugaaggagggugauaaagaggccaagguuuccucuccugcccaacccaggaaaauccccucucucucuguuaucugcugcuguaauaacuccuuucagcaggguuaauuugcccacggaagcaguuugugauccaaggaaggacagaagccuaaaaucugagccaacagucucccuuuagccuuccuuccccacuuuccuuuggccauucccauccagucuuaguggagcucuggauggcaguuugcaggugugaagcagauaaguuuauccauuuuccuccacuacccagcgcucacacagacucccacacaaaccaggaaacagaaccccaguguccuaaauucccccgcugccacccagccgccuucuccgaucacaggaggacacaacagccguccacagagggcccaugaauugacccagugucaccucacgucuuucucaggguuuauuauuauugucauuuuuuuucccuauggaauccggcuggcuguaacacuucacaguuuucagaauguuuuacaugcaucacuuuauuuaauccucuccuucaaccuacguugaaggcaggacagguaucauacuguuuuuuuuccacaaacgaggacuguaacguucagagaagcugaggaaaguguguagugucagagagcuccuagguagcagugccagaauuagagcccaaguuuauauccaucacaguccagucauucucaacagaggcgugcaauagaaucccugggagcacaaagaguccccugggauugcugaggcaggugcauguuuagaaaucccccagguaggcugggugccauggcucacaccuguaaucccaagcuuugggaggccaagguggguggauugcuugagcucaggaguucaagaccagccugagcaacacggugaaacccugucucuacaaaaaaaauaagaaaaaaaaaaauuagccauguaugguggcuuccaccuguggugccagcuacuugagagacugaaguaggaggaucgcuugagcccgggaagcagagguugcagugagccaagauugugccacuguacuccagccugggugacagauugagaccugucucaaaaaaacaaguauuuucccagaugauucugaugcccaccccauaaagaagcaggcccuagguggcacagcugugcaggcagcagcucacuauucuuucuauuaagccaccugucccuuguugaaaauuguguaucauuuugaccaugggcucagcagaguaaccaaguagccauugcuuuuccaggaggacaaugggaaguugggaagaaaguucucccuccuuccuggacuccauccacucaccacugcccaccuccaaccccucccaaagugguagauauggccaccucaaggccaaggcauccucagcaagaaaucacugugagcaaugaucugcucuccacuuucugggcuuuccaaggcagcugaauagaggaagcauaacaaauauuuuguccuuuuuaaaaaaugggcuggguacaguggcucaugcuuguaaucccagcacuuugagaggccaagcuggguggaucuccugagcccaggaguucgagaccagccuggacaacauggggaaacuucaucucuacaaauaauuuuuaaaaauuagcugggcgugguggugcacaccuguagucccagcuacucaggaggcugaggugggaggaucaucugagccuagagaggucgaggcugcagugagccauggucauaccacugcacuccagccugggugacagagugagacccugucucaaaaaaaaaaaaguguauggccagucaguacauauuacagaagaugggaccuggaggaaaagggggcccacgccaagagcacccaguuuguuugaccacaaaggauuuuucuuugcaguaggauuugucccauaggcaaacuuggcuucucccacccggggaguggcaugcaguaugcccucccccacacugaaaccacguucaacccacugcucuuuuccucuuccucuggguuaccuccucuuuuucagcacaccuacuucaagaauuuccaucaggaggccaggcuguacauacgaaccuccccagguucuaacuggaacugguuuugcacacuuggcauagaguccccagagcagccaggugccccuaagcuccguuacacuuugauguuuuuuguuuaauccuccuuugaaauuggaaauguuuccuguaacuccagguguguguuucaguguaagauuucugaaccugucccugcagcaagauuuugcagugugagucacugaaauucucaucuuugcgugggagccuugggugaauugugcucucaguggugaguggguguggcaagggaugaccaggacaccauucauugugggccugaguuuggggcacucuuggguucucaugucuccugaggcucacauaagccccaggugaccagcuuaccuguguucgucaaacauaagaguguuugacuggacuucuuugagggaugggggugcuggcagaguugcagauaaagaccgaggacagcaaugcauggguuguuuuuuuguuguuuuuauuuuuggagauggagucucgcugugucacccaggcuggagugcaguggcucaaucuccgcucauugcaaccucuggcucccggguucaagugauucuccugccucagccucccaaguaauugggacuacaggcacacaccaccacgcccggcuaauuuuuguaguuuuaguagagacgggguuucaccauguuggccaggcuggucucaaacuccugaccucaagugauccgccugccuuggccucccaaagugcugggauuacaggcaugagccaccgcacccggccugcaugggcuuuuuguaaacuugguuuuccaaagucuguauaaggauuugccuguaagucacauugggacaugcuucaccaacagaaagggaaauuguugucauuccccaaauauuccccaaccaaccuuaauggggcuuccuuaguauuuacucugggcaaauaauuguucuuugugguuucuuuuuuuuuucuuuugagauggagucuugcucugucgcccaggcuggaguacaguggcgugaucucggcucacugcaagcuccgccucccggguucacuccauucuccugccucagccucccaaguagcugguacuacaggcacccgccaccacgcccggcuaauuuuuuguauuuuuaguagagacaggguuucaucauguuagccaggauggucuccaucuccugaccucaugauccgcccgccucggccucccaaagugcugggaugacaggcaagagccacugcgccuggccucuuugugguuucugacucuugugagacauuugaagauggaucuggauaaaaggccugaugggaaaggaagcugguccaaaugaagaggacacaggagaggagaucuggguggauuucaaauacuuuuucacugaaguagucauucauuuauggaguaauuacuuacuaaugaccauccguccaaagcauggauggggcaaaggagauaaaagaaugacucagagguccccuggaccucaaggagcuugugcucugcugagaugggaggcaaaccccagauagaggaagggcagagaguguggagcauggaugcuggagaggacaggauggaugcgacacuggccugcucacgugcuuggcuugcucagggguugcauuugccauuugcaugggaggaaugggaggaaauggguggggaagcagcaggcuuggcuuaggcgaucacgacagcauucuaagagggacuuguacuagcagaggcacaaugcacgaggcugaacucgggaaacuuggagagauugcaucuaaggagcagacaaggaggaggcaggguucaguggugucagcugcugugggaucccaagacauaaggauucagcaaaagucuuaagacucaccaccccuuucggguugggagagaugcagugacgagccagugaggacuuggaggugguuaagacgccagcucaggggugaaaggaaagcagagagcacccugaaggagcugcgagguugaagaaaaaaaggguucuauuucugguuuucuucuguuuggauuuuuagguuagggagaccugucugugucuucgcaaaggucaaaaaaguggcagaggcagaccugcauagucaggaaagagguuaauuaguggagcagguucuugaaggagacaggaagcuuugaaagagagagaccccugcuucuuuauuauuguuuuauacacuuuguuuuagaauaauuuuagaucuacagaaaaguugcagagauaguguagagaauucccucauccuccuccccaguuuccccuauuguaccaucucauauuacuguguuucauuugucacaacuaggaaaccaccguugguacauucuguuaacugagcucuggacuuagucggauuucacuaguuuuucauguaacguccuauuucuguuccaggguccuauccaggacaccacaggacaguugucaugcccccucagucuucucugggcugugacaguuucugucuuuccuuguuuuccaugaccuugacaguuuggagagaagugcuaggcaaguauuuuguagacugugcucaguugagguuuggcucauguuuuucucagggccuagcaccagugaagaaacgaagaaauuuccaguaaaacaaugggaaaaaaugacccuuuuccucucggcccucucaaagggauggaaccauuuuuuggccagauagcaaaggagcuuuucccagcaaaaccagaauguuuccauuuggcuuuucuuggaaacaaaagaggaaaccaugggcagggccgcgagcugggaguagaagcuaugggcucucuccugcauccccgcauccccgcccgaccagcugggcauacuacagguugccauccucucuccagagcccugggaacagggcacugucucauucagcauccgcaucaaaccugcucugcuccugggaugauaggcugggguggggcagccaucgaagaaauuacauggucagcaugccgccauaugucuguuaauuaaccuggguggaagccaucgaccccuuggccucccggacuccuauauucucauuuauggagucccugaauaauugacuuggcacccucuuuuaaggguuaaagcucucuuuuuuucuugcuccuggccccucccauuuaguuucuccuauuauuaaaguagcugaagcugggcgcaguggcucacaccuguaauccaagugcuuugggaggcugaggcaggaggauugcuugaggccaggaauuuaagaccagccugagcaacauagcgagaccccuggcucuacaaaaaaaaaaaaaaaaaaaaggguuuaaaauauuagccaggauuagcggcaugcaccuguaaucccagcuacucaggaggcugagguggaagaauggcuugagcccaggaguccaaggcuacagugagcuaugauugcaccacugcacuccagccugggugacgagagcaagacccugucucaaaaaauaaagcagcuggggugaaagccggauggggacaggggagccccucuaugccacaccagaaagugaguucuccuagaaaauacuucagagcgccuuagauagcgcugccugacaaccaugaaaggcauuauuggguggcacugguuauacaaguuuugugacccugugaccccaagccauugugacucagccaacuggagcaaugucuccaacagcguuacagaaaauggggcagcugaugguucacauagcaucccccccggccggugaacucagucauucugucagaaaaggcagcaggguucacuccugauuuuuguccaaguguucccagucaugccccuggcccucccuuuucucuggguuacuugaaccuuucuccucucuuauugugaguuguuaagccugugagaccgagaccuauggcagcuuuucccauuucuccagagccagcugcuuuuccuuccugguuguagugaaauguuguagcuuugacaaccaagccgcaugauguaagguuuaaggugggguccgaaugcgggggacucccgacuccgggcuuggccuggcccuuggccaagauaagagaccugagaugcuuccuuuucccucgugguuccaguucuccagcccagcauccuucuuaccaccugugcacagagaccggaucaaugacuggacuuaacauauuggcucaggguccucgacauuggggcucucuauaagauggaaggggccuuaccccuggagguuccacugggguacccugucauuaucugagcguggaacauucccagagagacgcagcuccugcucgugagaggcugcugugcagagcguagcuuuaccucaucuuacagcuuaguuccuuggcagaccugggauuguuuucguucuuuucugcgacucaguuuucccagcagauaagggguggggucauaacuucacucaucaggggaaguaagaugacuugggagauaauugcuugauaagcacaagccuagagcaaaaaggacaguaaugagcacugucucgcuaucucccuaugcgcgcaagagcaucacaagaccagggcgagagggaggaccagggugagaaacagguuguggcuaaacguggaccaaaauugagcaccggccuacaguuuucagguuaacgcuuuuauguccaggaggccagcagcuucagucuuccauucccaggggacugacugggccucccugggguugggguggaaggagggaagguaucaccuuuguacuuuuuuuuuuuuuuuuuugagagggagucucgcucugucgcccaggcuggagugcaguggcgcaaucuccgcucacugcaagcuccgccucccgggcucacgccauucuccugccucagccucuggaguagcugggacuacaggcgcccgccaccacgccuggagaauuuuuuguauuuuuaguggagacgggguuucacuguguuagccaggauggucucgaucuccugaccucgugauccacccgccucagccuuccaaagagcugggauuacaggcgugagccacugcacccagcccaccuuuguacuuuuaaugcucagggaccuggggggggacccaggccaggacuugccauguacagagucaagaccgcccagugugugcuugucuagucccuuguguacgugaauucaagccacauaacucuucuagcccagcacgcucccagcagggcccgccuccccgccuaagcuaacugcagugcucuuggucggggaacccauggucugaaugcgaguacccugcuggguccaggacgguggagacucacgcuucuccccaaccaaacagugaucugcuugcugccuuuggauuaggccaggagacccucccucacuggccuuuuauuaagaaagaaaaucagacucgucuuugaacucagaacucucaaguucauuugaacucucaaauucuugugccugugugaguuuuucuccucugccuuguccagccgcggggcauguggcgucguacaguccuuaccaauguuuggagcugccugcccuaaggugcggcugagaggcugagaagaugcugagugacaguccacaggcugggagugcagggcugguggggcuucaugcugguaaagugaggugguucucccagagcccauuugguaccuuccucuucagaugcacuucugauauuaucuucuuuauucuuuagccauaccuaaaaggcagggaagggccgcaucucacaaucccugcuuuacagaugggaacacugaagcaauagaauaugaagcuagacucugcagccccucgugguggaagcacaccucccuggcaggagcaaauccccuuaugcuccugggggguaggugaguuugugacugcugcaggcggaggucuggguggcccuucccacuauugccacaucugcuguccacccaacaugcccacacucacugccauaucguaagggaaaggagaggaggaaaggaggaaggaaagagaggccuguccacaccaugggcuaucaauagcuccuggagccgagaaccaaggucccugaugagcgggcucugacauaagagugccucuguugaggaggguggaccagcaaaaccugggcccacccacuccugcguccagccggcuaccacacuggaggccugugagucacucccccggcaagcccugguacgggugacgacgagggagcucagcuggcacuggggggacuuggcaggaggccuccugcacagcaucuaguucagcagugccagcgaggggaggcccuggcaugucauuuacugagcagcaggucuccagggacauugcagcugcccucccuggugcauguguguccggaacuguguaaccaucacccaagucaacaguuagaauacgacacccccagccacauggcaccucccugagcauaauuuccuccuccaccuaaacaucaccacucaccugauaacaaugcuuuuccuuuaucauuuauaggcacauguaagcgucuagcucugugugcaucccuaaacagcauagcguuuuuaacuacauggaaucauauugugugugugccuguggcucuggcuucuugguuuagcauugugagaugcacucaugguguugcguguagcuagaguuacucguuuucacugcuguauaguguucuguugccuauaaaauaccccuucagccaaugggcggcagguaggucacuguuuauuccucgcuugcugguauuuuuaguaccugcaugaaucaaacacaccccguaauggcaucuacaacuaccaggcguauaugaggggcagagaccaaggguggucacaaaguccuuugcaagucucacccuuaagcgcguggggacuguguuguugcuggcagccagaauuaaugcugauguccuguaugucuugcagcuugccgggauugcuguccuugccauuggacuauggcuccgauucgacucucagaccaagagcaucuucgagcaagaaacuaauaauaauaauuccagcuucuacacaggugagggacggggaaggcucagugaauucagacccuggcuccaacaaaguuccugcaacuuuggaggccccauguugacccagggacuugggcuugggaaagacuuuugcucuagccacgcuggccagucgugucccuuucaaguugugcaguuuuugugugugucguugugccugggaauuugcguuuaacugaugugguuucuuuuccugauggccaagucaggcauguugaugguucucugaugugauguagccucugccaaaguuguacucauucuugaggguuuacgaaccucuguucucaucucugaugcucucuccugauugucuucuuauccugcaucauuuccuuaauucaaaaagcuuuguccuggggaucugcagugcuggaagaagauauagacagcuuuccucuucacuguucagauagggacucugagacugggaaaaacaucagccuccuggaaaacacagcaacaauaggagagacuagaauggacucugcccaguccuuuggaccccugguacugggguaaaugcuguaguguuuaguuuuauuuguuuguauuugacacgacuuuugcuuugggagagaggcuuccaguuuaaaccugccugggauccucugaacaugaacagacuuggcagguuucuuucuacacucaggcuucuuggcagccuugcuagaccauucuaucccucucguugccguaucaccacgucaaagcucccuucagaggagggggagccuggugccugccaagugcaguugcccgcgucugcgugaauucagacucugcggcuguacucugccuggcuuggagguaggaaacuuuucauuugugaggaacaaaggaaaccuccuauuuuuaggaugacgcugacauguugucaggcucaaaauguaaguuuggucacuuccuucccacccaccaaaaaaguuauuuuuacaaacgagggagaaaacaguuaucucccagucccucagggagaagcaaggcuggccagccacguagaccuucccuuucccaccucuugaacuggguagggagagucuuuaaaaacagcuccuuugguugcguaacauuugagcccuguggauaguuuugcuggguuuacugcuuuuuauuguuagcugggguuuuuuggggugugucucucuauuaucggaaagaaagugagagaaagcacaauguauguuuagaaaaaaaacuacacauacacacagaguuuuuggggaacagguuucuauagcgcccugacuuguuuuggcaacagaccauuuuuugggagucugugacaggcuuagaaugcuguccugcagagcaggagggaggagccgggugcgggugcuggggaagacucuccacacuccacgccguguuccagaagggagcccugugcugggggagcaggucugccggcaggagcaggcacagucaggccugcuuuccuaagcaaaagcccuguggccggcgcgugugucuccaaagagagacucaguccucccuuguccuggcugcuucuaacaacccacuuuuucuuuucuguuacccaaagccucuauggcugauucuuuauauuuuuagaugugggaguuaagaaucucauggguaagaggauggaacugggaggaagacacuaacauuuuuauuuuuuauuuuuuuuauuuuuuuuuugagacgaaguuucaaucuuguugcccaggcuggagugcaaugacacaaucucggcucaccgcaaccucugccucccagguucaagcgauucuccugccucagccuccugaguagcugggauuacaggcaugugccaccaugcccagcugauuuuguauuuuuaguacagacgggguuucuccauguuggucaggcucgucuccaacucccgaccucaggugauccucccgucuuggcuucccgaagugaugggaugacaggcgugagccaccucgcccggcuggaagacacuaacauuuuugagcccccuucuuugugugucauucauugucuuguguguauuauauaauuuaauccccuuagcucuacgaggaguguggagugauucucaucucacaagugcagaaaccgaggccuagagagcugaaauaacuugucuaagcuuauauucccucaagaggcagggccagguuuugaacccaggccuaaaagagcugcuucucggguugucauugccagguuguggggucucccucuguaggaauggaagaggucuguacuggcugaaugugccccauuggcagggaugggguggcgcugucuuggcccuuuuacuucacccaaauugcagucagggagagaaaccccugcgucgguggcccagccagcagcugacaggugggaaagcugcaggguggcaggagaauggugagugccauuagaggagcuggggcucaccucugggaaccucacaggauucagauccugcaggucauugcagggcccugcugguggccggugguccuaccugaagugaccaggagggugauuugaaggcacaaccccaaagagacacagauccccuaguuggggucuaagggccacuguccacuuagcucugccagggaaauacagauccuuugcagcgacaccccauucggggaagagagcggagcuuugaagacuucguucugccugcagaagcgccggcaagggggaugaugcacgguaaaguuagaacagcagcacugugucugggcacagugaucagcccugaucucaggugauccguccgccucagccucuagcacuuugggaggccgaggcaggcagaucacccgaggucaggaguucgacaccagccuggccaacauggcaaaaccccacuucuacuaaaaauacaaaaauuagcugggcguaguggcgugcaccuauaaucccagcuacucgggaggcugaggcacaagaaucucuugaaccugggaggcagagguugcagagagcugagaucacaccacugaggcucugucuccagccugggagacagagcgggacuccaucucaaaaaaaaaaaaaaaaaaaaaaacagcagcacagcacucugagcacugcuuaggucugagcuaugcccugaacgucacugaacgcuuuaggaaauaauaauugucguccaugggcaaagggccaaggaggcgucgcucuguguccccuuccccacgaggcugugagaccagccuucuguacuggcccagagcccuucuccuagcagaugagcuuggagugccagccacacccuggcuacuuuuccaaggaauagucauggggugaccgccccuugcacugggccaccaacugucugcagagcaacccacaggccagccugaccaugcagcugacuuuucaggaaaccugaacagcccaggggugucuuuucuccaguggggccacagcuuaccaaguagagaaagaguauauaaccaggcagaaaagcaagugaaaaccuuuccaacauucagaacagucuaugguaaguccagagcagcugacagccuuauaugggccuucucuccaauccaggccuggagauucagcccgucagcaagaucccuaaucccaggcugcaaacuuguuggggaacuucauuuucuugguccuaggccagcagccuuucccagcucccuggugucccuccagaaccauggcugcugaaugagggcaucuaggggggcuccagccagaggccgugaaugcccccccuuccucggccagcccccuauccaugaugaggugccuggugauuuucaggacacgcgacacuuggccuuaguaagcuggcauccccauccuggcuugugaccuggggcaguucauuuuauugcucugggcuucauuuuucucccuccugaaaccagcacagcuuacacaaccacagcacagcuuacacacccacuccccucuggggcaaagaaguacagcguguggcaaauggaauuccauuguggcacuuauucccgugaacucgggagggcgggaaccaagacgaaaccagucggggcagagguagggcuccuuugaacaccugguggaguuauuuggauauaauaaacuuuuauugcaggccagaggcccuaccggauuuuguucuccuucacacaaacgggcguggugagugcuguuugcaggacagagcugguguagggacgggagccugcuguguccucucccugggcuaaacugagagcccuggugaacagugaaaaacacuguuccauuucuuguguaaaggacacgcuggcauaugcuacugcugcuacaccagccuuucuuuuuuuuuuuuuuuucugggccuguaaugucagccugaaaaaagcagaauaaacaacccuuaagcaaauuaauaccguaauccuagagaaggcucugugauggauaacuuuuuccaugagucagacagcaagcuaacauucgcuuguuuuauaaaggggaacacuuugucauuuaucaacagcagccuuggcuaacaagcuugggguguaagcgaugaguagcuucuccaaagggaagcacugaauagcccuuguaaaaaccagcccgagcccugcagugguuccgugacuuccauggggccugcuuccagaugagcuguccuguagcuugccggcugcugcugaguccccgaacacagcugccaggggaucgcuucccuuuucccgugacuagagagggcuaaagcuaggcacugcagauccguagccauccacgcaagauuuaaagcccacaaaacccgugauccuaaaaucuuccucugcugagcccuagcaugaauauuuaauauuaaccacaagccccauuaggagcauguucucuuucucugcgugggaaauacuuucucuuuaguagcucacuugcagcuaauccaauucccuuggccucugccaggaccgccagguucaagaacugggaucuggacuuagagaaaacaugucugccuguucguucccacuccacgguauuucauguguuuguaaauccuuuugaucucuuaauaccuccuguuuauucagccccugcuauggagcucaaaggagugaccucauccuuccuugacuugcccccauuagauggggagaaacuggggccuuucuacuguccccaugugagagaaccaaaggaggcugcccucuuacccagugcuccaugcauggggcugcacagccuccccaagcccagcuuguggccucaacagcguuugacugcccaggaagaugcgaccugacuugaggacaagcuacauuuguccccuugcccagugugggccaggcaugcacaagaacaauacccauauucuugcaacaugggguuugccaguaaccccacgugacuugaccucacgacggaugugggggagaagggggaggaacaaacgcucucugugugcauucugcucugugcugcccgugagccucagcugcgggcagacugcaugguuuguugccugcaaagucucaccccugcucggggugcagaugugggacagugaagucagcgugucaccugccgaggguucucaucgaguguccugcuguguauuguggggaaacaucacagacuuucucucucgcgugcguguuuucagccccuacaucaaggauaucucucuggucccagugaaaggacaguagggauacagcagcagguuaaaauucaccauggugauuauuaaugauuguuacucaugcuugguauaauugagauuaacaacagcuagcauuuguugugcacauguggauuauaucacuuaauccucacagcaauccuggaagugggcauuauugcuacuccuguuuuacagauagaaaacuguugcacagagagguuaaguggcuuccccagagucacagaucuggugcucucgacaugugacaguagccucucccaaggcuagauagaacaugccugcaagacagggaggcacagagacuuugcugcugguuuuccuuugggacccauguagggcuggggugcugauuaagggaauagucccugcaggacagcuguggcuucucaagaauagaacugugggguggccccucugggcauuccuuugguggguuguggaacgaauggggccagugcugcucuacuguuugugucccaggaauuugcauuguucuggguuugggcaaaaguuauagaaguugcugcccuucucucaccuccuuuccaugagccacucagaucaagggcuuaguaauggugucacucauccucuccuuagcaaggaggagccucuucacccuuaaccugcaauaacugaguuaugacuguuaagaucuuguuagcaugcuauagagaucuuuugaaauuuccaggaacauaccucuuuaauuuuacuaguaaggaaauugaggcccagagagggaaaaugucuuaccccaggucacacagcaauuagcaucaguguuagggccaaaagaagggucuucugacacccagaucuguguccuuugcacuagagucagguauuggaccuuugccaagaggugccuuuggguguuccuaacuguaugugccuaaccaccacccagcaacagggcaaagaggcccgccuucugggaacaggcagaguugguuccccccaccccuggguaggggggugccuaggugugcacggccccuuccugcuggaaaucugcucugacagcguccucuguaaggcagggucccagaaguuagccagaguguggaagguauaugcuaacuagcuugaguggauucaucuugcuggaaagagcugacagacuggaccaguuugcauuccgaauguagggauucccguggauauucucuguccuggauugagggcuaaugggcaccuuccagaagggcugaggguaagguaggagcgugagcuugaugaagcagagucaugcaagagaggcuggugggaaggagaccuggggcagagguggaagaggaggcuguauuuuaaggaaagggaacuucuucccugagaugaggggaauaaggagguggggaggcaggaguuaggcagagggaaacaggaauugccggagaugccugggccucugaacugaugucuccacgcgugugugcuuccucuguccucccgcaggagucuauauucugaucggagccggcgcccucaugaugcuggugggcuuccugggcugcugcggggcugugcaggagucccagugcaugcugggacuggugaguauccccucggcauccccacagccacccugacucccaccaacaaaaaccucagcaggcccagacccagaccacagaacagauggagggggauggggucaggaagguacccaaagggcaugagcuguccucagccugggccccuccccgaugugaggcgucgccccucuuccuuucuggagccugucuuaucgcuuccccuaggcaacuaaaaggacuauguuucccccuuuucucgaggaccacguuugcuuuuuuucccugaauccacagguaccuuugccuucuccuucuuguuucaaaaucuguuuuggucuuuuccgaacuccacggaguggauucgcucccuuuacuugcccaaaucucuugucuuuugugaacaauaguaguugccugcucacugacucuuaacuaacgccuuguaaaugcuaguucugggcucagcugugcucagcucuuuccucauguccgggcaccuugccucacuguggccucuguccugggcuugguuaacugccuguucugugaacuucuucccugccccugcuaggcuauucauuugugucaccagaugccuguucccagggaguuguccuucuuccuugucccaaaauacccuuugauuuuccuggcugguuggcugggacuguucucaccccguccccucguugccuuccaguucuucggcuuccucuuggugauauucgccauugaaauagcugcggccaucuggggauauucccacaaggaugagguagguuuuucccaugagaucucuuggguuugggaguugggggaugggggacagugaagcagggggcaaguccuggcugggcacuuuguucagcuuucagcuguugaccaggccucuuaucucaucgcgucccugugugccagcgaaugugcccuccucggggcagggaaugucagugcgcuuacuguccuguccgagauugugccagccaugguguugacucauaguagauguucagaaacuacccauugggccugugcgugugucugucuguccaucucacaccucagcagcccuuccccacaacuuuuagaaagauuacucaggaaauacaggcuuucugugggcuggacacccuugccuccuccucugaucuauaaauaacauguucaagugcugcccccaugagccaagugcugcccccaagccugugcaggguccacagauguuugaacuaugggccccacauccggagacuuggccaucuaguauggggaaaagacaugaaauugauaagggucauagaggugauuuauauccaaaguacuaugggauuugaaaagguggggcugggaagggaaucucuuuuggcuucauagagaagggagccgugaccuaaaccuugaaugagagaugcguucaggaggaaaguuaguggaggcaggggacuuccagucaaaggggcugagcauggcugagcuugggcuuacguggggagcccugcagaguuuuggaccaggaugggccauaucagaguaguguuuuuggaagggcugccuugucauguucagcaggaagggggaaggaagagagaugcugagaugcuggaggcaggaacccuauuguuuuguuuuguucuugagacuagucaagcgcgguagugagaaacagggaagaguagaacaaggacuuccaucuguaacugacgugagcaauccauugagauaacucacuacuuuuagcccagccaagggaacucuguuuaaaaaaaaaaaaaaaacaugucuguaagcaauaacagcuacagccauagaaauaggaggggaucauugugaaaaaugucagacagaugcugaaggaaaaaugcuggcuguuggucuguuaacuggauguggugagcaucaaaggggcagacagacauuaaauugggaugcgccaggcgcaggcacauaauaauacauccccuauauuaugauacaauagcuggcacgugcuccagauuuacucuguacuggacauagugguaaaggcuuaacaugcaauauuucauuuaaauucucacaaauaaucuaugagcuguagggacaaauguggaaacuccauacagagaggcuuaguaauuugccaaaacucauaccuaagugaagagaaaaacaagauggaagccugagaaaauagucaggucaggaguaguauuucaauuauuaucauccucuagaucauagagauucaauuuaggagccaaguuaggagccaaguagagcugaaggacugaccaaaguguaagggacagggagaaacagcccgaguggguuucuggaggaugugggaggagaugggaagugcccaaaggcccugagagaaggcagugcuagcagcugccaucugcccagugacguuguccaagcacaggcaucugguggcugagagcuuagagagaacaagauggaacgcauaacauuuguucguggaggaagaugugaaaaugccgucucugccccucucucgucugcccauuguaggugauuaaggaaguccaggaguuuuacaaggacaccuacaacaagcugaaaaccaaggaugagccccagcgggaaacgcugaaagccauccacuaugcgguaugucgccuuggcaaagacacccuccugcgcuuucuccggauugugucugcacacagggugcugacugcaccagaccagugcaaacauucuaaucgucuucuuacaauuuguuucucucauccccaucccugccuucucgcuguaguugaacugcugugguuuggcugggggcguggaacaguuuaucucagacaucugccccaagaaggacguacucgaaaccuucaccgugaagguaaacucagaccaggauccuggugucccugcccccauugcucuggacaaacccugcaagcaugaaagugacagcagccaagugcugcuucagcaagacccguucugccugugaaagggccccagggcacccaucucuuucucucccacuuugggcccucuguuuacucaagggcaauaaaacaaaggccggaccaggggaaugacaaguguucuggcaccgcccacugcugccagcccggaagcucucaagggcaggcgugcuucugagucuuggacucccacucugacuuugucaguggcuccugucuguaagccagaguuaauguccaacuccagaauaguaaaaggugaccuuacaaccaugucagaaauagacccccaagcagggccugucccuccuccuucccugacguccugcccagauuuuagggauccacuagcauagccaucccuuuguuccccuuuccauccaccagccagaacuucucuuauccccgaacacuccuguccccagcccacccucugcccaccaguucucccgggugagacgggggccaugggagggaggaggugcccugggaggaaggauugugugugacccaggucuugguuugucuccccaaguccuguccugaugccaucaaagaggucuucgacaauaaauuccacaucaucggcgcagugggcaucggcauugccguggucauggugaguggcaggacgucgucccaggagggggacugaggaguucacauugauucagcccaugcucuacccagacaccgccgcacucugugcauuugucaacucacuuuguccucgugcccuuaguauuuccauuuuaccacuagggaauggagagacagagaggccgauguucugaucaaagccucucaccuccugaguggaguaucugaggcucccccugggcuucuaaagagucgacucucuuagccguuaagguucagggcacauggguggcagugcuggcacugcuaguccucggagcaugucuccucacgcaccugcuguucuucucccuaagaaagucguucacuagaggcuaccggcgugggaauuguuccauuuccugaagugcaucugaacaugggcagccagaaggaggucucucgcuaaucagccccuagaaaccaacaagggccaaccagguuccuuggggucauguccucucuucccaugagggacagccccagacggaacaugguccucgcugggauggccuuggcucacugagucuucccccacccccgccugccucugcccucuugccagacugcccccaaagagagaaucgccuccuuucuuagugguuauuugcacccuucaccggcaucuuaagaaaggcaugaagcaccuuucagcaaaauauacgacaauaccuucuuuuuuuucuuuuuuucuuuuuuugagacgaaguuucacucuugucgcccaggcuggagugcaguggugugaucucgacucacugcaaccuccgccucucuggguucaagcaauuauccagccucagccucccgaguagcugggacuacaggcgugugccaccaugcccagcugauuauuuuuaguagagaugggguuucaccauguuggucaggcuggucucgaacuccugaccucagguaaucugccugccuuggccucccaaagugcugggauuacaggcgugagccacugugcccagccaagauauaacaauacguuuuaaaauagaauauuaacauuuugggaggccgaggcaggcggaucgcaccacagcacucuagccuaagcaacagagcaagacuccaucucaaaagaaaaaaaaaagaguauuaaauaacauacacacaaagacaaaugcaaaaguacuaaccuguauggacuaggacuauaggaaaaccuggaauuugagcauuaaauuuggcucugagcuuacuuucccacccugaaaguucuccaaggaaaaugcuugugcagcugacugccaacccccccagauuccucacgucccgcacccuucucauuaucuggccugcaucucuccugcuucagcaccuucugacucguuuggccuccuggaugccauucuccuugucauuuuucuuggacugggugacccaugucucucccuuucccucagccuuccuucagaucaaaccacccugauccucauguuucuuccuaucuccuagauauuuggcaugaucuucaguaugaucuugugcugugcuauccgcaggaaccgcgagauggucuagagucagcuuacaucccugagcaggaaaguuuacccaugaagauuggugggauuuuuuguuuguuuguuuuguuuuguuuguuguuuguuguuuguuuuuuugccacuaauuuuaguauucauucugcauugcuagauaaaagcugaaguuacuuuauguuugucuuuuaaugcuucauucaauauugacauuuguaguugagcgggggguuugguuugcuuugguuuauauuuuuucaguuguuuguuuuugcuuguuauauuaagcagaaauccugcaaugaaagguacuauauuugcuagacucuagacaagauauuguacauaaaagaauuuuuuugucuuuaaauagauacaaaugucuaucaacuuuaaucaaguuguaacuuauauugaagacaauuugauacauaauaaaaaauuaugacaauguc
